United States Patent 10,724,096 (METHODS AND COMPOSITIONS FOR INHIBITING AND TREATING NEUROLOGICAL CONDITIONS) - sequence listing, part 40

SEQ ID NO: 840 - DNA, 3054421 bp, Homo sapiens (residues 1-1,527,211 of 3,054,421)
tggtctcaattttctcttctatatgcagaagtgatgcaaaaaatgactgatcaggtgaactaccaggcaatgaaactgactcttctgcagaagaagattgacaatatttctttgactgtgaatgatgtaaggaacacttactcctccctagaaggaaaagtcagcgaagataaaagcagagaatttcaatctcttctaaaaggtaaaaatgaaataaaataaaatattcattcagtaacacagaaagcaaatgattcatttttcttttcttacatcactttgggatctttgctttagtttgggtggtatggaaacctaagaaagattttttttaatgagatataaattcactaaaattctgaaataatttgaaatatctacattttattatatatactgaagtctttgactgaatattccatttggttgataaacatgatgtctctaactatagcctaacatattcatttttagttaaagtgagtcatattaatttacttccattgtgttatctacttcaagaataaaaacgcagttaggggatcaagatagctagttgcatggttgtctcaatactattgatggagacattgaggataaatctgaagtgcattattatcccccaaattttctaggttatggtgtaaaatctattaaatatatcctaaaacattccagctattattaatattaaagaataataatttatatatgtgaataggctttgcctgaattttgtgctcttcaaacagtgggcttaaaagcaggctatgtttctttctggaggatcaacaggataatccatttcctgctaatccaagatgctggcagaattcattttcttgcagttgtaggactgaggtctctgttttcttgatgtctgtaaactgaggcccattcccagcttctagaagccactgcatttcttgactcatcatcctccatctttaaagccagctacattgtgttgagttctccctgcatctttctgactatgtaactccgttggacctacctggataatcagaaaaatctctctatctcaaggtgcttaactttaatcacagttgccaagtcccttttgccatgtaaggtacatattcatggatacagggaattagcatatggacaccttgggggaaaggggtgtgtattattctgcctaccacagagatttatgtatagtgagtaattgttatgatagtgttatacacaggatacaatgggaccacttgacacttgcaacaaatccaatctaaggggaccagggaaagcgtctagaaagagaaaccatctcaattgatgttaaccatgcagaaaggtttcgggtagggcaaggatgttctaggcatgcagttagtttgattcctgggagcgtcccagtcgggtttattgtatgaaacttgtctgtttgcaagtttcaggattactgttttttttccttttgctttattcattaaaaaactcagtgtacaacccaatttttatcattcacaagttatcttttctctattgatttaaaaaagataaataggtggatatttaatatatcatctaccagtatggatgcttacatagctcaacaacaattatgttttttaatcatataaataattgctgctactcaaccactaaaagaaagaccctgtcctacatatctggtatggcccaaccttaccaatgctgagcatgagaaggaaacatttttcccccctgaagtgacagcatgagaaagaagtcaaatagaaacagtatgtaattgactataaccatctgaatgagatttgtttagcaagatttggttctcatgacctaacagaattagcctgtcaactgtttttttgtgacctaccagcctactacaaagattctggcactgacacaggagaaaaatcacacactcacagcaacagcattaataatgaaactccctccgcaataggaggaattaattgtgtactgagcacagtcattaattataagaaccagagggcttgtagttaatgaatattcttacaggaaacaaaaactaaacccacctccaaggtgctgtgcttgcctagcgaaaccacagcttcctccctagtttactttacatccaaggtgaaaaacactgcgtaatctgacagtagccatagaaactgttgaaaatcaaatgtctcaactccgtaagaggaggtggataccttaagaggtacctaaatgttattaaaaggccatacattcacaattacagaaggtgaatgctaaggtatctgatatcaaatatatctggtaagtcaccaaatgtaatatgcttctaagaaagtggaagcatatgagtcacaggaaacagaaacaaacagaattaaaatgatgtgcccactcaactattaacataaagcactttgacatgttcttgggaaatcagattcttgtacagatgcttgtttagtaacaaattgtagaaatgttacctgaaaagcttctgatcccaaaacacatttttaagctaataatatgtttaatatcttttcagacattgctgtgattttgcactttcttcaaagtatttttccataaaagtgttaaagtgtaacagctaaagtaatttacattactcattttcattgttttttctcccaattatgttgatcaagattttgtgctgagtttttgcttattgtttttcttattaggacttttaggcatgtagttttttgtttgctgaagttaaacatttattgtcattgtccacaactaataaattcaataaagcctaaattttattgtacctttcaatcttgaaaaactgtaagattataaatttaaagaaggtcgaatctgaaccttaaatattttattatatttcatcaagcttttgatgtcatgagaattagagtcatttttaactaatgggaaatgactaaatgttcttatagaaagagtaatattaatattactattgaatagtaccttacactcaatgatacttacatattcttttttgtaagaccagaaatcgaattttctaaattttacttactctatatagcatatagaatgtatttcatcaatatttattgaataaatgggtgactggttaaatgctaagcaaaatgtagaagataaaaatgctttaaagcctttctggtgtgattatccatgttatttgatacaaaagctaggactatttctgtataatttatcttaattgtggctagttagtcttttctaattcatttagcctttccttagtactttaaggctgtgtgtcatattgattactattctatatttcatgttttgttttcttttttccattacatacaaattgatctttggacttttaaacttactttagtttccactaagtttataaaaagtaaaataaaatatctttcccattttattttcatctggcaacatggatctttagggtgcaggatttccagagaaatgtttatccatctaaattttcatatttacagcttcgtttttgtacaaaattgtcaatatcaagatgctcaaacaatacatcattctatttttaataatcactctttcacatatttttatgtaagtccctcatgtatgttaaaaacttacttacaaaatggagacatgtggagcctatttttttaatcctaggatgatctttctttaatagactacatagtagctataattgatggcaatatcccattgtacagactttcctgtctaaaatgctttgcattgtattgtgtgtattttacattatagtcattgattattgtgttagtccattttcatattgctattaaaaaaacctgagacagggtaatttatatagaaaaagaggtttgatggactcacagttccacatggctggggaggcctcacaatcaaggcagaagatgaagaaggagcaaagccacgtcttacatggtggcaggcaagagagcatgtgcaggggaactgccctttataaaaccatcagatcttgtgagacttattcactatcatgagaacagcatgggaaaaatccctccccatgattcaatttatctcccactgggtccctcccacaatgcatgggtattatggaagctacaattcaaaatgagatttgggtcaggacaatgccaaaccatattatttcaccccggccccttccaaatctcatgtcctcacatttcaaaaccaatcatgccttcccaacagtcccccaaagtcttcattcatttcagcattaactcaagagtccacagtctgaaatctcatctgagacaaggcaagtcccttctgtctatgaacctgtaaaatcaaaagcaaattagttacttcctagatataatgcaggcacaggaattgggtaaatacagccattccaaatgggagacattggccataacaaaggggctacgggcctcacgcaagtccgaaatccagtggagcagtcaaatattaaagctccgaagtgatctcctttgactccatatctcacatccaggtcacactgatgcaagaggtgggtccccatggtggtgggcagctccatccctgtggctttgcagggtacagcctctcttccagctgcttccatgggctgattttgaaggtctgtggctttttctcatgcacagtgcaagctgtcagtgaatctaccattctggggtctgcaggagagtagccctcttctcacagctccactaggcagtgcccaagtggagacactgtgtggggggtcccaccccacatttcccttctgcaccaccctagcagaggttctctatgaaggctgtgcccctgcctgcacatccatgtgttttcatacattctctgcaatctaggtggaggttcccaaacctcaatccttgacttctctgcaccttcaagcccaacaccacatgtaagccacaggcttggggcttgcaccctctgaaacaatggcctgaactatacattggtcccttttagccatggttgggacacagagcaccaagccttgaaacagcacaaagcagcaaggcccccatgaaactattttttcctcctaggcttcccagctggtgatgggaggcactgctgggaagacctctgacatgctctggaggcattttctccattgtcttggcagttaacatttggctgcttattacttatgcaaatttctgccaccagcttgaatttctcctcagaaaatgaggttttttttcttttctatttcatcatcagcctgcaaatttttgaacttttatgctctgcttcccttttaaacataagctccaattccaagccatatctttgtgaattaataaaactgaatgcttttaagagcacccaagtgatatcttgaactctctgctgcttagaaatttcttctgccaggtatcctaaatcatttctctcaagttcaaagttccacagatctctagggcggggcaaaatgccaccagtctctttgctaaagcatatcaagaatcacctttgctccagttcccaatatgttcctcatctccatctgagaccatctcagcctggactttttggtcaaaaccatttgacaagtctccaggaagctccaaattttctgacatattcccgtcttcttcagagccctccaaactgttcccacctctgcccgttacccagttccaaagtcgcttccacattttcaggtgtcttaatagcagtagcccactctattgataaccataccccactctgttggtaaaagctatattagtccatttttatgcagctatgaaatagctgggtaatttataaagaaaaagaggtttaatggactcacagttccacatggctgggggagcttcacaatcgtggcagaaggtgaagaaagagcaaagccacatcttacacggcgacaagcaagacagcatgtgcaggggaactgccctttataaaaccatcagatcttgtgagaactcacttactatcatgagaacagcatgggaaaaaacccacccccgtgattcaattaccttccactgggtctctctcacaacatgtggggattatgggaggtaccattcaagatgaggtttgggtggggacacagccaaaccatattaattatattttgaatttgaatggacatatcttccagttatgtgtacttcatcactagatattataaatatatctctagtatatgtatcttttctgttttctttgtatgcaagtttttttatattttaaatagtcattttctattctaaatagttatgaatattaatagttgtgaatagtccagtacacttttcctgttcctttttttcatgctacatttagagactaccacaattatggcttatgattaaccaatgttttctaatatttgagatagtactatgtgtttcattacttgcaagttttctcttctctttttgttaaaaattaatgtcatactataataatatgtcaggtgtatcttgaattcctattttcgttggaggaagacttaattttgaaatccccaaatctcattattattattttattgttattataaaacactattaaatcttatgaatattacttcatttttcctcatttgagaatatcattaaggtttttccctgcagtcaatttattagcttttataagcccaaagcataagctttgcaacttaattagtagaaacctaacaacacagtcatgagctaacaccaggtattatttactaaggcagaaagcccaaagccatttattttcacacaaaacgaaaactagacctagaattattgtacacaagggtgtattactgaagtcagtagtagttccgtcatgtctttcatccaaaggaccttagttttatggttttagtatgttctagtatgttctgcaagtgatatctcctctcagatttattattcaaggaattgatcaccttttataaattatagtaatttttaaaattctataagtaaatgtagttaagaggtatttttattattacgtgttattaatgtttaatttcaaactttttatcttttagagatgcttaaagtctcatataattaaaactatgtattattaattatttctttctctaggtctaaaatccaaaagcattaatgtactgataagagacatagtaagagaacaatttaaaatttttcaaaatgacatgcaagagactgtagcacagctcttcaagactgtatcaagtctatcagaggacctcgaaagcaccaggcaaataattcaaaaagttaatgaatctgtggtttcaatagcagcccagcaaaagtttgttttggtgcaagagaatcggcccactttgactgatatagtggaactaaggaatcacattgtgaatgtaaggcaagaaatgactcttacatgtgagaagcctattaaagaactagaagtaaagcagactcatttagaaggtgctctagaacaggaacactcaagaagcattctgtattatgaatccctcaataaaactctttctaaattgaaggaagtacatgagcagcttttatcaactgaacaggtatcagaccagaagaatgctccagctgctgagtcagttagcaataatgtcactgagtacatgtctactttacatgaaaatataaagaagcagagtttgatgatgctgcaaatgtttgaagatttgcacattcaagaaagcaagattaacaatctcaccgtctctttggagatggagaaagagtctctcagaggtgaatgtgaagacatgttatccaaatgcagaaatgattttaaatttcaacttaaggacacagaagagaatttacatgtgttaaatcaaacattggctgaagttctctttccaatggacaataagatggacaaaatgagtgagcaactaaatgatttgacttatgatatggagatccttcaacccttgcttgagcagggagcatcactcagacagacaatgacatatgaacaaccaaaggaagcaatagtgataaggaaaaagatagaaaatctgactagtgctgtcaatagtctaaattttattatcaaagaacttacaaaaagacacaacttacttagaaatgaagtacagggtcgtgatgatgccttagaaagacgtatcaatgaatatgccttagaaatggaagatggcctcaataagacaatgactattataaataatgctattgatttcattcaagataactatgccctaaaagagactttaagtactattaaggataatagtgagatccatcataaatgtacctccgatatggaaactattttgacatttattcctcagttccaccgtctgaatgattctattcagactttggtcaatgacaatcagagatataactttgttttgcaagtcgccaagacccttgcaggtattcccagagatgagaaactaaatcagtccaacttccaaaagatgtatcaaatgttcaatgaaaccacttcccaagtgagaaaataccagcaaaatatgagtcatttggaagaaaaactactcttaactaccaagatttccaaaaattttgagactcggttgcaagacattgagtctaaagttacccagacgctcataccttattatatttcagttaaaaaaggcagtgtagttacaaatgagagagatcaggctcttcaactgcaagtattaaattccagatttaaggcgttggaagcaaaatctatccatctttcaattaacttcttttcgcttaacaaaactctccacgaagttttaacaatgtgtcacaatgcttctacaagtgtgtcagaactgaatgctaccatccctaagtggataaaacattccctgccagatattcaacttcttcagaaaggtctaacagaatttgtggaaccaataattcaaataaaaactcaagctgccctatctaatttaacttgttgtatagatcgatcgttgcctggtagtctggcaaatgttgtcaagtctcagaagcaagtaaaatcattgccaaagaaaattaacgcacttaagaaaccaacggtaaatcttaccacagtcctgataggccggactcaaagaaacacggacaacataatatatcctggtaagctgttactgaaaagtaacttttaatctctctttttacttaaatgatatttaatagatctgtacagttgagcaagaccattaaacataaaactacatacttgaacttggatagatagtcaagttgtgaagatcactgacattatttaaatctgaatctatcttacagtatttcagacatcaatacaaaacaaatatttctagtgtatatttggctatgtgtttttaaaatttttctgactagacctctataaaataattaaatttgctcctatggaacaatttgctttgcacaagtaattaaacaaagctattaggcaaggagatctttaatagaccagatttacttattttggcattttaccatatctgatatgcaataggaactcagtaaatacctgttgaatgatcatctgacaatgaatgttcaggaaatagatttgggtaaatcatagaaggccatcaatgccaagctaagtacttagacatgattttgtaaagagtagggtgtctgaaaattggtatcagtggattggttgtgataagagctgcaactcagaagcatgaagctagcaatagtgtgtagtgtgattgcagaggtgatattagggatgttactgaatgaatattggcaagagccatagaggaagctctaaggctgatgtgagaaatgttggaaagttcccatcaacagaaacagagggagagtggcaagaaaaatgatttgaggaacatcaaatcttgattctggtcctagatgtattagtaagtttctgtgttagttaatagcactaggtaaaaagttcacctctctaggccttagtttcttccttttaagtgatgagattgcagtaggtgatttgctgaggtgcttagtagagatatgccgaagactgcttcactgtaaaaaaatccacgatctgttcacagccttaatgcatgacacttggagaagagagagatctagactttcccgatgttttgaatttgggaaatgacagaatagtggtaccattaacagatgttctaaacaccaaggaagaagcatgtatttgggaagaaagaggaattgtgtggtgcatataaattgcataatagtacctctgtatgaaggaagtgttttatgaatatggttgtcatataagtaatattgaataatcttttctaaatatgaatatctcttcattcttacaaaaagtaatggctgtgtttttctcatatgagtctgctgttaaattatagcccatttgtatgaattttgtactttatttctttttaattacaaaggatgatcattattctaacataatatgacttcatatttaatgtatgaatgttttgataatattaaaaataacagaataatagagttgaattatctctactatttaaattagtatatttatttatgactcccccagagtaatctgacctaatagaactaattttacttctgtaggaacatagaagaaactatttagacgtatatgtttcccagagaaaggtagtatctcaatataagatgttcttaaaataacaattttgggagatataaggagttgttttttccatactatttccattattggtcttcatgtggacacttcatcatgatcttcaattagctatacagcatgtgtgaccacacaccaggcaagctatgtcattttttaaacatatatatatatatatatatatatatatatatatatttaaaatatatatatgctattttcatagtaagtataaaattgaaatagcctcaaataaattgaggaaaaacatttatagaacattaagaacttgcaaactttgataatataatgaatgcatgttaggacattataaaaattgtatctagatacttattgtgattgactcaatattgggcttaatagactaataataggaaataactcagttttgattcttattttccaataaggctttgataacattgcttcctgttcctttatttactgactgtagaactttttatgttcctgtctaccaaaaataactattaaagttctttattttatttaagcaaagataccaataatgatgccaaggtaataaagatatactgacctaattcccacgtgcaaggtagatattccttttatgccaggccgggccagcaacataatgtatgggacccttttaagtggttgcataggtttgcatgcccattaagccagccatacttccatgggccatagaacagatgtcaatcattgggcagctcagcaggcaaggtctatgaaagatgatgaaaccagtggactcaggctaagttctcctgtaagaatagaacaattgcagaataaactactacttttgataccctgttttataccaggggtgggacacactgtttaaatttggctgtttcatttcacctttgatattgtataagtattatacagccacattgctctcccacataactaaagccagaagataatttatcatcatcttatgaatctcagagtcatattattcagattctagctgccatcatttgcaaaataagtacagtatatagaaaaaagcatataaatatagtgttttaatcttaattttaataactgataacttactttgaagcctgataatatgaataccgtaataatacgacattggttagtattcattaacatttactatatctcaggcactgtgaaaattcccaatattcataacttcatttaacaatacctgtgaggtaagtattattatttattctgaagatgagtaaactgaccctcggagacattaactaaagtatcctgcctaaggtcattcaactagtaagtgatagagcttggcttctggccagctagactcagggctcagtcctcaaccacatgctcaaagaaattatagagtgtgttcacatgcctttctcttctttctgtttctgtttcatgcatcatatgttcttcagtctggccatatctgaatattccatatggctggagccgatatttttagggagtttcttttcttgaagatccaaatactgacaagttgtttctgcacatgaggaagtagaggtgctacttttcagtttggcttttttgggatatggccagtgggtacttattgaaagtcaccatcagatagtcacaagatcttcctttgactgacgaagaagagggacaaaattcattattctcatccctgccacttccttttgagccattcctacattcattcatgctatttctgattcctagtaggccactgatgataagatattctggttcaattgctaaatatttgatttgtttctaaacaatattctaatagacaccaagaggtttttatttcatctttgaagatttgtttgtacagcaattggcagacttatccctgcagagagcttttggctgcttgcccttccaaaagcagctgaatcctgacttaacacaatgtcagcagctcactgctgagcatgtgcacctcctgcttgtaaaaccattggctttttatttcaactttttctctaatgtttatcaatttagctccccttcataaacctctcttattaataattattcctgtactcccaagaaagattactttctataaaacatttggtagtgttttaaaatgtaattttaaaaattatcattgatgtgaatatatgctatttaaaagagaaaaaatgaggacctagtgaatatttaactgtcttatatcacattgaaaccatttctaaattttgtgactctgcatagaggcagctgtgatgactaatgagccctgaatttggaatcaggacaccagggttcaagtcctgcctggcaatatatttatttgtaataagtcatttatttttctaggcctttctttcctcatttataaaataagaataacatacaaaccttataagtttattttgagaatcaagaatataatctgcagatagtgtattaagttattactatatgatgcaattttcttagctatattcaatgtatatgcttttattttctcaacattttcacttaatatttgatatataattatttccatgcatcaacatagtttacaaacttatagcatctcattgttacttattattactttgataattcactgtgttttaaactccgcatatgcttataacttagcttatggtcatcatgcaatgataaatcaaaaagaataggatacaaaatataaagactgtgtaaaaacatgtgcattgataagcactgaaaataaatgtcaaagaatggttttctccaagcgattttctactatttatatgattttccatattataaaatattttcaaatatacctcaagataactaataggttatcttctgtacaaaatggctgaatataagcccgttaaattttgaaagctatctgcttcaatttagagtttagatgtgttttagaagtcccccaaatacgtgtacgcatttggtaattcaatagaagtgctcacaggatctggcatatccatagtgttcacatctgtggcttattatggcaaaaagttcgtaacaggatcagctaaggaaaaagatacaagcagagtctggagaaatttaggcacaggattttttatgtttatccctcccatgaaggacaacatttctgtgtgctctttttttctagtcacacacacatacacaaaattagtaacgtgtacattaattctgcccatacaagcccatcagatactcagcacttagttttactgggggctggtcacataagcatcctctgcctaggacataccaaaactccatactctcagaagggaagcagatattcagcataaatcatattgtttgtacaaagagtctgggcatggtgaatgacacttaccagttagggaatggagagaagtcaagttcccagatgctaaccaactgcaaaattttccaagtaggcctttctaaagatatcagtctctggcctactatgttcactcttctctgcagattatcttaaagatattcttcatgtcagaactggttaggaggcctgtctgctggggatggcctccccaatttgtgtcaataaaacatatcagtgttgaaggaaatagtaaatgaactactttttgttcatggctctctgggagaagaacagactcccccagatttccatatgattcccttcatatggaagaatgatgacagctaaagagcaaatgctgacaaaattgacaaccttttctgtcaccttgtcctcaataaagtagccaggctatctaaggtgcatagtcagaaacccagacgtttaatgatcacattctctgaaccaaaatgtctaacatttgctctgacatgaaaaaggaaatgggatggaattccaggttccatttacacagtcactgcatatgcttgggttctttcccaagcaaaaatcacaggagctacttcccaacaatagacgatttctttgacaccaaggatttgaaacgaaatttgattcttaacttgtctgtaaattaaatgcaataaacatatatttttgtactggtcattaactatattatgaatttaaaattgtactcaatagtattattttgtaacttattgattatcaaacatgaaaaggaaggtggcaggattattaaattacagattgtaaatttgctatggaatgatctaagtgaacatgatattttcatcctgacaaaaatcacagcatagaaataacagctgtgtaatatactaactgcatatgaagtctgaaaaacatactttaagtttttaattgccagttttactatacatagcttaaaatgggctctccaaagaaataattattattttaggatataaacctaatttgaactttttaattccaattatgttgacagcattgttttaggggaaaatatcacatgaaactccattgatatcaatattaataaatctaaactcaagtgtctttaccctaaaatcaaattaccagtaaaattatgacacagtgtttggagaaataaagcaatcaatgaaaaaaaatgatcgcatgttgtgccagaatgataaaagttctaaactacacttatttttttactttttacaaaaaagtaaacaattgttttacagttaatgaaccttcctttcagaattcttttccagactttataatcttaaacgagtgttaagatttgaaatttgcgtggaaatttagatttgagaggtattggcatgaaaatggtgtttggaaactctgggtgtgggtgagcagagccaggggactcatgtaagagcagagtcagaggaagagcaacctctaaagcttaactggagagagagcagtctggagagaatatcaagaagaaacaaaagagacaggaggataagcacatctgatgtggacgttagcatatgattgcattttccaggcctgccaaaataaattggaagttataaaaaatacttactatcccaaatcatcatctgaataataatgagacatcaacactaccttttatatataacctaaattcggtgactttattgtcaactaagaaactgcttgtacacaatcatgtgtacgtgtatttagtcatttacttgaataggaaatttgtttgaaaatgtgaaattgcagatttacctcaagaggatctttgtaaaacactttcctagatggatgctacaataaagacaagataatttctattattcatggttatattagcttaaaatgttgtgctaaaacttcttaaagcagtttttgttttaggacccaaatgaattatttttagaattatgagtattattggaaagttataatgattcttaattttccaacttgattcaacaaatattacgtaagtcctaagtgggatcaagttagaaagcaaggctctggctcagaaagctttgtaattttttgttctagaagaatttgatagtgaggctgggagcggtggctcaccactgtaatcccaacactttgggaggctaaggtgtgcagatcacttaaggccaagagttcgagaccagcctggccaacctggcgaaaccccatctctaataaaaatacaaaaattagccaggtgtagtggcacgtgcccaactactagggaggctgaggcaggagaatatcttgaacccaggaggaggaggttgcagtgagccgagatcatgccactgcactccagcttgggcagcagagcgagactctgtctcaaaaaaaaaaaaatgatagtgaaagatatacctatagagcagtgcaatgttctgttatattttatactttttttgatattttggtatgtgcataagaataccatgttattatgaagctattttgaatgtgaaagaaaagaaacaacataccacagcatattctaactatttatctaacttgtattcaatttttgacttttgtacattttaatttttttctctattttaaatagtgccacactaattaatttttgtgaccatctctaatcttatttccttaagataacatccaagaagtaaaattactggtgcaaagcccatgcacattttgaaagaatttgataaatattgccaagtttctcttcagagagtatcaatttacgctcccttgagcaacttatgaaagggccaagtgttatacctgtgtgcacatatatacacatgggcacgttaactttgcccaaaaagtttgtccaaaaaattaaaaaatatttaaatatgagacttttaacagacaatgatgacactatggatatcttttatttttatcattttaataggcgtgcagttatatctcattgtaattagggaagcagatttcacagctatatggatgagggttgtttagaggcaggcaaagcgatgttaagacggctataatcatctagatatgagaaaatgagagcatcaattagaaaagttaatggggatggaatggaaatcaaagagcagggagattacttttgagaagttacatttggtaaaataataagttttatagacaacaaagaaggtgggatgatgaactacaatattcttagtgattttgaaatccaaggtaggaaattaagggacttgaaacaacgcgagtttatttgtttgtggtataacttacatttagttaaatgtactaatgttgatagatagcctatgagttttgacaaatacatagtcgtataaccttcaccataatcaagatagggatcagttccatcaccaccccaaatttcctcatgcacctttgtagtcaaacctgttcctactaccaagcactagcaaccagtgatctgttttcttcccagacaattctattttttccagaatatgtaagaaacaaactcatacaatatgtggaggctttggagtctggcttctttcacttcatgtaacatatctgagattcatccatgttcttgcatgtattcatttttattcataagtagtgtatagtataaatatacaatttctttatctatttaccagttgaaggatctttttttggttgtttccagtctggggttactgtggataaagctgctataaacattcacatacaggtttttgtatgaatgtcagtttttgtttctctcttataattatacagcagtagcatagtttggttataagatacatagttttaactttagaaggaatgactaaccacttggcatttccatgaataatatatgagaattctaattgctccaaatttttgccagcacttgacattgtcaatatctttcatgttattttagtaggtacatagttatatctcactgtggttttgttttgcattttcctagtgactaggaacactgaacatattttaatgtattggtcagacaatgtttttaattcttctcttgattgatggttataactctaaagaaaaaggataaatcagttcacgatatcaaacaaaaacatttaatttcctaggtcacagcttaagataacaaaataatagcaagggataaagtaaatcctttcggacaggtctaagatatttgctgaagattgctgatacaactaaatgtgccttaaagtaatatatgaagggttgaggaaaaaagatcccagaaaacaatataagaaacaattggtgtgatataaaaagaataccaaaaataaaaactgacagtttgaaggaaaagcagtaaacatggtttgaaacagtatttccatccatctatacaccaaagaacacaatgttagtaattagagcaatgcatttgaaaacttaataaaaacaaataaatgttagtattcctagaagttgctggcaatgggcatatgaaatatttctagagcaacaggaagataagccttatttgatataaacagttttgacaaatggggaagcataatagcactgaaacttaagaatgtgtccattaatatggaaatgaaaacattttacagagcattggaatcaggatgaaacataaagaaaagtgcaaatgttgtgtgggcatgttacctaggagcagatttgtgtaatgctttcatctgtgtattataaaatgggaggacaggcaaaacgataagttccctcgctaatctcttggaaactccattgtgtcctagcagagatcagttatctgccctctacaatgttactgtttacatgaagaaattaagattttgatgctaaagtagaagtaagcaataaaatataaagtaaaattaaaataaaagtatatgatagataacattatatgtaatagaaataaatgtaagaatacagtagaaatcatcaacacaatgtatccctttattcatcaaattcctgttgaatgagttctgaatgagcactgaggaaagttgagtgaatagagcggtaaactcaacacagcccctcttctcatgaagttcatacattaatcgagtaattataataaaaaatgacaaatattaggaatgacagggtgctttgaaaatgcaaggtgctctccaattagttcaaatatgtacatttatgaaatatgaaactaggattaatagaaaattgtaactagagcacatattagggtccagaaagcaaagaccagaataaattgaaatttataaatgaaatatcagttatgctacttgcacagtggtagaatgttgacttggaagaactattgaactaattgcactgatctccattaaaaaaaatggacaggaaggagtttaagaggttattgaagctcaaggtaaggggagaagttgtggaaagttcgcttaaatggattcacttctgggcacagtggctcacactgtaatcccacattttgggaggccaaggcaggtggatcacctgaggttggaagtttgagaccagcttggcccacacggtgaaaccccgtctctgctaaaaatacaaaaaatagcctggcatggtggtgcacacctgtagtcccagctacttgggaggctgaggcaggagaatagcttaagtccaggaggcagaggttgcagtgagccaagatcatgctactgcactccagcctggacgacagagcgagactccatctcaaaaataaaacaaataaataaataaatagattcatgtctctaggataacatgacaatgatagcatagtgtcaaactctgtgacatttgagaaactgggaagaaggttgaaatttgataagaatgtggtattctattccatcttttattaatttgtctattcatttttaaaactactttagtattttctatatgtcaggcactgtgctaataaggttgatatgaagtttaagtcatagagaacatgatccctgacctcatgaaagctcatactcttgttggaagtaagaaagacaccaaagcaattacagttgagtgtgatgaattcaagaagacaactttggagcatcaggcagcaatggagagaactaaagtgatttactcctagggatgaggaaagatgtcataaagaaaatgatgctttattggagtttgatttttgttggtaattcaagaacaagtagcctattaagcacaaatatgagcaggtacttataaaggtacctaaccattttttaagcgttttaataataaaggagaaaaataagtcaggtggtgtacaaaagttgattttgttttgttttgttttttgagatagagtctcactccgtcgcccaggctggagtgcagtggcgtgaccctggctcactgcaacctccgcctcctgggttcaagtaattctcctgcctcagcctccggagtagctgggattacaggcacacaccaccacacccagctaattttgtatttttagtagagatggggtttcaccatgttagccaggctgatctcaaactcccgacctcaggtgatctgcccgcctcagcctcccaaagtgctaggattacaggcgtgagccaccgtacccagccaaaagttgatttctaactcattgtataacaaagtacaaatagcttcagttggaaaatcagtgccattcaatctttagttgtctgttataaggctctgtacttgtcactaatccatcaggtattttttttctagtacgtatttttatcgataacttggaggaacgcatgagacataaatttggaaatgataacaaagataggggagggtggctgaaacatctatacagaataaaactgaatgctttctatggacagagatggtaactcatgtctaataagataaattttattatcaataataattgtaaattcatgtttaaatgaattaaatagacatgagattttagaaagcttcaatacatcagagcacaggagacctgttatgagacagtgtgatacagatgcagaaatagacaatgaatacttaatgcttgtgttatcttgacagaagtgtaagttcatttcagcaggggtaactagcaattgctaccataacctactatgcttgggctcaactggtacaatatgtccagttctgggtgccatggacatgattttatattttaaaatgtgattattttggcagagacttggaaagtccagacatacctaaaatagcaaaaagaggcacagaaaggaacttaaaacagaagcagtcgaagcaggtacagacaagtggctgaggcatcctgagcagataatcagtaggcaccatgaaagatgtcctagaaggcaagctgtgtgcagtctcaagaagtttgggctactgtaacagtagtagtagatgcagaccttcaattaaacttaagtgtagccctactccagatgaatgaccctaaaaagaaattggaaaatggggtaaaatagcaccctctgaaatgactcaaagaactacagcaaggcaagacccaattcctaaagtaatggaacataaagaagcaaaaaatggaatgctgctcctggacattaaatagcaggcagaatccttgatcctgaagattcagagtagagccaacagcaatgcagataaatctaattttttccacagtttcttaagttctccttatagcacagctttgatccctgattcatgaacagggccaaggttacaggtgactgtgattttttatatttgggaaaattaaaattatagagctgatcaaattacataaataagttagtgttccccccaactctactgcacaattgatacattcctagtgaaacccattaattgaaacttctcctgtgagttgatcactgtgctaaattcagagaatgtaaaaataaatgaagcaaatgctttgatacagaatattcacattactataagtaatgaaaagtcattgatgtttttaatgcaggaaaataatgggcaaagttctggaatgttaatgagcagcaaaaaagggatttgataatctattcacatgcagcaaagtgaggttaaaggaatgttagccagtcgaaatatttgttaaaaggtattacacacatgtaatattttaatacttttcttaataaggaaaatagtttatagaatattgcagagaatatatcaagataattctgattaatttctcattacataagtacaatattaatatatttgctttgcaaaaaattttaataatacaggcatgccgtttgttcacattttatgtgaatttcaattgtatggctatgaaacaaaatgtatataaaaatttataggtctcacttcatgagaaaaatattacacaaaacaaataacttccaaattaaaaatcatcaacaatcacctggtttgaaatgagtggatggtaaactacatcattaccataaggtggcaccagagtaactgtggcaagtagtataagcgctgaattcttctgaccttgtttctgcatttacataattatgcattatgtttataaccatattcataatttgaagctttcacaacaaatgaaattattctatatgtaatgtgtgagctgtaactttctgtcttcagtaaaccaaacctgttggagaatctacctcattctttaattgctgtctaatattcctcagtgggaatatgttacaatttatttaacaagtcctgcatcagtgatcatttaggagtctttaaatttttcaagaatgcaagtgatatcattttgaattgaagaattgtctttgtgcacatggacaagtatgtctggagtatatatatactgccagaagaaatgtttggctcaaagtaaattaacctttttaatactgataaatatcgtcacattgtcctattaacagctatagcagtttacactccagccagcattgcatgaaaaggcccattttcccttatattgacatgactggatattttctacgtatctttttaaatgttgccaccttatatttaaataatgttattattgctaaatttattatttctgaattagtaatgaggttgcatatgctttaaaacttttagtgaccttttgtgggttttgttcaatgatttgcctactgatacattctccgttttttaacttatttttttctgatctgtaagtgaagaccattttcttatttttatttattttttatttaaaaaattagagatggggtatcactatgctgctcaggctggtctcaaacacctggactcaagccatcctcttgccttggcctcctgaagtggtggggttacaggtgtgagccaccatacccggcctcattttccatttttaagggagaattttttttttcttttcagagtttttcatatgttatgaatattagtcattagattgccatgtcttctaattttgtaacttatcattaaactttgaaaatggtggttttcaatgcaaatgagttttaattcttaggtcaaacatgataatgtttttctcttatggtttctgagttttgttttcctttgctttgctttgttttgctttgaaagaattttttaaaattttaaagctctagaaagatattctccttttttgttgtaatgcaatcatattggtttttttatatttagtatttttgtatatgtggaatttatgtttctaatatatattcaataccaccttagcaccatgtatcgaacagatatttttcttctcagtgatttaaagcattacctttatcaagtaccagtttcaaatatacatgatttgtattgagataattctattctgttctgcagttgacaagaatgttaacatttcacaccaataaatgtaatggatcacagaattttgcccactttactgaaggagatagagagatcagagctaagggatttgcatgacgtcctgtgcccagatcgacaggcatcctgggccgtggagcccatttttcttacttaaaattcagtctttttcctattctgctgcaaactacgatttgagatcaacaggaaaataggtcactttattctcttttaccttgattctttttccgtaacagaggagtattcaagctgtagtcggcatccgtgccaaaatgggggcacgtgcataaatggaagaactagctttacctgtgcctgcagacatccttttactggtgacaactgcactatcaagcttgtggaagaaaatgctttagctccaggtaaaaaaaaagtatacgcatctttggatttgctcattgtcataaatagaaacacgttttgaaaatatttattaatgaatatttaagcctgcttaatctggatccacttgacaattccttttactttttcgaaacttactgaagaatgtacctgatttacaagtggaaatgtccttttgttaggcaaattcttattcacatgcacctgttgaaattttcaatattgctatatagaggcagtttatggaaaattctaccccctcacaaactttttttctcttgtgcatcctaaaaatatatggatgtatatatctgactgatagaaacactttctcctcaaacaagcagttaaagaaatacgcctttgatttatgtctggtatggtcatttaaatgaggctttaatacatgcttagtaacacgttttctgtgaaggttaaactaatggcaccattttgactgtgtgagaactgttagaacatgctcaaatgtattaagtaaaacaagatggcttttttatttatttaaattcataagtattggtgctttggatttacttcaggagtgcaccatttctgatttttatacagaaatgtatgtgcagcataaaaatgtgttatttaatgactgcaaaaaaacctatttcaaatcagctttttcttaataatatcctgcatagtgaaatgtaaattttttagtctgtttttagatctcagcctttgtaagtacaattggcattaattacacagaaaattgcctttgtctactttgctgcagtgaatatgactttatatggttttcgttttagcctttagaaactgcttgacaaggtgccggaaaaattgtttctacatcatgtcagcttcaattcctgcaaggggctttaaaacattctgacataaccataataatcatagagtgctttgaattcctttatctctggggagatcaaagcaacatgcaaattatctttgaggcatttctgtgaggaaggtatcaaatgttatttttattctgtcctgatctaaatggagaaactgaggcaacaagaggctaagcaatttagagtaatttaccccagagaagagacaggcattgagacacgtgcacctttgctaagtttgatggatggcctttctcttctgctaagactttttgtaactgagataaaaatgacgaagatataaggaaagaaaaataagataaaaacatgaaaattaactcttgccattttttcctctaacagatttttccaaaggatcttacagatatgcacccatggtggcattttttgcatctcatacgtatggaatgactatacctggtcctatcctgtttaataacttggatgtcaattatggagcttcatataccccaagaactggaaaatttagaattccgtatcttggagtatatgttttcaagtacaccatcgagtcatttagtgctcatatttctggatttttagtggttgatggaatagacaagcttgcatttgagtctgaaaatattaacagtgaaatacactgtgatagggttttaactggggatgccttattagaattaaattatgggcaggaagtctggttacgacttgcaaaaggaacaattccagccaagtttccccctgttactacatttagtggctatttattatatcgtacataagttagtatgaaaaacagactatcacctttattgagaaacagccagtgttttcatttatctttgcttgcacatctgctctgttttggtttttctacaggaaatgaaaatcaacttgtttttttaatatgagtaaacttgtatgtctattttataaaattatttgaatattgtttaatgtctgaatatgaaagagttcttgatcctaaagaaatttagtggcacagaaaacaaagtgaatttgttagcataattattcctattcttatttcttcattttaagtcattgcaatggaaagtaatattataaaatggtaattacaacatattatcagtcacagttttctttccaattaaacacttaacttttgttattccctgtatataaatatataacacacattttctagattcacaaatttaaataaattactcaaaaaatgaaaattgattttgtaaacttttatttttactctttacgttgagttgatcaattttccatactaagattttcattcagaatcaaaattaagaaagttggactgaaaatatgaaaaatgcttaactattgttctcttcctataattctctaattataacatagtaatttacatgtagttggacatgtacactcaagtctaagaatatatgagtggatcatttaccgccccccgccccacaacatctataaggggcaaaaagtctttttctaataagtattcttctatggtagtacctacagatctgcccttcttcttctaaagggtaagtcataatctgtgtaatactacaatttatgggatgctcactatgccctgtttctcttctaaacaatttacatgtaatgtctcattcctcacaataacccttgtaaagtgggcatgattaccatgatttttatagttgaagaacctaagacacagagaccaaggcccatgagctcatagggctgaggcaggatttggaatcaggccatgtcttctccagagcccacatccatcctttctctatattgcctcccacagatgtgctaaaatttatttaactaatcctttatcctctatttgtgttgtctcccattttttattattacaatattactgtggtgaacatgcttaaaaatacattccttggatatctgacaacgtgtttctgaaaaacagattttcataagtaataataaaaataataataaaaaagttttggtatggtaagccttttttatgaattgatttgtttaatgatcactataacataatgaattacatattaacctatgatatttgtactacatattattactctctttctgcccatgagaatcagaagcacatagaagttaaataattttctcagtagtataaccaatgatggagaatttctgggacaaaggatgatcataattttccatttcgatgggtactaacaatctaagtctatgaaaaactgctctttataccccacacatcctcatcaaaattaacaatttttgaaatatttccagtcctgaaagtgaatatcttctatttgtagaagatacttgaaaatttttcaaatttgctaaaacttgaaagcatacatccatacaaagacttgtaagtaaatgttcatagtcagtttatttgtaatagctgaaaactgggaatcacccgcatgtcccgcgacagacaaagggttacgcaaactttcgcatacaaatacaatagagtacaacacctgggaatttcacaataactatgcagaagattttaaactgcagtctaacaaactttgtcacctctgcaaggaggaactctaaagtaagtattgtccatcagaatgtcctgcgctgagtcaaaataatcaggccttcataccctagcctcactcagtactagattcaggctgccaaagaagagtgtgacctaagagttaaaaccgacagctggatgcattagtccatcctcgcattgctataaagaactacccaagactgggtaacttattaagaaaagaggtttaattaactcacatttccacaggctgtataggaaacatggcccggaaggcctcatgaaacttataaccacagcagaaggtgaaggggaagcaggcacgtcttacgtggctgggggaggtggaagggggagaggtaggaggtgccacatacatttaaacaatcagatctcgtgtgaactcactatcaggagagtagctggggggaaattcacccccatggtccagtcaaatcccaccaggcccctcctccaacactggggattataattcgatatgagattttcgtggggacacaaattcaaacatatcactgaatgatgacaatttttatcctgttatgtgtaaacatgtcattttcaaaaacatttaaaaagttcttatgatatcttcagtccctgcctaaaaatttactataatctaaatttttaaaattttatttcttcaaggactcacagattaaaatacaatttttgctttccaaatatacttttcaacatagatttcagtgatttcattatattgtttttctttactgttaccagaacagaaggaagtaaatcatttgacaatgttcatcattgcattgtccaatataatttattgatttttaattagataataacatttagcattaaataatgctttggtgtttggaaatataattattaataatagtctttatttttatatggattcatagaatatacaattaaataacaaattgccaccaatagccaagaggcattatagcaacttttaagttgctgtgaacttgcttggctatatttttaaagccactcaatataatcaaagataatttagtattgtatttttaatggtcatcttcaaacttattcatgtagaaaaaaatatagcactggaacgtttctttatttcttctatggacatagccaagtaccttgaatattattttgtagattcaatttcagagcccttctctctcacaatatcttcctgccacaccagctcccaaagtacatcaggtcactaattactgatgaaaatctcaaatccattcatttattacttaataagtagctaattattatacctaattgaaggtacataatataggaggcatgttaaattatatataacaaataataaaaagtatataaagtaaatcagtacagacaaatgttgcatttgaaatacataatccggggtcatgatggcatttactaccaccagaatcatggatagctctgtaagaatgagaaatttatcttcaataaccaccggtctcttttttttttttttttctttgcactattgaccaatcttctattacctccttttgtatcattcccagaattgagagacttcccatacaaagccataagtgtctacaattgctctttcttactcatttcaccagttaaaattctcaatttggaagaataagctattattagttaatcattaagaaatgattaaaataagccatcctaattttcatttggcttggtttttagtgcacatagagataattttttggttgttgttcatctgtttcaaaatataaatttattaactcacattggaaacctcgtgagccatacatagtatatgtcttcaacaaagataattttcaatgtagcaaaatttttctcattattcaaaattttttctatcatttatcattgcaaggcacctgtgggatacattaaagcaaaaatataggcctgcccttcctagagtgtacaatttagctgagttgctctcctgtgtggaaggaagggatgtttgcttatttcctgtcccggtgatttcaaaccgagggtttcatcaacagcctggggagtgttattaagaaccttcccttcagtgcttttaccacagctcagtgagaattctcaatgagctatactgcatttgtgttcagagaaaacaacaataaagtagtatttatttctctgggctgacatcctaattacataatctaaaactctgggaaaagtccaaattttggagtttttattatatttactcatgaattgcttcatcaactttcaaagccagggctttagtcaaaacacttttcagattccaactatttaagttagcttaggctgccacaacaaagttccatagtctgggtggcttaaacaacagacatttatttctcacagttctgagagctgacaattccaagatcaaggtgccagcagatttggtgtctctagtgaggtcccttttcctggcttatacaaggcaaaaggctgccttctcattgtgtcttcacatgcagagagagaaagagaggaagacagagtgaaagagggagagagaggagcatgagggcggagagcacatgaatgctctggtctcttccttcttttaaagacactaatccctggtcggggcccatcatggggccccaccctcatgacctcatctaaacctaattaactcccaaaaccccacctccaaataccatcacatttggggttagagcttcaacatatacatttgaggcagggagggggcacaaagatgcagtgtatagtaccaagtgttgaatgtagtgatatttaggatggtgttttaaaacattctttgcatagattttaaaatatcagtctatagtagatcctagttgtaacatgatttcctattagattcaaataaacatttatatcaagcccactgaagataacagtgaaagtgctacgtaacattgtcttaaagttggtgtttttttcaacatattatttggattcaaatatttatttggatttcctatttttttgattcatactaataattatatctactcaagttaacagtgaaaatagtacatgatgcaacccaaggaacaggtgttcttataaataccactttactctcctaacttgaagccactgataaagaaagaaattgactcactgaattcctcttaccaggatacagacgattatggatagtttctgttatttttgtaatttacttcccctcatttatgtttgctgccactatcatcttcaaaatatgtaattacgcataatatatataaacagaaccacacgtacatttctttattggtatgaaatctatggattaaggatgatagtaatttgccagaaaatatatgtaggaaaaatacatttatttgtgcttccaaaccctttctaaaagcgatttaaggtgactagatgtataatttgtgtggagaaaagtactaaagttatacaaagacatttagttgctatttacatatcaaatatatctcaagaatatggtctttccttatcctaatttcttaggtatattcacatgcattaatttttatgatttgtcatagagtaaccttgctattaacaaaaaataacctacaaagattcctcccacagtctcaaaccctccttcaattctctactctacctttttgcctaccatcatagctttgctattttaatgaatatatttaggtttctttattccagctgaagagaaagctaaatagtgtagaagttattctgtagatgaaattcaaagaccctccagagattgcatgtctttttaatgtgacttttactgccctttctgaatcttgtcattaaatcccttgaatcttgattctatttcatatattaattctatttcctttaaatggtcagcagactgacagatcatcagtgagttttcctctatcacagatctctgttaacagtaagttatgtaatctaccccatgcaatgaagggcagaataaacaaaggtggagggaagaataaacaaattgcatttctgtataattgtggcttctttctttccatgtgtacactcaaaggagaacatctgtttgagaaaaagaagccatcattattatcaacagcacacctacatgcgctaaaggcattcttgggtatcacaaaagaacctttaaatttaagaaatacattgtaggtatcattggaacaatactagtatctgaaaactgattctataatctgttttgaagaataagtatattaaaatgcccacagagcattttagaattccatgaggccacataccaattgctcatcaataaagttcttggcactgtggctagtggaaaaaacactgaattcagtaaatgctcagaacatgctggaaatatagaaaaaattaaatgtcttaaattcatgaaaaaaatatctgagaaagttataaaacttagaaaattttgtagtaaaattcattttacacatcttaatggagatatatatgaatttttaaatatcaatcccaaaactaatcctaatttttctttttataatctgaagaggtaaaatatgacatctacatttgattaatgttgtcatcttcattgaattaagcctacaatgaagacatcgaatcttcttaaaatatcctcattctgggttttaacaaacagctactacatgctctagctatatcctaacacactgatgcagttttgccaacaagatgtgacttcttcacacttcaaattaaaatcctaagtacctccaccaattgaacagatacatcttggccaaggggatcccagagacaccttaaaaactgagttcctggccaggacaggatggaaagccagacatgcctcgttatactgaaacaggacattttccatgaccactttgtgggcctcacagcagaggtacctcacttactcagtccaacccctcacaggagtgggagcacacaggtgaaagggtgcaagagatagggcaagtgcttctgggtgccagcagaagcaaaactccatgcaggccttgtagcagcatctcgcaggagtacccacaacccccaaagccccagaggggtgtgttacagtgcactcttttagctttgcaatctgtggacgacttaagtgttaaacagctcagttggcctctgcctttttatgtgaggcagttgctctccaccagtgagggcagagggtcagtgtgacagcctttagcatccacacctgtgtgacacccaagctcttgtccaggaaaaatcagattgcacaaatgaattaaagggtggtgaatgaggaggattttattgctgatggaagcggctctcagaggaagggtgagctggaaaggggatggagtgggaacttcccctgaagtccggccatctccagccagactcttctctgaagtcctgcagtcaagccgtccctctgaagtcaaactgtttctctctgatgttcaaccacttcttctcttctccacttctctgctctctgccagtggagcctggggtttttatgggaacaggatgggggtcggtgcaggccagggttggttttggaaaaggtgacattcgagcaggaaaatggggatgtaaagttctcactttggtctgagatttcaggcttgagggtggggccctgggcaggaaccctgccctttctgcctagaatttctctgcctcctgtccctaacaatacctcctctcttttggggtctagacacaacagttgaccagcattgatgttaaaataaagatcacaagactgacagagaacagactctttgtggcaatgagatattaaattataaacagcaactaaggccatgccaggcaagggttaaatcatacacccctatacttaaagaataaactatattttaactgccacaagggttttttgttgttgttgttttttctagcaactaaacaagcactgccttgagataagcaaaattaaaacaatttgcaactctaccacacgctgactaactggcccctggcccctgctccacaagccataactacagctttgattgggcaagagactgatttcagtaactgtctcctgataagaccactgaccatggactggttatggctgagtgcctctgtatctctccttcatcttttgatgtataggatctaactgtaacacatttaaatgttaagttgcaccccaaggtaaacaagggtcatatattacatgcatgtttacttaatattcatgtgtcaagactaccttcatgaatattcatagctcctcctgtaatctgttgaatatgtatgtttggccaaccttttcaacttaaattcttgtcttacccctcctttcctcaaagtgcctgcaaatggcttcacctggaggcacacttcccagcctgccagatgggctcctcgcaaggctgtaaccttttacaagaaataaagtctccctttctaaatttatagatctcatgattgttttaggttaaccacaccaatggagaaattgacttggcaaatgaccctgtgagaaaaatattttcaatagggccaaatggttccagccttgggggagtgaccacattcaacagtgaataataatgcagaattgctttcgtcattttctttttgatgtgaacattacccagagtgactaatcttccttatatcactacacttttagaggcataatatcattttttctataattataaaatataaagcaatacaaacttcaggaacaaacctcctggatgttttatttctctattgtttttcatcttctggtggctacctggcagaagttaataacaaaggcaagaaaagaacaagaattagaggtaggggacaaaagaacagaacagaaataaggaggaggaagaggaaggaaagtgggagaaagaggaagagaaggaggatgacaatgagagaaaggaggggaatgagaaggaggaaaaaactacaattgaccccctgtgcatcaaaaatctgcatgaaaattttaactccccaaaaacttaactacgaatagtctactattgacagaagccttattgataacatcaactagtcaattagctcatattttatatgttatatgtattatatactgcatttttacaataaagtaagctagagaaaaggttattaagaaattcataagaggaaatatatgtattattcattaagtgaaagtggatcatcacaaaggtcttcatcctcatctttatgtccagtaagctgaggaggaaaaggaagagaaagggttggtcttgctctctccagggtggggggtgagagaggcttaagaaaacctgtgtataggccaggcccggttgctcacgcctgtaatacctgcaatttagaaggtcaagggggctggattgcttgagcacaggagtttgagatcagcctggtcaacatggtgaaaccttgtctctattttaattttaaaaaatgttgaaaagaaaacctgtgtatgattggacccacacaatacaaacctatgttgttcaagggtcaactgtatatccaaactggtaaactggtccgtgttaagagatagagggtggacagacacagtgtgagatagtgtggcagagtgaaagccaaagagatgtaagatcctgttaccatttcttcaacctccctctaacctagatgatgtgaaaaactagcagaggaaatctataataggaaaccattactgtctctactcactccagttgccattttgaaaacttgcaaatttatcttcaacacattttgagacatacttttgaacacatcttaagtccatcctttggactttgtgaaattgcctttctgcaacagatgctggcgaggttgcagagaaaatggaacacttttacactgttggtgggcgtgtaaattagttcaggtattgtggaagacagtgtggtgactcctcaaagacctagaggcagaaataccatttgacccagcaatcccattactgggtatatgcccaaatgaatataaatcattctattataaagatacatgcaaatgtatgctcattgcagcactattattcacagtagcaatgacatggaatcaactcaaaatggccatcaatgagagactggataaagaaaatgtggtacataaacaccatggaatactatgcagccataaaaaggaacaagatcatgtcctttggagggacatggatggagctggaggccatcatcctcaacaaactgacaaggaaacagcaaaccaaaccctgcatgttcttacttacaagtgggagttgaacagtgagaacacatggacacatagacgggaataacaaacactgcagcctgtcattagaggtgggggaggtgggcaggagagcatcaggaagaatagctaatgggtgctgggcttaatacctaggtgatgggatgatctgtgcagcaaaccaccatagcacacgtttacctatgtaacaaacctgcacatcctgcacatatatccctgaacttaaaatcgaagaaaaaaaaattgtcattctgtgagtaacttaatactgtagctgcccaaggggttcaccttgcccactgcctagacagagccaattcatcaagacaggggaattgcagtagagaaagagtaattcacacagagccagctgtgcaggagaccggagtttattattactcaaatcagtctccctgagcattcagggagcagagtttttgttttgtttttgttttgagacggaatctctctctgttgccaggctggaatgcagtggcacaatctcggctcactgcaacctccgcctcctgggttcaagcaattctcctgcctcagcctcctgagtagctggaactacaggcgctgccaccacacccagctaatttttgtatttttagtagagacggtttcaccatgttggccaggaaggatggtctcgatctcttgaccttatgatctactcgccttgccctcccaaagtgctgggattacaggtgtgagccactgcgcctggccaggagcagagcttttaacaataacttggtaggttggtggggagccagtgagtcaggaatgctgattggtcagggctgaaatcacagggagtggaagctgtcttctggtgctgagtcggttcctgggtgggggccacaagatcagacaagccagtttattgatctgggtggggctagctgatccatcaagtgcagggtctgcaacatatctcaagcactgatcttaggagctacatgactcctaaaccataatttctaatcccgtggctaatgttagtctagtccccatgcaagaaggaagtctgctttgggaaaggctgtctttgtttaaactataaactacaaactaagtttctcccaaagttagttcagcctacggtcaggaatgaacaaggacagcttggaggttagaagaaagatggagtcagttaaattggatctgtttcactgtttgagtcataattttgcaaaggcggtttcaatactagtgtcacaaaatgggaagaaaaaggactgggattatgcctccatttaaaaaattattcgtgagtatgtgttctcatttatttccctcttaactcttgaaactagtaatttgcctaacgagagaaaaaaaacttaccattttcataaattttctttcagtggtatctttcatgcgcgtccgtgtgaagagaccaccaaacaggctttgtgtgagcaacatggctgtttatttcacctgggtgcaggggggctgagtccaaaaagagagtcagcgaagggagagaggggtggggccgttttataggatttgggtaggtaaaggaaaaaggggggttgttctctggcaggcaggagtgggggtcacaaggtactcagtaggggagcttttgagccaggatgagccaggagaaggaatttcacaagacaatgtcaccagttaaggcaggaacaggccattttcacttcttctgtggcggaatgtcatcagttaaggcaggaacaagcgatctggatgtgtacgtgcaggtcacagggtatatgatagcttagcttgggctcagaggcctgacattcctgtcttcttatattaataagaaaaataaaatgaaatagtggtaaagtgttgggacagcgaaaattttgggggatggtatggagagataatgggcgatgtttctcagggctgcttcgagcgggattaggggcggtgtgggaacctagagtgggagagattaagctgaaggaagattttgtggtaaggagtgatatttgtggggttgttagaaggaacatttgtaatttagaattattggtgatggcatggatacagttttgtatgaattgaaaaactaaatggaataagagaaggagaaaaacaggtataaaaggtctaagaattgggaagactcaggacatctgattagagagtgcctaaggagattcggcatagtcctgccaacaaagattatttatttacgtcaagagttaagagtggcagtttggggatagcaccaggagatatcagctgtgatggcttggagaaacagtgtaaaccggcagtgtaaacaagagcagggcatgtatgagtagttgagaacgctgaataggagtatgactagacagaagatagtagggatgacaagtttttgggggcacattctaagttggtctggtgtctggaatgagactggggcctaataaaacggagcgtctatacaggagctcaaatgggctgtaacttgtagcattctgaggacaggtctgacttctgagaagagaaagtcataaaagtattgtccagtcctttttaaattggtggctgagcttagtgaggtgtgtttttaaaagacctttagtccattctactcttcctgaagacggaggaccttaagggatataaaggtttcactgaatactaagagcctgaaaaactgcttggctgatttgactaataaaggctggtcttttatcagactgtatagaggtgggaaggctaaactgaggaattatgttgacagaagggaagaaatgactgtggcagccttctcagaccctgtaggaaaggcctgtacctatccagtgaaagtgtctacctagactaagaggtattttagttatctgactcggggcatgttgagtaaagctaatttgccagtcctgggtgggggcaaatccttgagcttgatgtgtagggaagggagggggcctgaataatccctgaggagtagtagaatagcagatgaaacactgagaagtgatctccctgaggatagatttccatgatggaaaggaaatgagaggttctaagatgcgggttagtggcttgtactatatagcatagcctgcctttgctggtgtgtggtgattaggcctggtagaactgccatcaataaatcaagcgtgatcagggtgaggaataggaaagaaggaaatatgcggaaatggggtgaatgtcaggtggatcagaaagatacagtcatgggggtcaggtgtggtatcaggaataatgtgggaggccagattgaagtccgggccaggaacaatggtaattgtgggacttaacaaagagtgagtacagctgaaggagccggagagcagaaagtgtatgcgtcaggtatgaggaagaaaatagattttggaagttatgagaaatgtaagagactaagttgagcagagtttgtgattttgagggcctctaaaagtattagggtggcagcagccactgcacggagacatgatggctaggctaaaacagtaaggtcaagttgtttggacagaaaggctacaaggtgcggtcctgtcctggctcttgtgtaagaaatctgactgcactaaccatgcctaggaaggaaaggagttgttgtccatgcctaggaaggaaaggagttgttgttttgtaagggattgaggtttgggagattaatcggacacgatcagcagggaaagcacgtgtgtttttatgagaattatgccgagataggtaacagatgaggatgaaatttgggcttgactgaagtaatgggggctgtctgtgaagccttgtggcagtacagcccaggtaatttgctgagcctaatgggtgtcagggtcagtccaagtgaaagcgaagagaggctgggatgacgggtgcaaaggaatagtaaagaaagcgcgtttgagatccagaacagaataatggattgtggagggaggtattgaggataggagagtatatgggtttggcaccatggggtggataggcaaaacaatttggttgataaggcatagatcctgaactaacttgtaaggcttgtctggttttaggacaggtaaaatgggggaatggtaaggagagtttataggctttgaaaggccatgctgtagcaggcgagtgataacaggctttaatcctttcaaagcatgctgtgggataggatattggcattgatccgggtaagggtgattaggttttaatgagatggtaaggggtgcatgatcagtcaccaaggagggagtagaggtatcttatacttgtgggttaaggtggggggatacaagaggaggacgcaaaggaggctttggattgggaagaagggcagcaatgagatgtagttgtaatccaggaatagtcagggaagcagataatttagttaaagtgtctcggcctaataagggaactgggcaggtggggataactaaaaggagtgcttaaaagagtattgtctaagttggcaccagagttggggagttttaagaggtgtagaagcctggctgtcaatacccacaacagttatggaggtgagggaaacagacccttgaaaataaggtaatgtggagtgggtagcctccgtattgattaagaaggggaccgacttaccttccactgtgagagttacctgaagctcggtgtccgtgatggtctagggggcttctgaggtgatcgggcagcgtcagtcttcagctgctaagccaagaagatctgggaaggagtcagagagccttgggccagagttccaggggctctgggagtggctgccaggtgagttggacagtccgatttccagtggggtcccacacagatgggatgtggcttaggaggaatcctgggctgcaggcattccttggcccggtggccagatttctggaacttgtagcaagctcctcggggaggaggttctggaggaacacctggctgctgcagttcaggcgtttggaagttcttgtgtgctggagatgtggctggggtttgtctcacagtggaggcaaggaactgcaacttttttctattattgtacaccttgaaggtgaggttaattaaatcctgttgtggggtttgagggccagaatttaatttttggagttttatttaatgttgggagcagattgggtaataaaatgtattttgagaataagacggccttttgaccttttagggtctagggctgtaaagtgtctcagggttgctgccaaacaagtcatgaactgggctggatttttatatttgatgaaaaagaacctaaacgctatctgatttgggataaggaaaaaggagcattaaccttgactatgcctttagctccagccacctttttaagagtaaattgctgggcaggagggggagggctagtcatggaaggaaactgtaagccggaccaggtgtgaggaggggaggcgataaaaggattatagggtggaggagcggaggctgaggaagaattgggacctagctcggtctggcgaggagcagcctggggaggaggggagaggtcagatgggtctgtagaaaaggaagattagaaagactcagtgactcttggggttgggactgaggggacaggcggaagggaaagaaggaagatttgggacgagttgcattgggcacagagactaggaagggaccgatgtgtaaaagaatgcctggatgtcaggcacctcagaccatttgcccattttacgacaagaattatttagatcttgtgggatggagaaattgaaagtgccgttttccggctatttggaactactgtccagtttgtattggggtcaagcatcattgcagaagaaaataagatgcttagattttaggtcaggtgagagttgaagaggttttaagttcttaaggacacaggctaagggagaagaaggaggaatggaaggtggaagcttgcccatagtgaaggaggcaagcccagagaaaagagtagagacacggagaggggatggggggttcttgccctccagaaaagcagagaaggggtcagggcacagagatacgaggtcggggtgtggaaataagggatcggggtgcagagatttaagaggtcagggcacggaaataagggatgggcacagagatatgaggttggggtacttgcccctcctctagaaaagtgggacttgccactcagggtgaaggagaagaggttgggggtttcttgccccccagaaaggtggagaaggggtagagacacggagagaaggggttggggtactggccccttccccagaaaagtgggacttgccgctaagggtgaaggaccaaggcaggcgtccctgcgtggtctgacacctctgaagcctgggtgaataatcagagaggtgtccctggaatgattaaacaccaagggaaggctgccttcccagtccgtgactggcgccggagttttgggtccacggataaaacgtgtctcctttgtctctagaagaaaatgaaaggaattgaaattaaaagaagggagagattaaagtgtggcgccaagattgaaaggagaaagaggttgagtgatagtgagggaggttggagaagagagtaaaaagaggcggcttaccggatttgaaattggtgagatgtttcttgggctggtcggtctgaggacctgaggtcgtaggtggatctttctcaaggagcaaagagcagaaggacaggggattgatctcccaagggaggtcccccgataggagtcatggcaccaaatttcatgcgcgtccgtgtgaagagaccaccaaacaggctttgtgtgagcaacatggctgtttatttcacctgggtgcaggtgggctgagtctgaaaagagagtcagcgaagggagataggggtggggccgttttataggatttgggtaggtaaaggaaaaaggggggttgttctctggcaggcaggagtgggggtcacaaggtactcagtgggggagcttttgagccaggatgagccaggagaagaaatttcacaagacaatgtcatcagttaaggcaggaaccagcgatctggatgtgtacgtgcaggtcacaggggatatgatagcttagcttgggctcagaggcctgacagtatcctaagattatttcctggtttaatgtgaccattagtgcatttgttcagcatactccctgaagtcgtataaggcagctcttcccattaaaacaaaaggcataaatgggtaaattgggtacagttttaataaatggaacttaagctctcataatggaattgctaaatttcaacactggcattgctactgaattaaactaggaaattagcaaatgcatttaaacttttctgtttactgagctctaaaagtgggggaaatggcatatgaattttaaaatatttcttagagtaatggctttaaaatgagtcttcagtgaattcagttggcccttagtacaaaatacgttcttataaatattgatcagaaaataatctgtaataatatgtactactgtctctcccaaaaagctcttaaagataaaacaaatttccacttaaaataaaactttcttgatttcattctgcatttattttggaaaaggtgagaatctcataatcaacagtgggagaggagtttgggagaggaggttcttcataatgtcagaaaagatatcaaaggcacattctgttgatttttttccttgctaaaatgttttataatgtcatccaggcaaggttatcatgataattttttagaatgaatgaaaagatattctagaagttgctctgttttgttctccaaccctttggatagaaaaggcaacaaaataagtgcaattttgttccttttttgccaacttgaaatcttactttgacctctagattcaccagccttatgtttctgggcaaccccccacatttccttgggagcctctcaaactgctatcatttacccagcaacaaggacagttctaggcctagacaaatggcatttgcagtacctgagaactagccaagacctaatggtctctccccacatctcattggcaggaacgttcattcatttttccccacgtccacttcttttccatgaaagcaagccctaaggcaggagatcaccttctcattacccaacagcttgattctctacatgatcctctgaatgtcagcaggtgaatgtctggctttgcaagtgaaaggaaaagctttggtctttttactcacaggatcctggttctccttttgcttctccattctttttctttccccatctcttccctcttccctcctcctcttcctcttccttctccttttcctctcctccttctcctccatcttttcctcttcctccttttcttcctattctttccatcagttttttccatacttattactgtatttctcttctttcactttcagtctctcttttgctctcctccttattcttttttctccttcttactctctttctgacatacattttcataaaccatcatttaaagaatgttgttttgttttctcattttattttatttttacctcatatgttctaagatcctaaaataatacaaaacacactctaggaagcactatattattaatgaaattaatttccattgaatatagtactgaagcaggcctaaattgtatttcctttatgagagtattactgctaatgtgctgttccataggattttacagcgatctaaattaattacgctgccatctgtgtagtatactccaaagaaaaaaattaacaccattatttacaaattgcatccagtttaagcatagatgatattttgcctatttgggtaaaatatttttcatcatgtgcaaagaaacatgggatgatccaaaaaataaaaagactgcatctatagaaagagatagctacctttttaaatcatgtaatatgaaataatacacaactaaataaaattacaatcaggataaagagatacatcgtttaactacacacaaaaaactgtttgagtcaaatttgtttttctaaatatcagaagccttttgagtgtacagagctgacattattgaaaagcagtagtacatttcaattgatgaagattaagcatgatgaatgctagattgtctcagatgaaatcacatgtgctggcagaacatctgttacagcctcccttcttgttattttattgcaaatttacaacctattgcaattaaaataacatgattaaaattatagacattttgaataaagggtaatttatagacctctctaaataatcaaacctattttccaaatgacagaaattttaaaaagaaaagatttttgaacccctatatattgcttttcattacaaagaaacactggcatttagtatttacattcaggcatagctactacagaaaaaaaaaaaattcactcccataatcagaaacctgcaatactcactagctacatttattagagctatttcacagggacctaacattggtttctcttgttcataatatctataaggtccatctcaatggtcaacatatagtagataatttatttaatatggttttagtgaatgcttgacttaatatgagtgaagtattcataaggacatatgttttaggtgtgcacaaatatgttagctaaaatcacttcaaacagaaatatgctatgaagaatcacataatttatacataaaggtgtgtggaaatggtaagggtaaaatttaatttttataaaaataatctctcatataaatccagttccctgtgatcattgtctgtaacaattaaatgaagtctatagtactaaatcaactccaaagacaagtctgtaagaatcatctgtaaaccatagtttgattgtttgcatgtctttaaaagttctgattccactatttatttaccttaaatcaaacttttttacagacaataatcacagatttaggtacaaagataatcaggctttcccttgtaaacaaggcctaaaatcagttgtcagttggtcaaacccaaaggtcatacctatttgatgcaagaggctggttagtaagggtggggaatcatggacacagattgattgagtttaaactacagtcatcaacctcttgacctcaacttgtttgtgccccattttcttcacctgtaacatggacataaaatgattcctacttattaagattcttatgtagattaaatgtgacaatgcaggcaaaacattaagcacaatgactagtacttagcaaatacccacaaaatgattggctagcactatgattatgctagaaaaaagattgtgaaggataaagaagaatgcacaggaaagaggagacaattagaaagctctaaataactgcttatttttggattcaagttttagcaaagatgaacagaactggcagagtaagacaacttttggaaatgaataaatcaagagataccatgtcaccagcataagctcgcacaggcatcatctgacagattaaaaaactaaaaggaaaaaaatagataaaaagatagccttacacattcaatcgcttacttctgaaatgaaatatatccttagcctaaggtaatgtatcagtgtttcagcaaaaggctggtataggaaataaggacatatgaacaagaaaatgcaacaggaaattatttgttgaatttcaggaagctatattaatttttcacttttctttgtgtcatagtgacacaaaccttgcagcggtgtaaaaaaatatttactacaaaagattttgcaaaaataatcattaccaaaatgaaaaaggacttctcccataaataaaatgtttaatccatttttagtctgcttattgtcctcctagatcagttttaatatagtattcatagattctttagctattatattaaccataaatgtcaatataacaaaccacacagaccatgtaagagttagagctattgaatatcacaagctgttctaatgcaccaaaattaaatgaaaattaaggaatctattttatattgctaaaaattatttggctcagtagtaataaaatgcttcactaaaatattttgattgatctccttaaattaagaattttcaaatattcaatcaaaaatattctttcctcactctagcacactggaaaggacattagattaaaagcggcacagaataattgaactaaaaggatttttttaaggaggtggaatgcatagtggctacaaacaagactgcttacctcaaaatctggcttttccacttacctgctgtgtgccctatggttagttatttaatctgagtgacaatttcatcttctataaaatgagaaataataaaaattatataggcatatctcagagatactgcagatttgtttctaaactgttgcaaaaagtaaatattacaataaagcaagtcatgcaaagtttttggtttcccagtgcatacgaaagttatgtttacattgtactgtagcctattatgtgtgcaaaggcattgtgttattaaggtatgtaaagaaatacagcattaagttgttaaggtatgtaaaaaatacatatcttaatttagaaatagtttattgctaaaaaatgctgacaatcgtctgaaccttcagcaagtcatgatccttttgctggtgaaaagtcttgcccggatgttgatggctgctgaccagcatggtggttgctaaaagttggtgtggctgtggcaattccttaaaaaagaagacaatgaagtttgctgcgtctatcgactcttccttttacaaaagatttctctgtggtatgtgatgctgcttgatagcactttgccaacaagggaacttctttcaaaattggagttagtcttctcataccctgccactgctttatcaactcagtttgtataatattccaaatcttttgttgtcatgtcaacaattttgagaacatcttcactagtggattctgtctcaagaaaccactttctttgctcatctgtaagaagtaattctttgtccattcaagtttgatcatgagattgcagcaattcagtcacatctttaggttgtatttgtaattctagttttcttgctccgcagttacttcctcccctgaagtctttgaagtgttgaacccttcaaagtgatttacgagggttagaatcaacttcttccaaattcctattgatgttgatattttaacatcctaccatgaatcacaaatgtttttaatggcatctagaatcgtggagcttttccagaagattttcaatttactttgcccagatccatgaggagaatcactgtgtatggcaggtgtagccttacaaaatgtattccttaaataataagacttgaaagccaagattacaccttgatctatgggctgcagaatgaatgtcgtgttagcaggtataaaaacagcattaatctccttatacttctccctcagagctcttgggtgaccagacacgttgtcaatgaacagtaatattttgaaagagatcttttttttttttttctgagcagtacatctcaacaggagcttaaaatagtcaataaaccatgctataaacatacgcattattatcaaggctttgttgttccatttctagagcacagatagagtagatttagcatattcattaagggccttagattttttgcatggcaaatgagcattggcttcaactgagagtcaccagtagcattagcccctcagaagagagtcagcccgtccttggaagctttgaagccaggcattgacttccctttagctatgaaagtcctacacggcatcttcttccaaaagaagaaggctgtttcatctaccttgaaaatcatttactgtagcctccttcattcaatgatcttagctagatcttctggataacttgctgcagcatctacatcagcacttgctgcttcactttgcacttttgtcttatgaagatggcatttacctaagtcttatgaaccaacctctgctagcttcagacttttcttctgcagcttcctcaccttcctcagccttcatgaaatggaaaagagttagggccttgctctgaattaagctttgacttaagtgagcatagtggctgtattgagcttttcaccagaccactaaaactttctccatatctgcaatgaggctgcttcattttcttatcattcatgtgttcccagaagtagcactttaactttctttctagattttttctttgcattcaaaacttggctaactgtttggcacaaaagacctaactttttacccatctcagcttttgacatgtcttcctcagtgaacttaatcatttctagtttttgatttaatgtgagagacatgcaattcttcctttctcttgaacagttagaggccattgcagggttattaactggactaatttcaacattgttgtgtctcaggaaataggaagaaccaagaagagagaaagagatgtggaatggccagtgagtgaaagagtcagaacacacacatttattgattatttaccatcttatatgggcatggttaatggcaacccaaaacaagtacaatagtaacatcaaaaatcactgatcacagattatcataacatataataatgaaaaagtttgagttcttgtaagaaacacaaagtctctttgtgacattttggtctatggttgtcattttttccaatagcctgtgttattccaataccatatgctattggaaaaaaaatggcgcccagagacttgctcaatgtagcattaccacaaaccttcaatttgtaaaagaaaatgcaatacttgcaaagcctcaataaaatgaagtgcaataaaatgagttgtgcctgtatctacctcacagatttggtatggtgattaaattaattaacagacatacagcatttagaatgccacttggcatgtaattcatactcctgaagtatttgctactggtaattctggaattcttcacttaaagatgatggcaacaaacatttgaaaccatgtcaaagtgtaaaaaaatatgataggacctttttggatgtcaggacactattgctcagagctgtatgtttcaatttattatctaaaaatgttttttcctaatctcaaaaatatttcacttgaaacaaagattttgagatgctcaaagaatctttcttgaaataaatatcaagacaaggcaacaggaaatactttattaagaatgtcttgagtaaaccaatgtaaaacaagaactttcagatactaaaattaatttcccactcatttctttctatctatctctgtcgcccttctgaagctgtttttcttacatgatcaggtaccttggctatggtctagggaaaccacaggtttccaacttaatccacataattcctgcatacttgacttagttatgtgtcactgaagcagaaggttagaaatgatctaattagctacttcatgaagtggttagatatactatgaagagaaattctgagaaaaagagtagtgatgaaagaataagtatattaaaacaacctcatcgaccactggcaacaaatgcaattcggggaagtaaggtgggaatagaaaactaggttgagactgactcagttgtattgttagattcatgatttggcaaaacaaaagaaaagcaagattagaagtgatagcatattaacaaagtatactcttttatcatatacatgcacatttacaaatatataaacacatagacatcttgtaaactaaaaacaaattcctaagcaccccattgccggaactgatcccctcttggccaaggagaccccaaagaaaccttaaaaactgaattcctggctatgatgagatgggaggttggacaggtttcattatacccctgcccttttggggattatacacaacaactgaccagcattaatgttaaatagagatcataaaactggctgaacagtctcttcgtggcaataaaataccaaattttaaacagcacctaggcccatgccacacaagggttaagtcatgcacccctatacttaaagaataaaatatgttttaactgcctggaaaagatcttatgattcatgtcttatatcctgtctttgagtaaagaatcttatcgtgagatgttcaaatctgatcgtgagttcctcaaattgttgacataccgattaatatgtaacctactgacattgaaaaggacactaatttgtttctaaatcataaagttttgctgatttctttctgaatcatgaagttttacttattgtcttgtgcataaaacatttgagcctgtaagatgttatctgtagccaatgattgtaacctctggattttaccctccaatgaaaaaggacaactccaatatgaggagtcaccctcccttcttctaaactttcttacaaaagcattccaacttggaacaaactttggaacacacccacctttgttggtgtgtctttcttgattgatcctcaaatttggctttcaataaaattgtataattttttttctgcttcaacagtcttaattttgggcaatggtctgaaaatttgaattactgaaagaaaataactgaggaaaatggttttgcactctgggttttccaactacaaatgtgtcattaacttctagtaaaacagctcatacataggaaaaaactgaatgctttaaaatgagagcatacagagaaagaaaatgtgatatgaaattattttctaaaataatttggtatggtgactaaattaattaacagatatacagcttttagaataccacttggcacataattcatactcctttatattatctttatattattgtataaatcaagacatatttggtttcatttaaaactgaaagtaatcaatatgaattacaacatgtctatagatttaaaatatttaaaatattattatataaaaatccctgattttgagaacaatcccaatgtaatatttttgttttcatgctatgtttgtccactttactgtgacaaaatattggaaaaaagattaaacttaactcacaatatgaaagaaagatcaatttacttgttagatgtaggaattcaaatctcaggccacaaatgcagatgtcaaatttatttccctttcttttggtacttatcccctccaagctaaacctaactcttgaactcatggctttttttgcagtgtataccacacactgggaagtgtaattcagtcactcctgtgaaccctcagtcccccaccttcttccttcttttttcttttttttttaaccggagtttcactctgtcacccaggctggagtgcagtggcttgaccttggctcactgcaacctccgcctcccaggttcaagcgattctcctgcctcagcctccagagtagctgggattacaggcacccaccatctcagcctggctgatttttgtatttttttttttttttagtagagacggggttttacaatgttggccaggctggtctcaaacttctgacctcgtggtccccctgcctcagcctcccaaaatgctggattacaggcgtgagccaccgcacccggcccatcttcttccttcttatgtttgcctttcttttggaaagtagctcttccaagcagaagactctctagatctttgggaataaaaaaatgtcttcagttgatttgatctggtcatatgaatcttcatgaattaagagacaatacaaagagtggatgtatatccaaaaaaaggtcaacattttttaaatcattcaaaaaaatttatttgaatattatggtaagttattatagatcttaagccatgaatggactgcacagttaattccgtggtggggaggtatgggggaagaaaatatcaatacataattgcttttatactggggagaatatatacccgcttcaagaaaattcccataaataatttctcacattgctttttaaaattattaggttaattttagaattcaaaacccttcaaatagtgataagctgaaggagaataagatggtaactatctcagtatatttcataatctttgacagtccagaaaccctggatgccattatatattaaaaggggacccagcatttcacttacctccaagtttattttccctggcaggaaacaaattaatgtataaccacattgcaaacttaggtaatgtgcaaatgatccagttctgttaacagtagacatgaaaagagaagagtattttgtggggagtgttggtctggagtttatcctgtccctggacactttattggatgaggggttattatgtaatgagaagctcattatattttgaggcacataaattgttctcaatattgagctaagactcatttctccattattttcataagttagtttaattctgtcatatagagttctgtagaaaattattttcagggtctaactactgcttgtcaatgccccttttcgagcgtcacacccagaagcgcgtgctgtgctgcaaggccagttcaaatgtcatgtgggaggatgctcaggtgcttatgcccaacaggagttgtcaagggcatcaggctcttgacattgagattgccagtggccacccctcaacatttgagtttcccaggaagtgtcaccaacgatcatttgagataggacatcaggctttttttcctactactgtagcaactgatatctaaaatgagtctagagccctttcacattagttaagactgtgcataaatttaaaaaaaatcactgaacttaatggtaaaacagcaattgtagtaaaacacatttatgtgattaaacatacaacataaaataataaaaaatgtattgttatgaagtgaattgtgtccccaaaccccaaattcttatgttgaagtcccaacccccagtatctcagaatgtgattgtgttaggaggtaaggactttaaagagatgattaatgtgaccaatagtagaaacaaaatttttaaaaaataaaataaagaaatgattaagttaaaatgagttatttagggtaggccccagtccagtctgactggcatctttataagagtgatgttcacagaagaagaccatgtgaggacacagtgagaaggcagctggctgcaagcccaggagagttctcaggagaaaccaaacctgctaccatcatgatcttggacttcttgcctccagaattgtgagaaaataaatttctggtttaagccacctagtctgtggcattttgttatggcagccctaaccaactaaactttacaattcttgctttcataggagctgtgtttattccacagctatagagatattttgattcacatatttagtaatagcaggaaacttcactggagcttcaggctgaaaacattttggtacttctttgaaatgcctacaaagaaacatccgagtatttcatcatattaagtcatcttatatacgtataccacacacatacatatatatgtgattataaggtttttataacattatgtctctgtctatatcatctatagcttatgtatctctatgtaaatatccccaaaaggatgaattcttttaggagagatgatgtaacttatttatgtcagcatgtaagttttataagtatttgtctaaatttggaaaacactgtgaatattaaaaaataatagattgcaaagataatgatcttatccatgacgaatacctcatggacagttatggggatgtgataataccactatcttaccaaagcaatttgccttctctagccaattgctagagcagcattttaaaaagtgctgacaacatacttacacaattgcctccaaagtaacaaccttaatgagaaatttctatctgtgttttgatctttccatagcatgatggctgccctctttcagtgaattgcaccaactcatttgctcatgtatgctgataacaccatgctgtcaattctgtattgttggacctgtctattttatttgacatacttgatcatgagtcctcgcattctcatagagcatatgtcactactttaaatagggcttgttttttgctcatgcagtatacatagtaccttattgttaatattgccaagcattttcccatttgccattaagacccatggagtttaattcttgaattaagatgtctctggaattcatgaatctaagttatatttttccttccaagaccatcattctataacagtttcagttgacattgttatgttgttgataaatgagtttatttttcatctctcaaaaagcaatttaaaaattaagtacctgaatgtcatttgtaaagtaaaattgtgagcatccatccatcatctgaatggtgcttcataattcttgctttcaaatgagttatgtttattccataggtatagggatattttgattcatatatttagtgatagtgggaaacttcactgcatcctcctgttgaaaacatttttttggtacttatttgaaatgcttacaaaagtaacatctgagaataatgtcatattcagcatcttatatatgatagctatttaagagactatcaggtatgcattattatccctattttacagaggaatttactgggagactcataaaagttacattatccactaatctgaactagatgtcaaaaggaatatgtgaaccacgcctgataccaaacctacacttacttactatgctacattaacacataactctcattcaaatagttgtgcatgaattctaattgggttttgcacctgaagattcattattttaaggttgatgtcattcaatattccagctttttaaaaagttatttaaattcatacagctggctgatcatgtgattcaaaacaagtcttaacaataatttttcaagccctatcataatagaaaaaagttgatattttgtttgatactaaaattaataattggtcagtgtaaaaaaaattaagagagtaagaaggtaacctccaaagggaaagagatattctgaataaaatatgtatatccaacaaaggatttatgtttataacatataaaaaactcttacgaatcaataagaaaatatagctgaaaagaaaaagagacataagtcctctaccagggatttgacaaaagaggatatccaaatagacaatgaacatgtaaatgaatgcataacattgggaaatgcaaaattcaagcacagcgaaatatgagtacataccactgaattgctgaaaataaaatgcttgaaaataacaagtattgataagggtgaagagaaatgaaattaagaactttcctgagtgcagaagttagattcaaaggcccggtgcagtacctcatgcctgtaatcctagcactttgggaggccgaagcaggtggatttcttgagctcaggagttcaagaccagccttggaaacatggcaaaaccctgtctctacaaaaaaaaaaaaaaaaaaaaaaaaaaaaaaaaaatatatatatatatatatatatatatatatatatatatatataagctgggcatggtggcacatgcctgtagtcccagctacttatggggctgaggtgggaggatcacttgagcccaagaggtcaaggctgcagtgagctgagatcacaccactgcactccagcctgggtgaaaaagtgagacctagtctcagcaacaacaaaaaaagcagttagattcaaaatatagtatttgtcgacactcatttttcagaaaaggtgtggtggggctgaatgcattaatatttggaaaaggttcctcaatcaggaatcatatatgagagctccaaacagtagtaagcatgtcccaactattttcaagatatgctaatattatgtctttattcttttctgtgacagctttgagtgactgtggaataatcaacttgaatttgaatgtttttctcctacattttatgatttcttatgtaaggctgatgtgacacttggaaaagtttgcaatgatgactgacaaaaacaattttaccatatgaacatctactgtgctttgattttatcgtctaaggcagggtttttattttatttttatttttattttttttgagatggactccctctgtcacccaggctggagtgcaatggcgtggtctcggctcactgcaacctccacctcctaggttcaggcaatcctcctgcctcagactcccaagtagctgggactacaggcgtgtgccaccacacccagctaatttgtgtatttttagtagagactgggtttcaccatgttggccaggctggtctcgaactcctgacctcatgatccgcccacctgggcctcccaaagtgctgggattacaggcgtgagccactgtgcccggctgggtttttaattttttgtttgtttgtttttggttaggaagcatttatgtgtaaagtgtaaacaaataaacgttaaaaatgtgtactaacctggttgtaaaggtggtttgggaaacatgtaaaccctgcttgctttgcctgcttcctcagcagggatgatttgaaccacataccatttaattatatctctccagttacttgatgaaaaaaaaaagtttatctgaatcaccagtgctcctagtgtttttgagcactttcttcaaaagtaaagtccctggaaccctcaggaaagtcattcacaaattcccttaagaaacactaattgaagacactaaactctataataaaatgtattaaattatgaattatcactataaatgagaggttttgtgagtataattgttaaaagtaattttcagttattaaaataaaatcataaaacttaaaatttgttttcaaattttttatcttcaatctctgtgattcaaaaatctctagctagcctgtacaaaaccagtgtcagagaacaaaaaaaaatgtcatcttgcttctaatttaatgcatggtttctgcagcaaggagactggcctctggtttcagccctgtctgtgattgggtatgcacctgcatgagtaacttgaactctgcttcattttctcttatcaaacatgaccaagagtcaagttaaataatgtataaagacttgtggtaggccaaataatactccctaataatatccgactcctaatccatggaaactgtgaaagtcaaatcacatggcaaaaaaggactttgaaaatgtgattaagctaaggattctggatgaagagattattctgtatcatccaagtgggacttaagtggaatcaccaattttttttttttataaaaaggatatttgattcggtagagacaaaggcaatgtgccatggaggaatgcagccacacggaatgatgcaaccacaagccgaggaacaccagtagccactagaagcctgaagaggcaaggaacggattctccctggagcctaccaagggattatggccctgctgacaccttgcttttggccaagtgatactattatactttcaaactgcagacttccagaactgtgagataataaatttctgttgttttagaccatcaagtttgcagtaacttgttatagcagctacaagaagcgaatagaagacccttccagctttaaaattgtatgggtggcaaaacaaactgaagatgtaaaaatcaataggcatttagaataacttgctttttactaactaaaattctaaagtacaactgagcattaaaagttctgggcttcttgacatctgtgactctgattggttgagagatttgctctgatttttttacttaatgggaatgcttgttacttgaaaaagaaaagcagtcatttgctactagtctgtaactcagctaatctcttcttctgatcctcttcttttgactactaatttttagaagtactcagagatcaaccatgagtattattcttttctatttttacccactcagtctaggtgatcatagctattcccgtggctttaaatgccttctgaattctgatagctccctgacttacatacctgaacttcagattaataaatccaattgcgagattcatagtttctcttcaataactaatggcatctgaaatttaaattgtgcattaaaaagactcacttttcaacttgcacacttctatctgtgctttctccagcatttcctgttttaataagtggagcctccatctaccaagttgctccaagcaaaatctgagagtaatcctcaatacttccttttccaccaccgaccatgttggattcatcatctaattttgcatattatgtctcaaacattttctatttaatcacatctctccatctctagcgctatcattgtctctagcccggactcctcctaggtggtcccctacttctaatcttgcctgtttccaattcattctcaacatggaagccagtttgatatttagataagtttacttgcctgcttaaacactctaatttttaaataaataaaatccatgcgtgacttagtcccttcctctttctccaaactcatctcaaactctccatcttacctcatacctattataaacactcaggcctttcctccgttcctctaaaacttcatttgtttcctgcctccaggtctttagactgatatttccttctgcatggaacactctcccaaacccagccccagctatgcatgacttttcattactttttcaacttaaatttcacctccttaggtaaaatctaaaattttcctgattcattcaatgcaaaaaaaaaaaaatcctccccagctagtgtctatcagggcaccctttctgttcctctcacagcacacattaggacttgttgcttcattttatttatgtatttattacttgactgtatccattactaggccataagtcctatgggaggatgggatctcattagtcctttttaatgttttgtttttattatattttgcattttgttaaagttttacatgcatagaaacttttgaaagacaaataaatggttctgaaggtcacgtttgtatccctatttcctgagatttcagtttcaggaattatttggtcacctgctatttaggaggaagagcagttaactttcttcccccaagccccatggacatacacccttgccaccaccaaacttaccaatgtagctagatcagatgttggattagattaatattttatgtttacattaggacgattatgcaaatgttagtcacagatgagttttctctggagctaattatcatgctttcatttgcttgttttcttagttttctctgtactcaccgctaattcaattctaaaccctttgccgattgtctaaatcttcgaaatgatcagacacatgaatcattctatgaatttctttttttttgaagaaatatctctcctctctggctccaatctgggttcattgccctctaggcctggtgaacagttgtcatatggagactcttcttactcccatagtgaagattcccttatgtctctgcaaacggaagctattccatgttttcttctttcttgttttagtccctcattttaatgggacataattctttgctatcctgcatgactgagatactttaattctttccttgtccttgattgaatatggattgatttcaaatcctcaatttaaaatcaatttctttcagcaatctcagcacatcgctccgtgactttgtcagtttcttacatggttatagagaaattcaaagtaattttgacccatcttttgttaatatcccttttgttttttccctctctctgaaagtttacagaaatttctctttgtccgcaatgttctggattttcacaggttctgaatgtgcctacagataggtttatttgtatccattaatttgaacactcaatgaaaaaagggaaggatgagagtaggagaagatatatttgtaactgaggtggcaaaattgaggtaacttctggtgaattttatttttctaatgaggtaaagtcatctactaagggccaaaagaatttttgaaaaagttgttcaggtctattgaggagactgagagattgcttattaggcaattttattctaattcttcattaaacaaatggaactcattgatttcttcttgctcaataacatctttttctttcagatagaagaattccctttagcatttcttgtagaacagttctggtgttaatgaaattcttcagctcttgtttgtctgggaaggtctttatttctctttcatggttgagagatattttcagcgactatactattttagggtaatttttgttttccttcagcaccttaaatatgttacgtaactctttcctggcttgtaggcttccactgaaaaatctcctgctagatgtattggagctccattgtatgttatttgtttcatttctcttgctgcttttaggatccttgcttcatccttgaccttttggagtttattagatgtcttgaggtagtgttctttggcctaaatctgcttggttttctatgacctttatgtacttgaatgtagacatttttctctaggtttcagaagtcctttgatatcactcctttgaatatacattctaccctgatcttgttgtctaccttctctttaaggccagcagctcagatttgcccctgtgtggctattttctagatcttacaggtgtgcttcattgttttttattcttttttcttttgtatcctttgactgtgtcttttcatacagtctgtcttcaagcttactcattctttcttccacttgatcagttctgttattaagtgattctgacgcactcttcattatgtcaattgcatttctcaactctagaatttctgtttgattctttttaattatttcaatttctgtgttaagttgatctaattttgaattccttctctgttttagcttgaatttctttgagtttcctcaaaacagctattttgaattctctgtctgaaaggtcacatggctctgtttctccaggattggtccctggtgacctacttagttcatttggtcaggtcatgttttcctcggtggtcttgatgcttgcggatgttcattggtgtctggggattgaagagttaggtatttattgtagtatttgcagtctgggcttatttgtgccatcttagttgagaaggctttccaggtatttgaagggacttgggaccgaagcctaatatcgctgtgttttttgtagactcatagaggtacagccttggtggtcttggataagatccagaagaattttctggattaccaggcagagactcttgttcttttcccttatgttttcccaaacagagtctctctccatgcttagccaatgaaactggggtgtggtgatacaagtactcctgtggcctgacatctatacatttaaggtatagtgaaattaaacatggacagatctgatttaggcatcattcagtaatggataatccttgcctgttcttcccacatgtatatcattttataagttacagattttatagatttttttttttttacagatcacaaatataatttaggcccacaagttcagctacatttcctaaagtcaacagaagaatgttggtaaccactgataaaacataaaataattaagatattataatttactaaatagagtgagtgttttacaacaaattcaaataatatgcaagtatagttacaatgaagttcttgttaattaccaatactttcttaattagccatggaaaatacctcagtccaactgaccaaccgttcttttttttttgagacggagtctcgctctgtcgcccaggctggagtgcagtggtgcaatctacgctcactgcaagctccgcctcccgggctcacgccattctcctgcctcagcctcccgagtagctgggactacaggcgcccgccaccacgcccagagaattttttgtatttttagtggagacggggtttcactgtgttagccaggatggtctcgatctcctgaccttgtgatccacccaccttggcctcccaaagtgctgggattacaggcgtgagccaccgcacccggcctgaccaacagttctataaatattttttgttctttcatcttctgtttttccatttcatgatcattatattctacataggaatttgctaaagcaaaatttccttttatcagaattgatgagaaaatttcaaaatttctcagcaatttagaaacgatggatctttaatgagaaaatttgagtttgaatcctagttctgtgtccttctgaatgatgtagcccttgttgtcctagggctctgcaatgcaaaatgggactatctttcagagctgtatgaggatttgagataccttgcatagggctgggtgcagagtagttacctataaatgacggattattttttcattttttccctttaattattctaggtttaatcataaaactacaatgattttctttatcaaacagattttattaatctcattttcattgctctagtcctttaataagttgttgacacaaacatccataccagaaaagaaattgtaaactaagggcctgtcagatatgtacacacaattgacaaattctgtgaatatgtttgccacaaaatgccttctaccacagctgaagtagagtttgcatcagcacccctaacattcatgggaaaagaaaatctagactgaatgtggccttgaacacaactaataagaaaaatgtcctgtcgtctatcatatttagttcatctttgctatctcaactgcagatgagctccaaagctgttccttttttaaattctgtattaatagtatttcattgcttaactacttcagttcacaagcataacctggagtttcctcaccccttgaaatctattaagataaatgtaaaccccattctgtgcccgtgtataaataagaacatttgctaaggtttatgaaaattgtcaaaggtttacgttcaaatggccaaattctggttccagattccttgtaaacatgctacacaacccattcatgaatctgaagcttatacttagtttctgctaaaattacatcattcatgtaagatgctggatgaagaagatctataaagacttctgtgggggtggttgagttgaaaaagatttacactgaagcaacaccaacaacttccactcagacactgacaaccatgttctttaaaatccttttggctcccatgctatttggggcttttctcttgcacttagttccacagattgccaatccttcaaccatcatactcggtacttcccatccccaccccattttcttgagtcttttttttttacctctaattcaatcccttgaattgcgttagtttactaaagaagacttttcatatcttatgtcataatatcttcatgtcttgcatcacagtgtgatctaaagttcttagtcagcaaaggtcattaaattccctagaaactgttagtcttgctttccgtgttaaaaggcacatttgaacaagtttggtctttgcagcgggcattatgatgtgtcactgagctcccctttcaggactgatcaaccttttccctgggtagttataatattgttgctgtgagccctcagctactggccttcttcagaaattggctcaggtggagatagtctccttgcccaagttcatgctcccattctaggagcagtacacaactaatgactgatcgatgtggaggtataaagatcttggttccttgcttaaactcagaaactttgacagccatatcagtctcagagctccctgtgggatcagctgactgagctgaggtccttgtttaactatgtcgtggcttaacctctccctctcctccatcctggtttcctcctactgtaatctaaatgtttgtatccccccaaaattcatacgttgaaatcctatccttcaatgcaaagggattaggagatgggggtctttgataggtgattagaccatgagggctctgccacccttataaaagaaattctggagagctccctcctcttttccaccaagtgaagacacagtgagaagacagctgctatgaacgaggaagcagaccttcaccagaacctgatcatgctgacactctgatctcagacttccagcctccagagctacgagaaataaatttctttgtttagaagccaacaactctaaggtattctgttacagaagcctgaatggacctagatgtttccttttctttccatagtcgttaatccagacactactttctaacaaataaaaggatcttatctcagagtctgcttcccagctgcaacagtcctttggtagttaggaatatgcaataagtaggataaagatgtttgagatggaaggaggaaataaagagtgtggagagacataaaagacaataagaggctaagaaaagcagtgcagatggaagtaaccaggagtttcaacacttaagagtgaaaatttcagtcgtggcatcttggtagaatcagtctgaaaacattataggacagtgagtagcaactgatggagatacaagagtaagaaaggaaatgattcaaataggaaagttttattgcactatagaaatatctctattgtagtcaaaatagcatagtagatttatctttgtgtttccagcagttttgaggtatataatgtatacttccttgagacatgattttcggtttattcattagaaatccaaagatttttacatcttatctaactatagaagcagaggataaatgcctgattataaaaatcaggattattatagcaacctatttgaaaaacaattctcaagtgacataggctgcaaaaaccattgaaagatatttccttggctttggtcacggtagattcacatctggcatttggtcaatcactcattaaatattaactagctttatttatgcaatttcaaggctccttttaccctttgaaaggtttcaaatgtgcatgtaacagttgatgacatattaactatttaagtaaaagacacttgaaaacagcaagtacaaaaaatcactttgaccttcatgttgttttttaaaagcaaaggatgagattcccatgtgaaagacatgaaagaccctcttgatatgagaaagaagcaacatctttatttttcaggaagagaagtcaaaagcaagagaattttgtacagactttgttgagatgtctcttatcttttaagcatcccacataacttagctgtttcttcataacttactattctctgtccaatccaatatataagtaactgactcaaactgctcttcaggtcttcattttttttatgagggctttcatgccacataaaacttatattatgcttttctcttgttaattttatgttatgtcaattcaattctcagacttagtcagaattctaagaggatggaggtagagtttttaacccctacatcttttaatggaaaaaatggaaggaaagggaatcttcaaaggataattaggttctttctcactgatctggagattgcttatccaattaacgcaaatttcttctcttttcatttctcttcactttaagcatgaaatataatagaaatagtgaactaactacaaagaaaagcttttttgttctcagcatgaaatttccttccaaatagaattatccagttaatttatattaatataaacaagaaatccgtacaacatttaacatttcctgagtctgtaacttcagttatttaaaatatataaaataattttcaaaaagcttaactctaaaactgaagacttttgtatacagaaagctatgcgtatgtctagttatagctaaaacatgctgcacagatttggcaactaaatgtgccaaaggtttgaaaatattcaatgacaatgcaaaaattaaaaatattattaactttgagaataataacatgcctcaatgaagtaatataattctttttttttcaatacacatctgagcctctgttgcatgctaagcatttgtccaaagggtttcagaggtaaatgtgactccctacctaaccaacaagaactcactttctagtgaggtaactaatgacaagttagctatgtaatacagtgataaaagtaccatcatagggaaagtaggaaggacctaattcatcctgaggaatggggcacaatcaaagaacacttttttatggagtctaaaaggatgagtcagccatacacctcaaggtgggtggtgaaatgaatgaataagacccggatagggaaaaggagggagatatacaaaactggaagctttgagggatcctggcacatgaaaatggcgaatgtttctatgtcattggacaaaaagctgtgtgtgtataagtaagtatgtgtgtgtgtgtgtgtgtgtgtgtgtatacagggcagctacaggggaaggaaaacaattttttctttaactcataaattcttagttggaaggaatctctgtaatgaaagacagataaacaagaaaaaagcaaggagaagtttatttacaagtatatttcatatatacatgggagataacgagagaatgagtaattttccaacaagtggttttgaattccagcttatatagcattgtcaacaaagaacagtggatttttagagaagtgaaagacaaagcaaaaggactttgagtctccagggattgcaacttgtggggaaagacaaataaatggcagataaaggctattagtaaagcttgttaatacagattcctctggtgccattgccaggtccatagtggtcaaaagttgtctgtagttattaaccttgtttttccctggtagggataccttttgtctttgtaaatctatatcctgcttttaggtaaatagagggagggcagagaacgttcttgcacctacttttaattgccttcagttcaatagtctttcattttttggtgtggcatagtctgttatcccacagcagctgatgagttcgaatatgcaatagtatgacactaatgaagggtcttatatgctctgttaagaattttaactttatcttgaattccatgcggattcaatgaaaggtatttcaagaatcagttactcaggaaaagaagtagtttgaacttttagaaactgtttgaggttaatcttttccagactaatgaatatgagttagtataggggtgtgtcctactaattattctggtggccatggttacacacaacacagaagaccagatctccttagcctacaccagagattctcatgtgagaattgcccgaatatctgctttaatgaatccaaaaaggtctctgtctctgagtcccagctacttgggaggctgaggtgggcggatcacttgagcccgggaggttgaggctgccattattgtgccacagcactccagcctgggtgacagagtgagaccctgtctcacacaaacacacacacaagtctttgaatatgggcattttaaaaaaaactctaggcgatgttagtgggcagtaaaaatgaaagcttctaacttgcttttggtcatagaaggaaaaataaaatattgggaggtttataaagaatggaaaaaacatcaaattgcagtgttcaagtatttaagatgtttgtatcccctcagagtctaatgcttactaaatgtttaaggggtttagagaaaatgaatgcattttcaaagaaggtttatgagctaaagtacaacagttaaagttggagatgtagtctgtcagtctcccaagacactctaagcacaggattcttcaaacgttctatttttacatatatgtgcctttgttctctagaataacattttttagactactcatatggaaacatcttaactgtgtcttgaagctgtattgctgggtctttctcagcaccaacttcacttcacttccaggaaagaatagattgttccctttgtttggcctttctagcacatttttattactctgataaagcactaaccacattgggtcggctttttttgctggactgtggactccatacagagtaactcacctagattccccttgtagtgtctaacagcaaatgtttgaaagttgcaggttatgtatgcaaggatgcgtaatgggaaggtgagtgagcagagatcaaagaggataaaggttatttaagaaatgttttgcttgactaaaagaataaacagagggttgaaacaaaaggagcactgatttttatacaatattgatatggaggaagctcatcacacttttctatctgtgatattgatttagactggtcctggatggagtgagaaagtatatcggccccataatcctgcttttcatttgcaaaaaagttgtgtggagtacctgggtaaacaggtcctcatggaaattctcaaagctatttgtgatctagataattacttggtggaactcagaatgattcacatacactactaatattttgtggcttctactgagtcagaagttttttttcttctaacaattttttctttttcctttttgacatcagacattgggaatcacagacaagcaagaaagggaaaactcaaatacgtcttgtactgctttggataggaataacaaaagacaaaaacaaaacaataccactatttttggtatattgttccatttatatgcctgaaaatatatgttcagacttggtttctaatcacatccatggaagtagggcccatcatgtcatatccacacctattgatgtggataatttgggtaagcttgttttcagcattgtctttgatttttaaaatataatttcttgctggaactacaagtatcaaatcaaatctattctttctttttccctaatatatgttctgattatgttaggcaagaagtaagactagtctatcttctttacgatatcagcacctctatcatttgaagatgatttttgaaatgatacaaaatctgcatgctatgctgtttgtaatgtgctagaggtgaacaagcctctgggttataaaatatttgcttaaaatggaagacttacaaaccggatgcttgcgattcaaaatacacaaacctaagatgtaggatattattaaacctaagtcttcagatttcattttctataaagtcacagtattattaaggattaagtaaaattgaataaaaggttggctttcttttttgttcctctttccagcttatctgatttaaaaatgaagttaagatgtcaaagccactgttggaatagcatgaggagtgcgatttgattctgtgcatcgatagactctgcaaccacggagtagtcttttaacctttttgaaattcgcatgcactatgtcaaaaagggctttattaccaggttaataagatcatgtctgtagagtattttaagctcttttattctgagaatgataagcaaatgtgaggttttattatcattatcattatcattggcttcaaagggaatttggttttcatagctcagtggggtgaaaagaaagataagaacctggctggtggtgttcaaataaatgtcagggttaagaactcaaggagaagctgagaagagacagaggaagaaaaaccttgtttcattggtacattagttgagagccagctggagcaagattgaatcttaaataaactatcagggcaaaatatacatactacacaatcatactctctgtctctctctctctcccacccacacatatacatgcacaaacacgatcttttaaattcatttctctattattcgatctaatatattactcattcctcagtgttaaattcaaaagataaggataagcaaaattactgtaattgtatttctgactgcttctcttaatggatgtgttaatggaatttccttacatgtttaatgttgcatatattaatgaaaaatatagcagaccacttctgttagattagaccaaaacagctatttagccctaagaagtaacgtaagtaatttcccagtttgaaaaggatggtaatattgagaggaaaaaccttaacattttatggtggttgtaatcctattgtgaaatcaaaagtgacattttaacataatttaacatttgcatttttttagctcagctgagagccaaaaaaaaaacaacaactgcttcatatatctaatactgctcattgaaatgtaaatcacagtaaatgacccgtataggaataaatggacaaacagcagaataaatggacaaacagcagaataaataaaaatgtattacctttatacagccgtttgtcttctgatagcatgagtaaagcttaagtcagatacaattaaatggactgaagctttaacaatgacttttgaactgcttgatttaacaaactcaatcctcataaattaaactatcagtgatctatgatacaattaagttccataatcaaaaaatgctacagtgcatgcagtgtcacttgcactattcctaacgctgaattttaactactcctggctacctcttcctgcagggttgtgtaaaactccatctggcacactagacactaacattatgatacatggtttcttttctattcttcaatttaggctgacatctggtggtccaggggaacaacaagcaatgcctccgaatgtaaaccgattcacaaatgcggctttttttcccagttttccctttgtctttttgaagtgcttgaaattgccaccaaaccagttaattacatggaaattcacatagaataacaatttaaacagcagaacaataagggtgaagaaagtgaccttcacgtgatgaattatatacatgtaagtatattgaactcagcggtgactacaaagcatcaatagaaagcaccatatattggccaattagactcactcagaaagggtactatttaatggcaccacactggggatcataatgggaatgtggtacatgtaagatttccttctttttttctccctgtcaagatagttggagggaaggaaatgaagggaatgagggggaggggtagagggagctactgtgtatagtgagaaattgacgtttaaacaggcatgaggtagtattcaaaagcatttatcttttatttttctttgggaagaagcagacacttccagcagttagcagcagtccagatggcaaacacagtgggcagaagcaggaacaattcaactctccccatgcttgggatttaaaaaaacaacaacaaaaaaacctctcaaacacctccaattaatttactatggtatatgccactaattaccaaatcacagaggaacagagtgatacactgtcagccttatgatgttcatgttatttgtacaatttatccgtacagaaaaaggaaaaagcacctctgatttttctcacattcatcacttagctacaccattctataatattttgaccaatgaagagtcttaataaatgggcattttgtgttcattttttgttttttcatatcttttgcaatgattggaaatagcataagaaatacatgtaatgcttagattgactttgatctatatttatgaaaggttctgtactgacagaattatgggtaaagttccccattgtgggaaacacacacacacacacacacacacacacacacacacacacaaagacgaaacaaaaaaaacaaacaagcaaacaaagtctttaaccttgtccaacaaagaccgttctgaatgtttgggctggtctctgtttccacttcaccttgtgactctgaaaaggttattggaaggagtgccaattatgttggtgcttttgaaatatggccaaatcctctaggaggtggactcaagctgccaatacctaatctcataaaggtcactcaaaagttcaaatgaaattgcttttagttactataaaacttacctgagttgaaatgattttactaaaggaaaaatatttccacctgctcttaccagtcctttcttcttagagtttaatcattagccataagtttctcaagaaagaggaattattttaaataaacttaacaactatcatataaacttttaaagaaggagaagaatgaatatatgttctgtaagaaaattacatgcccagaatgtctacaacaagccatccacaagaaaggtagtggcattctgctagacttcatgtgactattatatttattaaggaataaggcagaggaaaaattgtactgtgattttagaagtactcaaaaagtctttctctcacaaacatcttacattgattgttaatgaatagctctcaaaattatacattagttctcttggctttgggctttgtggcctcccagcatataaatatttttccaagcaataacttttagaattatgagtttcatttttatgagtctttttttttcccccccgagacagagtcccgctttgtcacccaggctgcagtgcagtggtgtgatcttggctcactgcaacctccactcccagggtcaagtgattctcctgtctcagcctcccaagtagctgggactacaggcatgcaccaccatgccagcctaatttttgtatttttagtagagacagggtttcactatgttggccaggctggtcttgaactcctgacctcgtgatccacctgcctcgtcctcccaaagtgctgggactacaggcttgagccactgtgcccggccacaagttaatctttattttcgagatggagacttgcactcttacccaggctggagtgcaatggtgtgatcttggctcactgcaacctctgccttctaggtccaacccattctcctgtctcagcctcctgaatagctggcgtgccaccatacctggctaattttttgtatttttggtagagacgcggtttcactgtgttagccaggatggccttaatctcctgacctcatgatccacccaccttggcctcccaaagtgttgggattacaggtgtgagccactgcgccccgcctcgtgagtcaatttttttaggaattttatttcatatatgtaacatctatttcttctagctatcctgatcttggtataaaatggtggcatgttaagaataattaaaactatttctttgcaaactattaatatagtatttttatcttttttaaagattttgccacatattaggcagagtcctaaaagaaaagcatgttgtatgtaattgtgtaagtcccctattctgagatctccatttctgagtaactcacataaaacttccccatcagttctaccagtaccacttcccactgccgcttctactaccatcactatcaccactgctccttggctgctgctgctgacgtggctggtgccaacaaaaccacaaattatagccctagacctcctgtcaagaacacttgatggtttggttttggcattgaagcacaaaggcaaaatgcctctttcagattcagactgagatttccttccttcctctccatgttccttcctttcttccttcctttcctcatcctttcttttcctttctttcttctttatcaagaaaactgtagctcagataacatgtgtagacattaagctactgacataggatgaaaatacagttaccacggaattttgcgatatggtaccaagcttttaaaaaatatagaacacactcagaaggaagcagagttctataaaagattgaacaccgagccaagaatgaatcttttcctttctaggagagtggagctagattatttttaaatacttggatttcttaattggtgctagtttttgttgggtgataccctgctaatcctattctagaatctagaactatacggacccatttttgaagcttataaacaggcaatagcacaataaaatacacagtaggcaaaatgtggaaataaaatataataatatacagttatgtttacatatatgaattatattagtgtccttcttatttttctcaagtcttatacgaaccatggtttacagatggtaccagtagtagaatactgggaaaggaaagggagagagggaatcactgaatctagtacaggctttattttttcacattgttcccccaaatcctcttgagattatgggaaggagaagacaatataaccagttttattcaatagaactattgttgaaatagcttcattactttctacaataagatacggaagtcttgttcatactacatgtatatcactttgctgtagataaaaaaagtaataaaaatataactagtaatatgaaatatgttaatgcaaagtaggagatttattgtggataatacattttaagttagattttatgtgaaaacacagggaatgtgtttaaacattaaagagcatctataatttgtacatttattactgtattgaatgctattattttaaaatacctatcttttttatgcaacagggccctttaacaaacaaaattcagtctggtattaatgcataggtattagggatccatttcagcaatcttcggggactttctgtagctctagcaattgcacctactatatgttttcaattttaaaatattgtaaggggatcctgatttggggccaaggctactgtgccagtctatgtctggatgtcatgcacccacggtggttcatcatagcaagcaggttccatttccagatggttagcttgagtagacgaggagattagatgtctctgttgtcagacagccaagaattcctgggatggtccaatatttgcattccaaaaaagcaatagctggatgaaggcggctctcatagctgctgaaatttcctttgtacaaagggagcaattgctctcctttgttgagagaggctgggttttttgttattgttgctttatttttttacctgcatagtcacagccaagatcaaaatggtttgcatttgtttatctcctttgagagccagtgcttttttctgcccagctgtctgtagttccagaagccattatgcaggaagtgacaaaagccaagtcgtagtttcctcaattcattcctcaataacttttccttctattctttctcattcctacatgtccacatggcctcattacaggagcgagaactcagaaagtgagtcagacaaaggcagattgaggtttcccaaatgtagcagctgaacagcagcaattaagcttgccttaaatgtaagtggcacagtttgaaaaacataagtgatttactttctttcctttctcatgtatgtgacctggaattttcatatctctggaacttatctccaggtactgataaaaagatgactaagaaattatcccaccaatactatctgatgagacaatgcttcaatagaagtatacaaggtactaaaaatggaaaaggatgtacccgcctaggcaagagaagggaaccaatggacgtgagatttgaggaataagtgtctgtagcaggtggagaaagcagcacagtgtttcagaagaatgagtgaaacagcacaacctgaggaagtagtgggagaagaatccagagtggcaggcaaagacagaatctggggtctgggtatgattgcgtatataattgaagctatattctagagctttgagaaactgctgatagattgtaagcaagcaaatagtatgatcagattttcagtaactcggaagatgagtttaaatgctgaggattgagaaacaggattgatgcaaagagctggttgagatggagaaaggctggtaagagtggaatagaaaggccacagatgtgaaggatctagggatgaatatacacatgtttaggggtgagattttcttttgaagaacatccatgaacatagtaccagatatatgtattgtatctgttacatatcaaattgtagaaattgaagaaatattgcaccagacaagtaagttcaagagtcagaataggaatgtaggacttgctcaaggaagagaagggatatttgaggtaagcctgtggaaacagagcagtaagagggcatcaaatatactgcagtgtgcagagaaactcaagtgtgaagggtatttacttcccagttgctcagttgcattgctgtgctaacaatttatcagatgatagcagctacctttccattatttaagttttaatgttaactgtagtagtccttgattcactttattgtggctcttttatgacaattgagaaaatgaaagtagttcttattaaggccttttttgtccactaaaattgagtgactagcattattctggaggtttataaagacagcatcaatagtcttaattttgtttttcttgagtatttagccaatgaataattttaattataattttcataaaaaatacacagataaattattgatgagaatgcaaaatgcacataaaacataggacttggaattaatctaatgtgagaggtcagttctcatatgtttatccttctctatgtgagatacatcagtgaagtattttgaatatactgcattaagacatttttaaaataataaatggtctttagtttctaactgaaaatgaaaatatttggatgtattcatggctgatcaaaagagtgaaaggagtaaataatgtgctattttttgtcttattccagtatccctaatggaactcagccaataattccccatcatctttctcataaacaaatgtattcttggtggcattggtaggcaagaagaaaagttggcttttggattaaggttaaagtgggttggacattgtggtgacagctttctctctttatccagtgaatttatctctgcccacaaactcccatcatttgaggttttgtttggtttaaaataagaagataactttcttaatttgatacttgatttccatttcaacaatgctatcacattgtaacctagtggcagaactgacaatatttgcacataatgagcaagaaagcttgttttcacttccaaaactatgcttgcagttcagggacctcattaatgcttgtcttacttactacaataaccttctgactggtctctttgcctttaatctccctgacttgaattcattgttcttcttgattaattttctttttgtaccattctactctgaccactacccttctcaaaaaactttaacgactctcgattctccacttcaaaacgtattttaaattctttagatcaattattgtagtacttttggttcctgtaccaaaaaatcttattgaacctgatgacagttatggacactctcccagtaaattgcaattatgttaaaacttacatcaaagtttcaaaaaatgtccagctaattcacagacactctgaaacacatagggaaaaacacctccatatttcttcctttcattcagcaatccgacagatatcagtagtcttttattatatattaataactgttcttgatgcctaggataaagaagtaaataaaacacataaaaattcctttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaattcctacctcatttgacttatattctagagtgatcaggtaaacaataaagataaataagtaaaatacacagtatgtgagacagtgatgggtgctaaggaggaaacagacaaatcagagaagtaggatataaaatgttgaagggcagttgagaaactaaataagtcaatcaggaaaactttcattgagaaagtagtttttgagaaaaaacctgaaggaagtcagctagccatatgaatatttgggaatagtatccatgtatcagaactagcaagtacaaaggccctgagatgaacatgcttggcaagtttgaaaaacaaaaagaccattagagctgtagtgaacagaaaagaaatgaagtcagagagttacatgtaaccagataaagcatagcttataagtaatagtaaataccttgctttttattatgagtgaaatgtcagccattaaggcatactcaaatttcttcccagtctggttttaaccaactttcattttaactatgaccactctccaaaccatataacatgattttagttgatccccaaagcaatgtaaaatgtaactaccagtatacacgaatctcatatgttcatatggctagctcacttccttcaggtttttttctcaaaaactactttctcaatgagagttttcctggtggacatatttaatttctcaactgcccttcatcattttatatcctacttctctgatatctgtttcctccttagcacccatcactctctcccatactatgtattttacttatttatctctattctttacttccttatattagaatataagtcaaatgagggtaggaatttttatgtgtttaatttactactctatcctaggcatcaagaagtgtctgatatgtattttaaaaagatatataaaataaaatacacacatatatttattaaggtaggtatttagatgtgtaatttaaaaatatctttctttctgaggctatcgactgaatgtatgtgtgtcccatcccccccattcatatggtgaaaccctaatctccagtgtgatggtatttgaggatgagacatttgggaattgcacctaagataccccaactcatctccatttgtcactcatcctccaggaggctagcctggacttccttataagagtagtcccagaaatcccagtagcagcaaggagggaaaatcacacagtacaagtgtttttcaatcttctacttagtcatacttactgttatcattggccaaaataagtcaagtggccaagactagagtcagtataggaggagacttcatagggtgtgagcatagaaaggcatggacaaactgagagccagtactctaaaagtctaacataaattacataaattgttaaagttgacaattttaacagactctcttgcttacagtagtaacaagaaattgaatatcagaacataaagaagtggcattttaaaagaaaagccaaagtgtaaatcaaaccctataaaacagctttttttttttttttaaaaaaaaaaaaggaagttattcttcagagatgcatgctactaagaataacccttatgtgtcgactattgggtgcttggcatacatttttaaatttaatatttacagaaaatctgccaggcagcaattattactccctttgtatagaaaacaatctgagggtcacaggggttaagtctcttgtccaaagtcaggaccaaatgaatataaagtctttggtcttttccctacctgtcactctgcaatagaaagagaatagactagacatcaagaaatgatacagggggaaaatggcagataggaggcaggactaaattgtagctcccacttggaccaacaaagaagcatgtggagacccatatcaggaacttttgctccaagaactattgcaggaatataccagggaagtggagagaatccacagcccctttgaaggaggtgagttgttgctgcaggctccgtgagacagctaggaattgtgagtcttgctttcttgcttgctttctcagctgggaggcttgtagcctggggcaagttctcagccctgcttacgggctgcctagaaataaactaagtgctattgggggtgcacggtgggagtgagaatagcctttcaggctgtaggctgcaagggagctgggtgaggccatggctgctggcttttccccacttccctgtcaacctgtgtgacacagcaggagcaggcataatccctctgggaaggtaactccattggcctgggaaccacacccccatcccccacagcagccacagcaggccctacccatggagagtctgagctcagaaatccctaaccttgcccccacctaatgctctttctctactcaccctggtagccaaagacaaaggacataatctcttgggagctctatggccctgcccatcacctgatcctccctatactatagcagctgatgcattcttgaaagtgccatctcctggctggaggccaaccaacacaaaaccagtgcacttaacaaaaatacaaccaaggaccttcacagagtccacttcacctccctgctacctccaccagagcaggtgctggtatctacagctgagagacttgaaaatggattgcatcacaggactctttgcagacattccccagtaccagtccagagcccggtagttctgctgggtggctagatccagaagagaaataacaatcactgcagttcaactatcaggaagctccatccctaggagaaaggggagagtaccatatcaagggtgggtcccaccctgtgggacaaaagaatctgaacagcagccccttgagtcccagattttccttctgacatagtttacccaaatgagaaggaaccagaaaaacgaggttctttaacacccccaaaaggtcacactagttccccagcaatgggtccaaacgaagacgaaatctctgaattgccagaaaaataattcagaagtcgattattaagccaaacaaggaggcaccagatagaggtgaagtccaacttaaagaaaggaaaaaaaatgatacagggtatgaatggaaaaaccacagtgaaatagatagcataaagaataagcaatcacaacttctggaaatcaaagacacacttacagaatggaaaaatcattgggaagtctcagcaacagaattgaacaagtagaagtaagaacttcagagcttgaagacaaggctttcaaattaacccaatctgacaaagacaaagaaaaaagaattttaaagagatgaacaatgacttcaataagtttgggattatgttaaacaaccaaacctaagaataattggtgttcccaaggaaaaagagaaatctaaaagtttggaaaacatatttgaggaaataatcaaagaaaatttcctcagcctcactagagatctagacttccaaatacaagaagctcaaagaacatctggaaaattcattgcaaaaagatctttgcctaggcacatagtcatcgtgttatcaaaagtcgagataaaggaaagaatcttaagaactgtgaggcaaaagcatcaggtatcccataaaggaaaacctatcaggttaacagtagatttctcagcagaaaccctacaagctagaagggattgcgacctctctttagcctccttagacaaaacaattatcagccccaaattttgtatccagcgaaactaagcatcataaatgaaggaaaggtacagtcttttccagacaaatgctgagagaatttgctactaccaagccagcactataagaactgctaaaaggatctctaaatcttgaaacaaatccttaaaatacaccaaaatagaatctccttaaagcataaatctcacaggacctataaaacattaacacaatgaaaaaaatccccaaggtattcaggcaacaatagcacaacgaatagaatagtacctcacatctcaatactaacgttgaatgccaatggcctaaatgccctcttaaaagatacagaattgcggagtggataagaattcaccaaccaagtatctgctgtcttcaagagactcacctgacacataaggacccacataaacttaaggtaaaggggtggaaaaagatattgcatgcaaatggacaccaaaagcaagcaggcatagctattcttatatcagacaaaacaaactttgaagcaacagcagttaaaaaagacaaagagggacattctataatgataaaaggactagtccaataggaaaatttaatcctaaatatatattcacctagcactggaggtcccaaatttataaaacaattactactaggcctaagaaataagatagacagcaacagagtaatagtgggggacttcaatactccactgacagcactagcaagtcatcaagacagaaattcaacaaacaatgggcataaattataccctagaacaaatggatattataaacaggtatttacagaacattctacccaacaactgcagaatacacattctattcatcagcacatgaaacagtctccaagatagaccatatgataggccacaaaacaagtctcaacaaatttaacaaatcaaaattatagcaagtactctctcagaccacagtggaataaaattggaaatcaactccaagatgagctctcaaaacaacgcaaatacacggaaattcaataacctgcttctgaatgatggaatcaacaatggaatcaagatggaaaattaaaaatgctttgaactgaataataatagtgatacaacctataaaaacctctgggatacagcaaagacagtgctaagaggaaagttcatagccttaaatgcctaaatcaaaaagtcggaaagaatatatatagacaatctaaggtcacacctcaaggaactagagaaacaagaacaaaccaaatccaaaaccagcagaagaaaagaaataacaaagatcagagaagaactaagtgaaattgaaacaaaaaaatatataaaagatgattaaaacaaaaaagctgtttctttaaaaagataaataaaattgataggccattagggagattaaccaagaaaacaggagaaaagatccaaataagctcaattacaaatgaaatgggagctattacaactgataacacagaaatacaaaagatcattcaaggctgttatgcacacctttatgcacataaactaaaaaaccaagaggagatggataaattcctggaactagataaccctcctagattaaaccaggaagaaatagtaactctgaacagaccaattacaagcagtgagattgaaatggtaattaaaaagttaccaacaaaaaaaagtctaggaccagatggattcacagctgaattctatctgacattaaaagaattggtaccaatcctattgacactattccaaaagataaagagggaattctccctaaatcattctatgaagccagtatcaccctaatacaaaacccaaaaagggcctaataaaaaaagtaaactacaggctaacattcctgattaacgtagatgtaaaaatcctcaacaaaatactagctaccttaatccaatagcatatcaaaaagataatccaccatgatcaagtgggtttcatgccagggatgcagggatggtttaacacatctataaatgtgatacatcacatacacaaaattaaaaacaaaaatcacatggttatctcaatagacacagaaaaatcatttgacaaaatccagcatccctttatgattaaaatcctcagcaaggccgagcgtgatgtctcacacctgtaatcccagcactttgagaggctgaggcaggtatatcacttgaggtaaagagtttgagactagtctggccaacatagcaaaactccatctttactaaaaatacaaaaattagccagacatggcggcccatgcctgtaatgccagctacttgggaggccgaggcagaattgcttgaacctgggaggcgaaggttgtggtgagccaaaatcacaccactgcgctccagcctgggtgacagagtgagactccagctcaaaaacaacaacaacaacaacaagaacaacaacaataacaaaacctcagcaatatcagcatagaagtgacatactttaaggtaataaaagccatctatgaaaaacccacagccaacattatactgaacagggataaattgaaagtattcccactgggaactgcaacaagacaaggatgcccactttcatcttttctattcaacatagtactggaaaacctagccagagcactcagacaagaaaaagaaataaagggcatccaaatcagtaaagaggaagtcgaactgtcattgtttgctgatgtcatgattgtatacttagaaaaccctaaagactcatctgaaaagctcctagaactggtaaatgaattcagcaaagtttcaagatataaaattaatgtacaaaaatcagtagccctgctatgcacccacaatgaccaagctgagaatcaaatcaagaactcaaccccctttacaatagctgcaaaaaaaaaaccttaagaatatacttaaccaaggtggtgaaggacctcaaccagaaaaactacaaaacactgctgaaagaaatcatcaaagacacaaacaaatggaaacaaatgtcatattcacgaatgggtggaatcattattgtgaaaatgaccataatgccaaaaacaatctatatattcaatgcaattcccatcaaaatacctccataattcttcatagaactaaaaaaagaatcctaaaattcataaggaaccaaaaaaagagcccacatagtcaaagcaagactaagtaaaaagaacaaatctataggcatttcattacccaacttcaaactatattataaggccatagtcaccaaatcagcatggtactggtataaaatcaggtatatagaccaatggaacagagtaaaaaaatccagaaataaagccaaatatttacagtcaactgatctttgacaaagcaaacaaaaacataaagtggggaaaggacaccctattcaaccagtggtgctgggataattggcaagccacacgtagaagaataaaactggatcttcatctctcaccttacacaaaaatcaactcaaggtggatcaaaaacttaaatctaagacctgaaaccataaaaattctagaagatgacattggaaaatcccttctagacattggcttagtcaacgacttcatgaccaagaacccaaaagcaaatgcaacaaaaacaaagataaatagatgagacttataattaaactaaaagacttctctgcacagcaaaataaataatcagaagagtaaacagacatctcacaaagtgggagaaaatcttcacaattgatacatccagcaaaggagtaatatcaagaatctataatgaactcaaacaaatcagcaagaaaaaaataaacgatcccataaaaaagtgggcaaaggacatgaatagacaattctcaaaagaagatatgcaaatggccagcaaacatatgaaaaaatgctcaacgtcagcaattatcagggaaatgcaaatcaaaaccacaatgtgataccactttactctcgaaagaatggccataatcagaaaatcaaaaaataacagatgttggtgtggatgtggtgaaaagggaacacttttacactgtttgtgggaacgtaaactagtacaaccactagaaagcagtgtggaggttctttaaaaaactaaaagggccaggtgcagtgactcaacgcctgtaatcccagcactttgggaggctgaggcaggcagattacctgaggtcaggagttcgagaccatcctggccaacatggcaaaacctcgtctccactaaaaatacaaacattggccaggcatggtggcttgcgcctgtagtcccagctactcgggaggctgaggcaggagaattgcttgaacccaggaggcagaggttgcagtgagccgaggtcaagccactgcactccagcctgggcaacagagcaagaatccatcgcaaaaaaaaaaaagagctaaaagtagatctaccatttgatccagcaatcccactactgggtatccacccagaggaaaataaatcgttatatgaaaaagatacttgcacatgcatgtttatagcagcacaatttgcaattgcaaaaatatgggaccagcccaaatgcccatcaatcaatgagtgaataaagaaaatgtggtgtatatatatcatagaatactgttcagccataaaaaggaacaaaataatggcatttgcagcaacctatatggaatcagaggccattattctaagtgaattaactcaggaatgagaaaccaaacatcatatgttctcactcataagtgggagctaagctaagatgtaaaggcataagaatgatacaatggactttggagacttggggaaaagggtcgggagggtaagggataaaagattacacattgggtacagtgtacactgctcaggtgattggtgcaccaaaatctgagaaatcaccactaaagatttagaaaaagtttttaaaaatttaaataacaataataataagtgaaaaaaatcaagttccttgttaattttacattttaggtaatagagatcgatgtatcatatagtaccatcagtttttacaggatcagaatgtaatatgataaatatttaattctaaaatgatactcaaagtattgtatatttatcatacttcatgtattttgaaggtgctcagtatcctattgtatctaaaaagtttgctgtgtttatactatccttaaaggatttagatatgtgaatttggtagagagggcagatatatcaccttctattgtaatatttgttttccaagttaaatttgaagtataatagatcacgtttttgcagtggaggggactaaaaacaatacaggcttactatggtgcagttctggaggccagaagtcaaaaataggtcagcagggatgtgttccttctggaggtcttagaggagattccatttctttaccctttcccacttctggaggctgctcatgtttcttggctattgtccccacctcactctgacctcagctttggtcatcacattgatcagattgcttttcagtttaacttctctttgttctcactattcgtaattcttctgaaatgatagttacagaaaatggttataattatttctgtgtaggctgtacatttttataaaattggctatcttgattgtttaaaaaaaagagtcctaatgattaaaaattcaactaaaaataataaataaaagagtacctagaaaaaaaaagaaaaataaataggatacatttctggctataacatactttcttcatgtaatcaacattttaactcagaaatttctctggactccttcttgactttccatcttgcccaatagtatcctaacccaagctgatatcttttgatggaatattacagtgactaatacaagaagtactttttcaaaacttaaatttgctcatgttatttccccttcttacaattctttaatggatttgctgcacagactctctttctctctgtctctctctgcaacaaaactcacaagactctgcaagatctggcccctaactacttcttcaaactttgtgctgcagacacaaactttttttcagcaattaataaatcagtgaatttaatcaataaatatttttgagtgactattatatacctttctgtggtactggatatatgtaagtaaacaaaacaaagatcactgctatcaaccaagcttacattctaactaagcagttaatgaatacacgataaacactaactatataaactctaaactatgtgaaaaggtaacaagtcctatggaaaaacaaatagacaaatagagcaggataagcatggagtggggtaggttggaggattatggaaaatgggacagtcaggatagactccattgctaatgtggacctgatgcttgtgaagcagctggctcaggagatatctggtggaggggactaaagcattaagatgggagcaaagctggcatactctgagaatgtcagggagggcacagcatttgatgctgaaagggtgaaggggagagcagagaaaggtcacagaaggaaccagggctacagatcaggtagctcctcatacacctcccaccatggagcctttgtacgaaacattctcacccttcctcatttggtaaattcctgcccatcattcccgtctcagttcaagtttacttttgttggaaaatctttctgatgaactcaactaagtcatcttattgcaggttctcatagaactatgaatttctttttttttttttgagacagggtatctttctgtcggccaggctgaagtgcagtggtgcaatcatagcttactgcaacctctgcctccagggttcaagtggttctcctgcctcagcctcctgagtagctgggattacaggcacctgccaccacacttggctaatgttttgtattttcagtagagatggggtttcactatattggccaggctgctctcgaactcctgatctcaggtgatccacctgcctcagcctcccaaagtgctgggattacaggcatgagccaccatgcccggcctctcttgtattccttatcacagttacgttttacatttttggcatgactattttgtactactttgactccctgttaggctgtaagctccatgaagattgggaccatttctgttagtacttgccacagacttcacagcacatttcacagtgttgaaaacctagtagatatgtaataaattatgttgaaccaatcagtaaatggaacacatattaagcacttctgtgaagtgacacagcagagtgaatatgaacaaatcacttccatgtgccaagactgtatttcttccatgttcaatggacagatggactgagctgtttccaagatcaattaaggacatatgatttagtgaaaaagattcaacatattgccttctaattgtttgttgccctagttcatttacaaagagatgttacttataaatacaccttgttatgggctgagttttgtcccttcctcccccaggaagtgatatactgaagtcctaaactctagtacttcagaatgtaactgtatttggggaaaggaccttagagagctaattaaggtaaaatgaggttttataggtgggccattttccaatatgaattatgtccttataagaagaggagatttggacacagatcatacagaatgaggacaaccatgtgaagacataagaagaagacatcatctccaagccaacaagaggcttcagaaaaaacccaaacctactgacaccttgatcttggccttatagcctccagagctgtgagaaaacaaatgtctgttgttaaagctacccagtcagtggtgttatgttatagcagctctggcaaactaatagacacacaaaaaattttttcagacatctggtttctggttctgcatgtaaggggcttagaagttaccactccatcctaaccatagataaaaagcttcccccgccactaaacctcactaccacattattaaaggctatttagggcagttctttttacctagtacatcatgtctggaaattacaaggcataccaaagacaaaaaatacaggttgaagtgacagagccagcactagaaccagacatgtcagggatgttgaaatgatcagaccaggaattaaaaataatggtgattaatatgctaagagctctaatgaataaagtggatagcattcaagaacagatgagaaatgtaagcaaaaataaataaatcctgagaaagaaccgaaaaaagaaatgctggagattaaaagtgctgtaacagaaatgcttttggtgagcttatcagtagaatgaacatagtcgagaaaagaacctctgaccttaagcataactcaatagaaatttgcaaagccgaaaggcaacaaaggtaacaaagatgaaaaagaagaagacaaataaaaaggaacagaagaaatatttgtaacagtaatgaccaagaatttccttcaaattaatgtcagacgccaacccacagatccagaaagctcaaaggacaccaggtgggataatgaagaagaagaagaaaaaagaaaaacaaaacgaaaaatctaggcataacatttgcaaaaacctaggcatatcatttgcaaattacataaaatcaaaaataaagaaaaagtcctgaaagaatcagagggaagaaacatcttacctatagactcatctctaggtgaatgaagataagaattaatccaacttctcttcggaaaccatgcaagcaataacaggaggaataaaatatttaaaacattgaggacagaaccaacctagaattccatactctgcaaaattatcctttagaagtgaaggagaaatagtttctcagacaaataaaaattgagggaatgtctttctagcagatctgctttacaagatatgttaaaagaaatgtctcttagagagaaaaacaataatatagataaaaactcagatctatataaagaaaggaatagcaccaaagatagaataagtgaaggtaaaataaaaacttatttttcttattcttaattgatctaacagacgacagtgtgttcaaaataataatggcagcaatgtattttagtacatctgcatatgtatgcttatatgtaagtgcaatgaatgccagtaatgatacaagggacaagagggagaattaggattgtcttgttattatatggttctcacattacccattaagtggtaaaatattatttgaaagtgggcttaaattagttgtaaatgtatgttgcaagttctcgggaagaaacgggggaaaaaaagaagtataactgatatgctaagaacagaaagaaaataaaatcatataaaataccccaaaccacaaaaggcagaaaggagcagaagacaaaaataggaacaaagaacaaggggaacaaattaaaaacaataacaaatatggtagatatttattttaaatataaatggcctaaatataccaattaaaagacagagattgtcagagtgtatcaaaaaataaaactcagctatatgttgtctacaagaaactcactttggacagagaaaaatttactatgttaacactaacccaaagaaagcagtagtggccatattaaacttagacagcagaattcaaagcaagaggagttactgggataaagaagagcattacaaagtttgtttatcctccacttatgatttatagagatctctgatcctcatttgccataccaatgctcccatcatcttccttttatagatatcagctaaaatagaacttttagaaatcctagtgctctgccaatcagaaatatgagaccagagaagttgagtgattttcgtaagatttttcagccagccagatttctgtatgcattaccactggcatggtgaactgtccagtctcataaacctagtggacattttttggataagcaggtccacaggtccttaatgctttgtaaatacattctttagaggcaatttatgagaagtgaaaatgagtttaaatataccagaaatggtgtacttaaaaaataaatgaataaaaataaataaatacaccagtaattattttatattcttaatactctcaatatgaggtagctcaatagtgcaattccattacatttatgaatccagcaacagtctttcacactgagttttgtagcagtatcttttgtttgaaataatttaaatctgatattttaaacttctaataaagtttgaaatattttttaaccagtattcagatttgttcaaaataaattgcagattattcttaaaattatttttcttattgttgtgtattttgatctgaaagtaatatataaattattttaacctcaaaaatgaaatgtgttttttatgtatacttcatacacagattattatgaataaactcaagatttcattgacattaaatgtgagtggaaatcatcatttgttttggaaacaaacatttaaaaatcattccttctattttaatatataactactaactaagcatctaaatatagcctatactgttccatatatgattagaattatagatttcatcagtcacacattattagcatattaataatagtttctattttaaaggaaatcactttttctcagctctctaagaggattcataatttatttgtgctgacctgacaaatgcagtaaagtagtattaatctatatctgattgtatgcttcacaagtgcattatttctcattactagactttagttccttccagatgtgtgtaaactgatgtccagatcgcttttcagagttacttataatgaatattaatttttgtcactcagcttttcctgaagatgaaggtcctgttgtttaaaataaaatatattttattctcgtcttttttctaagagtatcaatcacaatcaaaggatttctaccctgtctcatttttatgtttaatggtgatgttattaaaaatgcacacttatatgaaagattactttaattagccaatagaaattcactacagctattcttgttacacactaatatctcttgaggagcaacagtttatattcacttaactcaaaaatacgaagagatccttagttgcatgttgattttgagggaagaatactttatctggtttatccttgaaataaatccattctttgctatttagagaaatctttgtagccgaatccctttgatacaaagaggatatgataaaattctagaaaagaatgatgtgtgtgtactgtgaaggtgggtattttaaaccatctaagagacaaggggaaaaaaatgaattgattcaagttcagtagccagaagctgaaggtgcagacatttaggtttttgtagaccttcctaatccctcttcttctggcaaaagcagccaaaattcattttaggaaattgtcacgacccaattttgtgtggtcttgataagactgtaaatcaagccaaggcacggcacttaacctaaataggtgaatgagactttctctccatttcacacctatcttcatcccttagttattgataggaaagcctcaagaatgtactgggaaaagtcattggtaatctagatgctgtggcagaagtacattgcaggattggttaattataattttataacttagtacatacctggttaaagtattatggaagaaagtttactataatatgaactccattttgtttcttctcaagagagggaacattttcttgaattgccatgaaatagaccctcaaattacagtttgaaggcttaggagcatcatgggcactgtgccaccagggttaatcagttacatcatcctgagattgtcctctcacctacaatgctaaatgtatggattagagaaatgctcagctactggagggcacagggtggatgtgtggaccaagatagagctagactagatggaaagtgtgatcaagtgtctgtttgaaaaaccgtccatggaatatggtggaacaatgcaggagcatataggatgttttagaaacaattgatgctgtcgatcaaaatctgcaggacttcggtcctaaagttttccaataccttggacatttatccactaagaaaatgtatattataaccatagatctgtctgaacacaactggtcatgatatttttctttacatatggctactctataaaattaacttaattttaccaaaaaaaaaaaaaaaaataggccaggtgcagtggcacatgcctgtaatcctagcactttgggaggccctaggcaggcagattgcctgagttcaggagtttgagactagcctgggcaacatggtgaaaccccatctctgccaaaatacaaaaaattaaccaggcattgtggcaggtgcctgtagtctcagctactcgggaggctgaggcaggagaactgcttgaaccagggaggcagtggttgcagttagccactcactgcactccagcctgggcaacagagccagcctctgtctcaaaaaaataaacaaaacttatttaattttaaaaaactaaaaatcacctctgactatagaatcttaccttgcttgaaaatgcaaagcatcagcgagtattataactaactactctgcaccactagatttcataggaaaacaaaataacctagaaaatggaaaaaaatgaaaaaacaaaaaaaccccagaattctttatcttaataatggcatgggactgccactcaccccagagcacttcctggatattcaaagtgaggttaaagagcatagtcacattgccttcacacagcaaactggaagtagccctataagggaggccactagcaagatttccagtggcagtaagacttgtctgttttctcttcctgaaaataaagcatagtaccacgagggcatctcactccatccaaaactctccttatccttcagaggaagtctaactatattctagagacttcagccctatatataagtggaagaattacaactgagtttttggcttttggtccctcatagtagtcattacttccctttacatcaatgttacttaaagtttacaacaatttaaggctcattgcaaatgacatggatagcctgcaattctgatgatctgatggtgccttggttaggtaccctctgtctattaacaggtttttcacattatttcaaatttggctttcaccctttctaacatattctcaaagaacatgtataccaattgttatatctgtaattttcttttttatgcatttgccacctaataactaaacagtcaccccttgaatttctatgtccttaatttggtgtacaagttgaccttatttttgttatattcataagagcttaaacttcatctttatggtcctttttctgatcaactgtgtcatgtctcttgctgtatttccttacctcagacacttttacatcttgctgcactacccttccatctggcaaatggccttttatgactttttacttacaaaattggcatgcttctgtgttctgaatattttctgtattatacgtatacttcctacatatattaaaatcattgtgtatctcttcaatatcactttttggcagattagtgtttcaatttttttctaagaaaacataaacataatatctgaatggattggatgtctgttaaagctgctaggctactaataaataaatctactaatgaacatcagtgttactgtcttctttgctctgcatgacttttaatgtggccatttaggaaattcaatatatctctgtaaaatatactccactattttctcttagaagattcatctaacattcaaaaattagctatagctgtaactaacaaaaataaatgtccaatgccattaagaaaatatgcaagtgaagtgaaaatgaaaaaaataactttaaaattaaaatataagaaactgatggtcaaataaatgctaagtcattgtgggttttcttttatttataagagggtagacagactggaattaacttcccttgtcttcaatcctatcattctagccacagtaatggagaaaagcttgttaatttattaaggataatataaataactcacacatgggttctacagctttgatatttgctaacttttaactttaaccagatcacttaactctttgcatttccaattattcctatttaaaatgagagactgggcgtatttgatattctagtgactaaactgtgatgaaaaaagagcatagtcacattgaaaaaagatttcttcttttctattttgtctcccttaccccacattctctaaaaacatctgtattagtcatggttctctagaggaacaggactattgggacagaggtatttatgaaagggagtttaaagataattgactcaaatgatcgtaaagtgaaatcccacaacaggctgtctgcaagctgagtagcaaggaagtcactccaagtcccaaaacctcaaaagtagggaagccgattgtgcagccttcagtctgtggctgaaggcctgagagcccctggcaaaccattgatgtaagtccaagattccaaaagctgaagaacttggagtccactgttctagggcaggaagcatccagcatgggagaaagataaaggccggaagactcagccagtctagtccttccaaagtcttctgcctccttttattctagccatgctggcagctgattagatggtgcccacccagattgagtgtgggtctgtttctcccagtccactgactcaaatgttaatctcctttagcaacaccctcacagacacacccaggaacaatactttgcatccatcaatccaatcgagttgacattcaaccttaaccatcacaacatccttactttctttctagcccaataattagttttgtgaatatttgtcaaatttgtaaaattatatagttttaactacatttatagtatatagttttaagaatcatctatgtatcattgtgtgtgccgctcatatgtagaagaagcccacttttagtgtgtgtgccagccaatactgtgcagttcattaaaagtcaataggagacagtcatgtgaatgaccaatttactttacatatttagaaagtgacagattgattaagtaactgatcgagttataactaattggtagtagcataaggaataaattatctgacccttatttacacctattatattttttgctatacattttactgccttttctgaattctcttcagtattttattgtattttttaataaaaattttatactttcccctcatattagtgattcacggtcaacttgttgtgagctatgctcctaagccatttttctgttggacttatgggatatttttgtttttcttctctaacatacagcaccatacttgtcttaattgaactttattctgtctctgttttttttttttttttttgcttaactgtagtttcctctaatctttttgggcctcagtttcctcctttatacaataagaaagtttgggtagattaactcctgaggtactttttacctccaaaacatcattctccatgttgggactgaatcaatctttggctccttaaagccagtttcagatttaaagagtatgttctatgttttatcatcctgacacttgataagaagatagacaaacaccaggcctcagatgaactcttcagggcatcatttgttacattctcctgagttgacactaatgcattgattatatccttatttcttatttattgtctgcaaatgttttcagtttggaaaacatttgttgattttttacaaaatttctggggtagattaattttatgaagcctttgtttttaaaaatcttcgtgcttcttcaatttgataaggttatacaaattcatttcaagtattatttttcaagattttaagaggatgaaaatgttaaagcagtgcagtttagttcaaaataccagtattctattaattctatgaatagaaaatttatccagtatttaagattgagaggcaaatgcactataattattgttagaggcctagaaagcttgaattactctcacaaagtaatctagctttattttgtctctgaaaaccttaatggaatttaccaaactagatgttacagtttcattattttcaacaaattaatataacaattttaagactaaaaaacaacattctaatttttcaagaacttcatttagctttgctataaaccacaataccaaacttgtcttcagtccttttaagacatttacttaattaattcaaatctgttttgctccttctgtaaaacatctttgaatataatgcactgttctgcttccaggattttgtttttattgtctctagaaaatggtcatgatttttactttgccagcagagggcacatatgcatatcctttgtttcttctaatctaccaaaaggaaatttaaaaagaaaaagaaaaagaaaagaaaaaagccatatttggttctgtaagatcttaccttatttgaactgagtctaaccgaaaaaataaaaaaaccaccaacaccacatcccatattaacattttctcttaaatatctcatgtctaaatgaaaatcaaaatagactcgaatactaccatcactaaaccacaacatcaatttaaaatatctattttgctctgcaaaatttggctgaaaattttaccccttattttgttctgattatattttggtctggtatttctgcttttgatattcaattctggacctagagttagcaaaaaaaaaaaaaaaagtggtcacctaacatttatttatttaacaaaaattcaaactattaatctatgctttagtctaaagttaatatgaacacatatgctgaatatctaatttgggcagaaattaaaatgtttctgagagaacatttttaaacaaagtgagttggactgaagcaataaaaattagtctattgaccattttggttagtggcttaagaacacctgtgaacattttaatcttctagctactttcaatgaactgacggaaccatggtgtttttcacactctcagctaaatgagcatagaggagcatctgtaatttcaacattatgcatatgcatcaagtaattatataattgcagatatgtggtgtctgcacacatctaaaggttatgcttttaaaatggaaaagtactgttaaaaagcagaagtcacaggctcatatgctaatatccatctccagcagcataaatttaaaaaattttgtataagccactgtacacctgatatgcaccaaaaccaagcaaaaactcagaaatgtaagtttacatgctatatcagcttttaaaaaattatgatggagtaagtcaagatgattgataattgatactggttattccaaatttggtgtatatggaataagagccacaagtaatattttattaccgaattgtttaaatcaggacactttggtcttacttttaaaaaatacgttattttaacttcaaatacagaaaaatagtaataagaatgtaagtaatgagttcattcaaggtttaggttctgctattttttaaatactcaagcaaagataattaaatgtgattacagtatcaggagagacaaggctctagacaaaagaagcaaaaggactctgagaatataagactatttctgttcataaggagttattttttccccaagaaaagtcttttcctagggtaaccccaatttgattccctccaatgttagtgaatgcaagaccgctggggttactatcattgacaccaaacattttgtcaactctaaacatcttaagtaattaaaattgttgatagtctcaaaacttacatgtttatatatagctttagttaacctctgagtataactaataagtattaatttttataaataactagtgccctgcagcccatagtattttaatgcttttgtgtctctttttcaaataaaatggaaactacacacagtcttaaaatattgactctgtttaacatcgaggagctggaatgttacatagaaaaaggaaacagagagagggagattatgctcacatggaatcatcaggaaagttgagtaccttataaagaaacagattgtgcacccttgagtacatctgtcttgcattgtttcctacttagctgacacacatcagtgtcagaacaatgcttccctggagccatgacttgttttccttctccttgtcctcctctccttttcttcctttttctttcttctttctccatttactcaactgggttatagtatcatagtttactgaatgcatatctaaaaatcttacgtatatttcattttacttgaaaaactcatcggtatcactgaaaattaatataaaattataggacatacattgagcaacaaggcctaaaggaggagatataagataaggactcagtgcttctaatttttaaaaatatgtatgttggacctatcctaaccaatctctcatctttaggtcttagtttacttcctttcccaaaacaaacaaaaaacaaaagaaaacaacaacaacaaagcctggcttatatttctatgccctactttaaattggttatataatttgatgcatatattttaatttatgctagtctgacttatagagacattttcaaatgtgcagcaattgacttctcctttagtaataaggaagtgaagataaacttgtggttccttaaggtatgaatttactgggggtttccagtaaatgattcgtcttgaaataaagcagaactagaacataaacattgatgactgcaccaattaactaaatgcgtttaccattttaatcattacatttttaaaaattattattgtacctgttttctttttgatcactcaggatgtgtggaccaagtggataaaccaagtcaattaacacagtcacctgaaagagctgaaaaaaataatatttttgttacctgggtagcttttatattatttttattattttgaggtattcgtgtttatccagtttcttgatctttgaagatagtggataatacagacatattatttctgtcctaatctgccttggtgcaaactaaacctgttacactgaagtaattatttgttagcttctatgtgaatgattttgtgttaatgattcaatagtacaattacaatgtgataattttctttttacaagagatgacacaacattgtttcttcctaaacaatggtcaaatgaaaaaaatgtgggtaaaaatgggttttgcaatagatgtgtgaataaatactgattttcagcctttagtgactttctgagttcattgcacacatgcagaagaagagtgcagcattcataggcaataatttacaaaagaaaccagaagaactaaaatagtttataattaaagaaatggagctggctgagggcagagaaaggcagagtggaggactgcaggtacaggtgacctcttccacagccatcattcagaaggctccaggttcatggatgtctgctatttaaatatgggagtgtaccttaaggttgatggaaggggattgttggtagtggtgacaggaggtgtgatgatagaatctaactaggtggttgctagcagattggaaacaaaagggaggtcacatctattcagcagctaaaatgtgctaataccaaattagatgcttagtcaatataaccacctctgcatgtggtaagtgctcaaacctcagagaagcagttaattatctctcctcaatttaccagcctccgctcgaaacccaactttagccatatattttatgccatatttgtgggaaatgtgtcttaccctctttatgagaaagaatcaatctatttcttccccagagagtaatatttaatcacccctgtgttattaggcttatgattgggattatgattattattctcatttgccttggaggctttgtgctttcaaagcctttacaacaaatcccatacccacatacaaaggttgactgataaccagttatccagcaccctttattaactgggtcttgatatttgatatttcttatcagtgtatggtcttaagttgttcttattctacacagagtaatgaaggccacacacaaacatatttcaattagtaattgtatatacgagtcaactttataaatttgagatctaaaaataatactttcgttgaagagtggctcctaatttttttaaattttaaaaactaatacaaatgattaaaagaggaagaatattattggctgatgtctaggaatttatgtatagtttcttttaagaaaatctaagggcattataggcaaagaaaaaatgttaatcatctaaggtcccagtttactgagtcactattgaaagactaatacaacaaataaagtagagaagaaaatgttccatacagtttgtcagtacaaagtttttcttggatacatcttgatatattctcagttttttaaaatttaacaattcaattaatatttcttttatctcctaacatatacaagagaatgtactaggtgcatttgggaataattatatttcaaagtatcaagtgcttcctttttgccaagtgttatgttaagtgttgtacatataatagctcattatttattaaatagtctcacaagaaaagttttgctgctatctctattttactgagggaaattgagacacagagaggttaactaatttacccaaagtcacaaagcttataaatgatttattccacctctgcatgtggtaagcgcttaaacctcagaaaagcacttacttatctctcctcaatttaccagcctccacctgaaacctaattttaaggacaacttttggacaaatgtagcattaactccagaggttttactctttttagtttgaaaataaatattctctgcttactgatatatttctccagattcagtggaaaagttatttttttctgttactgctttattttttaaaagatttaaaattttaacaaacaaaaagcaaataaaataaacacaaagcctgaaacatattcagtgctggcgtagtttaattgtttgctctgcttcctttggtaagtgatttaaaaagtcatttgtttgttctaaaaacaagcgaagcaaacaaaaaatacatattccatgctatttgggaaatgtaatatggaacaaaagttcacattaatgagaacctggactagcttcattaatttgtgagcctagtacaaaatgaatacatgaagtcccctgtttaaaaatgattaataattctgagatggagacagctgagtattaaatcaaatggcactgcacaggttacagtcccatgaagctggccctggcgagaaaccaatactggtcaccgaagaccttttgctttatctacccatctccttccaatagcagagcgacatgtgagccaaaaaagactcccaggggacactagaggctctagggatagacttctaaggttttaccactccttcatttcccttctgtttttgttttcagttttttgcttcagaaatttaaaaatcccttgaaaaacacagggatttcaaaagacagcatgactactatagacaagaaatcttgtctctggtgctctcactgccccagtgggattaatagctgatttctaatactagagctggaaggctgcacacttaggatggtgagacttttgcacagcttcaaggactgtgaccttataagcagagcaaatgtgtgcccacttttctattatgtggcagtttcatgggtaacgtgcacaaatcccctaatcaaaaccaagaagacggtgtttatggaattatgcattgcagggaagcctgaattggaggactgctaagatccccattgcagtcataagattctgtgcctctaaaagagtagaatgttagatgagaactgagaatagcatgcctgtgacaaaaagatgttgatcatctggtaatgtctttgattctagagtctgagtgggtggatagactatatcccaatttcttccaaattaggaagtgtagatggagataaaaatatcacacatattgctgacagagcctcggatggctatttggactcccttttctcggttaaactgatacctccagtcacactcagagcagttgaacaaatgctgcttccctcaagagggcacccttgaggaaagaagcaggaaaagatcctgagcttcctgcagaggagctgatatggaaaagaaaaattagaaagagtggagcaggccctccttgtctccggagaagtaaggaagaaggtttgggaagggtagaaattacagtgtaattattccaaaagggtaaagtccctaccttggtagttcacagaaatgctggaaaaacccacaagaagaatccttcgtcttctaccctctactattctaagatttgaataataaattggcttcgtggacctaaacccctaactacgtggcaccaacagaaagcactgtgctgccttggatacatatgttagatgtgagaggttgcatgaagcaggcgtgagggtccaagttttggaattaaacaaacctgggtctgaaacctggctctgccattgatcagttgtgtggtatttagcattttatgttacatatcctcgctaggactctatgtctttatctttagcaatagaatacaatttagttgtgtggattaattgtaacaaggataaattttcagtaacctccctactatagtttgaacgttcgtatctcctcaaaattcacatgccaaaaactaatacccaatgtgatagtattcagagttgaggcctttgggaggtgattaggtcatgagggcagagctctcttgaattggattagtgtccttatacagagacccaagagagctgccttacctctccaccctatgaggttacagctagaaggagccgtctatgaggaatggaccctcaccagatgccaaatctgctggcaccgggatcatggacctcccagcctctagaactgtaagaaataaatgtttattgtttataagccatccagtttatggtgtttaattacggcagcatggatggactaagatgcttactcttcctcactctcagtctgggttactaaggttgtgaaatttagttcatattttgcctattgaggttactcttcaaatgcatcactaatgtttccaaaataaatggcatttttttccaatttcataaactatccaaaaaattaagaagagaaaaaatattacagcacttgagccattcatgacttgctcacttttttgtgacaaagactagtttttaaaacaaaaatagactataaatttttctgaaaaagatcaaatagtaaatatttaaagctttgccagacacacggtctctgctacaactatttaaaatctactattttagttcaaaaactataatacataaattaatggccactgctgtgttccaatagaaatttatttataaaaacatagttggtccacgcctggtctatccactaagtgtattgaaaataaaatatagtgttggttgttctgagatataggaaaaaccaaccaaaatgtgtgttcccactctcacccagtcactcaacacaatactgtgtgactagatgtggggcagagggattcctacacatcatccactttcctggcagacacaaactgggtgtcctcaaattcaatttaattctaacaccacctacttggaaatagcatcagatccaaggttcagtcccacaagaccatcctccacctcagatgccaatcacaagctccaggtgttggcctatagctggtcgtggccaaccagctataaactcgagctcccacactctcctccttgagttagagtaatttactagagcagtatagaactcagggaaatactttgcttatgtttaccagtttattgtaaaggatagtacaaagatatagatggacagccggaagggggagatgcactgggcatcagggaaagggcacagagctttcatgccccatccaggaacacaaccctccaggactctatctagaagctcctgaaacccaattttttgagtttttatggaagcttcgttacataggcaggattaatcaaatcattggccgttggtgatcaacttaatcttcaatccatctctcctccccagagattgggagatagggctgaaaatctcaaccctctaatcataccttggtctttctggtgaccaatccccatcctgaagctatctaggagtccccagccaccagtcttctcattaacatacaaaagacattcattattccgatcgtccaaggttttaggagctggatgtcagaaaacagcatgaagaccaaatatatatctcacagtatcacaaaacccaaaagggctcaatcctgaagacttgggattttatcttcagttcagtattatttatattttctaatttgctttgtatcaggtttattgcatcaatcaataaatatattatatgtcaatgtgaaaatctaaagtattatctcctttgtgactgttaggatatatttcttttactgaacaattaatcagatatataattctaattgattctagagcatgttggttaaaataattttctgtacttttcattcaaaatcttcatgactatgatttctgagctttcttttctaagaatttaacaaacatagtgttttctaattctgaatatcaatggtagcttgatggggatagcactgaatctataaattacttcgggcagtatggcccttttcacaatatttattctttcctatccatgagcatggaatgttcttccatttgtttgtgtcctgttttatttccttaagcagtgatttgtagttctccttgacgcggtccttcacatcccttgtaagttggattcctaggtattttattctctttgtagcaattgtgaatgggaggtcactcatgatttggctctctgtctattactggtggataaaaatgcttgtgacttttgcacgttgattttgtatcctgagactttgctgcagttgcttatcagcttaaggagattttgggctgagatgatggggttttctaaatatacaatcatgtcatctgcaaacagagacaattttacttcctctcttcctatttgaataccctttatttctttctcttgcctgattgccctggccagaacttccaatactatgttgaataggagtggtgagaaagggaatccttgtcttgtgctggttttcaaagggaatgcttccagttttttacccattcagtatgatattgcctgtgggtttgtcataaatagctcttgttattttgagatactttccatcaatacctagtttattgagtttttagcccaaagaaatgttgaaaaaactaccttaaatttcatatgggaccaaaaaagaccccgtatagccaagacaatcctaatcataaagaacaaagctggaggcatcatgctacctgacttcaaactatactacaaggctacagtaattaaaacagcatggtactagtgctaaaacagatatataggccaatggaacagaacagagccctcagaaataacgccacacatctacaacaatctgatctttgacaaccctcacaaaaacaagcaatggggaaatgatttcctatttaataaatagtgttgggaaaactggctagccatatgcagaaaactgaaagtggaccccttccttacacgttatacaaaaactaactcaagatggattaaagacttaaacataagacctaaaaacataaaaactctagaagataacctaggcaataacattcacgacataagcatgggcaaagacttcatggctaaaacaccaaaagcaatggcaacaaaagccaaaattgacaaatgggaactaattaaactaaagaacttctgcacagcaaaagaaactatcatcagagtgaacaggcaacctatagaataggagaaaattttgcaatctatccatctgacaaagggctaatatccagaatctacaaggaacttaaacaaatttacaaaaaaaaaaaaaaccctcaaaaagtgggcaaagtatatgaacagacacttctcagaagaaaacatttatatggccaacaaacatatgaaaaaaagctcatcatcactggtaattagagaaatgcaaatcaaaatcacaataagataccatctcatgccagttagaatagcaatcattaaaaacttggaaacaacagatgctggagaggatgtggaaaaataggaacacttttacactgttggtaggagtgtagattagttcaaccaatgtggaagacagtgtggcgattcctcaaggatctagaaccagaaataccatttgacccagcaatcccattatggtatatactcaaaggattataaatcattctattataatgacacacgcatacatatgtttactgcagctccgttcacaatagcagagacttggaaccaacccaaatgcccatcaatgatagactggataaagaaaatgtggcatatatacaccatggaatactatgcagccataaaaaaggatgagttcatgtcctttgcaaggacatggatgaaggtggaaaccatcattctcaataaactaacacaggaccagaaaactaaacaccacatgttctcacgcataagtgggagatgaaccatgagaacacatgggcacagggaggggaacatcacacagcagggcctgttggggatagggggctaggggagggatagtattaggagaaatacgtaatgtagatgacgggttgatgggtgcaacaaaccaccatggcacgtgtatacttctgtaacaaacctgcacattctgcacatgtatctcagaacttaaagtataataataataaaaaaagaatttaacaaacatttatacttcatgctcagattctgggctaaacaataaggaacagtctgtatggctattaaaacaaaaagaaaatccagaaggacaaaattaataagtatgtttcaaaacatgtctctgagttacataccacaataaacaacaatttatatgataggatttacatttaactttaaaaagtagaactttatgatttacataaaataaaatttataaaaccaaagtaagttgtacacagcaagggtgtgggtgtgttattctgtttcccatttcctcaccccccatttggtgaaacaggagaaaagtgcatacaggagacgtagaggaggtaaggacctttggaccttttctcttgttttatcaacaggaaagcatgaccacttccttctctcattcatatacagtgatgttcatgaatacatatggtcaataaagcagtagcattttgttttctatcttcctttattattaaacccttggttcttcattgaatgacactcttttgtgttaataagtttgggtcaagtaggttgatgtattttcagcacctttaaaaataacatggttattttaaaggaaggaatgcacacagctgataggtagtacaggcaggaaacccacagacaagataatatgtgtcatcagcatcatgaaaaacctctttgaatggcagggatgggcctataaaatatgagcaaagcagagtctttattctctccgcgcagcagtaaataacagaggctgtactttagaaaaatccttgacgagtgatctggaattcttaataaaaatccaagtatgtcagatagctcttaaaggttcatgtgaaataacaagaaagctataattccatgacctggggaaatcctttataaattaagtagaacattgtgctttgtgttcttcctttactcaatcatattcagcttctgaagggctggggggaagggtagaatggcaaaagaaggataaaaatgtgttgttctacttatccacacctcattgatccatcaggatactcatgataatgcatttatatccttgtccttggcttcatatgcagctacagaagctctaagtcttgctggtaatcttaattaaggacccttcaaaactattccctactttataatgcgtccacctgaagcctttgctgatgaacatgcagacaaaataattacctagtaacatatttctgcatatgaaaggaaaacacagtttgtgaagggaaaagctgaaacctccttatttttttttttttttgacatgatacattaggacaggaggtagttttatacaagagatattaaggcagaaatttcaacatgaaattattttgaaaattccagcatggaatcatttcaggatgacttgaaatatggaagtaagcaaagagaaagaagccaaaaacagtgtttgcttttggaaaaggcaaaaagaaataaaaagttttgcagaaatatgtaattttaaattcaagttttcaacacattcaggcttataattttgggtaatatgaaattaatatattgctactataataattggttgattgatacatacatacgtacacacatatgtacatactgacaaatagcatgatcagtcataatcaaatgtcctgcaatgaaaatgagagaaaaatttagcgaatggagtctgaacaaggtaacatttttagttgatttctcattttttatttatgacctacaaatatatttatactaggtttccaagaagaaaaaaattattaatttgtaatagttgtaaagtgaaaatattaataacataaacaccttgctagaatttaaaagcctccacttctctctttgatttgaaacaatggacaaattactaagactttttaccatagaggtgcctcattactaaagatgattatactgactttcttgcagagactttgaaaattaatgagatagtaatcccaattctaatgttaaaatagaagtcagaaaagtgctacattacttactataatgaggagcaaaatgcggtcctgaaatggaagcaaaattgcttttgctcaactaaatgcaagaccactgacctaccatctaaaagtctcctccaatctcatacaactgtgggattattttttaacagaaattccctgtataatttattacatgttcttatgagataaggtaaattagaaccaaagcacatgcaaagcgatttaatgactaataatcacataccttcaactaagcatttcttatcacaaaaagacattattacgttattacttgtaatctcacgggtgcctgattgctctaccaccatttaatacactactgccagtggttattgacaagtaaatgatcacagtgtcatcaatttcttctgaataaataaataatgataataatagctaatactgaagtgccaggcacatagcaagcactctcgaagtgttggctgttatacttgccaggcattgttccaagtgttttacatatattcttttattgaatgttctaataactctatatcagaagtgttttatcgttaccatttacagatgagtaaaccaagacagagatgtcaagtaacttgaccaaggtcacccaagtaactgtcagaaccaagatttgaacccaggtcatttgctacagaatctgggctcttgaccatcactatctactgcctttgcaataattacataacaaataatttgacacagcatcttaagacaatctgttaatttctaagaaagatttatcaaatgttgaatatgcaaatttagaaataattgtaatctatgaactacaaaatgtttttagaaatatctcactcaggccggatgtggtggctcacgcctgtaatcctagcattttggaaagccaaggcgggcagatcacctgaggtcaggagttcgtgaccagcctggccaacaaggtgaaaccccatctctactaaaaatacaaaaattagctgggcatggtagcgtgtgcctgtaaacccagctacttgggagactgaggcaggagaatcactggaacctgggaggtggaggctgcattgagccaagactgcgccactgcactccaacctgggtaacagagtaaggctccatctcaaaaaaaaaaaaaaaaaaaaaaagaaatatcatactcagttttgatgtttattatatattatttaaatattattattttattaagtattcataaactggataatccagatgatctttatatctgcaagagaattagaatttattaaatatttaagaaggcatgaataacattttaataaaaaattacctccataactggtttaaaatagtagtgaaacagaagacttccaagagttccctgattccccttgcaggacgtgtctaacagaggtgcggctcggctgtttggtctcccgacagctcaaaccccttacaggagggtgagcacacagacaggcaggtgcaggaaaccgggaggagtgcctttgggctccagccccacagaatcatctaggggtgtgtgtctgcgacttctgaagtccaagtgggcatatgttacagtgtgctcctttagctttgccatctgcagatggcttgtgtgttaatcagctcaatggaccctcggccttatcacaagggcagggccccagtgtgagggccttctgtatcccaagctcttgcccagggtcgcaaaagaatcagatcacatgcaggcttgaaggataagtgcaatgttttattgagtggtggagatggctttcagcaagatggatgaggagccagaagggggaatggagagggaaggtggtcttcccctgcagtcaggactcccagtggtgggactcttttctgactgcccctggccaaactcccctcggtgtccagacatccttcctcctctctctttgtctgccacatcattccgtcattgctggtctgctggtctgctggtctgctggtctgctggtctgcttgcctcctcgtctccttgcttgcaggtcacatctggagtgtgggattcgagatttatatgagggcaggatgggggcatggcagaccaaaagggagttttttgggtgtgaaaacagagatacctgtcctcatttagggctgcaggtcttcaggcttgatggtggggcctttgccaggaaaccgccgtcttctacccagtattcaccgatccctggtctgtatcactagcaacaaaagacaaaagaattctataaatcttttttttggatatacttctatatggaaaacatttgaaaaatgttactgtgcagtgtgatgtccctcctccacactgcctgccttgtcggtgctcctgtcttttggttgccagaactctgaggaactccttgagtgttaaactaatcattttataatacacaaatattactttgaacattataaattataaatttatattataggaaaagcataaaacaattatatagccattataaaagtacacagaagttatttgccttcaaaattccaaatattgctttgttctactgaccactgttcatcatttggtgagtttccacaaaatattgcctctccatttttacatgatggtttaattatatcttctcctctttcccctgattttttctctttctttttttaacagtggcgaaataagagtaatgcatgcacgtaattttctctaacacaattatttgactggatgggggaaaaaacaatcctttaagttttgaatgaactcatttccccttgccttgcaatctgatagaggctaggcacctctaagtcataaattattccacaaatatgtattgactatctactctgagccaggaactggagaagtcaagccaataccttacagtcttcttctaaaactagcaagtttggggttgacatcaaaagtctaggttttgcagttacttcagagttctaaatgaagatcagttgccaacatgtggatggacatgcaatgaagatatgaaggaatacagaggaacttctgaattggaagcaagtggtgagcctgagtagataatgtgtataaatgggtaaaatgaaagaaaaattaatggcatcttgcatgttaattatacaactaaaaatactaaagtcatgccttttatagtacatttattaagtcgctactaagtgacttttattccaataaatgctatgagattatcaagtacacacaattttgtttgtgacatgacttcctttggtacatacaatcctgacaactgttttgaatttaaattcatcaacacaatcttagcatatttccacaataaattcacttgcccgatctctctccagttattaagttttttataatccggtgcttatgggaaactttaccctgaattactttttggcacccgaattgtaggaaacagcatggccttgtagtcagacaaagtgatctcaaacttggctttccccattttccatctctgtgaccgtgagtacaaaaataaccctcctctcaaaaatatagctagtaataggtactccacctggttgttaatagaattaatcagaaagtacatgcagtgcacccaataaaatatcagtctctcccctacttaaatatttcaacatagatttcaagatgtatgggtggagattttatataatttgaaataaatattttcttctagtagcagtccaagaaatagaagatgtgaaaaaatacagaggaagaatcagtgcagtgagaagacagtcagctttctattctggaatcagcaagagatgggagttaatagtctcttctgcattgtgtttttgctgaagaagtgcttagtataaaaattgtctggattagggcagatactgggctttccttaggttgctcttgggcagaactatttgagtggacttggaggccccaaattctcaggagattaagccagcggtaataggcctgatctggcactgtttatctctttgtatccagtaggacaagccttattcacagtaatgtaatttctgacgatgtttatttttttccagttttacctgaaattgatttaagtaacaaagtgataatcatgggtatgagccaagggatcttcctttccaggaagaaaaatgtaaaagcttagccacagctgatgtttggcttggggatttagggaaaatctgtgacacattgcttctgaggatgacttccattctgtggcagccagcagctgtgtgatcgtatttgaatgcaaacacctgtaacatttggaagggtctttaacaccagcttctcctggtatagaaactattaaaatcaagagaccttattttcttccttacctttcaaatgtaagtcttccttaaggtggacagaaaatgaattgtttccttcttaccatctgttattgtttttgcctgaaggcctgactgccttcctactccctaataaacaaaggggaattctattgaccaattcattttcaaagagattttaaaaggcattaagcaatcaattctcacatagtgtccaaattgagtctctcattcattctcttgcctgagaagaacctgaaagcaatattcacataaaacatattcactcagggtatagacagtgttgctttatgtattaatatttaccaagttgcaggattcttgaatactgtatttcatactggatttatatttttacttctcttcttctctctttccctttttgagtatgatatttttaattttaaaataattaagcttcatatgctcttatatgtattgtcattcattttttggagaaaacctaatgtgacatctgataaagaaatcaaagtgctgatagtggtagttacaaaggcaaagggataacttggtcaaatattatcatttcttttgacgtatgtcttcctttcaacaatgagattttgaacaatcgaggtattttattgtaagcacctcagagtgaagtctctattgttaaatttactttttctttgatgtaaaatgctttacatgcggaaaataatggcttttattttccagtacctttctagtttagaatacaaactcttcacgttaaggtatttgtgtgataaaagatacttaatcacttattaaagattcacttccaattctaatttctatgttttcacaaaaatacgtcatattcttgaatcttctcatttttcacctagaatgaaatcttaagaaaacaattgtacatagaagttgtatcattagctcatttgaaaatgcaattttgttttggaagctattgataattagaacagcgagggacccccatctgcttagttacctatatctcatttttatactttattcagctatcctatatttttatgttatgaatgtaaatatcttttccttgagatccctccaaagacaacaaatttcatattacaattcttatctgtaaagacagaaactataaaagcatgaatagctttactgttagactatatgtgaagaatgactgctatattactgaaagaaccgatttcacgtcactgacttccccaagtcacaattttcatctttcaaaaagtgataacttactctcttctagaaatagaaaaaaaatgccaaagacagtgctaaagtaaataatctctattgatttcatttccaataataaataaattgaacttgaaagttatttttttcaacatggtaaaacatcagaaaatcttacaatgttagaataaattcaacttcactacaattaaaaagaaaatgtaaattgaaggaaattgttttaagttaacacaccagggttgaggtcaggtggtcatgtaggaaatgaagttagcattaggaaagggagggcttgagtgcagatgtagggctctggctctatttaacagatatgtgtgcttttggaaatttatttaatccctatggtcctttagttttgtcataagtaaacctctatcagatttattttgggataaatatttattagaaaaactaaaccaataaaaaaagcctaaacattttagcatctatacaaataaagggctaatttatgtcataaaaatgttcccttttatctttatgctttttataagtaatatcgaaaatggtaatactgtagtaaagttagcagatacaattctcttagaacaattcatgcatattgttatgttgtttcatctgttatctttctggaattttcttttataaaatttaattccattactgctatctaatattgctgtcacattatcatagtcttcattaatgcataattgcctttgctccttctccatatttctttttgctggagactaatgtaaaattgcagttcattaattacaccatcataaaaatccttgttaatttgattacttcgtgcatttatctatgaacctatcctttcttgattttctcccttgatctatgtttatttcttattgccttcatcttttatcttataattttttatgcaactgaaatcaatgtatttaaaaaagaactggatgtatctgtacttgagtggattacaaaaacctgatacattttaagtgtatagatcaggaataattatattaaatagcatccatgatattccaaagtggattcaaagactgaggggaataaaaagactgatttcatgacatcatatgtacctaaaatacagactgaaactgaaattatatgttgacaaaacaagcagccaaatcatcaaaaaagaggaggaaaaatcaataaactgcctattcagagacatgaagacattacagctgaaatattgagcagatatttcctttcaactagttttttgttttttttatggtttttgttttgcattgtctatagtattttgcactacttatatacatataccttagataagagaaagtcttgactagagaattaatgaattaaggaatgatgaaacagcttataagggtctctagaaaacacaatgagttctcctacagacattattaaccactctattttgcaaaacaataccaaaatgttttgtgaagacttttgatggtttgttttaggaaaataaaagatgaccgagggacaggcactggggctcatgcctgtaatcgcagcactttgggaggccaaggtgggaggatggtatgaggccagaaattcaaggctgcagtgagctatgattacaccactgcactctagactgggtaactgagaaagaccctggctccaaaaaaaataaataaataaaataaaaatcccaggaaaaaaaaaaaaagatgactgacattactccttagtaaagcttcactgtccttagccagagactttgacttttgggtatttccagtacatggatgactgtggcatacattgataccacttcttcctgacactctgtttcttggcaaacttccaatctcaaaccttctgcccttcctaccaacccctgctgatgactctatcagacagttatctttaggtttggagaaaaattaacatttttgagataaatcctcgctaactttccaccttcattaattttccccagctttactctttacagataataggttttcttttttttctgaaaatgtaataaaagccaaatgtatctgtcactttaaattccatgaaatgacttggttaaaatgaactatggcagctagctttttaataaaagtgtgcagtagatcttctcattgtttgaatagctatattatgatttgtttacatttatatcttcatacaggacgtatcatcctagatctggaaaatccttttaaatggctatcatctacagatgccttttctactatgttttcccagcaaaactaggttttaattaggctcccttcctactagcctttagtggataaaatcacagttatgacatttatgatctgaatcaaattccaaagggtacaattatggggaagagaaagtgttatgatggtagtggtggtgatggttattattattattgtaaatgtaaccaacatttacgtagtattttatagttttaaaagtgctggcatgtgaatcaccttattaaatgagacaaatgaggaaattcacagttcctaatttctactcatgaatgaaattgtttaattttttttccttctcattaccagacttgaggagcatgtctattaggttcgtgttcattatctgtgaggattcccgcaatggggtactgaagtgaggaagaatgacataccggcaagctgtgtgattagaaaatagaaaactattttggcaataatataagtcatgagagattgcagaacagcaatcgattaatctgaaggaaaaaagtagaataaaatcaaatcttataaagaaaataaatagcattagagccttagaataaaaaattaaagtgtgaatacccctttagaaattccttggtatgaaaacatgtcttgaaagcatttacatagggagagatgaggatttgagctgcttgtaggaagatacatgaaggaagaaatcactttaccaataccagctaaagttaatttgatgcttcctgtattataaagcctatagctattttctctcaccctaatttgaaatgtctgctacctcaccatacaattaaaatttatttatattattccaaaatgaataactgagagacaaagctttatgtaactggaaactatgaaatcctcctccaatcctcccactcctcccctgaccctccttactcccccgactcagattatcaaagaatttaagatagagatcttgtaattctgagataaattctcagaatatgcaacaagtctgctaaatttggaggtagggaccaaagagaactgagtacatctgaaaatggaagatcgctttgatttgattgtttgtttgttttgcccctgagtgaggcagagaagaaagggaaggaatactgaaaaaaagaggaagggaaaaaaaaaagcaatgagaagagtcaacagggaaactgaatagaatgctggacaaaagcgtgagtttggaaataactaaagagattagatattttaaataaatatctaattatttggaactaaataaatattttatactacatttagttgtgttgcagcaatgcactacttcccaagccccaaacctttagtaatctgttacacacgtttcccgtgtgcacacctgtgtgtgtgcactgtgtgtacagtatgtataaaaatgagaagagggacaattagaaaccaatagatatatgtattttaaatgaataatttagaacactagaaaataagaacatcaaaaaaactgtgaaactaacaaaggtaaacattatataatttaatgctttcctggtgctggccctctatgggaaaagacaccattgtattttgaatttaggtttataagagaaaaacagattatcatcatagtgtaaccctgcccattaaacaccacataaaattggttgataagccagtgttaaaacatttagaatatccaataacctcaccagaatttctctgcattccaagggccaaggttgagggctgtatatttgtggatgtgtgcctgttttaggttgaggcaggtggggctggctaacttgtcacggttacttctggctccaagtttcactttcagcgatttagttcagtgtccctattgatccagacatgaaatctaacttttctcttccatattcttaaacactgtggagcactaataaaacgtggtcaattctatctgaggtctctttaaattgtacttagaaatgcattttgattgaaaggcctgaaaaaccgaaacagatcattctttaataatagaatttcttccactttgacagcttggtatagaggaaaaatgaagagaggggaatttacaaagctgaaaactattttgtctataatactaaacccactgatagtcaaatttgtttattcttgtctgcattacttgtcactagatttctatcgagataaaatattaaaaacatattataactttttgttatatgcatggatttgggaacaattatccttcaagttaccctgattctagatttaaaagcaaacaaacactcataggtgttctcttggctattatttatttctagttgtattctatattgaggagagttcagttgcagagggccgactctactccaactagctggaacataaggaggtttattcctggctattaaatggctcatagaatttgggggaatgcaaatgaagttgactctaggctgaacttgagcaataaatcctaaagtcatacaacttccaggagagcatccaaaagccatagagtagaactggaccactcaggagtccactaacccagaaatgatggtgactggtggaatcagaaagttggctagtaaattaggaaactattgctacagtttctggctccaaaacatatcaatattaccttaatacgcacaaataaaatggatgctttctgctcagttcctcctcatgtatgtctctccctcaattccagatcatgatgacacatcccattggtggacattaaaccatatagggatacctcagtgagtctggtaaatgtggcctttacttagcagcctctgcacacttgaaagaggatggaatgcatttctgagtgagccaattcatggtaccagctacatattcttcttgattgtggcctcggggacttcattcggtaatatattctattaattaaaatatttagaataactagtatttatgaataaaacatgagagtaaaatttgaaaatccttactaatatagggaagaatcgcatggaaacttgaataaaatagatttatagttttcaattagtgttgcacatccaacacagggacatctgggaatgtgtgccagattgttggttaccactatgagggtgaaattctatgagcatttagtggaaaggggtcagaggtagtaagttcttcagtacatggaatatacaatagaatttgacacaatgaagaattgtctcactgcaaataccaagagcacctctattgagaaatgttggcataggtaatctccaaataatttcaatttcaataacctacattattatcagaaaaatttactgaaatcaatcatctattttgctgttttctactctcttaatagaagggcacatacccagataaatattaatatggagataggtaaaaaatgagcaggaataaaagatattaatattttatgaacaaaagaattatttgactttactaaacagtagttttcaaaggatgttcagctaaccagaagcattggcaccacgtgggaacttgttagaaatgaaaactctctggactatatcagactcatagaatcagaaactgtggagctagggcccagaaatgtgtgtattaacaagccctccaggcagatataatatacttttaagttttgacagcttctggaataaaagcatcaaggactgaaatgttgtatatgtttgttgtaattagaaaattcaagttttcatttgcgaagaaggtattcaaaggaaagaaacattttgtatgaaattagcctacattggcaaattctttggttcttctaacaattattcctcctaggcatgctgtccaagaggatatgaaagagaacagatttaagacataacccaaactaggagcctgcaacagagataaccagaaattaggtgtattagttttctttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgtcaccgcgcccggctaattttctgtatttttagtagagacggggtttcaccttgttagccaggatggtctcgatctcctgacctcatgatccacccgcctcggcctcccaaggtgtattagttttctatggctgctgtaaaaaataaccacaatcttaagggcacagttcctatagatcagaagtctaacacaggtctcgccaggttaaaatcaaggtgtcagcaaggctgcattccttatgggaggctctggagaggaatcagctttcacattcatttgtattgttggccaaatttggtggatggatgtaggattgaaatatccacttcattgctaactgtgagtagaagggcacccttcactcttagaggcctctctttagtttgtgtttatgacctcttacagcacagccttctcatatttgaaatctaacttctatcattgttcctgctgttcctcttctgccttctactgttatctatgtggctccagccaaaggaagttctctgctttttcatgtaattagattgggccaacctggataattcaggttactcttcctaaagtccataaacttcattatgtctgcaaagtttcttttccatgcaatgtaatatattcacaggttcatgggattaagttatggacatctttggagagccatgatttaacctatcacatgggggaattcgttcatttatgccttgaaccacagcactaacagtgctaggctttggagtgtgaaacaatgaaggtcatagtttcttatttcaaggattgtatagtctagactatgtagaagcagatgaaggagtcagagaagggcactatatcttacatatgaattcactcattatagtaattcctagatagtctataatatttttgttaatagtgatattaagtaattacaagaatctcaggcagcagaacttcaaggggagctatgcagcatttagaaaatttattcactccttagggttccagggaggtcacttggtagcagtttagtctccaggccctgtaggagcagaggacagggattcccaatcatcaaaccaaaatcagagtccagtccctcaacggggactgaggtctcatgagtgaaactagtgagaacctagaaatagagaccaatgtaggaacatattgtgagagctcaaccaattatagtagaaaaaaggatgagtaccctgggacttggggcagccatacacatgcacagggatttccctttcatggttcttgtgctggatttgactggtagcaaggagacttggagaaacaactcaggagaacagtggtcctcactgggccacagaaaaccctgtgtgtttggtagcaacgtaagtgtgaatgccaacagtggctctagagcaggagaggactgatcctggggatcgtgtcgggaagccatgaactctcagaacctgagagtccttgattactctgtctgtgggtttggagagtctctctcaaactgaagttttacttcgtattttagaaaaaaggtgtcaagatttgtaaaacactgtgacaggtgacaacggagactaagaatttaaggtttgggatatagaagatatttttggtaactgagattcctgtcacctgggacaatatcaatttgttaaattcagattttttaagatgtatgtgggcctacatatactatattaacttatttttcttcctttcctcctaaagcatttttatttcattttatttatctttttgaggcaggatctcactctgttgcccaggctggagtctagtggtgcaactgtagcttattgcaacttcaaactcctttgctcaagcgatcctcccacctcagcctcccaaagtgttggccttatatgtgtaagtcaccgtgcctggcctaaaagcgttttaatatggattgcattaagactttttacaataatacattagagagaaaattatgagaataaggatctttaaatgtttttccttttagtaaatagaacaaagggtgatagtagtatatgccaagcttccccaccctctgaaatgaggaattatatgtgaaatctttagatttttttttctgtgagaaaataacagaagctactgtataattcttagtcttcaatcttcctttctcattaaagtgaaaacacaatggaaagaaatgaaggatttatcatatttatataggcaaatctttacaattgatataaaataaaaggaaggagggagccaaagcagaccttttgggagatcctctgattcaggaacagcagctagaagcttctgagaagtaaacacaaaagaggagaaaccgtaaggttctgagtgttcaaagaatcaccttcaagatttttaacagtcatacttattagttttgaggctttttttcccctaacaaatgagcttaatgtttaaagagccactggcatgtacatatgttgactatggcttctattttaattttatgttaaggggatcaccagaaaagcagtgtggagcttgtaaccatctaacctgacccaggtaacgaaagtcagccctcagtagggcattatccaaccctggagctgaggctccaatttccttggcctttggggattggatctcacttctaatggtattcacggctgccatgtatcgtgcaaggtcagtaatatgtggctgttctgatgctatatttaattgcatatgttcacattatggttttattgccagttggattcagaacctttatgatattattgggggagtgtacaagatcgtggataaaggggatagagttttatgcccgggtctttggctcactccagatgtgacctcgcataaattagccacctttcttttgatttagctacaactgcaatttatgttggcttgtggcaaagctaactgcaagtggttttgacataaaatgtaggatttatataattagttgtattttcctgtaaatcttacgtagattaacttttacctcataagaccacagagaagagaaatctctaaaaatcattgcaaagcacttgcgttaacacatgtatattgctatgcaaatgctaactaatgataataactattggaatggagcttaattgagggactaaaaatagctcactgcaagcaaaatcgagcacgtccttttagttgtgctaatattatacagaaggaataggcaaaagttttaagataataatgttttattcagccttactgacattattcttctgtgtcttctcatttgagattgtctttgctaatagctttaacattttccaacaagtgcattactgagccaagaatgcccagcatccaaattactgatgcttggggcaggtgggacacagctgcaagtcacataaaatcacagctggaatgctgctcttctttgtcattttttgtatattttagcttaaaatataattattaaacctgagaagatgactgtactaattctttaggataattgtccaacatttccaactctttctacatttttacggaaaatctggaaagttacattagtcttgctattaccaaggattattattccttctacaacatactgattacagggattttacctttgttcaaaatttatttttaattaattttgttgatctccagtcatatacagttcaccattttataaaccagaataccatgatgttgacaaagaaacactatatgtttctacgtatggtccaacatagcaaagtcatgcctgagtaaaatttattttgggaagtgagtggaaattataacaaaagcacatttaataaaatagtatataactttacttatttttgttttgcaagaaaattatacatagaaacactaaattaattaagctatttcttgaaataataacctgatttacaatgattttttttgccaaaaacactggactagagacctattcgaactccattttctgagaaattaaagcaaaggatccagaaggcaagttgattttattcaggtttcagacaaaggacggtatttatgaaaaggaatttatggaaaagttctttctcttggcatttgtctgtttcttttatattcccatgttttctcttttcctcttgggctcttcttttactgtcatatttttctacaagaaaagcctcatagaaagcacaattaacctcttcaagtggatacaaagcattagtttcctattacatgaataaaggcattctagttccaaaattctataagtaaatgctgttatgtttacttccagtaaattcgaaggcaggaatagaagggccttagcaccttattaaagactgtttttgccaatagtctatggagtagatagaactactctttacaaagatttttaagcaagtttagatatttccaagtattaataattgtcctttacatggtatggccaacgcaagcttgtgaatctgctatttactaaatcttctcactaccttttctatcatatatgatatacatgtctagaatttcctgctattaaattcatactgatgagaggtgtcagtcttttgcaaattgaatctttcttcaatataaaagagaaaggtccatttcccaattcctctctcaatctctcctttactcttcctctctctctcccttttaagtgacacttgccttttgcttagtgacttttcttggaatatatcactattatgggtgaatgtttgtgttcccccaaaatttgaatgtcgatgccctaacttcaaatgtactgttatttggagatggcatctttgagaggttattagggttagataaagtcatgaggatgaagcccttatgatgagattagtgcacttatgagaagagacactagacaggttgtactctctttccaccatgtgaggacatagggagaaggcagcactctgcaagccagaaagagccccctcaccagacttgaccatgctggcaccctgatcttagatttcccagcctccaaaactgataaaataaatttcttttgtttaagccacacagcctatagtattttgttatggcatgctgagctgatgaaaataataataatatccatttttcatggtatgtgttaattctaaacatacgtgacaagagcatattaaatccaagtagctttcttgatcaaacctcccctgctaaggacatatctgcaatcataatttaataacttggtgctttcattttcctgtgtatttacttagctttaatgttttatcatgagaaatggtgccttgcaaatactgcaaatgttttaataaaataatattctactagatgcagaccctggaaaatgtattctaaaaggtaaaaaaggtcaaaatgtctaaagaaataggtgataaattctagaactagaaatttgcttatttctagactataaaagataccaagtaaaattccattttttctttttttttaactgtacctgttttctttttattagtgctctaaaactgttcattactttacaaattggctatagtattcattactaagtgaaataataaacagaaacaatgaaaaaagcaagttgcctaataaggataatttatttccatctagagagttcattatgtttccaagcattgctattcttgttaagtagcatttacctcctcatagctgagacaagcttacaattttttaatcagaggaaactagcaatttcactattccaactagattataatatttaatcttgttttttttttctttttttttttttttgccacaaagcctagctcctaatctgtgatatctatcactggaatgatcatgtaatggccaaaaagaaaacatgttctcatatatgtgcaactctgtattttttagaacattgctattaatctcatgatatctataagaaatttaactagaataattgactacatgggacagattagtgtgaacctaatttatttcataaaggaatgaaaaattgaaaatgtccttttaaattatttagtataggaaggagagaaaatattactagggaattttttaacatgctgtataatccattcatattttcattagtattaagcctgtatgtcatatatatgcacattaatatataagcatatgttaaaatagaatgttggctaatggcaagtgttatgaaaaataaataccagtttattcattataattcaatgtaaataattgcattctaaaagctaaatatgtttagtttattgaacttcatgtttttaatcaaagtattttcatagaaaacttattatcaagcctgtgtctcaataaatttcttgataatttgattatgcaattgacatgcaatttcttgataatttaattatggaaagtaaaaaaaaagaaagaattattgcctttaataataacatgatctaataaatacagagatcaaataatcattattgtttgggtcttaattaatagtaaaaattacagtaaaatctcactagtttagacttgtgaaagaggaagagaagtaaattgatggaattctgaatcatgagaaatattttaaagaattatagttttactatgttcacatagataacaaaagtaggttaacaaagtgatatcaaataaatgacctgagaactgacttaatatataaaagagaatgagttatacagtttccaatttatcattgcttattaattattaatgctatctttagatattttttctcctaaacagttttgacatgctccttgcaaacactgttatcaaggcctaatttttttttaagctagctgtactgccaggggttagaaataagttctaaggggaaaaaatagactctttaaattccaccctcaaaactagctcctcctgacaacataaatgacaacatattattcctgttttcctagggataaaataaattttctgataactgatatcaggggcttatgaggcacacatagactttatactgttaaaagctataatttggcccggcgtggtggctcatgcctgtaatcccagcactttgggaggccgaggcgggcggatcacgagatcaggcgatcaagaccatcctggctaacacggggaaaccccgtctctactaaaaatacaaaaaattagccgggcatggtggtgggtgcctgtagttccagctacaggctgaggcaagagaatggcgtgaacccgggaggcggagcttgcagtgagccgagatagagccactgcactccagcctgggtgacagagcgagactccgtctcaaaaaaaaaaaaaaaaaaaaaaagctataatttaggtcataggtacaatttctggtaaagatgtaagaaacttattggggctaaactaaatattgcctggaatatataaataacaactaacttaacaccatgttttgttatcatttcttaaaattttgcgattgacgcaaggcagcctatataaggcttaacactacctactacatattttctccatacagcttgggtgaaaggtgcattcattcatttattattttaataaagatctaatgaaagccaactttgtagtaggcaccgaactacaagctgaggatacaattcaaaacagacacagtactcacccttatggtatgtagagttaaataggatagctggacactgaacaatttacagtgcaaataaatcattacaattgttgcaatgctatgaaggaaaaagttaaaagtgagaaaaatgtcagggaaatgattggtggagtgggtaggaccaattcctggaatactttgtcacagtcttgccacttcacccaaccttatggccattcttcataccaccattaactacaactctctcctctctgtctagatccttcctgaacttcaccctagttctgattctaaccctgaacgtctcttctgttaggactcctaactggcctttccttttccacttcttatcttgtaccatctgttcttcatacaacagccaggtcatcttactttcttgattaaaatccttcaggatttttcttttaaatgtataataaaatcccaatttctggctacatgattgattgtcttgcatacactttttagtgttgtattttttgttgttttttttaacctgaaggtgagctttcacactataaaatgaaagcagccacaatgaggtcattgaatcacctggcttcatctgaaggctgtggtgaaaacattaagttccttaagatgatctgcaccttgtcttgttcaccctccagattttccttgggagaaatttagcaaaagatggaagacaatttataagtcaatgatagcatttatttcattttacaaataaatcaccactgtaccctaattttattaattataatccctgatcatgtcagcaaatatttattgctataatgcaaattttaattcattttgtctatctacatttctctctttctggctgtctctcaagtcaatatgtccagataggaatagatctgtgctagtcgtaatcctgaaagacacaatcctgaacgtcataatcctgaatgttgaaatccctgaagatcaaaatccttaaagtctaaaattccataactcacaattccaaaagattaaaattctgaaagttgaaatcctgaaagctgaattctgggaaagggattagcgcattttaggttttaggcaggagtctcatcaaccaaagttgcatcatattaggtggaactaatactttgttattgtctttatttgcatttggtggcaaactcagatgagtggattggccatgtgatagggcaagaatgaacactttagtttaaaaatgcaccatttgtctaaattggctttccttccagctaatgaaatcccaggaacttttagcgaaataatgctgcatttgccagaagtcatttgcatttttttttgcaaatttcatgccacaacagtgctttatcacaacattgacttcatgtgagagtattgtatgtgtacataaaaacgttgaaacttcctcaatacaggaaaagatgtctttttgtacatttgcatttgtgaaatataaaacttctcaggatctcagctctttgggagactgtgcatgctgtgctgaaccattgtgggttttggtccctctggtaaaaagatttaagttgggctgggcgtagtagctcatgcttgtaatcccaacactctgggaggccaaagcgggaggatcacttaggcccaggagaccagcctggccaaccaagtgagacccctatctctacaaataattaaaaatatagcctggtgtggtggcacatgtctgtattcccatctactctggaggctgaggcagaaggattgtctgagctcaggaggtcgaggctgcagtgaaccctgatctgactgtactaccgcactgcagtctgagtgagactttgtctcaaataaaacaaaccaaaggcttaagttgtccatgatggtgttttagatgactgtggttataaagctgggtgtacacaattaccaaccatagtaatatgtgcttatacatttcactgtttgacctatttctatatgaatacagttcatctgctcataaatgttatactcatgagactgtcattagtatacctgggtggttatgcttgcaaaaatatgtatgccattattgcccattttactatataaagtggtctaagaagtgttctgtggtgtttttgtgtttctcaaataaatccttaaaaaatgtaaataaatatctttaaagaattttttattcttttttgcagaattacacttttgtgattttgatcttttagaattaaaattttcataattttagactctagggattttgatcttttaggatttaaacattcaggatcctgtctttcaaaattatggctgaaactctaataggtatctatacatatggataatgtctataattaaataaacggtgtggtgcttaatttgaacattctagtgtttttaaaataatttttcaaattttcttttaaggaaagagcatttttatgaattccagctttattcaggttatttttattttcacgtcaattacatgtaaacaaaaacactaattaaaattccttttgcatgtagatctcatatattttaaagtgaaaataattaacaagttaaatataaataaaactataactactataaagttaaatgtaataataaatttaatacgctaagtaacattattttgttatatagtatttctactgttgagtttaataatgaaaagacatatttgcttaaactatgtcccactttttgttattttgatttttgtgattttgatcattattgactgtgatttttattttatagttaattgacaccttttaactacaaaccattattttgatggtctaatcaatctaatgtaatgaaacacctgcaaaatggatcctaatttttaaagttaaggctgggaatgatagcagttaatgtctctttcctatagctctctttttaaaaatccttttgttttttcttttttcataagagggaagctacactcagtagccctcctagcctttccacatactcacattcactcttcctcctgagagaaagaatgatttaatctgataagagtatggaatgaggaactgggccttttggccacccacttccattacccttttacattcccaaggaaacatccctcaggcttcacccctgcctgccacaggggagatggctgctggggtaacgggaggtctgtgctgaaccagagggtcaatgactgaagggtagcttgtccatttctggcatgaggcgtcagaaagccccttgtccgtagacgtaaaccacattgcataatattgtctttaatagtagtaaaagtgatttttaaaatttctagcttctaaacttttctctgtctaattcttaattgttcaagagaattatagtaaccttcaaatgctaacaaaaaaataacactttaacaacaacaaaaatcttgcatttgtatttaatacaatggataagcacagtattgtacctatgtaatataatatatcttatctcaacctgaactgaatactgtgtgctataatgcatttcttctaaattgaacatgaacaaaaatttttgttccctgtgctgaatcgcttctcttttactttgctctcttaagagttgaaagtccttcccccttatagctcatccttatgacatatgacttcatttaacacatatggattatttacataaatcctcccctgttcatttccacccatctacactattttattttattgatattagttctcaatttattgaataacctaagacactaaaaccatattcaattaaaatgcctttcaattgcgaatcacactgaaatgaaaggttttctctttacaagcaacaaataattcaacttgatcacagattagttttagattatctatgaaaaatcaaacaaaagtataaaaaactcctgaagtttgtgtatgcctcttaggaatctataaacctgcgcttataaaattaaattttaagtaatttactataaaaatgatttttaaacaaatattttgatactttgttaaatttaagagagtgtttaagaggtttgaaagttggagatcatcaaaattagatgtattttgattagaaaggcaattttactaatttttaaatacttagtatttttacatatgttttgttaaatacaactagccaaactagcaatcatcagtgaagctggaacttgaaaaagaatatagaagtggatacttgttaattttgctgtttaggaacagagagaccttgctaaaattttctgtgtgtctcatatatgttcattcagccataatatttgtcacacatacgcacacacaaaatttaattgttacatatcacatactgttgtttaattttttttttaacttttgccttcacttgaattaagggcttgaaaaattaaattactatatattaggctattagaggacactgaggtcactgtccttcagagtaccagtcaaccatgactgctttcaaggaagtagggagtcgcttgccgtactgtatgcttttcctgggagaaaaaaaatagtcattctttttttcaagcaattttcagcaaatattatctttgtttggtttggtttgctttatgctggcctttgaaaatttgcaatattttaaaaactatgaaagaaggttattatgtgtagaacacattattattttatgcttgcatttttgaaaaaagactatcaaatgaacacaatatttttaaagaaaacaacaaagggaaaagggagagtttattttaaaacagaaaaacacaaacaacacttcaaatgaaccatctggttaaacaatggctggaaaaatgtcagggaaatgacaataatacatttgtttctttttaccttctcattttattattcaaagtcagtatttgcattgactccctgagatatagatctctgagcttccactttgagagaaggaaccctcagaacactttacatatccatgacgtggtgctagttcaatgataagaatgaaacacacctattccagctttctgtttcataaaagaggacaaaccctctctctgttgttatctgaactggacaggtagtctcatttgcttaaaaataacccaggaataggcaaactaaatccccaaatgccaaaaagtagagaacaacaattcatccattggatttctgaagatttttcttaagagtcaattgttaaaacagagatgtcttttcgggaaataaatatcttaatcttctatcattgtgcatgcatgtgtgtttgtgggtatgtgtttattgttacaattctgcattctatcaacaaatatttaaatttctacaaaaatgatatgcaagtcaaatctgaaggggagagctcctaaaaggagaatatggaagtttctgtaagttaggaatcttcttaaatcttaatggggtagtcattagaggtgtgctcctgctctccactttctgcacaccttatatgattgcatttcctatggccctaattgttggtgaaccgtatgactagttctggccaaggaatgtgaatggaaatagagtgtgccacttttgtaccagagcataaaggccctctgttgtccattttccctctgatgtggtaatataatgttccagaaggtggtcattcagcctttgctttgagtctcccagaaaattctcaaaggacatgaaccttgaaagaaaaattaaatcctttcgttctaagtcaccactgtgtttttgagtttattatgcagcataacctaatccaacctgattaatatatctaatcacacttcaataatttcataactttgcttaggccctgacttttctgtaagacatgattatttagtcaaactgtatatactttattttatttggaaatctgtatataatgatgaggccactttatatttgtacatcctttaacaattttcaaaatatctttacatatattatctcacttattttatacaataatttccctagaaaatataagaatattattaccactgtttaggaatgaagtaatcaaggttaagaatggtcgagtagtttgctatttagtattaaagccaagacttaaatacttggatatattataatttgctatttctctccctccaccactctccttttcccgaatcattttaaatgttctgaacatccaaaagttctaaaccacgtgcagtgagaaagttaatgggccagattctgtaacaggaaataatattaactaaaggagaaatgtcctccattagaatgaaatccacgaccactgaggaccttaattacatagctcttctaagagagccaagatccctacatgtgttaaagatacatagacattgattttgtgcaagagggaactagtaacaaattatgcatataatgaataacatttttattaaagaattatggaaaaatcatcaataatgttggttatgtattaacaaaataatagacctatatattttcttgaaattagaagtgtggaaatcagtctattgcagtgaaattgaagtagctagttttataacttttattaggattcgttggaacaactaatatttacacattctccatatttctgtgaaccttaaagagaatccttaagaaatagtaaataacttctgaaagccagtaaatatttactgattagaatgcaactgggggccaggtgcagtggttcatggctgtaatcccagaactctgggaggctgaggatggcagatcgcttgagctcaggagttccagagcagcctgggcagcatgacaaaatcccatctctaccaaaaatacaaaaaaattatccaggtgtggtgacgtgcacctgtcgtccaagctactcgggtagctgaggtgggaggattgtttgagcctgggaggtggaggttgcagtgagccgagatcatgccactgcactccaggctgggcgacagagcaagaccctgtctcaaagaaaaaaaagaaaaagaatgaaggtgggaggaagggagcaacaggacgaataacaaaagcacaatataaatatttattattaaaaagataaaagaggtaatagcacaaacataatgaaggctctctcagtagtgtgtaaattttgcttaaataaatgcctaagacgtggtgttcataggagacgctttccaaatttgaaaaaaaaataaaatttctatcttttgtcttgaggggatctgtcacatgtttgtagaaatacagtggcacttctgcaagcaaacctcccccaccgtcacatctagccaggtgtgaatcacaaagccagcatgtgactcccatcacaatggaaataaggaataaatgaggctattaaatgtaaagtctcttaaatgaaccacgttaacattctcctcttcaaagacagtcttagtttttgtaacatccaagcttatttttataactcacacttctttagaatatctcaatttgaatatcaatataagattcaaaataatctagtatctcccttcaccacattttcacagtaaatatgaataatgcacatggagcattgaaatatttttgctgcttcatagaatttagagtatggtcttatacaaaaaagtaacttaaaagcctttttgatataattgttcatatcatcaattactgaggtatacacgtacacagagtaagaagcttttccatatgaagggatttagaaacatgtaatactataaatctatacccttggaattgaaggaaagttctagccctgtgtctgcacctgtttctttatgggacagaatataaataactaatactgtcaagtttctgggggtaaagaataggatttttcctacattgacacaaataagctctaagaatatgtagcttttgtattagcttttctattagccatatgttctgtgtcccagctgttaagatctcctacagctgattaattatattttttaaaagtcaggcaatttacacctgtgataccatagatcacttaaggctaatggactggaagtccttgcgatattagggatccttcagggtatgggtaggatgaggaaggaacataatctgtgccccataatctagcacagtttcactctttactaatgcttagggtttagataaatgtctcattaagaggtaaatgtctcattaaggttattagggttattaggttattagggtttaggtaaatgtctcattaagaggaaatgcatttgtcagcaagggctgtaggctcatagggtatgattgcaaaagacttttctgaaagcttagctttggataaatcttcagctagcctaggcagagtgcatattctatcctgtgaaaacaattggtgaacactggtgaaaaaagagtgtattagcccacaggccacagaggtgtttaaagaattgagcttatgtacatcaatgttcaataggaagtccagtttatttcatatatagggtcaacagttaaggaagaaactgggaaagaggctgtgtcatgggaccaacagggagggtcagtaaaaatattgagtaaagagaaagtttctttacaaggtttttctgtttgtttgtttgtttgttttaaagctagttgattcaagtaatgcaattacctgattttatagctctaagacagttattttcactgtttaccaaatggattggggaattttgaagataacttaaaagcctgaacaaatgttttagaactttttcttaggtttcgatacaagagaaggcatttgaagtaaccaccagtttcttcaatttctaagatatcttttcttctttttctcacagtaaatgtgagttttgttttcccttccttatagagttattaaaagcagtaaaagattatcagtgtccacaacttcagctgtggtcatcattgggaaagctgtcataaactttaccttaataaaaatcaattgctcaattttctatatcagtgaacaagaacactaaccaagaaaaatgaaatttatgtttaatctatccatttagatcagatggtatctcagtcataagggaagcaaagagctctggataaggaataaggagctctgggttttaattattctctgctactttgatacttttactataattggaaccctggagaaaccaaggaccaagtctccttgtccataaagttagagccaagatcatttctggtttatgaactacaaagttctttgaactatgaatgctgtgaaggcattctagagccaccaaatgtaaccttactcagctaagaatcaagcttatgttctaaagccttttgattcatttggcagaatatcagttggactgaatgggaaattactgcatcaattggaagcttccagactctcaccattagtgttcccattattcattcactgtgtatgataatcctagatcaatatccaaatctatgggagctggttctaagaaacgctctcagagtaaatctattcatttattgatgtaaccaattattcagcatgtattcattaatgattatttatatggcactatattatatagactgtatacaaaagaaatgctctagtctcacagagcttatgttatattaaatgctagtataccttataataaggatttttagggccagatatcagaagtcttggaatcatcagggcagggaccccattccaaacattactgccaaagagaagagaaccgcaggcttgacaaggcttggtggaaggcatagtggctgaaattcaccaacaatcaaaattgaacaatatttctgaaaacatatgttctctgacatgacagtggtatgtttattaggaataattatacccaggaaaagtaattggaatatcattaaatctagaatgattatgttgagtcaaaagaaaataattggttgtttgagaatttctgctttgatttggagagtagaaacccataaatatacagtattatattagttggttctttgcaagaatcctatgcctggatagcattaggagatatacgtaatgctaaatgatgagttaatgggtgcagcacaccagcaaggcacatgtatacatatgtaactaacctgcacattgtgcacatgtaccctaaaacttaaagtataataataataaaaaaaagacagtgacatgggaaaatgtaaagacttttaacagcaaacctataaaataggtctctggcccctaaaaaaaaaaaaagaatcctatgccttttgtttggcccctttgtttttgctttctccagccattttttccaagcattcttttatcattttcttagactctgatgcctagaatatccagtaccagagataaagttctggttaatacattcacaataagatgtaaagggattggttaaactacatttaaaggtgaatgtgaattttaagaaataaatggagaaagataatacataacataaaagaatatcccattaatagtagactctcaggaatccaaggaatagctgtttaagggaggaaaaaaatatatataggagttcctaatttgtttattaataaggacatctcattgttaattgtttccttaattcatgccacaaactttttttaacttctaaattcaggggtacaagtgcaggtttgttacacaggtaaacttttgtcatggggattttttgtacagattatttcattacccaggtattaagcctaggacccattagttatttttcctgatcctctccctttgcccacccctcaccctctgaaataccctagtgtgtgttgttcccctctctgtgtccttgtgttctcatcatttagcttccacttataagtgaaaacatgcagcatttggttttctgttcctatgttagtttgctaaggataatggtctcaagttccatccatgtccctgcaaaggacatgatctcattcttttttatggcttcatagtactccacagtgtatatgtgccacattttctttatctagtctacattgatgagcatttgggttgattccatgtctttgttattctgaatagtgctgcaatgaacatacacatggatgtgtctttatagtagaaatatttatattcctttgggtacataacgagtgatgtgattgttggttccaatggtatttcattggtctttgaggaattgccacactgtcttccacaatggctggactaatttacactcccaccaacaatatataatgttcttttttctctacaaccttgtcagcatctgttattttttgacttcttcataatggccattgtcactcgtgttagacagtatcttactgaggttttgatttgcatttctctaattatcagtgatattgagcttttttcatatgattgttggctgcatgtatgtcttcttttgaaaagtgtcggttcatgtcctttgcccactttttaagggagttgtttttttcttgtaaatttgtttaagttctgtatagatgctggatattagacctttgtcagatgtatagtttgcaaaaattttctcccattctgtaggttgtctgttcactcaattaatagtttcttctgctgtgcagaagttctttagtttaattagattccatttgtcaatttttgcttttttttgcagttatttctggcgtggcaccacgcctggctaattttgtatttttagtagagtcggggtttctccatgttggtcaggctggtctcggactcctgacctcaggtgatccacttgcctcggcctcccaaaatgctaggattacaggtgtgagccaccatgcccggcgacctgattgttttataaagaggagttcccctgcacaagctctctctcttagcctgctgccatccacctaagatgtaactttctcctccttgccttccgccatgattgtgaagcctccccagccatgtggaactgtaagtccactaagcctctttcttttgtaaattgcccagtctccggtacgtctttatcagcagggtgaaaatgaactaatacagtatgggtctaaaaattgtccacctgtcatttgtttattcatttagaatctaaacctaaccttgatagggtggtttcaatgcaatcttcttgaaataaatcacagaaactgtagatcgctgagacccaagtagctagaaacttaccatcttttagagttttaggatgaggggaagtgaatcatattacataatatgtaatatgacttacattctcccaattataggtataactcttcctcctgggaagtaatttagaatctagaactgggagaagaggaacacaaagttctctttgtctgccttttaccaattcattccaccttagggttgactcacaggattcttgtaatctagcagatatgagctcagcaggcacattgccagagaaagaagtactaagtagatagttttcttatttattgttggaaggacaagaattgatttttctatgccaagtattggaagtgatgttggtaatgtgcaccttctctgccatcctccccttgcaataatcccgatttgttcaaatagtcaggaaaataaagctgtaatttagatctagaagtttagagaatgccagacaattgtaatctaccaaaatatctgttacttccagataaaagcctttttcttttgagaaatgaatgaaataatttgggatcctgtgtctttattacaatgattataatatatttgaaaaagatcttgagactaagacaattttgtcaagaacaaggaatagaaataaggcaccagaattggtacttagagctataagaatctttttttaggtttttgaaaacgaaaactttttttaatgcttagagacatttatcagcttgagttataaccattttgtttataattagtaagaactaacatcgatgcagtatttactttgtgtcaagaaacattagcttcatttaatcctcataacaactctatgaagcaattattattttcactacctctaatttttgaaatgaagaaatagagagagtttaaataacctgtcaaagttcatagagttaaaacatgctgaaggtaggataaaaatctctatcagataccgacacctcccacaactttctaccaacctgcctcctaccaatctgccttccaggggttgatatacaatttttaacatcatattacatgtttatttattctacatttatgttggcatttgcaaataagaaaaatttctgctaattggtattactgttaggataataggggttatggtgagatactcacaacataattataaataagattgccctaagggagttcaatttatcaaatccaaattaaacgactacatcagccatctgcattagaaaatcaagatattgttcataaaagtgtaagttaatgttaaggaaacaagagatctgagaatcattttagaaacaatactgtttgtgtgtctaatctactacatagagatgtaattggtttatcctatttgaagaaaaattgtgggaagagagtacgggtgctgagccatggaagcataaggaaaggaaagactcagaaacacaagttggtagagcatccactcgctgccccgggtggactgaatctctgctaagctgcctcaagtgggaaggtttctttgggtagtgtatcggtcttgtatgtgaaaacaactcaagctaccttagctaaaagtcgcttaggataaaccaacttgttctgataccaagttcactgttgtggttggccattttaagtattctggtcagcttgatgcctgcaaattaatgaactgaggttctgtttcacacaccaaccactatatgctagttcatataggtctatttctacaaattagatgttctctcttattctgcagatcacaccctgtgtatggtaagtccactggggcaaaggccacattacacctctttcatctgatttttcacagtttttaaggacttctacaatttgtaagtgtcttgatagctatgctatggtacaaagaaaccatttggtagaagttgcttgctaacacattttggtcacttaagcctgacctaagtcacctattcatttgttctaaaactttttctcttaacatcctctaatcttacctacctggggtagatagtaattaggaaaaaaaattatatacaattttgattcatatatatttctaactaggatgcatgtacagagcaatgcagaactgaattcagtgaatttgtgatttttcaaactcactttataatcctattagtattaattattataactctttaatatagcatggagaaaataagttttgtaatcactatctttgggtgatatgaaaactctaggtattgggagaagcaggactctgctgatactacttgtgcttctccacgctggcatttacctttcttgtaaacactagcaatctctgtagaggaagctaagccaaggctatgcacattgaaacctaaaagatggagactggtagcagagctcttctttgagcactgctccgtgtattgtaactttactcttctggtatgtggttgtctcctgctggcctccgccatcctccctttctccatccactctcctctcccatatgaactgcagatggagaaggcatggctgactgatgctctgctgtcattagttcgtgtatgccagattcaaagggacctttagttttaccctgctaacaatatgcttaatttaaacactactgtgactggttgtagcctactgcttcatatcccattccccataaccctattctctatttgttgctcactgttcagtcaggcaattcaacataagtgtgtgttcctacagctgcctaatatgttttgctattccacagtaaattagccgcaactatccattggtagctattgacttttactgaagtgaaaaataatgcatgcatatctacatgcaaaaatgtatcctcgtgaaacctctgagggaaataaaaagaggaagagacacgaacgtagttccagaagtggcacttgctaaagaagcagaagtgtcagctctgcaaaaaaaaaaaaaaaatacgtgggtagaaagaagatggcttatttcaggattcttaaagccatggaatcctcaattagtttggcgacgtgctgatcagtaaagaaaatgactagaaatgcacttgagttggactaaaatagattgcctgagagaatctggaagtcaagaattttcctgctaggtaacacattacaatgtcccctatactttctttgtctggtttgttagaatcatttgtaatcagtagttctgtttttttttttaagatgtcatttggcaagttacaagtatcagtcaaaccaaaggcacatagaaaaatgtttatcaaaagaaaaatcatttttgcattttcctattggacatcaaaatacaattactagaacacattgaagaacacttgtatcaggaaatatgtccaccttttaaaaaatgtaggtatgttatttgatgtttcattgcattggcttttattttcatgtttttgtcactatgcctgacttgtcttgcatgttttgagaaaccaggtgacaaccaaacaataaagaagtgaaaaagtttgaaagataatctagacatattttaactctcgagtgattctttaaaagcaaaaacaaagaaaaacaaagaaatgctaggcttatataagttttaaatgtcggctgggcgcggtggctcacgcctgtaatcccaacactttgggaggccaaggcaggtgggtcaggaggtcaggagttcgagaccagcctggccagcatggtgaaaccccgtctctactaaaaatacaaaaaattacctgggcgtggtagtgcatgcctgtagtcccagctactcgggaggctgaggcaggagaattgcttgaacccagcaggtggagattgcagtgagctaagatcatgccactgcactccagcctgggtgacagagtgagactccatctcaaaaaaaaaaaaattttttttttaaatatattttttatcattttattttaatatcctaaactagcaggttttattatttcattgtgcatatgaaaaaactagacaagaaaatagagtggcttggccactgccaataaggctaactctgtttatgagcagatacaaccccaaagaaaaaaaacaaattccttacaatatactaagtcttttgtctccttttcttttctttggatatagaaaacctgcaattctggcagctgatcataaaagtgaaggagataagttaatataaaatgttttctcagtaaatagaactgtgtgctcacatcgctaaagatgaggcttttcacaaagaatgaaaggtctaagtctcttaatgccatccggaggttcagattaattaccctttcagttaaggtcactgacagtgtaaagaattttcagaccccctagagccaagtgttatctttctcatacagcagccatggatgcttaagtaaatcaatacatggcaattagcaggtaataggcatgatttttaagtagaaataagatatgatgatcttgctatagtacacatatggctagccatgagtgaacaactgctgctatcttgctgttgtaataaaatatccatttcaatatagagagcaaaagggccatcagaaatgaaagaaatcagtatataaaatattcaaattttttgtttttaaaaaattatttaagggagattttatatattcttggaacaacaagcttctagataggagtgattttataatgttgtattttgtataataggcttttttaagagaagttttaagtttacagaaaatacagttcccatataccctcctccctacctacacgtacacagtttccctattattaacatcctgcatgagtgtagtacacttgatacatttgatgaattactactgatacattattgttaactaaagtccgtagtttccattaaggttcactctgtgttgtatagttctatgggttctcacaaatacataatgccatgaatctgccattacactgtcatacagaatatgttcactaccctaaaaatcccttgtgcttcaccttgtacctctagataagagtgattctataatattgcatttttatgtgtaaaactctaatgtgattgtagtttgagcataaaattctattttatgggtatttcaagattgatttaggagctagaatagcatgattcttcttagaacacctttagtattctttcattgtacattatttctattaatttttgtgggtaccactgtaataaagtaagaatttaaagccttgtttttaactcaaaaaatttgcattttaatttaaattgataaatgagtgaaaaataatacacagcattagatgacaggctagcaggcagtaggattaagtgctgaatgagtgacaccaataaaattggggaggtgttcagtggagtgatcatacacaagggcagaggttaagacagaagctaagtggattaggaggggcttgagaggagtgtgatatggataggctgagagaagggagagcattcgggcaggtgaaagggctggccaaaagctctagaaagaggaatgtctatgctgtgtctctatgctgctcttggagcacaggcagtttgtgaggctatgtttggtcccatttgctaaaagcctttgcccacattcctcactgggaacatgctaatttcctggtggcactgcaggtaagcaagactcacgtgctctgttcccaagattcgcagtctttgccttctcagctctccttacctcagccctggaaaatgtcttcctagtttagacacaatcttttcacttcatattactctgcttagggattctaatatagacttatgttttccgggggcaaaattgacaaaaagggaagtaaatatcatttttttggttttgttttctagtctgtttcaaatgccttttaaggcaaagaaatgcaggggtctccatgttttgtgtggatgagagcagagggaagaaacggataatacaggaagaaaatgaaaacaacttagattaaaatctcaaaaatatcattttatcacagaaatgactggactaaaatatcccaagcttgtctcaaaattaattttggaaccaaagatgtctgatgttaccaagataacatcttgtcacagtcttttagggaagtaaagagcaatttctaatgacaggggatgaaagactgaagaatgaatgaattatatttgctgttactaatgatttgcctttattagtaaccttcaaccatgaggtagcagaagaggcaatagggcaggtttaataaagaggtcccagcactggcaagggggttcagtgcaattcacccagtaagacttgctaaggagacaaactggactttagagggaagtctggagcaattagaacaagaaagtaagtcttttaagtcatagaaggaaattacatcagagtaaaaataagtatcctaactccagtaggcaatttgtaacacgtagaactttaagaagttggaaaaataaacataaaaaggccatgtgcagtggctcacgcctgtaatcccagcactttggaaggctgaggctggtggatcacctgaggtcaggagttcgagcccagcctggccaacagggcgaaaccccgtctctactaaaaatacaaaaattcgctgggtgtggtagcaggtgcctataatccaagctactcgggaggctaagacacaagaatcacttgaacccaggaggcagaggttgcagtgagccaagattgcgccactgcactccagcctgggcgatagagcgagactcagtctcaaaaataatagtaataataacaacataaggagacagtaaaaagtctgtgttgtgattcccaggacacaagctacttatgctttgcccctttataaaaatatactctacctaactgagtgaggaaaagactgctctggaggctggcattcatcatgctgggaccgagagcttggatgtgttaggggtgaagctggggtgaagtagcagagattagggagagactactacacttgcactatgttattctgaatcagagaggaaacactcggagttatttaatggtttcatttacactaaaacacgtagtcttcagtatctagaatattgcctgaaacacagtggctgtgtagtaagtggtaattaaacccaagaaattatgtgggtatagctaatgtaggagtcacaactcattaatagctctttttttcaaatggactaaaacaacatacatttactattttacagtttctgagggtcaggattccaggcatggcttagcctggactcattcaatgaccaacaaggtatcttcaggctgcattcctttcctaggttcagagttctctttcaggctcacatggctgttggtagaattcagctccttgcagttgtaggactgaggtccccatttccatgctgtcatcagtaagggaccctacttgcctcccagaggctcctgcaggcactgtcacaagagggtagcttattttctggaggtctttaggagggtctaattgaaggctttcatctgattaagtcaagcccacccaggataatctccttactttttgatgaactcaaaatcaactgatttaggagcttacttacatctgaaaggatccttcacctttgccatattcttgtcatgacattttaaaattcagcctggaccaaggaaaacccaattgtccaaagttctcttgtgttagcttgtggagaacattgcaatattattatcattcctaaatttctttgtatctaaattgaaatatcacagacataaaacatttgtgaattttaaccacatgatcaggtatcatagaatcattaattcatagaacgttagagaataaatataaaaacattagtcctatttcattcacctacaacttgttctctgttagcgaatgtacaaataattcattttcagaaacgtaagcattcagtattaaatggaaatatttacaaaatgttagactagagattaattgggatttactgacattatcatagaaactcaaaattcggtcaaacaaaaattttagtcatatcccaaacgcttttatcagattttcacagagtatggtgaatatcatcattcacgccatagacactgccatttttcaacaaatactacttgaatgaacattttgatctgtgaaaatgcaaggttagctctttccttggttttattttcattttttcaaagtatttatatattatgtagaatacattttctggaaatacttttaaacaattcttgaggtagggtactttgttttcctgtgggatgaaggaggtgatttatagtagttataagtctgtccctttaaatttttatattctcaacctgcaaagaatgaaatctcagcaaataaaagtatgtcagtgggaaaactcacagtgattgttctctgctggaaggattaagtaaatgtagagtttcaagcaggcttaggcagtgaactgtaaaagactaagggaatgtgaaggtaaaaatctatcttccctcaccaactgatcatgttgccagtaccatactctggaagtagcaatgaggttacctttcctttccttttctctgcctctccagcagctgagagttgaaccctcagtaccaacacctgctgacaaatcagggcactgcttatggttagtaacaggataaggcatgtaacctaagagtctggccactgccttttagctctttcaaaacgaggttccttatgacttgcaatacttgccttccaagtttcttattgagggtctaatgaaagaatatttacagaagagttttgtaaacaccatataaatattagtatgtatgatattccctcaggaagtacatatatatatataaatacacacactgtatatacactgtaagaatctaaattagttatttctttttatagcaaaatcattttaaaaactgttgtctagtaataattctgtgaacttgtgtactgcttttactcttgtgtactactctgatgtactttttataataaaataacataaaaatttgtctctaccactccagaaactgaactaagattcttaataggttaatgcctcattcatttctcaaaacaatcatgagacataggtattgttattttaattaacaaatgagaaaactaaatgctaggggctgtcattgaatttaaaaacaaaaatcttcttgattcagacataagaggagaaacaccaaattaggaacacacacctttggatttacgatagttaaaatcataagctggtggctgagatatatataataatttaattgattgacagacattattattctcatcggtagaatgaggaaattgaagatgggggcggttagtaatttgaccaagctgaagatgagaaccaagacttgaattcagataggcttgagctaaaacttttgatatttccatttatttatttattcagaaatatttccagagtaccttctaagttatagaattactgggcaaattgccatagctacttctgtcatggagtttcaagttgacagataaataagagttaatctacctaccaaataaggaaatggaactgactcataattcaagtatcagcaaaatctctccctagaggagatccttcccctcaatagtcattaccactctatcctattatagtttcatcatagcacttatttgtttgttgagttgctttttggtttattttttgcatgtgttccactaggacagaagcccctaagatcaaggatcttatctaattgactattgctccccagtgcctggaatcatgcctacttatcccatcatttaattattcattaaatgtttgttaaaagaagtgaaagaaggactcctgagaagtacagagtactaggagaaagtattttacctgatatgagaaatcacagatatttgagggagtaagatttgtactgcaaatctgaagaatgaatgaggttctaaaggagtatgtgtgtggacacatgtgcacctatatgttgggaaagggggcagcaacaagcttcaggtagaagaggaagtgtgtgccaaggcctgtggtcgggcagagcatgccaaataggaaaaaaggagaaaagaccagcccaaagagccagcgcagttcagtgcaacacttggcggagaagcaggccaggctagaggcttgtaggaaattcgactttatctgaaaagtaatgaggaaccattgaaatattttaatcaggaaagaagtttgagttttgatgtttgagttttcagcaagacatattttcaatgtgaagagaagagagaaatgggtcaaccggatagagacatcccactttggagtctctgcaacagtccagaaatgaagccaaaggaactttgctaacctttgattatggtgataagaaaagttgttgaaatcacgagctctttagaaggtaaaactactcagagtctataatagaggtggaacaaagagcagaggaaataggggtggaagggatgactattaggtttctggcctgtgcaatagaatgggcggtggtaccatctctgatggggaacatggcagagcaggtatggagggacatgcatgcctgcctttcctgtatatgtgatatctcattgatactgaaaggttccgtagagtacagattttatttatgtgtaccaaagcctgagaattttcagaaaggataagggcatagcctaacaacagagctgaggtaccctgatttcaatactctgcatgtgaaccataatattgtttaaataattattatatttcaaactagtaaaagattacatccgtatgaccacaaatcttgaagtaatttttgagcatttttacattattaaattcctatatggatctcaatttctagattgtgtttacaactatattaattctaaagataaaaagatatatgccttcacaaggttttcttttcattttagaatcaagcatattctgaaaagtataattaactattttcattttaatacatctatctgaacatttccaggaatttcaaagaataaaggaaaactagaaataggtaaatattggaataagaacatccggtacctaaaatgtgaaagaagaatgggatctcattatacaatataaaaaggattacaaaacccacagcacaaaggaggtctgtttcttttcttttgatgtgtctgtgtagtgaaactgcaattagtggtaataggagttgcatgtgtaactcaaaggagcttgatgcaagattgcagcagggtacaaaatggtacaagcaaaatctcattctcattaccaacatataattttattgtctcgtttagataacataatttttctgttatcagaattgtccaacccattacatcacaaatgcaattataaattcattataaatcacctaagctgataaaaaatcaaatgtagcaaattaatatgaagtcaaggagagagaaagtaaatggtggtcaagttgtatatgaaatttacctttgtggttacaaagaagacatgcttacacttaaatactctgttctgatacagaaacatcttttttaaaattgggtttttgttttaaaatgctgttttttcttgggcaacagacaatcccttcaattttgcaatctggcattcccttcttcctataatttctgcagtgtttttctagaaatatcctgctttggacactgttggttttgtttctttctgtatagaacttgcttgtaagttaacatccattacacacatcaaacatgtgtaaccatttaattggtatggatatcatacgtgtatataacacaagtctaaaaaaccagatggtcttctatgttgagtattaacatatacatcatatcacagtacacaaaaaaggctttttacttagcaaatttgttacatatatcatagtatttacgctatttatcttccttaaaatgtatttgactaatttttaagttaaattaattgattcaggcagtttccattctcttctgcattttaatgcatattcttctgtcacagaaaaaaatacattttcaccctctaaaggatttttatgttcattatataatacataataaacctatattaataattttgccgagaatatcatggtgaaatatacattagcttgaacattgcatctctttttttcccctctaatttatttaagttacttgcttaaatatagaaaatggtgtcacagatttactcacactacatttaaatctaaagcaaaaatatagtctgcttatttttgtctactaccagtctgaacttgaaacctgaactttctgtgttgttgcagcaggggtgggccgggttgggggcggggagattgcccaaattcattttaaacataatttgagcaaacacgtaatagtgtttaatgcagggtttaatctctttagataacaattctctgactttcagactaaactaaccttctctcctttctaagatagcacttaacttaaaaagaaaagtcaccctaggatctgccatgggttttgggacctactctgctctgcccctgctgacctgatggttgtgtaacccggtctggaagtccttgggctttgatcgcgattgcttcccatcctcttttgagacttcattttgaaagagaagccagctaaaattcttgcctttttgctgggtggggagacggagtgtggaaagagtaggtcctgaaggtagaaaatgcctaatgactgagagatacaatagatggaaactccaccaaaactttctctgctgaatccctgtaagtccacatccatttgcacctggcttttttcttgcctgttaacacaatgcagcagtggtctgctaactttagtataggtgagaatcacctggaaggcttgttaaaccttagattgctgggtcctaccggagaatttctggtttagcaagtcttgaatggagcttgataatttgcaaagctaataattctcaagtgaggctgaaccgctggtgcggtaacctttcatttagaagcgctgcagtgaagcagtataactttgtaccaaagatttgctacatttcattcttttctgtcttcttaaagatcttgcttcattaacttttccttctgtttctctattcttcagtctctttctctctagggaatcctttgaatcaggatacaggcatggcctactctacttttacaaaagcaaaacacaataaaattcatacacaactacaaatagctttcttggatccaagctgcatctctagctaccatataatctctacaaagccatgcttcttggaggagatttttactcatgctttagctatttcattacctattctttgttctagctttctgcaattcaggttttgcttttactacttctaccactacaccataactcctggtctggttaatgtaaaaaaccttatgcttttatggcattattttagtttttcttagctaggaccaaattacaacttatgagaaaatgaaaatttgagggaattttaataacttgtggattcaggttcatagtagttctgccagttataagttgggtaattacaggcaaagtttgaatccctctgaggctcagtatttgcaaatgttaatggtatctgtcttgtaaggttattttgaggataggctatgtatatcttgcaagattagttctaggctattgtgcatataatgcatagaatagtgtttgcaatgtaaacagtagataatagtagtagaaataaagtaattttgaaatttaaaacagaaaaatgagattattttgagtctgtgttttgtcaccatcagaatacaagtgggtgctagtatcaattttctaggtggagtgcttcaattatacataaattctaatgctccaaaagaatgatctccatgaattaaatgatttgttgaaaaggtaccttatcatccaacatcttacagacaggctttgctggctcttgaaagactagatatgggccaagtgccgtggctcacgcctgtaatcccagcactttgggaggcagaggcagtcggatcacctgaggtcaggagttcgagaccagcctggccaacatggtgaaaccccatctctattaaaaatacaaaaattagccttgcgtagtagtgcctatagtcccagctacttaggaggctgaggcgggagaatcccttgaacccaggaggcggagattgcagtgagctgagattgcaccactgcgagccagcctgggcaacaagagtgaaactccatctcaaaaaaaaaaaaaaaaggaaagaaaggctagatatgtagaactatctaattaaccaagagttgcttaaagggatatactggggctaaacatatttctccctataatcccttgctaaccacagccctaaagtcttctgatgattaacatcaggcctcctttgctgaactggtgagcctgacagagaactggcttatgttggacagttctggccacatgctcacttaaagacccatggtcaggcactccatcttcaccagaaccctaaaacacacccagagctgtttttcaaaaggtgaagcattttcctctgcagacagcttcagaatcatagaggactatgttgatgaccttattgggcttgtcatgaaccttacacatcatcttttctcaccgaagatacctctaatatcacagggtctactgggtcatgtgtcctaagtggccaaggtccttgccctctctagcctggatctgctgctggattcttctcatgctccatgctctaatcatagttgacagcttttcatgccacccagtacagaggccagagtaatattcctgggttttggcatatgctgcctgcaaaacctaagggatcttatcaggtgatgtgctttcttctttgtagtgggagacgtgaggtgcaaaaatttttctttttctttggtgttggcccagcattccttaaaccacatgacctttaaaaatgttagggatgtggcaggcccctgaaaatatttttggtttattccctaccctttggagcacatctgtcttactagagcctccaatatacttgtcatttcttatttatttggttcgattagcatgatgtcagcagtgtaacgtgccagcaggatgttcttcaggatgtgcggccagtccagatttctttgatagagagagaaaaactgttaacctagtgctgggcaagactgcaaatgtatgctatcgtcacttccaaggaaatgttaattgtttctgttcttcttttctgaagagttaaaagcacacacacatttttcagatcaaaggcctcataccatgaacctgaggatgtgtttatctgtgctcgcagaaacagcccatctagaacagcaaaggcaagtaggcaatgggggctataatttgactgagtcagtagctgattgttgtcatccagaagccacctgcttttgtaggggttcctggatgatgacaggaaatgttatttacatagacatagggcagagactaccagcactgcctcctttaggacaataatttctgccattccttaagcaatacaatgttgtttttgatgtgcagtcttgacggggagaacactttagaggttctgcttaacttaaacagagttcagtgctaatgtgcccactccctaagaatatacttgaaatgggaccattagcactgaacagggtacatgaacagagtagaccactgtaagctagaccgtggccaagtgggaccattagcactgaacaggattcatgaacagagtggaccattgtaagccagactttggccaagacttcatttgatacttgaccctatatttgccctcctgcaacagagggctcttgatggcactttagttccctagagttcaatgtcaacaaggacattgtgtccagtgacctagaaatgtttaggtattctcttttcttcaatgaatagttactctgagagggaagtgagcattaaagaagttcagtagggagtgctagactcaatatctgtggaaggcagatagtgaaacaagattgaacagagggagaagctgggctacagtgcagtttcaacgaagacctcaggggaccctatgtggagctctaaatgttactctctcaagttgtcccacgtcatggcgaggagacaggcttttctattccctctttcactgcttattggatggaagctgtccttggagagggagtctgaccacgggcaagatagctctccacccgaaggcaattttctgacagggctgagaactgagggttgtcagcccctaacattccagcagctgctgaagattttctgttctaaagatgaatctgtgtgtcacagcccaatacccttgaatcgtcaatatctaatgtggggaaatgttggtgctagaaatataccaggctctcaaaatcacaaaacaagaataaatataaaactgccttcaaacaccgtctttaaacagattgctacctttgattgttctaataatatttttcttttacatttgaaattgtggttaaaatatacataacataagccttactcttttaaccatttttaagtgtataattcagtggcattaagtacattcacaatgtggtgtaaccatcaccactctccatttccagaacttttgcatcatcccaaacagaatctttgtatccattaaacaataactccctattccctcttctctctcagtccctagaaactatcattttactttcagtctctctgattttgcctattctaggtatctcatgtaagtggaatcgtacagtgtttgttcttttgtgtctcaattatgtcacatagcacacagttttcaaggttgcagcacgtatcggaatttaggctgaataatattctattgtttctgtataccactttccaattgttaccacattcagctgttgattcacatttgagttatttctatcttttggatattataaataatgcttctataaacattggtgtacaatatatgtttgggtcactgttttcaattctttggggcatagagtaagaagtaaaattgctggaataataactgtattttaaattatagcaatacgtaatattttattctgatgttcactattgggagtataattcttattgtatacataattatattcatttaataaatttgcttgtatttatgaatatgtgacattctgctaagcattttatattcaatatgtcttagataattactgagagacagtaagtacaaattaaatggtagtaattgatatttactatgattgcctcatcgaatacctatagtaacccctgaagaaaagatgtaaatatttttatactaagtctattaaatggaaaaactgaggcttagagaagttataatttgcctaagatcacacagatcaattgcagagtcaggcttagccactagaactgtttacctcaaagactgtgctctgaaaaattactctgtcttatacttagagaactattagatctttggccatatgtttagagacccatatataccttttaaaatttaaattgctttaaagtgtataattcccaagggagaatttcgtgtgtatgtgtgtgtgtggggggggggggcttatggtttttttatttgtttgcttgcttgtttgtttttgcagcatattcatatgtctaataaaaatatcaaataaataaatttagtataagcatttgaaactcacaatagtggctttttttttcctgtttgtcctctaattccatgaggagacatgaaatactgggctggcctagtatatgcatagtttttcatttacatgtatgcaaactggaagcaaatcgatcttctactccagattttttttcagatttttttctcaatagacaatataatgttttagagtttttaggccatttccacaaaatattattttctttagaacaagtagaaagttatttgaaaatattttttttcagaaacagaaagcatatttgtcagataaccaattctgtttatacattggaaattttattttaaatcaaaataaataaaatctagctttgctttagcacaattatttagttaacgcatttgtccataattattttagggtaaaaaatatatcacatagttaataaaataaatgtttggtttgttgttgttttgtagcttgatgacaatttatagacaaattaccatacacaaaaagtcaacttaacaagacaatcttttaaaaaaaatttgtctataccacaatagctaaaaattacattgagaaaaatgtacaaaatattcaaatcatagttacctttcattagtagtttttatatttttataagagatgttctttcaagtggcatagatatctgaataaatcaagttaaatcaagggaaaaactttctaggtcaaattgcttgcatattatattaaatttgaggtgtaacctttggtcaggatactactttttgctatcagttccttacaaaattttcttgttacattatttattcttttttttaaagccatcgtatttctatctgactatggtttggctgtatgaaaactgggataccaatagttaagatatcattgagatcctctaaaaatttatcagagtctttaagctataagttatatacatcataataacttaatggtatcattaagtatataaaacccaaactgatacacttagcttctaatcagaccttcacgtgcaattgaaaagtaaacttggtttacatacatgtcaatacttctcactccaggttgattatttaaaacagtattttctaaactgagttttttcaaacttttctccccagatgtttggttaaaaaagtttggggaatcccacacaattatctccatctgagaatggcaacatatatcagtctatagatcactctgatcagtcctgtagtaactaaatttgattaatgtatttactcaaaattttgaaaccctgatttagaaattatatatgctgtaagtgtttaacctctgtgaaatccaatctagctgttgacaataaaacagaaagtagaaaatgtctttgcatttcataacaatatatagacatatttttgcctgtatatattgtcatctgcaatagattttagtttgagggaaattaagttcctggcaagattttttttagttgctagtgtttctcaattaactcctttgagttactgttatacgtcaagtacattaaacaaaggacttggtgtgtaaaaatttgttgcaagttattgagttcaggattaaatacactgtacaattcagaaaacaatagaatatttgtactaggaagggaatttaagaaattttctacattatgtaaattgaagtatcaacttttataatcttagaaaacaaaattcaaactaggaatattttatgaacttagatagctgatttagtatctaatatttatttttaagtgaacttggtttattcctgcattgcactaatataatggaagaggctttatagaaaagaagagattatatgaaataatatcatggtcagatgaaggaaaaatttgagcaaaaagttgttcaagcaatgtgttaaaattttctttttttttaaaaaaatgtatttttattttaagttgtggggtacatgtgcagggtgtgcatatttgttacataggtaaacgtgtgccatggtggtttgctgtacctatcaacccatcacctaggtattaagcccagcatggattaactatttttcctaatgctctccctccccaaccccattccctgacaggccccattgtgtgttttgcccctccctgtgtccatgtgttttcattgttcagctcccatttataagtaagaacatgtgatgtttggttttccgtccctgtgttagtttgctaaggataatggcttcaagctccatccacgtccctgcaaaggacacgatctcattcttctttatggctgcatagtactccatggtgtatatgtaccacgttttctttatccagtctatcattgatgggtgtttggattgattccacgtctttgctattgtgaatagtgctgcaatgaacatatgcgtgcatgaatctttgtaatagaatgatttacattccttcgggtatatatgcagtaatgggattgctgactcaaatggtatttctggttctagatctttgaggaattgccacaccatcttccacaatggttgaactaatttacattcccaccaacagtataactttctacaaaaaagaggaggtgcactaaacatatagatttttttcctatgtgatttttacataaaaatatgtatgtcagaagaagtaagacatgattgcatttttaaaataaagctttttaaaatttaaaaagtaaggcgtgatttaattgaatataatgagcatgtaacatcagatataattttttaggtacctggaatccattgattgaatggcaagaaagtaccataccttctttaccttattgcccgagtactaaacttcattaggaaggtggcttgcacctcttggtacttttaggacaaataaagatcacctagttacctagcagtatcttgagaatccttttaatgtctacgccagtgatggagcctacacatgcttgacttctcttgtgtaattaataataagatgaaaatcagaattatttttatgtggctattagatgccttttagacagtcacaacttccaggtgctatcactgaagttcagagttatagattcttctgaccaatatccttacacaacttatcctctctccactccactccactcttaaaataacctgagttattcaaggttgttgggacctttgtgggggtctaataaataacaccttgcatggaatctgaaaaattagtaaaaaattggaaggaagatggagaaaaaggtgtccacttaattactatatttactactttacactaagttggaaaatgtatctaacacaaaagctaagtgagcacctaattgaaccccaaatttaaatagacttactccttacttaccaaggagaatttgtgctatctgtgggcatctggatcccagaggaaaagagggatgagctgattcgagcagagcatgatcaatgttcaatatgtttttctcagtttaaccaatcacttgaatcacacctttgcccttggggcagaatgaattccatttccttaatgtggaaatacaagtgaaaggtatggataaagtgttctcccctaacaatgttatttggatgatattcagagaagcaactgtgaagtcattgaacatatattggattcttgaatcaagagacctcatgaatgtttgattctaccattcagatgttttaccttcaaggtgtcaaaactatccaagttccagttttctcgtttgtaaattaataataataataaaagtacccagctttgagagttgttttaagggttaaattaaataataaatgagagcaagaacaaaactgtgttaaatattagtattatgttattaaatggtatagatcaaccaaacgtttttgagcactgtgctaaacactggagatatgaagatgagtaagacaaagtctctgaccttcagtctcatgtaagaaataaaaacacaaacagatcattttagggaaagaggataatgagaaacagcctgagtgcttatgagtgcactgaaatctcattcattgaaagctcaaaggaattgttaagttacttctaattttagcataaatcacatgaatgcatggaataaatagcactcagctttttgtccatggctgtcttcctatacttactttccccatctaacctacatttatatgaatataaattctataaaaccaaacaatgtgctatctaggtcatgtcatgtggtggtaacattggatttatcaacatcaggctgtatattgtgaaaaactagggagcccgtcatgggatcagcaagcttatagaataggattgacagctaggatgaaagccaaagccaagagattgttcccagtataataggagctgcaaaaatgcaaaaggcagattctgtgcagtagtccagggtcaaaatcaaatatggtctaaaaatgagaaaaacaaataggaatatagactttcatatctgagagttaattccttgaactgtgatagtccaatccatcccacttcctaaaaggagatctgtcttatgcaagcagctgaaaatactgttgaaccttcttttttttttccaaaattctattcatttaaattgtaacaaaatatacataaaatgtactatttaactattcaagtgtacaaatcacattaagtgctttcccaatgttatacagtcatcacctctatttcaagaactttttcatcatcctaaatggaaactctataccaattaaacaattatttccattcctccctatccccagcccttaattacctctgttttactttctgtctttgaatttgcctattctagcgtattaggtagttcttgcattgctataaagaaatacctgagactaggtaatttataaagaaagagttttaattggctcatggttccacaggctttacaggaagcatggtgctgacatcccttgggcttctggggagacctccggaagcttatgatcattgtagaaggagaggggagagtaggcagatcacatggtgaaagcagggggaagagagagagagaaaggggccacacacttttaaacagtcagatcttgtaagaagtcacccactatcatgaggacggcaccaagggattggggctaaaccttcatgagaaatccactcccataattccaattacctcccaccaggccccacctctaataatggggattacaattcaacctgagagttaggtggggacacagatccaaattatgtcatgttggtacctaatgtgagtggaatcatacaatgtttgttctcttgtgtctggtttacttcacttaacgttttcaaggtttatccatattgaagtatattcatattgtagaaaattttgtatcagaatttcttaaggtagaataatatttcgttgtatattccacatttttttttaccacattcatctattgattgacatttgggttgtttccaccttttgatgattgtgaacaatgctgctacgaacattcatgtacaaatatctgttcagcccctgctttcattttttttggtatactcccagaagtgtaattgctgggtttcatgacaactctatgctttattttctgaggaactctcatgctgtttcctaaagcagctacaccattttacattcccaccaggaatgcattagggtttcaatttttccacatattcatcacttgttactttctggctttagtttagttttgtttttaattatagtcatcctaataggtgtgaaatagtatgtggttttgatttgtattcccctaatggtgttgagcatgttttcatgtgcttattggctattgtatatcttctttgaaaaaagtgtgtattcaagtcctttgcccatttttaaattgcattttttgttttatagttggtgagttgtaggagatttttacagattctggataataatcccttatcagatacattatttgcaaatattttctctcattctgtgggttgtctttttacctcttgatattgtcctttaataaacaaatgttttaattttaatgaagtgcaatttatgtatattttcttttgttgcccatgtgcttggtgttatattcaagagaacattgccagaaacgccttttttttaaagcaagaattttaaaaataaaagctggaacgatgtccaattagcttttacaacattatttattaattttttttcactttactaagtaaagtaagagaaaattgaatggtaaaaacttactgagatttagctatgtttgtttttcttactgcatacagagttgttattataatacttaaagtgctactagaaatatccctaatattgtcaccatgctattccaaattaaaaagataaactgtctctctccactgcaaacttgaaatagattttttgtgacattcataaaatgctataatgcctggtttttttgtagtggtacatgaaaaggactgattttattttattactgatgggcaaaattggcaaatatcttgtctttcttctcatagctcagtgtaatttacaggttaattgtgcatcacaaacacaaagtatttagattggagagttgccttctctatattgctattgatctaaattcacatgaagaaaaaaggcattaatttgagggcaaagagtgtcagaaatgatttatagatttcatggagtgtcaggaagtggacatcactatctggtagcttttatgaatactaaggatgaaattctgaagaaactaggctacaaaataattatttcgcagaggcaaaatattgacataaaaccaatatatcttgctcttaagtgaatcgtaaagatgaatcactaagattatccaatatcattgctataagcaagacgatctaaccaaacctgtcttccaagggtattaaagcctccttttgtgctataaaagtactttaaattcttgaagcaagaacctgaaataagctggactcaccttcttaaacagaatacacaagtcacccatctgttatagatgaatgaccttcgtatttacatacccaaaattacctgcttctaaagccatctggatagtgttacaatgtccttgtttgacagaatttgtattaagagggctagaagccaccaatgaacaaagcaaatcagttcaaatgggagatagcaggaaggaacgtagattcatacattcttagcaaaaaattagagcacataacaaagattaatgcttcaacaagaaagaaaaatatgactgttgtaacaaaacataataaaggtaaatatctgtgcgaacagtagacgcaggcagtgatgtagaaaggatgggatttggatggcaggggaagctgatgcaccatatgtatatatatatttatttatttataaagcatcaattcagtctacatgcataacttgatagcacaaaagaaaatgttttatgttattccctctttggatccttgaatgtatgtgatttagtaaagaaaattagattaacagcagatgtatgggaatctcctttattatttctttctgcaaccttattgagggatgccccttagataaagagaaaactacttcatttaacacattcttactttaaaaatattttcctcatcttccatcaattaatagaaccctagatgtcaatctatttcagcttaatgcggctttcttcagacacatccgggaattcactaaagtaataagtaggtttttcctgaaagcaccaactaccagacatatttctcctacaaggtttttaattgagagactgttttttccaggcacctttacatggttgtaggttttattttattcaaaatgacatctagttcctgtcataatctgaattgtggcagggcagagtaggagatgagtgatatatatgaggagggtgattattcataattgctacgtttgaagactagaataaagaaatgatttttctagtactaaaaaaatgacacttttctaaatgaaagtgattttatattttgaagttgtttcctctatataaatatgattttctggtggttcatgaaattttagtttctatagtacttctgaaattcaggtagactacagagtatcaacttgattcccatcctctgctccccacacacatacacaaaaatgacagaaaccgaataaatataaaaggagaaaatgatagcttaagtaaaaaccagtaatatttaagcaaaacaatgaaaatttcccatgaaatatcttcatatttgatgcaaaaatataaaaaatcactcgcatatacatgctaaaaagagttaagtgcagttaagtacgccgacacacatattgttccattttcctgatctgtgtcatctctgggcctggaaaatagctccaatattaactgtacatgtgcttcaagcaatgtgctgattatgtagggggattgaactaaaccaaggggtttatcaaaatggtggaacaaattacttcaacattgccattatctgaggaagcaggacaggggttaatctcttgcactgatgactaacattcagccgtgcaggcatcaaataactctgcacagtattgttaaaggtctttctggctcaaaggcacatttgttctgaaagggtttacatttgtttggttgagggtagagggtttgattgttgaccaggttgaggtcacagactacaattaggtatttagaaggaatgcacatcttgatttcattatccagaaggtgtaacaaacaaatgttaaaaaggcataaagacctgcagacagagacacctagcctgactccagcccttactatttatgtgttttccctcatttgctcattttaaaaactctttggactacttcaggaagtcgaatcaagctttactcaattacagtcttttcctctttgcgcacgctagccagagtggtggttgtgccagggtgtgggttaagtctttctttctggaatctttggaagtcatcccaatgtatttgtcagctgccagtttgcggccctttatctaacgatggggtggtcacaactgattctcatggcacacgtgaaatctatgataaactggaaaatcatgtagtgtcttggaaaacagatgaaattttcaaaggcgtttgtcattgtcttgacattgccttacattttagtgtttagcatggtacattgtttgttggttaaaaaaagaatatttaacaatgcttttgctctttttgtgaagttcttcaggggtatattatattctatgacagttttaaagatagctatttcactgttaatggttttgctcctctggtgttctacacttgaaattttctttataaaggaaatgttcatatatattagacagaaacactctttaggattaatctactaaaaagaaaagtatttccttcaaaaggccagtcagtagtctggggtatagaaaatgttacattacttactcaatattgaatattttattcatattggctttgcaaaaaataaatcctttgagaaattttagtttcggtatttaagattcatgctcataagacatttcctccatatgtcaatgtaggaaccacttttcttttttgaagatacattttaatatagaaatgacaatgatattggaaaacacagaaggtcaaaataaaaagtatctatatcaagtatttatttattttccattaattcaaccatatttaaatgtctactgtattagaactaactgtatgtgtatgtgtgcatgtatatatatacacacataaatatatgcatatatacacatatagttagttgtatatgtatatcatacatacacatatttattataaagtattcgcacagatgattatggcagctgagaagccctatgatctatctgtcctctgtaagctggagacccaggaaatacagtggtgtagttcaaagccctgagagtcagagagctaaatgtttagatttcagtctgagtctgaaagcctgagaaacaagagcaccaagggcaggagaagagtgatgccctgggtcggcagtcaggcagagagcaaatccagccttccttcaacgtcttatcctcttccagccctcaagggtttggatgatgcccatccacatggaggagggccatctgctttactcagtccaccaattcaactgctaatctattttggaaacaccctcaccgacacactcagaaatgatgtttaaccagctatctgggcctccaatggcccagttaagtcaacacatgacaataaccaacacatttaccaagttccagacactgttgtaggtttggaatttatagcagtgaaaaataaataaaagaaaaaacaaaatcctgagatcctttcccttatgatgacacaacaaaaagaaagataggtacaatacagaatctgttaggtagtgataatgccaagaaaaagtaagaaggcacatggtaaggaaaacacatgtgtatgggagaggctctcctagagtttgtggtgattcagacagggtgtaaagggagtcctcaccaaaatgctcatgtctgagtaagcacctatcacactctgtttggtttgctataacagaatacctgagattgggtaatttataaacaaaagaaatgtatttctcaaggttctggaggctgggaagtccaagatcaagggaccagcaggtaccattgttgggtgaatgctgctctctacttccaagatggctccttgaccctgcctcatccagagaggaggagcactgtgccttcacatggcagaaggcagaaggccgagtgagtcaaatgctgcatgaggcctcttataagggcctaaattgttttccaagggagaattccttacggcctgcacacctcaaaggccacacctttcaacatcatcaccttggcaacatctgaattttggagggcatacatttaaattatagcagcacctgaaagaggtgaaggagaaaggcacaggatttctagaggaggactcttccagagagagggacactccaaggacaaatgccctgatgcaggaccacacctgacatcagagtttcagagcagagtgagctaggagaagaggaggaaagtcagggtggaagaggttgtagaagtgagaggagtcacctatgtcagaccttgtgcatcattagggagtaattggagagttttgagcagaggagtgatattctttgacctatttttaacaggattctctgcatgcttggttgtgaataaactgccaaaggcagagcaaagaaactagttaggagattattgcaataattaataatatttttggaagataagatttacacccataaaattagtagaaaataatgcaaagaaaaatgtaattatgctgccacatgattctccttttaatcctcttaaaggatggctcaacactaccaaagttgtttcatacttttccttcgttccctaagcctgacatttctatcatactgcactgtatagtgaactggaaaaaaattgcctccaactttgtaaaaaatattctaccactttttccagtaaaaatttgttgagcatcaaatatgttccaggcataagattgtcactagagatataaagatgaataacaaatagctttctcttcaaaattctcaaagtcccataagcaaaacagaaacataaaaagatatacgtagtacaatttagaaacacaatgccagagatgtgcccagggtatgttggaagcacaaactatatacaaagtatggagttaccttttattctagaaaattaggaaaaatttcagggtattgtttctagtaaacttaattctcctcaaacccttgtctccacatccttaaaacatagaaaagctatatacccagtgtgatggttaattttagttgtcaacttgacaggattaaggaatacttagagaactggtagagtgttacttctgagtgtgtgtgtgaggggatgtttccagaggggattgacatttttctgcttcctgatgatatgatagtcacagtttattttcaatattactcatgaaaatctatgaaagactggaaaatcaagcagtgtatttggagaaaaggaataacatttgcaacagcaatcataagtagaaagtgtaaagggctcacctaaaagaagaaacagtagtaacatagttttttctggattagatgtaataattaccataggcataatgagtttattttagcatggtgtttgccagatacctcacctgattccgttttgataattgtaaccaattgtgttagttggctaacatcaactgggaaaacagtagtcttaattccaagccacacaattctgaacatgactttatttggctttttccttcttatatcgataacatttaaatgaccttttcaaagtacctgccacacatagcaattgctcagtaatgcacaagggtatgaaaaacataatcaaattatagatgatacaaatagctaacaattgcgcattttcccttccaaatttctcacagaaactctcaagaagaacacaagaacaaagtttaaaatcattgggaactaggtattctattcaaattgtacgagaatcctgaaactcaatagcaggagtaagcatgcagctagaaaagagttccaggcactccatgacaagcctctatctcaggaacattcaggcatcagcatcagacattcatttcacaaatatttattgaacattaactgtgttataagaacaagccaaactatatcgtaaagcagagaaagcatagttcctacttagtacttagaggggacatctaaccatacttagaagaattagagagatgcttttggatatgatatgtgatgatttgaaataacattaggagctagccagaaggctgtggtcatgctgtgtgtgtttgtgtttagtggtgtttgtaatacagtgtagtatagtcagacaagggaatggggaaagatggcgaagaggttttaaggctgagtgaacagcatgtgcaaagtttgcaaataaggaaaggactgtaagtagtttgtgggattatcaataggttcatgtgggctgagagtagagtccactgggggagtgttacagcccaatgggttcttcttcctgctgcacagataaagccccaattcactgagacagagggcttgcaacacaaaaagagtttaattatcacaaggcagttgaagaaggatgggagatttttctcaaactcgccttccccaaagcatgggggctaggctttttagtataagttggcaggcagacggctagggaatgggtgctgctaattggttgaggatgaaaccataggagtgtccaaactgtctccatgtgctgtaatacccacccagtcagtctctgggttgagtcagctccttggtatgagtcacaggtccaggtggcatccatttgtctacccaaatgcagaagtatgaaaaatatctcaaacaccagtcttaggttttacaatagtgatgatatatacaggagcaattgcagaagttacaaaaatcttgtgacctccagacacatgactcctgagcagtaagcaagctagggaaaaatggctggttatcgtttagctatgttcacatcttagcagaattcaggcccttcccataatcctaaacttgtggcctttcattagtcttacagaggtggtttcagtccccagagggggtctgtcttgggaaagactattatcctcacttcagttaagctataaactaaattcctcccatagttagtttggcctgtgcccgggaatgagcaaggacagttaacctgtgaaattagaagcaagatggagtcagttaggttagaattctctcactgttacaatttttgcaaaggtggtttcaagagtaatgaagctacagtgataatcagaggccatgtataaaggcattctatgccatcctaagaagtttgtgctttagactttaacgggaagcatttcaaaaggttttaatcagggaattattatgattaggcttacatttcagaaaagtaaattagattggtatgagagacactagttaggaagttgtggcagaaatttatgctagcagtgattgtggcctgaactaaggtaattgctataggagctcaaggcaacaaatatattaaagagattttaaataaaaatataatattcagggaaagtacattaaaaagataatgattggcacttggcaatcaattgaatataggatatcaagaacaaagattcgcttaaaatatcagggcttttgacttgggtaaacgagtagattacatcaacttttcaaatcaggagtatatttggagactgagtgcaagtaatgacaaatcaacatttccaatatattcagtatgaaatgcccaaaggatgttcaaggaaagaccttctctggtaaattacatatatgtgtctggggtgaagaaatggtgtggagtaaaaattaaaattatgggaacagatgaactcattcaggatgcgcaggaaatgtgatatgagaaaaagctgataacaccttgaaaaacattgaggaatgtagcagaataggcacctattttgagactgtgtcagagtagccagaaaggtagacataaaccagataatgacatagaaaccaaggattttagagaatgtatactacaatcaaatcatgatttactgtgaatgagtcaatacttgtaaagcacatagaataatgcctggcacatggtaggttctctataaatggcatcaaatactgctgagaaattaagtaaatgtaactaaaatcttccttttaacatcaccaacctgtcaatgcaaatggaaactgtcttagtctgtttgcgctgataaagattttgtatttttttgcagacagggttttgccatgttgcccaggctgatcttgaactcctggacacaaggtaggtatcaacccgtctcagcctctcaaagttcctggattacaggtgtgaaccaccatgtccaccattaaattgcttctttatacatgaaatatataatgataaattatttttagcttgcacttaaaatttgacacccacagaacaattaattttttatttaaaaagattgaggattaaaaaaagagaatatctcaaaaatatatgaaatttttacaagaatagacaaatgaaaattctgacatgggtaaaagtatgtttaacacatcatgatctatcaaaaatggagagtatgtaggtagaaaaatagattaggtagatttttcaaaaaataaaatttacaagtggggagagagagaggagaataaagggaaaaatacaggctaaatttctttgaatatatatatttttaatttgattttggaatcatgtaagtattatacatggttgtaaaaaattaaggaaaagtgtaataatcaaacattataacagtgtatttacttggtgacataacctcacagaggagaaccactccaagtgactttaaaacataataattttgttgttcttacctaatagaatattctctatggaaaaaatgcagccctcaaataagaaactattaaactcttttcagatatcataaaaaaattgaggatggaaatgcaaacttggatattgtatatgatatattaaaggggtgttatatatgatatattaaggtcttatgcatttttctcagtgcatccatattcttctaatataaggaagatacttatgagtatcaaaaattatgaaaaccatatttggaaaaattacaaagtcaacacagacacataccacacaaaaactgattttttctcttgcattgtagcttgaaacttcatttattattttaagtgggttttatagaaaatgattcctttttacattacttacaattcctacaaggattcttattcaatttagatttttcttttaacttgataacaatactctcactagaagtgatgagaattaatttgaaaaactatgaactctagaaattgaataaattattcaaaaaacactcatgcttcaaaattatggcagtgataggagacttgggaagaaaatgtgagcccagaagattataaaacatgctcccttgtcccctgcttctgactcaatgacaaccattcctggaataatggccgagaaaggaaggctctctaagtcacggagcctcacttgattttggaatcaagttgattctaaaatttaattccctgaatttaaaaaactatgaaatgtaatgatgttcacaaataggaaatatagtgcagtgattaagagaataaactttagaatcagacagacttgtattcagttccatgtactagttgtgggccttgagcaaattatttcaactgtttcctcacctataaaatgaaaatatcatcaaagatacttcatggatttatggtccgagtaaaggaaacaatgcatgtaaattacttgccatagtgcttgtcaaatagaaagcattcagtaagtattttctatttttattattatgttaagaattggttacaggagtctacagatggagcaggaataaaaactgtgcagtggattcctgaaactatgtgggatgaatgtatacactttgctgtttttattgacctcattttctaaattggggaaattttgatgctgaaacataggctatggatttggacacaagaaagtgggttagccacagattgaactcaaggattattcatactcttggttgtggaagggcctctgtctttagtagttagatctttccctgttaaaataagatacattttccttagtttttataaatgtgatctttgactaacctattgaatacatgaaaaacaaggtaacaaaatttttttatgtaaaggcagtacttcatagttatatgtactatttagataatttatgctaagttcagaaatttaacatacaaataaaacaatgatcatattgatttaatataatctatagtggaagtaaaattagttttacctgggagagatgtgaggaacatataattgatgaaatggacttctctttatgaacatcaatgaactataaatcaatataatatcttgtgtagagaaatggaaaggtctggtacgaacaatgttattttctttccaaatactagccaattaaactgaagtaaaaaaaggcatgatataaaatttatatgatttaatatgccatattctatattttgacatctccaaatttaggttttcacaaatatgaatccatatctgtttgctaagtaccttaattcatataattatacctgttcagtagttcagaaagctatattcatggactgaaatttaaaggaggaaaataataaatatatttgtaatagttgttgacaaaaataataaaaacatagaaataaaccttactttcaggtttggtcatgaatattatgcatggaaatccccaatattgatggctaatcttgcttggtaaaacatgtctcaaaattttcacaaagggagagacctgggagaattctggtttaggagtaagggcctggaccctcctcagaatggaattcctaggaggggagcaggcccagttgtttcatttcatcatggaacctgatgcggggaaggtgtcattcctctctggtgatgtaattctggtggctggagggcaaatattgagaaatataccttgaatctacacatcggtgcctaggttggagcaaggtacttaagtactgaagttaacagagaacagcagtcaaacgagaaggaacatgggaagtaaagagctcagagcaagcagagtagagtggtatgactttcatctagagatggagtatagatgccaaggtggctttctatccattcgctgcaaaggacataagcatgtcagatcatataggagccagactggaagagttatgtaatcatttcttacttaaggaaaaacccaaacaccttatgaactgttatttactcaacttctcaagctatgcatttatttcactcattccttcacttttatttattcactcaccgaatatatcaagctcccactaggtgcatgtaacagatctttctgaccatcttgaatgccttgaagcacaagtctatttgttgtctagaaaagcagattttttaaaagctttttccaagatgttacaattcctgcagtgtcagtaagggaattatattttcacaaaactcccagagttttcctaaaagactgacttcttagtaggatttaaggagggcatccctgtagattgtctgatctctgatattcgttaaaacagagaacccaagagtagctttagagagtaaatatgattctgcacaaatctaggtctcatttttatcaaaaggtgatttctggattttcatgataggacataatacgagaccaacagaatactagaaagcatgggattagcagtaaggtcactctatgacttttaaaccatgaaacacatcagtgtacaatagtggaagaagtattacatgttacaggtgctgtcaggttataagacctctgcaaaatcactaactctgaattctctgctcctttgaccaacatacctaatttgtgaagtgcttagattagataaatgatcataaatcagtagtcaaggttgttgatgggttttgtttttgtttttgtcgttagctcctatttccttaaaatatggctcttttttagggttgatagttataagccttttaggaaaaagcaaagggaaataaaaaggaagttgaaagtagcaaaatggtagaaactgtgatacattatataaacatataaaactagatgtcatgataaaaagtgattaaaaaagagaacaagagagagcaaaggagactctgaaaacaatgatgatttgatagtgaatcggcctggcagttagagatggagctagaagagagataagggaactgattgggatctgaaaagcagttttatctgctttgaattctctaatttttccattcagtgtgcactggctttcagtttcgtgaaatttgttgagtttggcaaatattccaaacaaggattgtcagatacagtattcaaggtcacctttcccatactctatgctgactgctgaaattagctggaatgctgataatagaatagcattttccaggattgatggagcctctacaattatcattttttctaacaaagccctagtttgctgatgttcaaaccagtgaaaaaaaggggctgcctttaaatttatcattttctaatttaaaggaagattgtgtcattgaatggaaaagtaggttttctttgtctttttcatcttaaaaagatatatatttagcttaattccctaatctttacaccatgcatacaccattcagaaatgaaatcactaaacaattaaaagagcttcattgtttctttgccattaacacttattaaactagaaaaaatacagaaacactgtacttgggatctagtgttagtaaattcttcataataaatatttggttgttaattacataattagcctagtgaaatttctgggttctgcgtttttttaaactttactatagcattatttaagaaataaatattatcaattaacaactctaagaaccaacctcagtttcatcccatttgtttcacttttcactcctcctgcaataacctaatcttaactttacctgtaccccatccaaatttggcaggaggctgcatctcctgaacttgaatcttgtttctatagatttcttactctttaaacctcagtttttcatctatcaaatagaggtatctctcacacttggctgctgagaagattaatacaataacaaacactagctccttttcagaatcaagcactctgttttaactaagacatatattccaactattgtttctcaaatttttgctgtataattttcaggaaacttctatctgggaaaaaggggcaaaaaaaatctagaagaaatgatgaattttctttaagctagataataaattttgtaaagcaaactctaagggacataaaacagagaaaagcacttacaccatttagaaacaaataaatgcagaaataggtatctatggaaacaatattaatattattattataaataactgtaattatgttctgttgaaggcaaaaatggagtcaaatgcaaataatcagttctttccccacaccactccatatacatacacacacatactgagctgtctccatagggtgacctccaaggcaaggtttacacatggctttcaggaaccaagcaagaaattgctgattgttaaacaggtcttatttaagttcaacctgacctaccagcattaatgcaaaaagggctttggaatctacatataagggaactttacgctttttaaaaatgttcacatatttataccagactggaaaagaatgaactgatatcatatatgtattccaaaaaagaatagtagaaccaataaaaatctcacttgaactgtcagggatacaatttattctggcacgattcagtgctcctcatttattgtaatagccacaaattcactctatgttttcatcatgaatgtctcttctttaagcctttacattctaaaatgtattttaatattttacctttaattgtgataggattttaactcaacactgtattaattccaaaatctttctaaaggtagctgctcacttctctgcaatttatagtcttttaaacttacatagaccggctttaagatacataatcatgaaggtttaaaaatcacttgtaataatcatatttctagctcatattttagatatgaatgtagtaacaaactacatcactaatattatttaaaacgaatttccaaaaaatattactagtatacttttttacttaaatattgtcaccatatagatctcacaaaggattttccccccagaggccagcctttaaattcaacagctagtagtattaaaaggctgttgggggttgggggaaaggctgaatatgtaaagcgaatacaggactaaacagaaactccagcagagactaaaaaacacctcctgtgtatcacaaataaatagcgcatgatcccatttgtacctcaagacaacacactaagactgatattgaataaacaatgaagactttaatactaaggaattcactgtgactattttgatatttatggcaatttcagttgggatgtgtgtgtgtgtgtgtgtgtgtgtgtgtgtaatattagaagatttgctatatccattgtgttagtatggggtaaaacagctgccatttaagataggaagctttaacagcatatagtgatatgtggaaaggagtgatttttcttctcttggcttcaaatagagtcaaaagactttatgataagcatatttttaaacaaagagttacgaatatgaaggcatatgcaggaaacattttcttttagatcctttttcgctgtttcaaactggcttttatttcctagtcatttctatgatatttacattcaggtagttgagtcagcgaaggggttattagaacacactagcaatggaaatgatttgctcagggacccctggcagtgaaagcttctgtatagcggtgcactgataaatgatttgcatgctggtgggacaaggatatcacaattctgcattctgtattttcccatacctcctacttccattcctgcagatggaaatagactcactgaaacttactagtgacataaattttgtagaatttttaatattgtcagcgatgtcagaatggtgcagtgagcttgttccatgatattgtagctatcttagatttaaaagaaatgtttttggctggatgtggtggctcatgcctgtaatcccagctctttgggattctgaagtgggtggattgcccaaggtcaggagttcaagaccagcctggccaacatggtgaaaccctgtctctactaaagatacaagaattagctgggcatggtggcacacacacctgtaatcctagctacttgggaggctgaggcaggagaattgtttcaacccaggaggcagaggttgcagtgagccaagattgtgccactgtactccaccctgggtgacagagcaagactctgtctcaaaaaaacaaaacaaaataataataaataaataaataaaagaaagaaatgtttttgttctaccatgaagaataaacatgtcaattaaatagaaagtagtcaatgagccataaaaggaaaaataaataaaagaactaaataaattatttgagcatttttcttcccctagaccaatgagctccagacacacggtcctggtttctgttcatcctacacagaaatatagtagacttgttcccagtttagggtcttgccctggctgtagctggccttcttattatttagaaatcagtttaaatataatttcaaagaaagtccactcctggcactcctaatatagtttgcatacttgtccccaaccaaatgtcatgttgaaatgtaatcctcaatgttggaggtgggtcctagtgggaggtgttttggtcatgtgggcagatcccttatggtttgctgctgtcctcgccatagtgaatgagttctcctgagagatctggttacttaagtgtgtggtgcctcacctccaattttctctctcttgcttctgcttccatcatgtgacttacctgctcttgcttcatctcctgccatgagtaaaagctcccggagaccttcctacgagctgagcagatgccagcaccatacctgtccagcctgcagaactgtgagccaattaaacctctttgcttataaattactcagtctcaggtatttacagcaatgcaagaatggcctaacacaacatgcaaatcaaggaagtcaccccatcatgcactgagtagcatgttgatttcttgttctcatcggatgtatcattttatgaaattactgtatttatgtattattaatacatttgttgtctgtctgtgtttacttcattcttctactgaccagaatgtaaattccagaaaagcaagaactctacctgccttgtccacttctttatcttcactctggtcttagaacagctgacaaattctagttgttcaagaaaaatttttaaatactagaaaaaacattacttaagaatgttatgactagaaaataaatatagctatgttatggcaagttgcacagaaaattgaattcactttttttttttagcacttatttatattacagagggtaatttggagttctttttacatatagttagttgcccagtagtttggaggaattcatattttcactgagttaccaagttgactttggtgcatattaataagaatagataaccatctactaaatacttgttcaggtaccatactaaacattcccatgctctctcatttaattctctcaaacacccaatgatggcaaatactattattattgtcattttgcatatgcagaaactgaggattatagaggttaagtaacttacccaaagttggtctgctaattaatctggtgcaaatatttgatgccagctctgtgggacctgcaaagctggggctcatcgtcacttcattttatgaccttttattggagcagctattaagtttatatacttttcctaatttatacagttgagccatatttttcaaaaaatatgccttctgtttaagcaacaatcaggtgtatgccctctcccccactccagtttttattttgttgttattattttattttattgaagtagagaagtgcactattaattacactttttcttttttcagccaatggcatggctttctttgtaagttgattacagtggagctaagaagtttgtgaatatagaagactgtgaagggcaataatttaaatgatgttgctacctttatgatgatagtggcacatgtgtaaccatcatacattctctgaaaaaccctcctaagtcaattatactatgctataaaaatctactctaagaatttggaggtaagctcacaaacactggaaataatctattcatcaactggtagcttaacccacacaaatggagttacctgtttaacttaatcaaggagatacaagagtaaagtccatcctatgtttggttttatttaaaaatgtattcattttaattaggacatttgaagaaatggtatagtatctatcctgtgaataaggccccaaatgaagtcagtcattatgattatgagagagaaatgggagtgggagggatgctgacaggggaagaaaagaaagaggaatagcaggaggaagagaaggagagagagtggaagtgattgaagatatagaaaacaaaggagaaatcgtttccttaaaaaacacgggctggatttttttttctaatcaaaggatctttttcttgacaaagtattatatggaggtatttgtatacttctatatattctgcaaaaaatttaaataacagcagttactggaattgaatgcctacaaacaccttaaacattttaacagttaaggggaaaagaacctcttagaagtgtctcccaaaacgtgtgtgagtctatacattttgtagagtccaagtggaagaaaatttagggatgcaagttcatgcaaattggtgaggcataacttgctattgccctagagacgttaaaccaccttcatttttaatttatttttgttaatgaacacatatttaatatggtagcacattctacatgctttagcacttttgtcaccctttcaaaagaaaatgcttcccaagaagtaatcatccagactccaggcatacttttcctaggagaacattgaaaattaacactaaaagaacgcagatgtgccttcgttagaagaaaaataccaaattgaatggataacataagaagcacagtctcatgccctgaataggaagagcaggtgaatcatattattataaatacagcattaatctggacattaaaattacaaggaaagaagtttcttttcctagatggtgcttcggctgtataatctgattttatcaaggtatggcatttctaaaagattcaagttaatgcataagccttaaaattttagatatgaatctcttttaaacagatccttactgtttatattaaatgttcatttatgtttacatataaaagatagagacctttagagattttataacaacatctcaataacaaaaagtccaaacacctatcggtcttcagatatgtctttaggaaaataaatttcccaagtgtgtacttgctctaagcagtaagtaacaccctgacctatattttgaggctgtgttttatgcaggatatggacaaaaatagcactgcttcgaaaaatttatgacatataaaaatactgagtgaactatgcatgttagcgtaacaatttgaattcagggagaatattcaggaagaaattatatttaagccttctggttgttcttcaagtctatttctaattggtgtctttcctgagtagtagccttaggatttgcactaaacacataacttaaacaactcttccaacatagtttctgcaaaacagcacatcatcttctttgtttagacattttacttgaacacaggatttaaaaactaaaaaattaatgcttttgatgtcaacaactacatacacaattaaataaatcagaatatgactaaaaattatgtgactttttcccatacattgaatctcaagaaaaaaagagaaattgcagaactgtcattccttttcacctttatggttcttaagcatatattatctactgtgttatttttcatgagcagagattctcacatatataggtgcataaatatttttcattatgtcaacattaatctggaaaacattcaagatgtctaaatgatcagtcttgtcttattttagattagtaattaaaataaaaaataaaatttgtagattaaatatggcttcataaatttaatgtttattaaaataacagtgccaaatgcagatatttttaagttattggaatattaaaacattaatgaatgcttacttactcaaaaaatggaataaatattatgctgccacttgtctaataaagtttatatagtcaagcaagacatactttttcgactttaggccagataaaataacttttaagaatctttccctgacaatccaccccttaagtctgcattatttatacctgttagataatacaaaatattccattttgcatctattatagtattaatacagtttagtaattgcctatttattcagctttcctattagaatttcacctcttgcctgtattttaattgttttaaatctccataacttagcatctgcctactatattgccaatgtttaattaaagtttgtggctgtgtggggtgactcatggctgtaaatcacagagcactgggaggaaaaggcaggagaattgcttgaggccaggagtttcagaccagcctgggcaacatagtgtgaccctgtctctacacaaatattaaaaataagccagggatggtggtatacatcttaatcctagctacttaggcggctgaggtgggaggatcacttgagctcaggagtttgaggttacagtgagctctgatagcgccactcactccagactagatgatagagcaagaaactctctaaaaaccacaaactaataataacaataatatattaaaagtttttgaatattgcaggattcaccattgtatctagctcctggtacatagtagccactcaatttgtggactatgatagttaattttatgcctcaacttaactgggctaagggatacatagatagttggtaaaacattactctggacatgtcagtgagggtgtctctgaaagaggtcagcatttgaatcagtacactaaataaaaatcaccctcaacaatctgggcaggcatcatccaattaattcagggcccgaagagaacaaaaaggctgagaaagggtaaaattcctcttcgttttagctgggacatccatcttccccaccccttggatatcagcttgcagatggcagatcacggagtttcttggcctccataatagctgagtcaatttcaataatctctctctcttctctgtatgtgtgtgtgtgtccatatatataatgtgtatatatagtcatatatgtatatattcatatacatcctgttcatataaattctatacattaatatatattatgtataattatgtgtgtatgtgtatatatatctcctgtaaatatacgtgtgtgtgtgtgtgtatatatatatgtatatgtatatatatatatacgtatatatatgtatatatatatacgtatatatatatgtatatatatatatacgtatatatatatatatacgtatatatatatgtatatatatatacgtatatatatatatatatatatgtatatatatatacacacacatacagtcatgtgccacttaacagtggggatatgttctgagaaatgcatcatgaggagatttcatcattgtgtaaacatcatagagtatatttacacaaacctagatggtacagcttactatacacctaggctatataaggctacaaacttatacagcatgttactgtactgaatactttaggcaattgtaacacaatgggaagtgcttatgcatctaaacctagaaaaggtacaataaaaatatggtatacaagataaaaaatagtacacccatataaggcacttaccatgaatggagcttacaggactggaagttctctgggtgagtcagtgagtaagtggcgagtgagtatgaaggcctaggacattgctatgtactactgtagactttgtaaacactatatagctagactacactacatttattttaggaatttttttcttcaataatatattaaccttagctcactgtaacatttttactttataaacttttaaatgttttttaacttgttgactcttctgtaataacacagcttaaaacacaaatacatgcagctgtacaaaaatattttctttgtattcttattctataaacttttttctattttaaactttatttttttactttttaagcattttattttgtgaaaaactaaaccacaaacccacacattagcctaggcctacacagattcaggatcatcaatacccctgtgtcccaccttgacatcttctcccactggaaggtcttcagggacaataacatgcatggagctgtcatcccctatgataacaatgccttcttcgggacacctcctgaaggacctgcctgaggctgttttacagttaacctctattttataagtagaaggagtacactctaaaatatgattaaaaataaatacgtacaccagtaacatagttgttcattactattatcaagtattatatatgttacataattgtttatgttgcataattatttgtgttacacttttatatgactatgactggcagtgcagtacacttgtttacactacatcacaaatttgaataatgtgttgtgctaccacattacaatggatacaaagtcattaggtgataagaatttttcagccctattataatcttatgggaccaccgttgtaaatgcagttcattgttgaccacagcatagcaatgcagtgcattactcctttcattatgcagtttacaagactcaagtctggtttgcagatggttctacatgatatgcaaggaccacctgaaagtggacagctctagcactgcatctcctctccaggacatccctgaaggatgttgttggaccaaaattctcccagcaggcaaaacatcttgtaatgcacctggttgtgcactttgcttggaaagagaaacagtcagatgtgagattaaataccaattcatgggctatagcccacggtttggctggatggtcagggcctagggaagggatatgattgaaaaataagtggtgaagaaatctggggaaaaagtatgtggaaagacctctctacagaccaaaaaaaaaatccccccaaaacccatgaagatacgtgtgtcctatataaatgctcaccaataggtagattcagcagatgaagattttaataatcaagtggctaggatgacccattctaagaatatcagtgaggttttccctagtcagccctgtcactgcccaatggactcatgaaaaacatggccatggtgggagggatggaggttatgcatggactcagcaacatggacttctgcccaccaaagctgagctgaatatggccactgctgagtggccaatccaccagcagcagagaccaacactgaacccgtggtaatgtcacagtttgctggggagatcggccagctaccaggtggcaggttggttatatgggatcacttccatcatggaagggacagccttactgattagacaccctggatatgggtttataggtttgccttctctgcaatgtttctgtttacttacagaatgccttatctattagcatggttctttacacagcatcatttctgatcaaggaacacactacagcaaaagaagtgtagcagtgagcccatgctcataaattcattggtcttaccatgttccccatcatcctgaagcaggtggcttgacagaacagtgaaatggcctattgaagactcaattacagtgccagctaggtgcaatgtattgcagggctggagcaagattcttcaggaggctgtatatgctctgaatcatcattcaatataaagtcctgtttctccaatagctaggtccagaatcagtggggaaatgggagtggcatcactcaccatcacctctagagactcactaaaaaaagttttgtttcctgttctcaagaatttatgttctgctggcctagaagtcttagttccagagagaagaatgcttccaccaggagacacaacaataatttaattgaactggaaattaaaactaacactaggccactttgaacctctaatgcttctgagtcaacaggcctagaagaaagctgtggtgttggctgagattattgatacagactatcaagggaaatggactaccactccacaatggtagtaagtaggagcatgcgtgaaatacaggagatcccttagggtgtctcttaatattatcatgccctgttattaaagtcagtgaaaaactacaacaacccaactaggcaggactactcatgactcaaaacattattactttttgtctgtgagggagtttctggaagagattagcatttaaatcagtatactgaataaagaagatcaacctcaacaatgtgggcagacatcatccaatctgtttggggcccaaatagaagaaaaatacaaggtggggggaagggtaaagctgctctctgtttgagctggaacatcatcttttctgccctcagaagcttctggtttttaggccttcacatttgcgcagaattaaaccatcagctttcctggttcttcaagtttgcagatggcagatcatgggacttcttggccttcatactcctgtgagccaattaccataataaatcttctcaggtttatatgtgtgtatatatttttataccctattggttctgcttctctgaatacatggactgaatgaataaatgaatgaatgccatctgcttttagactcactgtgaagataaatttctcagttaccacatgactcataaacaccaagatttagcagaagaaaaaaatcccatataaaaatcttttaaaaatgtgttcaaaatggcaagaatttgttcttgcatttcagaaaagtcaacgaagagcatttgaaaccttctccatccccctgttgtacttcttgtatgtgcttctagcattgcatatatggttttgtggttttatcagtgacttattctccttattgaacaaatatttattgagggtcctatgtgtaagtcactccactaggcacaggcaaaaatggaaatatctctgtcttcagtatcttttatatcagtggaggatgaatacattaaacaagaataaatacatagaataagcagtgttttagatagtgataagtgccaaggaaaaataaagcaggtgagggggcttggaaggggatgtgaacgtaagtatggggtgaagttactattttacatgtaatggccagggaaggcatcaatgaagtgacatttgagcaaagtcagaaaggaaggaaggaaggacccctccatgaccaagcaggagattccacagagagaactgtaacaatacatagtggtgagggatgggtcatgtaatgacatttactctcagtgagacaggatgtcattggaggattcgaagcaggacagtggcatgatctgacagattttaaggtgataaccctgtctgcagagttaagaatatactgtgaggggcaaaggtagatgcagatatcagttataaggcctttgaaataacctagataaaagatgatggtggcttagaccagttcacagcagtggaagttttgagaagtggttggatactgcatatcttgtgatgataaagccaataggatttgggaacacattagatgaacattataagagaaaaagaaaggctaaaaataatctgaaggtctttaacacaaatgactggaagaatggagtttccattgcctgagataatgaagactacatatggaacaggttttgaaaggaattccaggaggctttgagtatgttaagtttgagatgctcctacacacagagatgtcaagtgggcagttagacatgagttcggtgttcaggactggagatacaaatttggatgtcatcagcattcagatgacatcaaaactcggagcttaaatgggctcaccaaagaaatgaataatggatagaaaacagaaattgaaatcccgagtcttggaacactctaaatatagaggtcatggatgtgagtagaatctagcagagaagagtagaaactacagagagagaaagttaggagtaaaaccaaggaactgtggtgtcctagaagcttaaaattaaatacatatttcaaatagatgatcaaaattatgaggttgatttatgaaatactcacctttgtctcttgtctttccccatcatctacctccagtcatcagagctgttttggttatttctacaaaatatatccatgtaagtgaatgttccgtcagagaagcagaggtaatataaatgatattgagtaagatatttattgcagggattggaccttacgcaactgtgggagcttgaaagatgtctatgcaaatttgttgccacgcaactaaggctagctgaaagccactagtatcagcagaactgaaagttgtaaagaaaatctatctgtggacttggggttggctgggacaaactggatattttggaccccaaaagacaatctctatctacatctgtctctagccacctccaacgtcaacaacacaagtgaaaatgcagtagttcctggcactcttcacatttatacatgcacattctaagaggattaagaagatctcccaggagtggagggaacttcagatgcagctgctgccacaaatcagtaaggtgagctagcagatcagcaaggagcaggagcaaaaacagaacctggttccatacactgatcttcaatgtgtaataaagctgcccttttaatttttttcttccaaatctcatgaagacttctcttccagccaaccctaattcagaaccataaaaggaagagatttccaggaaacacaagtttcacaagatgacacagtataaaacaactccaatccagaatctgccaaagtaaaataaagactgagagttagctactgtgattgttgcagtatatctaggatcaggttttgatttccctgaaaccaaggagtaactgcttgtgtaccttttgtattgtacttcatattgtattctacaatgaccatctcaataggaaaagatttttcccatcttggtatccctactatttgtgtggtttagtatcttcagtacaaatttgttgaataactaaggttccttcaaattttacttttctatgattccaaataaagatgttttctactactaaacaatacaatattggtgagaaatgaacaattaaaatagatcttgaaataattctcatgtatcaggttagtgaatatactcctccattatgcttagactgcaacattcatatttaaagttagttcagaaaaaaagataacttatgaaagaatcagagacaaaagactgtcagtagtctgaaggaaaatgaaggctctcaaaggaataacaataatgtgtctctattatatatgatttgctggaaatgatataaagaataaatccacagtcacatactccaatccttgtttcacctgagcacccattattttgcttctacaagttattggggatataataacaagcaaataagtcatgggcccacaactggcttatagcctagtgggatttaaagacttagggaaaagcttgtgtaataggcagaattcaaataaccctcacccttgtataatcccctccttttcaatgtagttagaacctgttaccatagtacataatacattttacctgagtgaatagttatgttatatggcacagttgacctcaagatagggagattatcagggtgggcctattaataaaataatcatatgacacttttacaggcagagagttttctctggttagtggaagaagaactaacagatttggagcatgaagatttgaagctgctgttgttggctgacaatggggggagctgtgtgtcaacaaatagagacttaatcctacaactgcaagaaactaaattttgaacaatgagcctgggagtggatctatgccccagagcctccagatgagaactcagcctaaataacaccttgatttcaggcctgtgatattgaacaaagaactagccacaccttgctagacttgacctacagaactgtgatctaacaagctgacatttattttcagccattttgtttgtggtaacttgctatgcagcaatagaaaactaatgcagcttgcctccgctccacatggctggctggagtatacagattgagagctgaaggttctatttccaagatggctcacctacacggttggcaaattggtgctcattgtatgtgggatgataatggctggaggcttcactttctcttcatatgggcctttacacaggctgcttggcttccctacagcaggtggctaatttccaagagcaagagtcccaagagaacaaggagaaaataaatggcagctttatgacctagcctaggaaactacataacataattttcatcatattctgttggttaaggccatcacaaaggtctgttaaggcttaagagggagaaacataacttaccactcaatcagagcatcttcaacatcacattgtaagaaatgtatgagatgtgatgcttgtgatagccatatttgaaacatatgattacatggtgatgtaatgactcactcccatctcaatatccattgtttttaaattgttaacatttgagggaaagttgaaaatgatgacagtgcaaaaaaatttaaaaaaaaaagcattgttacatccagtgtaggtcagggatatgaatgtgtttgaataataaatcccagaataataaatgtcaagaacacctgctaactttaatattaacttaaatttcgagaaaactcccaagatgttaaaaataggcagtgagaataaaaattgggagctatttgaatataaatgtgctattttaaccttagttaacttgaaaaaattgaaatataccacaagtgttttcttgaacacttaatgtttgtaacattaataatagtcacatttcatacattgcatattttgctttccttgatatgtaaatgctaagaaactataaaactattattcacccagatataaactgcaggcagtttttctattacagagttaagtgtatgattttggcttttttttccagaaaatgaaaaagttcaatattgtttttatttacagaatatcatgataaataaatataaaaagccataacattagtccttaagatgatctagactgcataaatatatacaaattattcctcttcatcttctatacttggatgattaaaaataattgaatctcactactaagtgaaccagacataaggaaaccacacttcaattcatgaaagcatatgcattcatttctaaagttaaaattttggtcgaataatgtatagatttgtcaaaataaaaatgacttccattttatataacgtcataagcctagaatttcacaattataagagaagctttatataaatgacaaaaactaggaaatgcatttttcacattttaattacaattcacatgtctgtatctcctgctgtgatgttttgccaaaaagagatctcatttgtgaaactgccagtatagaaagtgacagatggtaagaccagtttccaacctgctatagtactggtttaatatggtttagattattttattagcattgtttacttttattatatatctaagtagtaccagaatactattacagtttgtttcatttcttctatggttataactgtatctatttatatgatttatatacctgatttagttttagtttcagattttatcaatacactatttttaggtacggtttaactgatgttttattttaaaaataggacaaaatgtcctattcattttgataaaatgtctacaacccacatagatacctagggacaatcataatagaaaaactcaaaagcccaattaaaagaaaatcactttgattatataacccatagccatcaagaaattaatcaattaattgggttaactttttaaaaatattacaatcagaaaaaatagtacaacagttcacccttatccacagttttactttctgctgtttcagctacctgaggaacgttgcagtccaaaaatactaaacagaaaattccaaaaataaacaattcataagttttaaattgtgtgccattttgagtaatgtgataaaatctcagtccttcccactccatacgccgggacgtgagtcatccctttgtccagcatagccagctgtacatactacctgcttgttagtcatttagtagccctcttggttatcagagcgcacacgcacacacacacacacacacaaatatatatgtgtgtgtgtatgtatgtgtatatataaatgtttttattccgtgtgtgtgtgtatgtgtgtgatattatctatggtttcagacattcactgggagtctttgaacatatcccccaaggataaaagagaactactgtattcaaacataaaaaagtattccatgtgaaagcatgaaatcctaaagttattttcccaaagacctcattagttatatttggaaatagaaaagtggctcatgcctttaatcccagcactttgggaggctgagtgtggaggatcccttgagcccaggagttcgagaccagcctgggcaacatggtgagactctgtttccaaaaaaacaattaattaattaaaaaaataaagagaaacaaagatgtgaaaatgatataaaagtttctaatggtgaatctgtttacaaaattttttgttttatgttaataaacattattttaactcagttttcctcccttaataaacagagaggcttaaattcagagaacattaatgttagctcttgcctcctttcactacatttcaccacttaaatgtgaaaaatgcatttcctagtttttgtcatttatataaagctactcttatattgtgaaattctgggctcatggcgttatgtaaaatggaaatcatttttattttgacaaatctatacactattcgaaattttttcagctccctaaactgggtagtcttcctggaaattcaagattacttcagttgctgggtaagagatgcctctccatgtcctctattatccatcctcttagcccacaaaatgggcttagaattacatcatttggtaaatccgggacatgatagccaagatacaaggatagtggcttacattcacctttatagtcttgctcccaagtatgtcctacagcatgaatcctaggtgtcttgtggagtttccagaccaaagacagctcatgcagtgagtgctttgacccagtcacctgagtttagcttctgcctagatttccacatgaatagatcttgctgtcctgccactgggcagaatttccacagcaaaaagacaatttaccaagtatagtcaccactatcagatatctgaagaataattttatttaaagtcttgtctactgtgccttgtctacctggaaacttgcccagctaagagttttctacattaagattgagtttttctgtgctctctggacctagaactgcagctgagtccatctgcacatctcctatctcacactttctcatcagtccttgtcttgaactaagtgccagttttagccttgatgtcaattaactagtcctgtcgctctaaggtactaatgatgccactttcatattacaaaagtcatcacagaaggataatttacttcttagtaatatgaaagaaatccagaatgctaataacatatgcgtaatattttcttgaatttttgtattccattaggctaaaacaactaggggaaatggtcttcatatattttttcataatgattggctaatcacgatagagtataaagtaaatcaaagaaacataaaatagcttggaaagaacaaaagaaatgcaatttaaaaatgtttaatgacactccacctacaaacattgttttacaaatgtattaaagttaattctctttctaaaatgtcttagactagtaatagggttggggaaaaaaatctccctttccttccctgggctataattttactttttaggtatgactactgaggaatttctaatttggctcatcacttcagtgggaattcagtgcacataaggggcacatatgtaattggcaacctaatttttctgctttcatcaaatggtgcaatgccaaatcttcattgaacttgccagttaaatgcacttgggaaccaaacagcagcaagcatacatgagattaaaatgaacaaattggaaagagtcattaactttttctgttttcctatcacaacaaaaattgtatcattgaaagtgttgcaaagtggggaattctacttgaaacattaaacaatcttaaaagagaataattcatttacttaacttctaaaatgtggttcattataatttataaatggggtttctagtgcagatttttttcaacaaaaatacaaaatcattaaaatgaataaacttttcaggagtatgttttaagttatatgtttcacatgtctttctggtctagtgcatataaattctagcctttatttggaaagaaaaattgtcagaaaattaagcaagaaatgttggcttcctgtaataccgtaatgaataaaggcaattgacagcttttcatggttctcagtaattatgaatggaactgagagtgtaaaaattactatcatttgtggttaccaaaaatgcccttgaaatatctggtctaatatataattttgaagtatgcaatatacagtcataatcaaattattgttattaatgacaattaaatagagaaccaggacactgaaaacaccacaaacttgctgaatatgattgagtatcatccctttaggaggacataaccttttaaaatgtctgtttacggctctcaaaccacctatgtattcactagatgcaaatgttcagtaatatctcctctacaaaatttcgttttacaatgacaccaggtttctttcagaaaggactgtgtaggaaagttttctttttccatttatgagttcaagtatgttaagactttttaaattgttgaccagccctaaaaaacattaacatttcataaatcgctcttgcattgtaaaaagaaggagggaggtagaagaaaaatgccaaaggattgtaggtcagcttatttcataaacaaaagctctaaggaaagtcctgagatttttaagtaagccaggccttctgaatgggacatgatatggacagtagaataagacagattgagttccattgacattatttattctttgtatgatcttaggttatctacacacactttcaaaatttaactttcttggtctgtaaaattgaggaaataataatagctgtcccatagggcacactatcaatcccaatatgctttgttagtccattcatttttccagtgcttaatcaaagaagctttaatggcctatatacttatattattgatatattcacgcacctgtcccaacttgctgtcctttccaatatcactttgtttttatcacactccttaatatcacttctttgttaggtcttgatcacatgcttaaatcatttttaatgtttgctaaactctgtatgagagattgaagaattacgagacaggaacatcaatgtgaaagggtaaaatatgtggagaatatataaggtgccagcatatgacaaaaccctaaagatgtacgatggtcacaagccatggaagaagataggacaactgaattgtcaaccttgccgcctcctccgtagcctcctaaatcttatcttccttttgtctaatttatgaaaaatgtttcctataattgtctcccaaaagcagagttgtccccatgctgtaatatacattgaccactcagattcatttaaaaaatacatcttgcttttattcccaatataaccacatttcagaagttagatcatagccagttagattacacagagcgtgcgcacgcgcacgcgcacacacaaacacaccttgaaaaaactgtagatcacttgatttctggaagtttttctcaatacctcagtgcacctgatcacaacatcttgtaatctgggcagaaggtaagggaggtgatgttaggcgtacaaacttaatattggggatgcattttctacctagaaatggtcctacattctaccagaatgggttaaaaacagatgcgcgcgcgcacacacacacacacacacacacagaattaaatgcactacatttgctgtattgcctgctaaaggcataaatatactggagtggagataaagaaggggatggatgggaaagagttcagtacttagtgtaaacctgaaaggaaatgaggcagtgcaaggggagagaggatcaggggaaaataaattatgtaggcaacagaaccatgcatcaaaagtcttttcgatttctaaactggcaaattttctccaggggaccatcagtcaaatgatgtcaaattgagctgattctcttgtaatgcctgtattgtgtagggccttccttgtaggaacacaagttccactctcggacacagtcgcagtgcttgcattatcttacagaattgattgctgcaaatggttcctgggaggtgtgacctgcttaaaggaaagaagctaggtttcttttcttgttactgaggaatgaagacacttgtcaggatgtgaattgtgtgggtgagaaggaaaagcggcgaaagaatctggtaattccttcccttacaggaggaagagaaaaaagataacatcggaaccttggagaggagaaatacagtgcatttatttccagcatccccgcagtcacttcacgtctcttcagacttcccctattctttagtcttgacctgcctatgcacttgaactccacataagcactaggatggactgggggaaaaggccaggtcagcacggtgggatactgcttcccctaaaatgaaaactcagcagcgggccagcagtgggtgtgcgcgcgtcgatgccagaggatgcgtgcgtggaatccggcggacgcagtgggccgggcaccgccctccaagccgccccgcccagcccaccacactcctccttgtataaaggccgcgcttgggcccgccctcctcacagccccggagcgcggcctgccggggaggtggatctcgcgctccccacacagtcacactccgcgcactcacacacttggaagcgcctccccacgtccctcccctgccctcctcttgctctgctcttctctccctcaccacaaatagtcgccgacctactgccaatccgcctctcctctctctctctctctgtctcaacatgactgactgggaagcggtggctcgggcagagcagctccgctggcgcaggcaggaggagcaggaggattattaaataacgcagctggactctgtgcaactgggagtggagaggagcccaacagccgagaaggggagggagggcagaggagggggaccaggaaggacacccccgtgccccgaagacataaatccctgagtgcccgggaggagccttaacaagcgcacggagccctcaaggtagtaacgcccctggtgcctcagcgctcagcgggtcgcgcgtcgcgtcgccgctttgcggggccggccgcaggcggacgcggggatgaccgctcggcaggtgaccgcgccgtgtcggggccgcctgcgagcagcgcgcgcccaggcccggcgtgctcggcgcagagacctggccttgcgggcggggtgggaaggaggcgggcgggctcgctcaccaccggcccgcgactcccagtgcgccgcgtggccatttcctccacgctgctgcgtggtttgctgcctgcggccgcggcggccgctccagggcgatgcggagcgctggccaaggcggcgagagttggcgcaggcttcgggtcgctccccttcctcgccactcgcgtcccgcaggtagaggcgaccggtcagcgctggcgccccgggctgcgggtgctgaggcggggacggcggcgaagagggggaaggggaggagggggcggggagccaggggctcccggaggaaccgcagtgcggggccgggaccacctcttgcctccgcctgcttgtcctctggcgccagtttcctggattggaagcaagaccctgcccagaggcagcagtaacggcagcgacttagattgaaccacttgctttgtggtggagcgtcaagggccccaggttgtgtgcgtgtgtgtgtgtgtgtgtgtgtgcgcgcgcgcgcgcgctctggactaaccagtgggttggttcacctgagcagaaagtcagccgtaagctgaaaccgcatgtggccccctggccccttcgacttttggcttgtgtcccagggactcgtacacacggtgccagcaaggggtaagggtgacggagggatttgtgaatggtgcttctgcgtgcgtggaggctgagccttgctgatgtaaaggaggaggtatccagagtgagaagaaaggctatttatggcaaagagttgtgaaatttcttggggtttccttttagtgtatcctgaactgctctctttctctctctctctctctcctctccctgcctcagaattagaagcaattatgcttccccttcctctcgtgggacatggaatatgaaatgaagtaaaaaaaaaactcatatttttacaggtagaaaaaaatacttcttagaagttacagattctttgccctttaatgtttttatgtcctcttctccacccctcttaccttttcaggcagtcagtaggacttacaagtcagaaaatacctacttggtttcaacagctttcatttctgaaatctttacagttgaataccttcctattgaaatgtaacacacatcctcccttctctgcccctcaaggactattaaaaataatgtgtacacgtttaaagtaaagctggttttattaacagccttagggaaaacggataagaggacacctaggtgggggtcagttatcactggttccttcaaaactggttattaagggaagacctaaaatactggtaatctaggctataatataatttgtcttggtttctctttctgtttgctttataacaggtacatgttccagatacgtaacttgaaacttaaagatgccttgggacagtgcctgtcacggtgcttataaaatgaatgttttctcttaaaagtagcaacctgtacttttatagaactgtgactgggtttagtagtaggacagtatccttaatattgcaaactgaaatgtctctaaaagcctgccaagacaatgtttttcaaatattgaaattccatgttgtaaccacactttcaatagtttcacagagaaaaaagagaagttggtcaacctattgtcagagtgatttgtcttcatttaaattaattagttattttgatcaaaacaaaccaactgttgtttgtattgttttattgctttcctaaacagtcctgttctttgaaaaacaaagcagagttaaggatttgatattttgattttgttagatttatattactttgaaatacattttcaacacggaagcatgtgcagctttaaatattaggttagaactcagatggagaaccccattcggagggttattacctcaactatcccaaactatttgaacatagatataatagggaattaaaaaatgtaattgatgaactgtattattgcaatcattaaaagtcctatttatgagtattttgttttttgacagttaagagaatcagcaactgtttattattttaaagatacattatttataccatagaatgttaatttagataaaacaaagtagaaaatgaaaaatttgttatatttttacagtaatagttattcaaccctttattgcattttattactcatcataatgctcataataaagggcctaacgtttgcaaagtactactgtctaggcattggggaggaacgggagattccttgttccctgtctttcaggaacttacttgccatgtgggaggaatctgatgctcatgcttgagcgtagagttaacaacccgtaacaataagagattacatgtctaatgagtactacaggagttcagaacatgacaataacatttcatactggattttgtttgagaatgcttcgggggtgggtaagacttgcttgatcttgatgttaaaggataagcaggattagtacattgtggataagaaaaatataaggtataagatgcaagtctcctggaataatagaaaagaacatataagggaagataagtttgttttgatataaattaagatattgctggatattttgcagagtgcaggttgagtctgttttggatgtacatccttctacacattctattctttttttttgtttgtttctgagatggatttttgctctgtcacccaggctggatttcagtggcgctacctcggctcactgcaacctcagcctctcgggttcaagtgattctcctgcctcagcctccggagtagttgggactacaggcgcatgccaccccgcccagctaaattttgaatttctagtagagatggggttttgctatgttggctaggctggtctcaaactcctgacctcatgatcaacccgcctcggcctcctgtgctgggattacaggcgtgacccactgcgccctgcccacattctattcttgaatttaattgttaatatttacacatttaagaagacaaatctttagctttatgttgtctttttgtttgttagtttgttttttgagatggagtttcgttcttgtcgcccaggctggagtgcagtggcgcaatctcggctcactgcaacctccgcctcctgggttcaagtgattctcctccctcagctccctgagtagctgggattacaggcacgcgccaccacacccagctaatttttgtatttactttagtagagatggggtttcaccatgttggccaggctggtctcgaactccggacctcagttgatccactctcctcggcctcccgaagtgctggggtaacaggcgtgagctaccacgcctggcttatattgccttttaatagacaatatgtacttgtattactacagtagtgcaatagagttcttgtagagaatatgtactttaaatatttaaatgtatccacatctcactaatgtgttgagtaaaagtggcacacctctttatagtgaggtgttttcggtatttccctaagcaaatctttttaggtttgctctaaagaagtgtgatgatgtgtaaaagaataacagtattaatagtgagcatctattgaatactcaacattttattcttcatataaaatgtgttgtctattaatatatttcatataatagtttattttaaacttcttagatttattgaatctattagattagattttatttaaagttattgtatgcagccacataatagttaatctatccatatattatttgccataaatatagagctatgatacggagcctatagtgaaaattttagaattttagcaacaattttatggctattttaactatcttctgataaataaattgtattaacaataacaccatgacctgtctctaaacttagttgtttttttctttgtgtatataggttgattttagacaaactgcttaaaatgcatttcttcatttcaagaataaaagggaaacatctgagttgactttgagcctgtacattcaatatgacaccccagaagtatgttttggtgacagtaaagaaattgcacaaatattagacatgactttcaataaataaccaaatggaattactttcagattagttgaattaaaatattttcatatatatattttgttgacagtgaatagataagagttattacaaaagtgaaagcctatttaatcaccaattttatattcatgcaagaatggaatgattccccatgtagttagggtacaaactagcctatctgttaattggtaccttttgaatttggttttggactatatgtcacaggtgtatcatttcgataatgtaatctcgtccactgtatgactgacagcttctgcatgatttccctattggacagtgacaaaatctgtttgctttatagtgagtacatacacttctatcagcaatattatcttccctgtgcaagagtgtcagttaacaataaaacatgaagtctggggtgggagaagcagtgaaaaaagatggggagattgaggagaaaacactgtaacaaaagaaacatgttttactatgaagcttaaactgaatattaaaatataaagctgactattctaaactgcagtacattaccaagatattgttatcagtctactttaaacaaccatattgtattttaagttgtttccatgcagcctaaatttttttaaaaggtgtttgttggaaatatttactgaggtgtttgatatattacaaattgttaaaagatttctgctcagatcattaactaatgaagttatttgccaaattcctggccctatacctggaataacttaaagcacggcttttggttttgcatcatttacactgcactaactcttttcaaatattaattaaagttaaacttgattaaaagttttgaatttttaaactgtgctttgatactaaatacagtccaaaggacttttataaagaaacagtttattatctagtgacaattcttaacctagagtagtggttttcaaaatgtggtgtcctaagcagcaatagcagcaagtataaacttgttaaaatgccatatctggagccccaccacagactgattgattcagaagctctggggtggggttctctgtgtgattcttatgcactctagaatttgaaagccactgacctagagtattttagagtaaaaactgaaggctatgtctttcttctgttttataaataaatacttccctcagctggtagtaaactaaggttcagatattcagttttggaaaatattccattgtccatcaaaagtttttcatcttaactatgttttctgaccaaatttttaatgagttcccattgcttgtgcaagaatttgctgttgattggggagggaatacatgaaaatttaactggatagtaatgactgtaggctggaccttattggtaggtagttataatgcaaagggtatgcacaatacaaaagttgaccaatttctgtttagttttgttgactctcctgtgatatttttggttttggcatatagtaagcacctttctttggataagattatagctgttttagctgtacaataataatatcacacatgaaatattctaagtcccactgctgaaataaattttggaccatagctctacgtctttcaagcttaaatataatgtgttcacatcctgtatcacctttataccactgtttctctccctttccaccgaacccttgcttctctatttcaatcatcacttccctagggatacctttcttggccttgttttctacatcggttgccctgttatatatagttttgcattatgttcctcttccttgtggtacttttggcagtttaaattttacctgttttgtatgattggttcagtattgcttcatcagtgttagcaatgtccagcacatagtagacgcctgataaatagtgcctaaaagaatatatgaataaataactgagcttctttgccttcattctgagaatgttttattttttccaaagaaagaaaccttaagaaatattaaaaataaggggagtcttagaatttttgcaaacataggtatttcctgttttgcaaattatgaaatattattttattaacaacaatagcaatgactgtaatgtgctggacacttcttacatgatatacactttataatgttatgtcatgtcattctaacattgtaaagttagtttgatgcatatattagagatgaggaaaccgagtctctgttctatggtctgctaaactatatagaccaaactttgatttttaaagtgataatgatgcaaaaattatgaaactcataaacagagaaactctgaaggagtatatctcctctttcttcctaatttaaccaagggcccagcagcaatatctgtgtattacctgtccttttgccaccatcttgaatgatgctgccattgcttcttgggtcactgaggacttggagatggaggacctgcaaggctggtactcccatcttcttattgctattttcagtggggatattgtgcactctcagtgccattcaaccacacttctcttactctatttagtcagaatcactgaactctttaatgaaaatttaagatgtaaccaagtataattttgtgaatgtgtgcgttcatgcagagaaagttcagacattagatattccacttcatatttgaagttatgcagcttatcttctggaaaggttcatgcagagctttgagcatgttgcttaagaaaagttgagcttatgcacaagttatgaatctagctttccttccatgaaaaggaaatatgttcactgctgctatcagatttaatttagtttcttttaacttttattcttcagttcatctatttaactgtggatttaatcagtgttcacatatttgtagcaaaggatatatttaaaggctgatttcatagaagtaaatggacagaaagttaaatttggttattttgaaactctcttcaagactatacaaagttatatatattttataatgtgtttaaatcagtcaaaaccatgaataaaactagattaataatatcaaggattaaaaaatgtttttttaactaatttttcacttatggcttattttgtagcttttgtcaaaatctatttctgttactggaagaatgaactctaacttgagccttaaccatgctcctgattcggaagcattctttctatataatgaaaaattaactgatttctagcctaacattttgtggcttaacattaagcagcctttgataactcaactctaacattacaacgtatttctagtaattaggcttacttctataactgaaactgatttctcgcttaatattttgccctgtatcttgataaattacccaatctcactattcctcctagcatttgagcaagaccccccctttgaaaaaaaacaacaactgggatcctgcctctgaaacaacctcattttttaaaaaaaagactgggatcctgcctctgaaacaacctcatttcctgagccattttatctgccagcagacaccagaaaacacaacactttcctggatctccaaacattgctagctcttagaagtatgcttcatttcaatactcactcttggatttccatgatgccaactacttatggcatattgccttgctcctgcatagttagactggttagactttttctaagtatttacagctgtgcctctggagtgctttctaaacgacagtgcagttgtagtaccagtttaggaccatcgccagactgcctcattttgctgaatgtaacctttccttacctggctgtgccccactagaaagatagtcatgcatcatcattgacaataaatattttataaatgtttattatagagttgaagtccgtcagtttcaaaaataatcatgcacctcttattggtattatcttaaagtataaattaccaataacttatggtgtttactgaacagcttaatccacaataaatgaaatacttggaattctgtatcttatttggtgtccaaatgtgatatgtgtgtacaaatatatgcacaatgtgcatatgaattctttagggtttgcctgtttctctttttctagtcacctaagttcatgatgatatgactcttctgcagtctccttcataaccttatttgtatcttatgtatttagaatgtagaaaaattgacgaaatttattccacacagtaagttttcttctctaatttctccagttcattagtgaaatttagtactgctcctgtactcaaggagtgtttattagctgggtgtggtggagcactcttgtaggtcctagctacttgggaggctgaggtgggaggattgcatgagcctaggagttcgaggctgcagtgagctatgatcacaccatgcattccagcttgggcaacagcaagaccctgtctctaaaaaagaaaaggtaaaaaaagaagtgtttgcttagctaagtgtactactctaattcagcctttatggggatatcagtgatataccattcttattaaacaaattcagactaagttgttgtatttatgtacctattcactgaaattagctctttcttggaagcaaatattatgaatctgttaatgaatgtttgttgtgtgtgtgttttgcaatagcagtaaataatgtattacaaacctacatcatgtttacaaataaaagccaaccaaacatgaattagaggcatggcaaaaataaatggctaaatttctaggcaagtatccctttagagaactgtttttgtttgtctgtttagttttgtttattttatagatatagaaaggaccaaaacgttaagtctgaatatataaaatggattgtgagtgcttcttgataatagacaatattcttcaagacatttaggaaaagctcgaagtgagaaaaccatgcatatatcccagaaaccatcaggtgagaagttaggaaaaggaggaaaatactagctctaaacaagacccaaattcattgttataaatataaattaagaataacttatttcaggtaaagtttcaatatattttagaggtaacaaaaccccactgagtttgtacaataagattcttaaattttcaaaggaatgttacctagtgcacagatagctcaagaataattattgactttttcagctagtaatattgtattcatgtataaatgacctaggaatattaaaagtactcattaataaatgagctccacagaagtcagaatgtgactcccataatgtaaatcttaaaaattaaagtacagattactaaactgggccattaaatgaaacattacaaatttgtacacaggtatataaacttttagaaacattatgactaaaattgtttttgagaggtattccttacagggtacttcaaagtataaatataggggaattggagagatagcttcattatcaacaacaattcagtttctgataggaggaagggacctgaaatgggaagttttacgttgattatcgggacaatatagtatgaattctagcctggcttggaacacagaggggataaagaccccagagtggtaactatccagtgaggagaaggaaggtattgcctcccaggatatttctgaggagagtcaggttcattggacggtgatatagaaagtacccagcctcagaggcctggttcaggaaataaatggatgagatattttaaaagctaaggaattataatttgaatacaaaacagattagtaaatttgaagttctggagattctctaatctcaattccaatctgctagccatcagtctgcacagtcacctttgacgcagaggagctatccagggtactagatcttgctgacctctcttgcaaaaatgcaaaacatgccgtttttgtttacgttaatcatagagtctgctgttgcagatgctacgttacttaactgcagttactaaccttccatcatttggcttattctagtaggcccttcaaagttctttttaaaagtaaactcatggaagcccatctcaattccacataagaagcatattctgagttccagtaatattctgtgtatgttagtatcaaatctccattgaaagtatcataattcactgcttgtttgtacttaatgctcagtagatggtgagctctatgagggcagggtttttattttattttattctctttccccaccagctggtctaaaccagaggtgtaaagatactcagtatggaagtgagaaatggatgaataaatgcactactacttaagagtgacgtggatttcttttttaaatttttttttgaggcaaagtcttgctctgtcacgtaggccagagtgcagtggcacagtcatatctcaatacagcctcaaactcctgggatcaagtgatcctctcacttatgcctcccgagtagctgggattacaggtgcgccccactacgcccaactaagaatgacatgaattttgtcggcattatgtgaactacttccagtgctaaccactgttctgaatcctaccctaggctcactttgaacactgccctccctggctatttcatagactgaaaatttgttcttaatttggagctgaatagccaacactggctaaaattcttaaagtaaatgaaaggactggaggaatggtggcagctaaactacatgcattaggggttagtgaggtctagggaagcaagaagcagtggcacaggccaatttggagaatggagatcaaaggagagttggttttgtcacttcctcaaaccaaaatcctgaacacctactccatgttcacttttttttttttaattattttactttaagttctagggtacatatgcacaaggtgcaggtttgttacatatgtatacatgtgccatgttggtgtgctgcacccattaactccatgttcactttttaagacctttggaatatggcattttcttccactttatacagcccagattcacattttgaaatgttgacaaatctgaggtcatgtgaggctgtcagaattctttcattcagtaaacaaatgttactaggccctatgcatgtatcagttaatgaaacccagtatgtttcctgtccccatataattgatggtccttgttgagaacagaagttggtagactttttttttgtttgtctgtttcttctagtagccatgttagtgacatcctagcttgctacacagagtgagtgtgcttgtttccagatctccaacctgcctcctcacatcattgccctaagtttccaatgtggcaaaaagggactaagtcatcatagagaaactcttatttacataaaagatatcctgtcactagtgtggtattgatctgctggtcagttttgcatgatgttggtaaattatgtgcctgtatatattttcccttatagggatattttctgaacagtttaggttccatggtttctattttggtcagaaattccctgtattccaagtgcataagccatagaaaatagctgtgtgacctttagatggagtgtattttcactttatagttctagctttcatgtttttgaagtatatatactatctatccttcaggtcatatgttcctgtttcctgttttattttattttattctatttttttcacgtattgccaacagtaatgttccaattatgaagtagaaaaagaaaagctgtatttcttggtaatttttttccttgagaacacaattgtgtcactcagagaaataatgtggattcagaataacaggtgtaaaagtatgaaaatgaagctcggtgcagtggctcatgcctgtaatcctagcactttggaaggcggatgcgggcagatcacctgaggtcaggagttcgagaccagcctggacaacatgatgaactctgtctctactaaacaaacaaacaaacaaaaattagccaggtgtggtggcaggtatctgtaatctcagctacttgggaggctgaggcaggagaattgcttgaattcagaggaggaggttacagtgagctgagatcatgccacttgcactccaacctgggcgacagagtgagactccatctcaaaagtaaagaagtaaataaaagtatgaaaatgaaaaatgaataaagcaaaagatctcggtaatcatcttgaataaactgattatttaaaaacctaaaatttctttgctaaatatttacaattatgtcaaataatatggtcatcattaattgcattgattaaaagccacttgtgctattttctaagtattactagagctgaaatatacataataaaaactatgtttaatctatctaaaataaaagttgccttaaaaccctttcaagagttagcatgtgtgcgcaaaatttaggtgttttgtagtgaaacttaaagggatgaattttcgcaatcatctgaatcatttgtgttgtgtaaatatagccctaggaatcctcagtactcactcaagtttaggactccttagggaccagaagtgatgattgtctttgattttagagtgtgtttatagaaagatggggtcctgctgagattacattcttctttgacaaaggaaagtagttcagttcacactcacatcaaaaacaaattttattgaattaaaaattttttactggaatattttttgacatgaagacaaacttgtatcaatctttgttatatgtgtgtacgtacacatgtacacaggtatgtagtaattaatttcttatgaaaactgtcttgtataacttacttccaatcaggtatttttggtctacttttttttttttttttttttttttttgagacggagtcttgctctgttgccaggctagagtgctgtggtgcgatcttggctcactgtaacctccaactccctggttcaagggattctcctgcctctgcctcctgagtagctgggattacaggcatgcgccaccaagcccggctaatttttttgtatttttagtagagatggggtttcactatattggccaggatggtctcgatctcctgacctcgtgatctgcccgcctcagcctcccaaagtgctgggattaccggagtgagccaccgcgcccggccttggtctacttttttagaatgaagggtttagtgttctccagagaaacccagcaagatatctatctatctatctatctatctatctatctatctatctattgtctgtctacctattgaaagactaattttaagtaattggcttacatgactgaaatctgtagaaccgactggaaggctggaaactcaggcaggatttttatattacagttttgaggcagaattctttcttttccagcaaacatcagtttttattcttgatgccttcaactcattagatgagacccaccccacattatcaagggtaatctgctttacttaaatgattgtacatattaatcacatctacaagatacctttacactaacatccggagcaatgttttatcaaacaactgggcattatagcccagccaagttgatacataaaattaactaaaacaagggatgaaaggtaatatgttaagctctttctgttttacataatatgttagtgtatacattttctttggtcagagatattttagcattggttagttattggtatacaaagacacaggtcatcatttgttctttatcatttatttaacatgcaatatgtgcaagagacaatgctatgcaattgaataatttttaaaaaatgaatgaggagactgtgtcttttaagtttgttaacaactctagtggaagagccacaagtgtgttagatgactgactggtaaataaagttgcagaatgaaaatgcacatttccaactttgccgatgaaatgtcattttacccatgagcaatgcccctccaaaaaccccttatgtcaaggctaatatgccaagttattacacttgttagtttaaggatatgttgtgtgtaaaataggatcctgaaaggtatgcttgcccactgcaggtcaacttaatttggacaatgttgactatgcatacatttattttagcacattaatgggtttgtacctgtactcgacctttgcaaaggtgattcaatatatgcccagagagccatgacaagtggactgtcacgttttattgatagtcttgctcttcatgtagcatagagtaataaacatttgctttactggctctaaataggtatttttaatgccttcctattccaaaactacattgtgtttctgtgtttttattcaatgaatatggatttgtctgcctggctttggaggccctttgtgagctcaccacactttgttaatccaaacacagatcttctactttgttaaggtcatgtaacttagagcaccctcacacacaaagcatatgcatttaatcctttttgtttatgcaaatctcagctgtcattacaggcctaagtccatgaaaccttccatgacgactttaaccctcctggggagtttcttttgcagcactctgagttgtgagcaatacctgcttggcaccagacaattaagtacagtctgttctgcaacaatgcatttttctgtagtgggaattagctccaacatgatgggtaaataggggaattgtgttagtaaaatgtggaagttctttcatgtgtgtttttccccaagcataatcatatttagctttgccaaataactacagctgaatgcaaaatatactaatacaggcaaatgcacaatacagcagagggatatcgttttatttatttaccactttttttttttttggtatgagtaagccacaattttagctttgaaagtgcttattgtgcggtttttcttgatccctgcagcctctggctaccttcacttttttttaaagagaaaatttatgtattctctgtattatttcttttctttactgagaattttacatgtccttttaggcatataggatttttataaaaattgttatggttttggttagaactttgtgttataaattgcatagattttaaatgtttctgctacagttctatttttttattatccctgttatatttattgcccagtttttcagaataaaataacacatatattgcaatagcaggagttcggcaaatttacatgaaatcacttaatttttatttaatatccactatttgtcacttcctagtgctaatgttggatgtatgaaaagtgaggaagccttacttttttgtacattgggctttctaagcaaatatctggtatgatggtggttgtaattcttggctcatttgaaggggaggaagacagacaatgagaagtaactgtgttactgcaaacatcagttccagcaaacatgtttttgttcttccctctgcctggaatggtctcccattcctgccgtattaagccaatttcttctcaagcttcatctctcaagtcaagcatcatgtcttcatgctattttaaactctcactaccatgtaccatatacctttctttcatagtctttaaggtagctgcaattttataatcatttgtcagattatttaaataatatcttttttcttagaccataaacttcctgagaacacagttcatgtttggttttttccaccattgtatttctgtttcctagcaagtacacacatacacacacacacacacacacacacacacacacacaccaggtattaatataccattatagaatacatcaagtattcagtaaatttttgttgaatgaatggattattgaataaattaacttttcttttttcttttttaacaactaagtcttgaatatgcttcctagaatcaattattttacttctccattcctacttttttttttttttttctgagatagagtcttgttctgtcacccaagctggagtgcagtggtgtgatcatagctcactgcagccttgaactcccgggctcaagcaatcctcccacctcagcctcccaagtagctgggaccacaggcatgtgtcaccatacccaagtcatgttttgttgttgttatttatagagacagggtctccttatgttacttaggtttgtcttgaactcctgggctcaagcagtcctcccacctcagcctcccaaagtgttgggattacaggcatgagccaccaatccttgtccacatctcctttgttatcatcacatttcctggtctgtattcccattacttgtaaagccacttcagcatccaaactgtaagatatctttttaaaagggaaagatataaatcacttgttacttgtcaggttgttccatctactgcttttttctctcaaaatttggatttgtttcttgaaatttcattttattataattcacagctttcctgaatgtgctcccataccttgcctgttcaaattatagctaggtaatgtttatattcttgccagggaaacttgattgtggaaggaaaagtgtgctgctattcattggattaattgtggatgacatctttgctgtttcctattaaatatgacatataggtagctagattatttaaagtaaaatatcattaagtcaagtacctgtggatgatcaacatatagctcttgtaacattcatcccactatgcattatgaataactgtttcactgcgactgccttggatataaattattgaggtgtttatgaatgtggactcaaatttactcaatgcacacagtaaacagctgagtaaactcctgtttaagcagtgagggaaaaatgtgaaaaagtagtggaatatagttaaaacatatctagtcatcatttcagtcattaataacaactggattctagattacctggactatttaaagtgtttcaagaatacagtataataatcaaataggaatttttgctttcacaattacatgcagcgaatttcagatattcagactatgtagtattttatgcattatgggaaaatttttatgtaaattattttattctaatgcttaggttcctctttgtgagttcaaatgccccatttattcattttgataattgtttactttttgtattatccactattaatctgttattatgtaatattctgaaaaccaaccaaagagatcagctcatctaaattaattactgctgagtattatttctacaaaattttacgaccattattttcgtttcaataagcaatctattttctggctacctatagtttaattttgattataaaagcatgatggcccgtaaacttccaggtatcaagtattatgataaaaagtcaaagaatctatttctctttgctttatagatgacatttgaaatgctaattctatttttatgttactttctacctttaaaatattctaatctcataggccccaattagattttaaataaaaatctcagagaaatagggtaccttttcaatttaacaaacaaaatacatcattttttatgcataaggtaactccatgtaagtgattgtggaatgccacataatcaaaataactcataaataattaaagagtcacattataaaattaggaagtgtaaaagaaacaataagtgtactcctgcctgctttttgtgtcatatgttgctgcctttaaaatacaatttcattgctgtatcagtgtgcttttcagtttcatgctctgcatccatagttggatttacattgtctgtaggcttgggctgactcaccgtatttaacatttcaatatctattgtgtcaagcgtgattttgttttttatgttcacatctgtgtttataggaactggctatagatgcctaaactgtgagggaatatgatctttatgcagtcattgtcttaagataggttacagagttttcattgttgttttgactgtattaacattttctatctgtgaagtgttttgtaatcaaaattctactttttcttttatcatgtcttcattctttggagtttttaaaatctggagctaaaattaagcatccttgcctaatatgtgcaataaaaacaaaacaattgaacagattataaaaaattttaaaaggccagaattttcatataatgctgatctatgcactcataggcattgtcttagggtacctttttttccctgtgacattgacaaataaacagctgaagatttgttgaaataatctctgaagcactattatatggcttgataattggcatttgcaggaagctaactgttattatctatgaattaatactcttaccttcccaagacttaaaaagaaaataaactttaagtgggaaaaatgtttcaaagtgaaatattcagctaaagtagtgaaaaagaacaagtgagataagtactgctcttttgatgtgtgattctgtaaccttctcatttttaatattcttgtatttctagtcttttgagaagtgagctccaatttatatagcacagatgtagaattttaatctacatctactgtgcaagaacaggagatcagaggaatattttaatatgtaaagtctctttaaatttttatggagcataaaataatactttacccacattatgcttgttctcatgtttaaatttaacaaatgtaaagggcatgatctttagatcatctttttcctcttaaaaatcatctcttttacggtgcatattaatgtctgaattagcctagaaaaacagctaccgtcattctaattactggcagctttggtccagcagcttgtactcggttcaaagagcagatcacaataaagatacacattaaataataaaatacggctgtgaacttggaaaatttagtttagtattaataattttattaactcaactgttatcgaaattggcttagtgtaattttatgttagctaattttgatacaattggattatgttcataaaataccttaataatttatacagaggattatatatcttttagaacagcacttttgaaaatttttcactagaagatgatcaattttccttaacttgaagatgtggcattactttgaccgggctgttatgtgtttgaatttggtcaaatcagtatcaatgctgctaatagtttctgtaaccacatgaattatttccctttgaagacactatgatattcttttaaaagtaattaacacataagattaaatattcatttttatgatctcaagaatttatgaagtcaaaccacaatgtttcttctaattgtcttcaggctacgacttgtattttgattattttatttatttatttacttagttgtttaattcatttgttcagtgatttatttatttactattgtatttatttatttttaatactttgtttaataacttaacagtcatttaatgctttccatgtgtaagacactttactgtgtctttctgtgtgtaagacactttactgtgtctttctgtgtgtaagacactttaaatttctcaaatttaatgatctaattttattctcacaacaaccctatgagataggtttttaatccccattgttgtttataaaaatagagacacagaaaactcattaacttgtcaatgattacacagtttgttgtggtgaaatagttgttatttgggtttaatttatataactgcttattaggtcaaaagtattccattataaatgagactttacaaaccatgaattgtttctggtttattaaaatatgcatctagtaattatagatataaaagtagtattggccatgttcaagtaccttacaggctattctagattaatttgaaaagataattttgtgaaatgcacaagtgctaattatgcatcaaagtgagtagcatttgaacaattcaggtgtactaaaagcaagaggcttataatcctgataatcttcatgacaaaattatttcaggtttgaaaatgatatgaatacatccgtaaatacaaacatttgaaaacattttcacatttttattctaaaacagaaatgccattatattggctgtactaatgtgcccttaaaaaaaaagtaagattgtgaacatatgctatgtaggttagaatgtgattgtgatcaacataattcatttgaagagtataattataacaatttaaataattttataaaaggccgggcatggtggctgactcctgtaatcctagcactttgggaggccgagatggatagatcacttgaggtcgggagtttcagaccagcctggccaacatggcaaaaccctgtttctactaaaaatacaaaaattagctgggcatggtaacgcttgcttgtaatcccagctacttgggatgctgaggcataagaattgcttgatcctgggaggtggaggttgcagtgagccaagattgagccactgcactccagcctgggctatacagcaataccctgtctcaaaatgataataataataattgtatgtaattataatttaaattttatagttataggcaacctttaggagttaaagaaattaatggtttatatttttcactcaaataaacacatgtgcataagaaaaataatagtacttgtaatttctgatagtttgtggatccactagagtatccatgaatttatttagaaaagcccagtattagtctcttgaaaatattcaatcaagaaaaaaattgtacagtttttttgcattgttagtatacttggattgacaacattataaaacaaacaaaaggcacaaagaaatgcatattgtctaggatatggtagtacaaggttgatatagatgtgatcctggtcgtagagtaaagggcttcttggttagagagaaggatcagagagataggaatttacctacctgccataacaaccaggaacaaagcattcctcagaagttttatagtctgtcatcttttttcccaaactctatctcatttgaacctcactgtacaattattttgatttcagttttgcaatggacaaacctgaggattggaaatcaaatgttttacctatgatgtcactgtgtaattagtacttctggctttagctgacttattttttttctctatcttattctgtggagctatcaagctgaacctgtaactcaagcatacctatacgtctactttcctcctagaaggcataggcattggaatactgtcttttaacctcttgagtcaatcttatgcttatttttacaagtaggtcacaccctaactaaaagacatgaataatgacatgcattttagaatatgaaaggcactttggctttgttagaattttatcagtgtttcttatgacatctatttccgaaatcccatgatgtttgtaattgcaggcaacaccaaatactgataacagctgtcagtatttaccagctactgttctaagaattttacatatagtaatgcatttaatcatcacaataaccttatgaagtaggtgatatttttcttattttgaagatgaggatatggaaggatagatatgctgagtaaatagcccaagttcaaagagttagaaagtagtagagcagaaggggccaatccatgcagtagggctctcaaccacctcaccctatatacatggaggctaaccaaagttttgttcatgaacatttgctattttattgttgctgttttcaggcaaagccatttcattgccctttgaagaacaatgggagtctaatattgatgaaattgtccatttctatgcttgacttttatattggaggtagtgccattaatccagcatcaactgggaaattactcaaatcaggtggactagtctgagatttctctaagacaatctcaacattcagttatacttaaaaaatgtgttaatctttgagaaagggaaagcaagtaattgaaattaaaaataaacttacgaatatctttggcctctatatgacaattttggaaaaactgtatataataatctaaaccatgatacttctttaggtagtgtttgaaaatcagaaacagacttgttcttagctgaaaattttattattataaacttagtgctcttgaactttgcttaagatatttaatgatgcaggaaaaatagaaacattcagtaaagaaaaaaagagcaatatatttttcatattcaagttaagtctgcattgtatgtaaaagcaatcatttaatgttttttggagtaaaataataagaaacttttattgacaggtcaatgccataaggaagttggaaatcaccagtgtttatgttgacttcatgagctataaagttgacccttgaacaaaatgggctaactgcatgggtccatttaaatgtggatttttgcaataagtagggttggccctccatataggggataaccacatcctcaaccaaacatggattgaatatattcgtgcaatgaaaaacccacataatagcaagggctgatttttcctatctgctaattctacaggaccaactgaagtaacttgaatatgtgcagattctggtatctgcggggagtcctggaaccaaaccctgtgggtaccaagtgtattcagttttccaaatgagtaaaatatcattattagttagcctgagtttcctatttatttttctgttctttttttaatagcgactcccatagtaacatcagtcactgttgcaaatgtgggcaaaaaaagtggggtttcacacatttggtgaattcctacgtagttattagtggggaaaggatgtcaataatactgcatcttgctgctttaagtataagagatgcatgacttgtgaccactgtgtatgtgtagaaaacgcaccttttgttttttaaaaaagattattaccagctcatgaagcattttgaacatataaacatttacttgtaattgtacctcattcatcttcatcactcttatcaatgtcctaaatgtaataagcaatttgttgttaaaaccagtactgaccacagtgatcattttatgtataggacaatgtaattattaagaagaaaaaccaatgctttactaagtaagccagctctattctatgtaaatatccatatagaaaacacatttgaagctgtgcactgggtttaatatttatatatagatgtctttaataatcagtttgtgtatttaaggattcaagtagttattattaggtcagtgaataaatgtatccaatgtatctcatcattctgaattattttattgctttgcagttggagtttatttaaaatattactaaaatctttttgaatagattgttatttttttttcctcctcacaaaagcgaagcatttgatttaataaaaggttccacaaccctgctctggcctgacaaagacttgcttggttgattagcatgaatgagaatatgaaagatttaaagaaaagctgtcaaagcaattagaactaaagtcctcctatcactgaataatgaaaatccaggcctggaacactttcaaatgtacctaagaaaatcgtacttatacaaaatgaaatgatagtgaataaaagaaatggaataataaaagccaccagaggtaaaattgtacaggtagcattttaatatattcttgctactatattttagatttattaatgaacataatgatatatggtttcttcataaagatatatgtatcaattttaatttaggtatttatttagattattaggcttaatattcaattgttttaaaatgtttagctttaagatgatttctataaagtctaccatttgggtgtctttctttgtaatttaacttttagatcaatcatttaaaatcaaatgtggatattcaagctacaaaagagattaacaggcatttaatatttaatatacaccctttttcttaatgcttttaaatcttaaaaatctagaataaattgatagactgtcagaatactttgtgtgattaagaaaactaatgatacaaagagtacacctggagagcaaactcataatcattttatatttttattaaaacataattcagtctaggagatcattacatcaatagattcttttccatttgttcagttatttaagcactcagttatttagtattaaacaattattttttcaatctttacaatgtaaatttgtatttacatttacacagtgaaagataacaagatgagttagacatggatctggcattaaagggcttgcagtctaaggaagtagctatgataaatgtactatagatgctaatgcattaaataggtagaatataaacactataaagtgaatataaaaaaagaagagattatctccagctctattaagtaaaggaatcaccactgaataagttatattagaatttggtccttaagtctgtgtatgcatatcattttaaaatgtttttgactgcaagtaacccaaatcaaagtatcttaaacaacacaggggatttcttagcttgtgtcactaaaagggtgagcacagacacagttcattagagcctctgctttatctctctctgctctatcacctgagatcttttccctgactagtaggagggtggcaggagtgagttctgaaactcacaactgtgcaccacaatctccagaagagacactgacccagtatttcaagaaagtgttctgagagctaccttgattggtgtgtgtaggttaaaaatttgcccttaacctgaggccaggatgaaggaatgggcatactggcctaagtgagccaaggttcatccctggagctgaaaatggggcttgattttccctgagtattcagctgcatgatggagaattttgggatattacagtgagcttatgtgtactgttggggatgggaaagggagaatggatcctgagtaggcagcctacaatgtccagtggagtgtgatttagacattcacatttgaggaaggttattcaagcacagtggattatgtgaacatgtgaaggaaggaaaatgtaacgtgtgtgtagagagcactgattattgcagtttggctgagatagagagtgcccaaagggaagttattggaaataacatcaaaagagtaaattggatcagatggtagaataccttgaaagctaggcagtgaaatttgggatattctgtagatgatgggaggtgcttaagcttttgagcagtagaccagcatgctcagagttgcttttaagatttgtatttgtcagtgctaggtttttttttttttaattttattttttattattatactttgagttttagggtacatgtgcacaatgtgcaggttagttacatatgtatacatgtgccatgctgctgtgctgcacccattaactcgtcatttagcattaggtatatctcctaatgctatccctcccccctccccccaccccaccacagtccccagagtgtgatgttccccttcctgcgtccatgtgttctcattgttcaattcccacctatgagtgagaatatgcggtgtttggtattttgttcttgagatagtttactgagaatgatgatttccaatttcatccatgtccctacaaaggacatgaactcatcatttttttgtggctgcatagtattccatggagtatattgccacattttcttaatccagtctatcattgttggacatttgggttggttccaagtctttgctattgtgaatagtgccgcaataaacatacatgtgcatgtgtctttatagcagcatgatttacagtcctttgggtatatacccagtaatgggatggctgggtcaaatggtatttctagttctagatccctgaggaatcgccacactgacttccacaatggttgaactagcttacagtcccaccaacagtgtcaaagtgttcctatttctccacatcctctccagcacctgttgtttcctgactttttaatgattgccattctaactggtgtgagatggtatctcattgtggttttgatttgcatttctctgatggccagtgatggtgagcattttttcatgcggtttttggctgcataaatgtcttcttttgagaagtgtctgttcatatccttcacccactttttgatgggtttatttttttcttgtaaatttgtttgagttcattgtagattctggatattagccgtttgtcagatgagtaggttgcgaaaattttctcccattttgtaggttgcctattcactctgatggtagtttcttttgctgtgcagaagctctttaattagatcccatttgtcaattttggcttttgttgccattgcttttggtgttttagacatgaagtccttgcccatgcctctgtcctgaatggtactgcctaggttttcttctagggtttttaaggttttaggtctaacgtttaagtctttaatccaccttgacttaatttttgtataaggtgtaaggaagggatccagtttcagctttctacatatggctagccagttttcctagcaccatttattaaatagggaatcctttccccattgcttgtttttctcaggtttgtcaaagatcagatagttttagatatgcggcgtagatttctgagggctctgttctgttccattgatctatatctctgttttggtaccagtaccatgctgttttggttactgtagccttgtagtatagtttgaagtcaggtagcgtgacgcctccagctttgttcttttggcttaggattgacgtggcgatgcgggctcttttttggttccatatgaacttttaagtagtttttttgaattctgtgaagaaagtcattggtagcttgatggggatggcattgaatctataaattaccttgggcagtatggccatgttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaactgaataccctttatttccttctcctgcctaattgccctggccagaacttccaacactatgttgaataggagtggtgagagagggcatccttgtcttgtgccagttttcaaagggaatgctttcagtttttgcccattcagtatgatattggctgtgggtttgtcatagatagctcttattattttgagatacatcccatcaatacctaatttattgacagtttttagcatgaagggttgttgaattttgtcaaaggccttttccgcatctattgagataatcatgtggtttttgtctttggttctgtttatacgctggattacatttattgatttgcgtatattgaaccatccttgcatcccagggatgaacccacttgatcatggtggataagctttttgatgtgctgttggattcagtttgccagtattttattgaggatttttgcatcaatgttcatcaaggatattggtctaaaattgtcttttttggttgtgtctctgcccggctttgctatcaggatgatgctggcctcataaaatgagttagggaggattccctctttttctgttgattggaatagtttcagaaggaatggtaccagttcctccttgtacctctggtagaattcagctgtgaatccatctggtcctggactctttttggttggtaaggtattgattattgccacaatttcagatcctgttattggtctattcagagattcaacttcttcctggtttagtcttgggagggtgtatgtgtcaaggaatttatccatttcttctagattttctagtttatttgcatagaggtgttcatagtattctctgatggtagtttgtatttctgtgggatcgtatcccctttatcattttttattgcgtttatttgattcttctcttttttcttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgcttcctcttgtgggcatttagtgctataaatttccctctacacactgctttgaatgtgtcccagagattctggtgtgttgtgtctttgttctcattggtttcaaagaacatctttatttctgccttcatttcgttatgtacccagtagtcattcaggagcaggttgttcagtttccatgtaattgagcagttttgggtgagtttcttaatcctgagttctagtttgattgcactgtggtctgagagacagtttgttataatttctgttcttttacatttgctgaggagagttttacttccaagtatgtggtcaattttggaataggtatggtgtggtgctgaaaaaaatgtgtattctgttgatttggggtggagaggtctgtagatttctattaggtccacttcgtgcagagctgagttcaattcctgtgtatcgttgttaactttctgtctcgttgatctgtctaatgttgacagtggggcgttaaagtctcccattattaatgtttgggagtctaagtctctttgtaggtcactgaggacttgctttatgaatctgggtgctcctgtattgggtgcatatatatttaggatagttagctcttcttgttgaattgatccctttaccattatgtaatggccttctttatctcttttgatctttgttggtttaaagtctgttttatccgagactgggattgcaacccctgcctttttttgttttccatttgcttggtagatcttcctctatccttttattttgagcctatgtgtgtctctgcacatgagatgggtttcctgaatacagcacactgatgggtcttgactctttatccaatttgccagtctgtgtcttttaattggaacatttagtccagttacatttaaagttaatattgttatgtgtgaattcgatcctgtcattatgatgttagctggttattttgctcgttagttcatgcagtttcttcctagcctcgatggtttttacaatttggcatgattttgcagtggctggtacctgttgttcctttccatgtttagtgcttccttcaggagctcttttagggcagtcctggtggtgacaaaatctctcagcatttgcttgtctgtaaagtattttatttctccctcacttatgaaacttagtttggctggatatgaaattctgggttgaaaattcttttctttaagaatgttgaatattggcccccactctcttctggcttgtagagtttctgctgagagatccgctgtcagtctgatgggcttccctttgtgagtaacccgacctttctctctggctgcccttaacattttttccttcatttcaactttggtgaatctgacaattatgtgtcttggagttgctcttctcgagtagtagctttgtggcattctctgtattttctgattctgaatgttggcctgccttgctagattggggaagttctcctggataatatcctgaagagtgttttctaacttggttccattctccccgtcactttcagatacaccaatcagacgtagatttggtgttttcacatagtcccatatttcttggaggctttgttcgtttctttttattcttttttctctaaatttcccttctcgcttcatttcattcatttcatcttccatcactgataccctttcttccagttgattgcatcggctcctgaggcttctgcattcttcacgtagttcttgagccttggctttcagctccatcagctcctttaagcacttctctgtattggttattctagttatacattcatctaaatttttttcgaagtttttaacttctttgcctttggtttgaatttcctcctgtagctcggagtagtttgattgtctgaacccttcttctctcaactcgtcaaagtcattctccgtccagctttgttccgttgctggtgaggaactatgttcctttggaggaggagaggcgctctgctttttagagtttccagtttttctgctcggtttttcccccatctttgtggttttatctacttttggtctttgatgatggtgatgtacagatgggtttttggtgtggatgtcctttctgtttgttagtttcccttctaacagacaggaccctcagctgcagatctgttggagtttgctagaggtccactccagaccctgtttgcctgggtaccagccgtggtggctgcataaacagcggattttcgtgaaccgcaaatgctgctgtctgatcgttcctctggaagttttgtctcagaggagtacctggtcgtgtgaggtgtcagtctacccctactggggggtgcctcccagttaggctgctcgggggtcaggggtcagggacccacttgaggaggccgtctgcccgttctcagatctccagctgcgtgctgggagaaccactgctctcctcaaagctgtcagacagggacatttaagtctgcagaggttactgctgtctttttgtttttgtgtgccctgcccccagaggtggagcctacagaggcaggcaggcctccttgagctgtggtgggctccacccagttggagcttcctggctgctttgtttacctaagcaagcctgggcaatggcgggctcccctccccagcctggctgccgccttgcagtttgatctcagactgctgtgctagcaatcagtgagactccgtgggcgtaggaccctctgagccaggtgcgggatataatctactgctgcgccgttttttaagcctgtcagaaaagcgcagaattagggtgggactgacccgattttccaggtgctgtctgtcacccctttctttgactaggaaagggaactccctgaccccttgtgcttcctgagtgaggcaatgcctcaccctgcttcggctcgcgcagggtgtgctgcacccactgtcctgcgcccactatctggcactccgcagtgagatgaacccagtacctcagatggaaatgcagaaatcacccgtcttctgcttcactcacactgggagctgtagaccggcgctgttcctattcggccatcttggctccgacctccctgtcagtcctaggttttaagagatgtggtctcactgagtcactgaggttggagtgtagtggtacaatcatagctccctgcagcctcaaactcctgagctcaagtggtcctcctacctcagcctctttagtaactaggactgtaggcctatgccaccgtgactggttaattttattattattattattattacttgagaaatggagcctcactgtgttacccaggctgctctcaaactcccagcctcaagcaatcttccctcctcagcctcctaaagcactgggattaaaggcatgaaccaccatgcctggcccattgccaggttttataaaaaaatatattgcagttgaatcatgatttttggcttcagtacctcgatgaatggtgaggtcatattctgacatggggaagaggaatagaagcagtctgtgaatgtctaactttggtgtctaggaagacagttgtttccttactagagagagaacacacaatatggaaaaattaggggtaaagagagatgagtcaatatttggatataccaaattagttctccatggatctattgagtataagccctttggaattcgatttttcaaagctttttatcttgcaggtaaatgatttaatattcacagaatgtagtgacctactctatttacattgttttacatttcagacctagttttcgtgtctagttcttttgactcaggtggtcagtattctgttcattttaatatagttacctccctacttgacatacagattgacatattttgccataatagtaaatagtgcctaacatttattgaggattgttttatttcaggcattatgccaagccatttttactcttattaataatatttcattgataagtataattaaaatcatagtacctaatgttatcaaatacttacaacatgacttttcactgtcaagcaatttgcatatattatatactgtgcttttaataatcatcctattaggtagtggtgttattctcattttacagattggaaaatttacacttgaagaggttatgtaacttgcagagattacacagcttgttgggggcagagcaggatttaactccatagtagttgttgcactcaaccagtgcacattgctctcttcaaaacagtccttaagagggtgtgttggcttggtggaggagagggagtagactggagacagttgtgcttggaaactggaaatgtgacactgacagtctgtctggaggtcagggctaaactggctgatgatttagatgtcacacttatgtacattaagttgggaattgaaatcacgtgtttgggctctgtttatgagagagattagagatgaagagaagatgactacagtcagaatctgggtgccaaataataagattgagcaaccatgaaagtaggaggactatcaggagatttcagtgacaaagaatgcagtagagatgagagttttcaaaacaaagaagatggctaaattctctggtgttacaagaaaagcccattaggcttggtaactagcaggtcattggaggcctcttaggagcctagtttttaatcaaatggcagttgtagaaggcacaggaaatagggctcatgaatagatgctatttatatttggagagagattccactggagagggtaatcttgaagaatcatgaggtagataaactatgcaatgaagcctgatattggaagctatgggaaacaatagaatgtagacctctagaggaagagttaactgcacataggaagcactaaagaaaaagtgaaattaatgaagattagcaaaaaaacaggaataaagtgaaattgggaaaatctcatggataatctcagtactctcagccaagtgtatgtctaagtcatcagcatgattttgtgtgatatttttgccaaataccacacatatcctaagaatcaatttcctagaagataagattattaaaatttaaatccagctgccaaaaagataagctacctaaaagagaaacaaggccaaataaaactacccacctatatagatgcctgatagaaatgtaacctgtaatgttgtatcctaagtgagtgtaaggagacaggtggacttactgtatgtaaacttgtgaagtctaaattttctcttatatgtttgctcatcctatgtgcttatttttcttgctgatgatctttggttggattcttccaagtacacagtattcaccttcatgcaaaataagaacagattgtgtagtcagtttaaaaaaacagttaacacttatttagcactaattctgtttcaggtactgttctaatgtcttacacataatcacttattattctcacctgccatatgatttggatattatttttatgcacatgttgcagatgacgaaaatgaaatatagaatttacatattgttgatgtattagctgttggcattttgttataattaatttaaacaaaattatgataatcactttaaaactattaaccattaacttgacctttgtaaaggtaatctatctcagatctctttttttaatgagaatgtttaaatgagaataattatagaaaataactcttgtcattgtgaattgaattagatagtatatataaaaatctaaaaaagttttaagcacaagcaaatattgaatcagtgtgaattaataataataggtaaaacgtgggtttaaaacttgaagtctttatttctctgtgcactaatagaatgaactaacaaattccttgatcaaaagtaaaaatgtaaaaattctcatatttttttcagtttagaaagtgcaattatagcagatagatgcacaaagtaaaccaaattcaagacctagagagctaaaaggtgttctttttctctacaagctatctacttcactgtgaaaataaagtgctaccttttgtaaaacacagtttttcaagcaagtagacaaatgttgcattggaaagtaaggctctatctgtgtccatatcaagtctattcttctggctcagaaagtaaaaacaaacaaaaagctatggtattttggaaggtggagtgtggtaaggtggcaaagggataagttggtgaaaggtttaggtgtacaaagtatgaaccagtttctctcaggcttatgttctttttgcctcaggaagctcattttgacatatcccctcacagactattacccatttccttctgagtgtgaagcagaaagccttccctttattaacttgcttccctgtaggctgttcctaactgaaatattgacatttatgtgttttacatgctctgatcacaataaatgctaatgttttatcaatatttaataattatgatagcagaactcatataatgtactcagatgccttcctcctgtatcatttctgtatctgataatgacataatgacattttcaccaaataagtatataaaaattagtcttaatgcttgtacttatcccactgtatgtaaaagttaacgtaacataatggattaagtgtttttcaattagaaaataatttttaaaacttatccttttttaaatgagcgtagcagtatcctaaacagtattatagaagtctaaaaaaaaagttaagacatcaaaaccctaacagtggtggaaagtcacttgaacagtgacaagaagagtccaatgagtcataaataagctaaattaattcagaagctgcagggtgctgcagagatgtggttggtaccttttgacctgtgaccaaaaaaaattcatttttttcttctatggtttatggagatagccttgtgggattcttatcaattgaagttacaatattcagtacttgaatataaacatggtggattagagtctgttagaaacagtgacttagataagcgtgttaatattttaggtcactagacaaccacctaattgaatagtataaaacaatttgtgtctttgtccagggagtaagaaaccatggaaattattcacatatgtcacaactccaagattatttttattcctgtgtttgtttcagtttatcatgtttttacacattttgaaagaagagatgcatataattattttcaacttttttgtcacttattttagcattattttatttacattcaaataaaataatctttaaatttatgctttcttatacatatatgtttatgtttttctgacattgttagtttatgatgctaaatttaagcattgcattgttaaaggcaggtaaatatgacagagtgcttttaatgtaataagtggggataataaatgtttcgtaatacctatattggcagtggagcagatagcttatgtagaaatagaacgccattcttaaataggtcagaattagctctttaggccttgaatttggtttactttgtgcatctatgtgctataaattcacattacaaactgaagaaagtatgggaatttttacatttttacttttgatcacgaaatttgttagtttattctgttagtgtagagagaaaaaagactactttgagttataaacccacattttttacctattattattaattcacactgattcactatttgatttgtgcttaaaacatttttagatttttttacatgtagtatctaatttaattcacaacaatgacaagaggtattttctattgttattctcatttaaaaataagagatctgagataggagattaactttacaaaggtcactaagatgtcaaggaaatgaggtgtagattattataaatgctctaactttttccagatttgctccccaaagaaggttggaagtactacattaatgacattgtaccagctgactttctagatttgtagtaataaagtgggaatgaagtggggttgggaggagtgtattcactaaaaataccttctttgttggctttggcatactgaaaagagaaacatttcttttgagataaattttctagccatttctgctagatacctccttttggcaagtgttgaatttggatgcactctgtttcagtttttatagctgggtgtttgctgctgtcttgggtcatgtttgtcaggggttgacaagcactttaggatgttgtgcagcttcaggcaacagcaggctccctggaaatcatgactgcttcttttaacctcatagttctcaaaattccgtggcttatgagaacctacatgaaagcctgccatgtcacacatttaataagggttttttttcaaatcattaaggaaaataatagctacaatttcctacattcttaaggtttttttttttttcttcaaattttggcttctactgttacttgtctatcgcagaattgattttagatgttacatttatattttagaacaaaatttatttttagttatttaagatatgaagataatcgcaaacattttaaagtttaaggaatagtaattttttctttaactgctgttggacaaaaaagaatctgtacttgtgttgctgggcttttgagatcttttttgatagtcaggataatatataggtatgctgaagtagcacagatagtagattgagttacataagaaaggacacacagctaactgaatatttttaaaggtggattaaaaagaatagatccataaaaagaatctaaagtagcagatccagaaataaagcgaagaggaaaattagagttgtctagacttcctacagaaagggagagaaaagagaaattgtgaagcagctactgtgttgaatgagactttgtctaaagagtgtgttttggatattttggtcattgttatatagaaatctgtatatagtgagcacccacccatacccatagactactctccccaaatacactttgctaccttttgacaaaacttgaatgtttttgaattttttttgaatcttttagacttggattggtgttctgtggatatgatagcatacagaaatgggccagaaggcaggataatgaggaacaaaggagtattgatggtggtttttaccaaatcaaaaagacatatagatatttcatgatttgaacttgttgaaaatcactgatgacatttctatctttttctggattctaatcctaaactcttaaggctgaacctgtgatctacttggcattgtttttgaagacctagaattttaaccttagtgtaatgcttatgcttcattagttgatagaagcttctctgataccagttgtgccaaatattaagtttcactatacacaatagctggtgttatgcctgtcattggaagtaaatgaaggactgtgtgctttaaatattactaaaactgttctaaatcctctaaagaataggaaaacaattgattcatgttcttcaaaaggattttaatgtaactgctgatttggtgatgagcatacccaaaatgtttagtttggggaatgtggtgtcaattggaattcttgaaactacactagtattatcctattactgagtcattcctttgagggtggcttagaattaaaccatcttggaaaggagaagacattatatcctctttcatttatttgttcaacaaacattaaattgttactcttattgggcagtgtgttagttttcatagatacaacaataaataagaactctctttgacttcatggattatattatctattggaaaagacagatgtgtaaatagattataattacatgtttctgtgataatggtatacacatgtcatacatactaagaaggaagcataggacaataatctgagagttgttttaacctaaaaagactaattgtcacagggaggaaatctgcatggtgagaattgatggggttgaaaattttgcagtgaagtatgaggcaagctgtgtttaaaaagcagaaatgtaatatggaaggtgagatgataaaccaggaatgagtgaaaccagaggatcattacttcagtaataaaatctctagggaaaactaggttaaagctggggatgttgtcttctggaatttaagaatagaagttaatgtatgagttcacatgtataactcatattccaactatagacggtccctaacttaagatggtttcacttaacaatatttcgactttatgatggtgcgaaagtgatacgaactgagtagaaaccatactttgaacacccacacaaccattgttttccactttcagtacagtatttaataaattgcatgagctattcaaacgttactataaaagaggctttgtgttaggtaattttgtctaactgtaggctaatgagcatgtttaggtgtgcttggctaagctctatggatgttaggttaaaggttgtatatatcaaatgcatttccaacttagatattttcaacttaatggtgagtttatcagggcacaacccaatcataaggagcatactttagtgttgtgtaatagcaacactaaaatagtgacatagagtaaaaaagtaggtacatggtcttagataagacagtataccatatacttgacataattttttttggaaatagcaccctcaaggaggtattttgtttatattattaaaagcttatagcatttaaaaattaattaaggggagaataattatcagatttttactctttagctaatgtcattcgtataataaaatgcctatataagtttaaggagtataattcaattaagccttctttctgtggttttgaaaataatttttacaatgataatcagctgcagcaaaaacagatctaaggcaaaaataccaaattgtattagaatagtcaaatttcagatatttttattgcaaatgttaaaagagtttcaaatatcagctttaaaaacttatgtaaaagctcattgtatactaatgtgatttaaataatatataattaacctacataggttgtgtaattaatttaccagtatttaaataatttaggatgataatattctagaactgaggctgtgtctttttttagtttcttttaaaatatcatatttttaattcttgagataattgcttgttggaagtatcaatttagtgaaattctttaatcaagcgtaagtttatgttatatcatcttcttatgtgtattgtttattataattgattgtaacataagtgacttcaccttgcattagccagataaaataaaattcagcaatgtaattttggatttccacatttctatgttaaagtacttaaaaactcaaactcaagaagttacaaaggtgttaaatattaaagtatcaagaaattagcaatttaaaaatatctgtgtctcattttaagcatatagttacatcctaaatatatttttcatttacaactgttagaaatgagttaattttaaggatactactaccagggtaaaaatatagattgaatttaagaaatttataagaatattgtcaataaagttgtacattttcattctatccatggctaaagaaagattatccacacactcatacgtagtcattaatacagaaagatgggaaagatggtttgggacaattttatttgttttattattattttttattatactttaagttttagggtacatgtgcacaatgtgcaggtttgttacatatgtatacatgtgccatgttggtgcgccgcacccagtaactcgtcatttaacattaggtatatctcctaatgctatccctcccccgtccccccaccccacaacaggccccggtgtgtgatgttccccttcctgtgtccatgtgttctcattgttcagttcccacctatgagtgagaacatgcagtgtttggttttttgtccttgtgatagtttgctgagaatgatggtttccagcttcatccatgtccctacaaaggacatgaactcatccttttttatggctgcatagtattccatggtgtatatgtgccacattttcttaatccagtctatcattgttggacatttgggttggttccaagtctttgctattgtgaatggtgccacgataaacatacgtgtgcatgtgtctttatagcagcatgatttataatcctttgggtatctacccagtaatgggatggctgggtcaaatggtatttctagttctagatccctgaggaatcaccacactgacttccacaatggttgaactagtttacagttccaccaaaagtgtaaaagtgttcctatttctccatatcctttccagcacctgttgtttcctgactttttaatgatcgccattctaactggtgtgagatgatatctcattgtggttttgatttgcatttctctgatggccagtgatgatgagcattatttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtagattgaaaaaattttctcccattctgtaggttgcctgttcactctgatggtagtttcttttgcagtgcagaagctctttagtttaattagatcccatttgtccattttagcttttgttaccattgcttttggtgttttagacatgaagtccttgcccatgcctatgtcctgaatggtactgcctaggttttcttctagggtttttatggttttaggtctaacattgaagtctttaatccaccttgacttaatttttgtataaggtgtaaggaaggcatccagtttcagctttctacatatggctagccagttttcccagcaccatttattaaatagggaatcctttccccatttcttgtttttgtcaggtttgtcaaagatcagatggttgtaggtatgtggcattatttctgagggctccattctgttgcattgatctatatctctgttttggtaccagtaccatgctattttggttactgtagccttgtagtatagtttgaagtcaggtagcgtgatgcctccagctttattcttttggcttaggattgacgtggtgatgcgggctcttttttggttccatatgaactttaaagtagtttttttgaattctgtgaagaaagtcattggtagcttgatggggatggcactgaatctgtaaattaccttgggcagtatggccatgttcacgatattgattcttcctacccatgagcatggaatgttcttccatttgtttgtgtcctcttttatttcattgagcagtggtttgtagttctccttgaagaggtccttcacatcccttgtaagttggactcctaggtattttattctctttgaagcaattgtgaatgggagttcactcatgatttggctctctgtttgtctgttattggtgtataggaatgcttatgatttttgcacattgattttatatcctgagactttgctgaagttgcctatcagcttaaggagattttgggctgagacgatggggttttctaggtatacaatcatgtcatctgcaaacagggacaatttgacttcctcttttcctaactgaataccctttatttccttctcctgcctaattgccctggccagaacttccaacactatgttgaataggagtggtgagagagggcatccctgtcttggaccatttgaaatgagatatgagaaaaccaatttactctcagaaagaaatagaatatcatttgaaaacttgtgaaactgctataaaccatcatgttactgaaatgcattcattttaaaggtctctctgtaccacaaaaacggttttattgtggagcatatgaacagcttcttccattctcactacatgcttaatgtttcttgttcctcattagttagcctttgtctacattctttaattgtggatttctatgggtgttaatcactgggttacacatgtacttatctagtgtccctctcacgttttattcttagttctaggcataaaccttttcatgccattttccaggcttaggcttctatgataatacacgtatcctggacctccttccctttcttcttttccccatcctcccttttctatctgtccttaggtgttcttatgtcacctagatagataattcctctagcctccactctggttcagatcttctgatttccttattcatttattggtttctctaaaagtttccaaatgttcttaaagtcccagcatcttgactcctatgcaatcatctacccattatatacacactactgaaatatatctattaccaggcaaaggtggccagaacgtctcttgaaggcagatagtatatctacaaataatttgcctcatgctattgtttctatcttagaaattagatttctatagaaatggtacttgggcatccaaacagattcaacaccttcttttatatcacagataatatgtatattgtttttactgtttttgttaaaggaaccttgaaatatcttttaattctcgaacactttacctacctaacagctaacctttttttttttttactgtattttaccctttgcctagcaataaactcaacaatttaaaaatatttctgatttattctaattatatttttcaccagttaaccatcgccccctagccactctccactacccttcccagtctctggtaaccattctgctactctctatcttcatgagttcatttttttttagcacccacaaatagatgagaacatatgcaatttatctttctgtgcctggcttatttcatttaacataatgacctctagttccgtccatgtttttgcaaatgacaggatctcattcttttttatggctgaatagtattccattgtatatatgtactatattttctttattcatcttttgatggacatttagtttgcttacaaatcttgtctattgtgaatagtactgcaataaacatgggagtgcagatatctctttgacatactgatttcctttcttctgagtatgtagctagcagtgggattgctggatcatatggtagctcaatttctagtatttgatagcacaacagtgtgattatagtcaataataatttattatacatttaaaaacaactgaaagaatataattagattgtaactcaaagacaggataaatgcttgaggtgatggataccgaattgcctctattgtgacttttatgcatttatgcctgtttcaaaagatctcatgtaccccataaatatatacacttaatatgtatccccaaaaattaaaaattaaaaaaaagtcttgtgggcagaaatgtaaaaaaaaaataaaatacaggaatatattttaaaaatttatttgcatcaatttaaaggacacaagtgtaaaaaatttatactaagagaattttcagtgtcctttgagggtttgtcaaactaaaatcttaaaaatgttattaagacgttcctacttaaatctaacctaaatatttattgtgccaaactgcccacatgaaaacagaataaatatttgtgatgtaaagtaaccatttactactattaaatcttgtctcagctttgtttttgcctattatatatcatttacttaaaaaccttttaatcacaccctgattaatttggattggtttttgtaatctgacagtgtaacttccaaataataaagatgttttaagttaaaaacactttagaagtttttcttcacttagaaacacattccactgtgtaagtcccttgaagtcagttataattattacagtctgtggggattagtatattgtaaggagattactgggcttctttacttagcagcacaatgagcaacggtgtaccctgagcacacagagcggtaaacattggaattgtacagttaaaagagttctgcataaacatgctatgttccagcacccacttaaaaagaaatcagcctgaaaccaataaatttctgttgagtactactctgtatatattatttgctataagggctagaaagtaaagaaatataagacatgatttccaggctcaagaatactgcagttgtttacgaggaagggctgtgttcctgttgtaaacatttcatacaataatcttattcatatcactatttttataacacagggaaagaaattgagaatcagagaagtcagataattgcccaggttctgtaggtgggaagtgtaagagttggaattcaaatttttctctctgggtgaaaaggccatgctctttgctcatgtcaaatccgctggatggaaaagatgatcacacatgcagtaacactgaacacttacgtgatgatgacttccattgtgagtattgtctatagttactctagaaaaactcagagattgttaaagtaacctataaatgcttcatagaggagttaagaattgagttgtattttgaatcagaataggataaagatatacccagagaaagttgaaataaaagagcaggagttagtgcaaaggcatgcaaatagaaatagtatgtatatttcaaatgtggaagaaaataaattttgtcagtttaccgtagaaagattcttttagtaatagcttggaaataagactagataaggcataattgtatgagctacactgattgatcatgtactagttattgatattggtaagtaatttaaatatactaattcatttaatctgaataacaaccatatcagaagtatagtataattaatttcattttattatgcagaaatggattgtgcagagagagtaaacagcttttcccaagattttacaactagtaagtggaaaattgaattcaaattcaggtattctagctctagatcctgtactcttaaccactatactatccattcctctgggaaaatgagacaatattgcatgcaaccttgaaagtcatgcgtactagctacgtttgaaatagtaaaatgaaatagtgacctaggattgaaacaatatgtgtgcctggtggtatggctggagttaggtagtggttggtgtgcagtaggactggagagtaggattgtaaaatctgcaataatttgtgattgattttaaatattaaggtgaggtaaatgttaaaaattttatggagttttagattctggtgattgggatagtgctagtatcaattacagatagataagaccctatttggcagggaaagtggcgatttcagttttttcatgctgaacttgagccaactgtgatacatcaagatgttgatacccagaagatgtatcttagaatacaggacagacaatctgctgaggatcacagaaattaagatatcaatttaaaagtaatacagtgtagtaaatttaataattatttgagtgtaaaatattgctgaagaagtgctaccaaaagtgagtttcatgggccattgtggtccacgaattgtttctggttagaattaagagtaattcatgtttgttatatgaaagtattgatctgcaattgtgttttttttcaaaaaaaaaatgattcttcaggataaatatttcaagaagcattgttctaaatggttacattcctttgctgtaatgaccagacagtatcaaggtctcccaaacaaattgaggcattttccagcatttcaggattaagctcaattgaattgactttattcacttttgtctccttcagcaccacctcccagataagtaggagcctgggtcagtgatcttgtcctagagtctcagacaagtactaggacagagcattactttcctgtaatatgtgattaaggtgagcaatccaagaggcggaatcctgtaatgaaatcaaagtcagttcagacaaaccatctatctcactatcatcaatccagaaatgctaggcacaagtttaagggttaaaagtgaagaataagaaaacaatcattttctcctggcttgagaaaacatttaaggtcatcttcataggtcacttaagagtggctggctgtgatcagttatggattatttaggagcattgattggacttgtataattatagcctggcagacatcacatctgattaactcagccttaccatggagatgacttagtttatattttttaaattgtacctgtaccatttcagtacttcctgagaattctcagcctattttgtaggatttattttcttcttatccaagtcagaaacaatctacctacatgattaaactatgtcccttggtcagtgaaactgataggtttgttaaatacataaaatcactttaattttgagtaagaaggcaagaagaggtgggtacagagaatgtcttctaataaggaattattattagaaggattatgatctgagatgcctaaaaagtcaaaaactctgaagtataaggaatataaatataacaagaaaaatctgtatataccaggagtttacaactagtttaaagtgtaaagcatacaaaaagtttataattaaaaatataagcaaatgccatttatttgatggagtaacagggatcagatctgaccttccactgtaaacagcaaaacatgaacaaaatatataaagctctaatttttaaggcactggaacactggaatcagccaacaaagaacaatggatcgtaaaaattggagaataaatgaagtaagccttatgattttctcaggttagtgccttgagagtttctatgtctcaatgcacagatggaaactcaggtgaaccctggtggattctctgtaatgaggagacagagctgagagtttggcaagactacagcagcaagaaattgcaatacagagtaccgaggaaggaagagctgcactcgaagaatgctgacatgtgcagaggatcccctttaggtattctgctgaatactaagtagcacatgtatgtgaggaaactacctgaggcctgaaaaagaaatttctaaaatgagtagaggtgacaagtgactcacacagggctagaaatagtacctattcccacaagtggcaaacctattagagaagttacaattaaaaagattgattgtatcaagtgtcgagaatgtggagcaactggaatcctcatacactgctggtgggaatgtaaaatggtgcaagcactttggaatgcaacttttcaggttcttaaaaagccagacatgtaccttctacctatgacctagctattccaaacacaggtatttacccaagataagtgaaagcatgtatttatccaaagactcagacatttgtattcatagcagttttatttgtaagagccagaaactggtaacaaaccgagtgcccatcaacaggtggatgggtaaataaactgtggtatgtccacaatggaataatactaaatgatataaggaaatgagccactgatacaggctacaacatgggtgaatgtcaaactagttatgctgagtgaaaggggctagatgaaattacttcataatgtattcaatttttatacaattctagaaaatgcaactaatttatgatgatagaaagccaatcagtggttccatgaagaaggggtaagatgtatgctggccggaaaagatgggaaggagaaattaaataaagaattgagaaacctttagagttgataggtatgttcattttcttgattgtggtgatggtttcacaggtgcctatacagattggctatccctaatccaataatccagaataagaaatactccaaaatccaaaactttttgagcgccgatctgacacacaataaaagtttattggcacattttgaattttggatttttggattataccaggaagtagaatgcaaatattaaaaaatctgaaatattccaaaatccaaaataccttttatcccaaatattttggataatgcattctcaacctgtatatgtaaaatcttatcagttaccatttacaatttttaaaagtacagcttattgtaggtcagttatctgtcaagaatttaaaaatgaatatgagtgaatgatacttgcgaagtgaaggatagatatagtaagtgcagtagctactcaaaagagtgtgagagagaaatagagaattaggaatcatgttcagttaagaaaatgtatataaacaaaatgggagatatattagagcttaacagtaaacatttagacaggttgatgtaagatgaatggaggtgggtatggtatcaatagagtcatcaaggggaaaaattgtaggattttcataaaatgaaaaagctgtgatcttaaatagagtgatctcaagttttggaaaggggtggacaagagggcatgatagttgggaacttttaaatgacaggttaagacgtcttggcagtatctgtggagtaaggatgcttaatggtcagaatagatgagtgacaagctctgtgtgaaggagcttgatgccagaagagcagagagcaccaaacagtcttcagaagcactcaggtcaagtgaattcaggaaaaagagttataaacgttgaaaacaattagtcatcatagtatcagacaggctaatttgtagaagagctttagacacaggatacagtttttgcaacttccgcagagaaggcctggagaagaggaggaatgaaaggacagaccatggcttgtcaatgagatgttgttttctgaaataaacatagtgaataggtctctactggaaacagtattgaacatacccacttattaagaggccttctaacaaagtgcacagagaaaagaatcccctgttgaggttgctgatttcctatgagggatatttttggagagcaaatttggtctgatactgatactttttttttcccataagagttgtcttacttttggaccacctgtcgatatccagaaactctgaagattcccagaaccattccaagtattattgatagtgtgataggtccaaaattttgacattttaaaacttcagaacgaggagcattttggagaccttaaattcaggagggaccttctaggaggcctgcatttttccttttgtgttttagaggaaaccaggaaattctgaagagtataataaatcaatatgtagtttagacatctgtgttattctctgggtacagattagttaggctgttgcaagtcatattcccctatttcacattagaacaacctgctgttggtacatgagttagcattacactatgagcaaaacatgagcagaggaattgcaaagttgtattggtccttgaagcaatgaatcagagctaaagtgacagactttaccagcagcatattaaaaaatgccctcttgtaaaatttaccatgattattttcagacaaactgtgcatccaggacacatggatgatgacaagatcatgaacattatctctgaatatgaaaggcatgatgtgcgcaactatcaaagtgcagttcattttagaataagtggtattttcatgtagttgcagggcaagacaggaaaaaatagtttataaagggaatgaagttgtggatctctgacagctgatcttttcaatctatgtgaaaataccagttgtagcagcaatggcaacaaaaactactgatttctctttttatttgaaagattccttagacactttaagcggttttaccataggataaatggactatgctttctgcttcatcttcaggtctccaattaggggtgggttgcccctgtttgaggagtcagtatgtggggaatactattgatggcgtacacttagagactgaccttctgaataccttgtaggtcttatcaaagtagtcactgaaattcatccattttataatttttcttatgtttctttttgcatgaacctcctcaagtcatcacccactgccccagaaaaaatcactctgatgttggaggctaaattcatcattgcatttgtaagcctagaatcaagggagttattactgcttttcttcacaagactagctctttcatatgcgttttccgtgtatacaaaatgcctaaaccatttaagcagtatctcatagcaagtgacaaaatatgttctgtttgaagcacgatgcacagctctggttgttttgggcctgctttatttacatgttcagagtaagcctggcaaatacaggttgaatgtccctaatctgaaatccaaagtgctccaaaatccaaaattttgagtgcccacatgatactcagagaagtatttcagattttggattttcagatgctcaaccagaaagtatattggaaatattcaaaaatccgaaatccaaaacatttctggtctcaagcattttggataagggatacacaacctaggcattgcattgattgcctaaatggaaatctggagctattaaaatttttggaatgcattagtttactttgaaagtaaaaattgttgtagtgtgctcaagcctaaactgcagcaaattaatataatcaaatgaatttagagcataaacaaagtattcctaggatttttcagagttggaatttcatggttgcttttggctttaaaatgaagcttattgaaattatagtaaaaatacagtaacagggaaaaatttaacagttttggtaaatggaaacaatttgtctctgatataatttttttttctatttctgttactctctcccatttttagggcagtattttaaccacatacttttatattggcttttttttgaaagatcaaatatttgatgttaatttttgtttgaagttgtgaaggctttgctggaaaactcgaagttccaaatgtgacatttattatattattatgtgcccttactagggaaaattgaatataaataagtgttaatgagcgtgctggttgtcttataaggaataattcattagaattcggtatatgagaaaagcaggtggggagatgataaaccataccacatgaatatgctggacttttgaaatgacaacaatagtaagggaacaatagtacattcttgaaagataattgtaattctttcaaggctcatgaactgatcattttgctcctaaggcgagaagtttgtggtgattaaattatggacatataaagcatgttcatatttttcaataaaattctatatgatatgctccgcaaatgtggaattgttttggtggatgaataaatattaatctttggaagtggctaaataaacattgaatgtccaaggtgatttttttcaccatttatcctaaaggagaaacttacgcatacatatatgcacaaaaacacacaccatacatcctcagggagattgttttttggtttctggagatcatcagacttctggtgatgctggtgtaggaagtgattctagttagttttatatagctgttgctttatattgtaaataaaatagtactctgggacactggaggaacaattagatcaagtaaaatcagttttctttggtcgaagaaaataattgagtgaaagctcttgatattgtgtgtttaagaaggaaaatgtaaagttaaagaagaagaaaatggatatagcccagagataacctaaggataggatatggaatacataggtaatatggcaggaatggagagttatctaactgcatgtcctcatgtctccaacatgtgcaagatattttccgaagtataatttttttttaatttattttttagagacagggtctcactctctgtagcctaggctggagtgcagtggtataatcctagctcacctcaaactcctgggatcctcctgcctcagtctctagagtagctataggattatagttgtgcaccaccatgcccagctaatttgaaaataaattttgtacagagagggtcttgctgttttgcccaggctggtctcaaacttctggcctcaagagatcctctcaatttggcctcccaaagccttgggattacaggcgtgagccatcactaaaaatattttaacagtttcctcgagtggttctagttgtggatgtccagtaacttaacttgtttttacacaatctgatgcttttattagaaagtatttcctgaatgcttaacataatttccctttactcaattaaactgtaccatttctagctggtgtaattacaaacatacttaagaacctttcatggttttgtttctatgcggatttggaactttcatggttttgtgcctatggcctctttaaaaaatataggacatatctaaaatgaataagcaataagtaaggaaagttgaagcactcctaatgtatgataggacagaaaagacaaagattaaaaaatagactaaattttcttatggctataaacctttttcctataaacgtatttgattttgtaaaacagggaagttgttggagtttgatgtatgtattgcttatgtagttatatatatatatatatatataaattatattttgcttttgttatgtttagtggagaaacgataactaaagataatttttaggcattttttaagacttctaactgcagacagttttttagagttggaacaaactttctgaagtatcataaagcaactcttgaaattaagagtaaagagataattgatggccagatgcggtgcctcacgcccataatcccagcactttgggatgccaaggtgcgtggagtgctagaggtcaggagttcgagaccagactggccaacatggtgaaaccgcgtctctactaaaaatacaaaaattagccaggcctggtggcaggcacccatggtcccagctactcgggaggctgaggcaggagaatcgcttgaacctgggaagcagaggttgtagtgagctaagattttaccactgcactccagcctgggtgacagagcaagactctgtctcaaaaaaaaaaaatttgtttatctcctgtctaaaactcttccctctgtgacttcattattatggatgagccaccttcttaaaaatcctattttgaatcacagaattagcatattctctcagtcatctaccctctcaccatcttatgaataagtatcactcctgttaaggcttgaaaaactgagacagggaatacctgtatatagatattcagtaaatatttcatggcttcgacaacaaataacacttcaaaatgaacatcataatgtaaaaggcatgttgttgctaagactataggttgagtactagactatacgagtttgaataattgctctactgtttactagctagatatgcttatgcaagttatttagactctttctgtctcaatttctttatatatatatataatgagcataacagtaatctttacttcatgtgttgttgtgaaggtcaaatgagctgatacattcaaaacatttagaaaacttcctggtgcaatagaaaaactacctgtttgggtactgtgcccattacttgggttacaaaatgatctgtacaccaaaccagtggcacacacaatttacccatggagcaaacctgtgcatgtaccccctgcaactaaaatagaaattggaagaaaaaaaaggaatttccttgtacaaagtaagcatttgataataatcagctagtggtcatagtaattttaattcatataaaatgtcagttttgttgtcaagggaaaaattttcacaatatgatatacaaaagttaatgcaaaagtaatgaacttttggtacatgctacaacatggatggacttgacatgcgaatggaagtaagccagacaaaaaggcatcagtatttctcatctccctttttgcttttacttcccatttgcaacccatctcaagagaggacaatggaaggaaaggggtaaaaataatatttaagaaagaaacaggagaaaaagtaaaagaaaaagcaaaatagtgagacagaggaacagttgcaggggtcgttaatatgcattttccatggttccaagaggctcctcaattttattttccctgattgaaacttcaaagaacaactttttgattaaaaaattaaatttcccagtaattgccagcctgaacaagatgtgaattggcagacccagtggtagcttctagatttactgacaaaagaaatattctgggctggtagagcagacactcagctggtgagtcagctgactgaggtgcctttatctgtctttctctactttgcccagtcctctgagagtgtgagacagccacagcccataaaagaagtcatttggtaaacatctaagggttggatttagaaaaaatggaggatggtttgggtcataggatttgggatacagtaagaggtcataaaggcaataactggttagttgtacgtagaggctgtgggcacagttaatttgtgtggaggaaaagaagaatgatttgatgctcagatgtttttgagaaaaaggtttttatattaatgttggaaaaaaccctaaagataactttaattatgtactacaaataaattgtttttaactttatattttttcttaaatttagggtgaaattgaattgcttttgtctaattattatgaaatatgacttcttatactttggaaaataagagttatggttttgaaacactagaatacagttgtttttgatttgactcattttatttgacctaaaaaatagaaattaggttatgtatgattatgatgaatggaattttctaggaagcaaaattggttcaatcagagcaattattgtttttcattgttgttagcccagaagcagtaggaccagtctttgtgttattctttaccgatgtctctctagatattatagtcaatttgctttattcagtggtgaaggaagcattacaggatatgttgttatattatcagagagttacatgtggataatggtaacagccacagtgtctgaggctaatttttcaggaaaagaattgactaattattaaagcttttcttatttaggcaattgcagataattttgtatcattgaataatttttagtaaaagtagttcccctctattttggaaaggaaaatttaaggaaacaatagaagctcagaggaaagattgacttttgaaaaagtaaatattacacctaacactttgatgaaatgtacacctaactaatacctttatccagaaggaaaattgcatttgtctctgacacttgaatggaagaacagtttaaaaaatggtttaataaagggtattacctttatttttttactgatatttgctttaataaaattatatttaattaaattatattagattttaaattgtttttgaaatgaaggacatccatttgtaattacacacaaaaatattttttattttctcttttatctcagttttatctcctcaattttctcaattggtataatggtataaggagaaacataaattatgatttttctgtaattattctgaaatagaaaacttctgaaaaattggtagaccttgaggaaatatttaaatgatgccatctaaagatgatgctgagtaaaatattcattattctttataaacaaaattacagagtagatgaaatttgtcttaattcccttgttagctttcctcccattcatataattcctatcaccctatgacctccaaacacacacacacacaaccctgtatccggttttaaccatcttgcaggggtaataactaattccttactaccagtgaaacctgataaaggtttaggtacaaagtctataatggtttatttgcattttataaaaggagaagggtggggaggttggcagatgagattggaatcataacaacttagtgaagttacctctgggtggagtccttttgatattgcttactttccctacgaagggctatcagtgctgctctcccacagtgcacacacacatgcatgcacacacacactcgtgcaagaatgcatgtgatagtggaacaaataatgaacaatgaactatgttataataactctgaaaaggtactcactcagctatagtctgacttgagctttttctctgactagattttttacctcaaaggcagttgtacagacaacactagtaatcattgtaaattaaattctttctattgtcacaatctggcagtgttaaggacaatttcagttcactgcagaaaatatatttgaaggatattttcccaaatatttgagtgaacttcctttttagagtaattatttgttaatttgagaagtttcatttagattttatctatacaataagttgtcagctaaaggtggacaaataaataaataataccataaaattttagatgtatgttgcttgtgcccccctctacaaagagaaaacagtattatgagaaatatcataaagcatatcaaaatggaaatatctccccagtgactgctgtgtgcttgaagtatctagcactagtctagaaatagcacctaggggaggagattctgttaaattgtgaatatatgtcttgaaacctgtaagacattttgccatggctcgaaagtgacaagtttgtgcctagtttattattacattagttgattgtcatgttacagagtagacaacacaatactgaggtaaaaagaaatagacaagaaggctctcatttgaagcaaaacacagtactggccaatcccatagcatcttgatctgtcagcagcccctgttgggagttggcagaaagatttgcaccaaagagtaagtttctaagtgacaccaaaatgttcggtggggatggctgaagatctgactgacttcttaaaatttttctttagagagttgtacctaggtgtccattaaaaaatattgctggagcatggagggtagggaagctgatagtagaacctcagacaaatgatattttgaagagacagtgcaacagactgaacatgtagcagtattttattgaaaggttttattaatcgaataaaaatgagagcatgctacattttaaacatacaactcaaattaactgctagaaaagtgaaaacttggtgcaattgttctgaacttaaccaggtaaagtgtttgctcagcctgcagatggtgtgaaacacttggcatagtttctggactcctggggtgagaagtgtgaactctgaaacaaggaatggcaatgtggtgatgatcttagtggagacaatgtgagggcagagaggggagaacaggaaatgcaactttccatacctaaaggaatagtgtgctttacctgccagcctgaaatgacagtgactgctgcagttctagattttctacatagttggatacaaaagaaaggaacaattcctgcctctgtgccaaaacttccatattccttagggttttgacaagaatttggattaccttgacctagggaataggagtgaggataatcaccatccgtctctagcccatgtgaggacagtattcccatcagtgtcactcgctgttgtatctgagagtcagcagtattgagtgaaggaacgacctgaagagagcatgagaaggtacattcacaccttcacaatatgtgcggattagggatctacaatctttggtgaggagaaactgctttttatttccctggacctttatttcaacctgcattcattcaacagatgccttctgaggacctcctacatattattgactgatttgtttctctggcagcctactattatagagataaaagttgtcatcactcatgggaggtaaaagaatgaacatggcctcctccctagttgagtacttgaaaggcagacatgagaaacatgattaaatgaataatttttaaatgttgattttcaatattgatctttgaaaaagaagtcaaatgtacaatatggatacgtgatgaacagaggagtaagtctgccttgtgattagggaaagcatctcatttgagacctaaagaaggtaccagtgctgataataaagtaataaggaggaagtgctgacataaaacatatgccactgttatctgtatgcccttccattctgaaagacaagagggatggagatgaataatgtccccagtcctcaagcaaaatattagtcttgtttaatggattatacttgaatacagtatataaatctctctactgaaaatgtctacaatgaaatgattttgacaattgaatatgtaattaaatttaaaatatttatctgtgctttctacaacaatttcaaggaagtgaggcattattatcaatggaagatattttgttttcacaaaggattactacatccctcattagagaccaatctaacacagataacatggtacttttttgatggcaggtgttcagtgcgttcactgaattgaattgcaattcatattgtgccacattaggttcctcacaattaagcattttcatgttgagttacaaaattgcctactttcagggaataatgtattcaacagctctcaactatcttgcattgtctaggagtggaacagaacaataaatcttggatcttgatcaccaagaaataatctggttaggatgctgtctttgggcagttctactttagatatgaggcagccaaagagttaagagacttgctctaggtcccaggcacattacatatttttatgtgtcccttctctcataaaataaaagtgcttactgccaccctcaagagatatgtgtcaggttcttatactcctgtgggataaggttaaatcatttcaataggtcttgcaggaaatcagtggcacagctgtttataaaacctaagatgtttaaccctgggtgactttttgaaccctgctcttagtatcaaaagcaaatactgtgattcattttcatctacatcagtgtctgtctgaagccttaaagagagaaaaggtgtcactgatcataacatatgaattagaaaccataaatgagtaaactgcttctcagtacagagaacaaagtacttatcatttaccaatatgatgatattgtataacgaaatgtatacttacaactatcattaggaaatccccattttaaatattccttgaggccttaatagaaatgtgatttcttaacaggtacctcctttagcctatgaatctctaatttgtctttaggttagaatataggtaaaaactgtaaagtgtacctttttccttttctatttttttgtttgttttttgctcctctctttctctgtgctttgtgtccataaactgtcactttgctgcctgtgatttcctggtttttcccccccatggtgtagtgtaaccaaggcctcttttgtgttgcaccctaataaagtgtacaagttgagcatctaccctttcttggtatctttttctgcatcgtttttccctttcatctttgctgtgataatctgataaattaatattctttacagttttaatgactgctaatagattaatgcatcttaatgactgttaatggcttaatgtgctgcacctcctgggtaaaatgtttgcattttaaaagggctttttagaatcctaaccttatttaaagacatgactctgtgagtatccaaaacctgttgacaaatcacttaggagaaataccatgttagatttttttttcacattttaacatctctgagaacaagaatgcattcttaaaattggtgtgattaaaaaacactgcatcatagattggaggcattttttatttcattcttagtgatgcataaaataatcatatgtcttaaaatcaatgacattgtagatttgataaaatacagtagctattttttttttttttttttggccaccgttgaaatcataccttgtggtagatggtaattacctcccttatcggatttcactcacacacacacacaaactcaattctgtatccactaaacactcataaacatatcctggcaccatcgaaccatgacattctctaattggctgctgtggaagctacaattaaaattttagggtttttttgagccacagcgaagaatgctttctaaacttggcttaagacatttgtaagaaatctgcactggaaatgacattctatttataacatctatttgctattttaaaaaatgtcatttataatactttggttcctcttattctgtctcactttgctttgagggagagaatgataaatatgagtaaacaccacagatgaatatagtgtcttgaaggactggtgatatttttaaagatgaaaaggctttgtatctgtaattactgatcatgtgatacacaatttcaaataaaagagttaatttcgtcctttctttttggaagacattagaaacagttgcagaagaaaaagcaagctcatcaacaacaaaaaaacagtcagaaaattggctaaaattcagctctttgtgctcttgagactgaaaaccatggctgaaagaaagcttttcaatttcctaccacgtatattcattgcctccttttagattggtttacttttttgaagcagttaagtagtagtatttcttggcaaaagaaacgtgtttaaacaattctttaaattctgttacttattcttcccactttccactcttctccattgctcatcccataccaccaacttcacattcctgcttgggttatgaggtatgggcactaatgtatattcctctagggtatcttttaattttatttttatttaagttcaacattgagatagtggagttaaaggattttttaaaaaaatatatagtagcagtcatatcttcactgttttattatcagtatatatttttcagtattctttgtgaataagactttaatgtagcttctatcattgtagtcttatattaagaagtcttccaagagtttaaaagtagggttgaattttgcagagccactacttagaagattaccaaataaatgctgaaatgtgaaaatatcaaaaccaattattttctggacttcttagtatgtataccaattacatactaagtcttacatactaagttttacatactaaatttacatactaagttttagtacaactagaaactatagttttgtgaaatgttaatattactccattagctccttcttaatatcttatcctgagaaatgccatgtgacttagcaggcgcatctagaataatgaattaaaccatccagctctgagtcagatgctaattagagaaaggactcctcccaaaaaataaatatgaacattttcaaccatatttgcatatttatcctggattagtatatttcatattaacactcttcaaagagaagtgacctgagtgaataagaattaggataggagactattactatgggaatagaaaaaaatctgatgaacctgattaagcattggtaactaatggcaagagaagtttgctacacacaataaagaggacttgaggggtgtagatatgaaaaaatgtagtttctttatatttttgcctagggctagcccaggggctttagaaatggatggctatactgtggctgacagcagggttgcaaaaattaaggtcatttttatgtacaggtctgtattttttaaactctttgactgcgttttcatgtaaaacttaagtcctttagctgccatgttgtcacgagaaggaaggaagtatgtatttagaaggtactcatagaagcccgtcagaccaaggatctgtgaaatatggttttgtcaagaaaggcacctctgagtctattacaagtacaatacaatgtggtctgtaatgaatccccaaccctagagagttctaaatatagaatagatagtcaggtctttggatggtttaagcattaaactgcctaaaggaaaggatctcctcagatgacctctcagtgccccttgcagctctgtaattccaagtctgagacagttggcttatgacgtgcactgagcatatggatgtgcgcaagtatgtttagtgtatatatgtatatatagatgtgtgtatgtatgtatatatatagatgtgtgtatatatgtatgtatatatacatatatataccatagagacgttgtgtttaatattcgtaatgttccttttttcttatcctgttatatcctgcagaatttgtgttttttctacctttctctgtgtatttgccttatatacaaaaacatatacctatttacttttgcagttgaatagccaacacatggagctcttaaacgtttagtttcttcattaagcattcttacaattttatccctgatattttcttaacagaaaagctatgtgtgtctgtttaactttaaatattgtggtaagaggtgaaaggcatattttcaatatagtatgagttttgttgtttactaggagaaagaagtgtaaagcatatagtttagtttggagacccaggatatttacagataccagtagagaaggaagatgtgggatagaattaatatctacttgcattttgttattgtttgtggaacaataaaaggttttctggcatagtcattctgatagcggcatgagactgcagaggattaaacatttatgcattgtgatttggctctgaggcgtgataactacagttggtcgagaaactgaagtacagaaatgccatgtgacttagcaggcgcatctagaataatgaattcaaccatccagctctgggtcagatgctaactagagaaaggagtcctcccaaaaaataaatatgaacattttcaggcatatttgcattcaagatgaaaagtataatctgctctgtcatgagtcctgggacaggcattgtacagaaagctcaaagaattgtacattgttgttttaagaaccaacacagtagttgtttcttgctggtaaaattatccacaaaaaactggtcaaggtcagaatagagatttcatcaggatgcatgtaattgcttacaaatctttgctacttttttacttacactaaaggacaaagcattttcattttcagctctcaaatattcctcctcacattttaacaccaccggggctttcatggatttgtgaatatttgtatgtatgtgagcttgataacaaacataaatttacaaactttaaaagacaggctattcttggccacttgttcccagacaatagtgataggattccacttgccctaaggccagttctggcctgcatttgttgcctttgccaaattgccatctggttactttgtcatccctagtcagctcttttatgtgattaggaaggaacacttctttgggcaagatgctaggtgcagctgttaattggcaccaaggttttcttcctagtacttggaacaaaatggttattatcatcagcagcaacttgaaaatagaaaatttgaaactctgctcatatgacataaaaatattaccagaaatataaactttatatgtaatagctaacacaaattggaaaagagcttcaaagtttatgctatgttctttaaaaagtcaaaacaatctaatgacaatttactatcatatctaaaaatatttaaggaactttaccttgccttataacttcttgtttctctttggactagcttgattgagtgattatttctgttcataatgcattaggttcttgtagggtttataaaaaagtggaagaaagggctgggcaaaccttcccaacacaggactccccagagaagagattgacagatgctgcttttagcagaagaattgatgagtcttctttctccctgtgtttcgggccatttcataactgcattgtaacaatctgagtatgggggcggggggtataaaacctggtgtgaagcacatgtactagtttatacggagaatgagatagatggtcagaaagaggttttttgccccccagttcctagtgccaagctggcctggccctttgttggtcaagatcatgtaatttatgcataagacagaagtcaagtccaaattaccaagaagtggaaaggctagggagagagacagcactataccagtagtgtgggtgagatgcagtaaagaggacaagtgggtgtaccatgcatggaaactaacctttaactcacttatgcaggggtccctgcagcatcttgagttctggatactcagatatattaggagaaggagctgtgaggagatagtgagaggggctgatagttatgttttccaacagtctcctctcctaaggagaagaaatggtttcctatggaaagtagaagcataagacaagaacagttcttcacaataatccttgcctttaagaaatctacgttttccttgatgtgtgcagacaaataaaagtaaagcagtaattaaaaaatacccaacagtatggtataatgtgttaatctgtgacttttagaatgtggaagttttctactatatactagagacattgcattgagttagcttatgtaaaattgctgtcactttaccctgtacttattaaaaacaacatataaaagacttcatactaattacaaaggcataaaaattacagaatggagagattgtgtgtattagtccgttttcacgctgctgataaagacatacctgaggctgggcaattttcaaaggaaagaggtttaattggacttatggttccacgtggctggggaagcctcagaatcatggtggaagtcaaggaggagcaagtcacatgttacgtggatggcagcaggcaaagagagcttgtgcaggaaaactcccccttacagtagccatcagatcttgtgaaactcactcactatcatgagaacagcatgggaaagacctgccccatgattcaatcacctcccacctggtccctcccacaacacgtgggaattcaagatgagatttgggtggggacacagccaaaccatgtcattgtgacacaagaatgaaaggcacatctctgcaatgtattcagtagacatttagttcatttttattatgagaagcaatatttcactagtggttgagaatttcagctttggagccacaaagtcctggatttgcgaccattgccgtgcagtagttgtatgaccttgtaaaagacatttaccctcattgagactattttcttatatgacaaatagggataatagtaattatcatgaagaaaaatatgtaaagcacctagtgcatcgttcctggcccataaccgttaataatgaagattatttatattgccagtagtgtattggctgaaatacaatagataaaagtaaaattcctcttttgaatgggaggtgattagctaggactgaagttagtaaaaaaatttgtgtgttgtgtttagaggatcaggtgtgaatataaggcagtaggaacaatttaataaagtatgccaccagtattttcccttgtgtcacaaaagtatgtagacatgctacatctctaaactaaaaacaggaacaaaaaacaatttttctttcctttccagagaacagcttgtgccccacatataactgaatcttaaaataaattttattaggattcctattaccacctcagcatgcctgtgacaccccattgagaatctcaggagcaagtcctacatatccgtggtagcaacatgttattttctaatgttcatgattagtttgtttttgaaagagtaaaatctgatattctaaaattgcatgtgtagtaaccatgaataaataattttgaaccattagactgattctaagagtcatgtataagagacccagcttcttttagccaccctggaggcaggaaccactttgtcttgttcacacacagacctcaagtgcataacaggtgcctggcacatagtgttcaataaatatatagagttgctaagagaatgaaaaatctatggtcgtacttcacatattatagtacccagaagatcattccctagtagagtggcaaggatattgaatttggaattgaatagctaagtatgaatacaaaagagttagggtatcttggagacagttttctgtacattgggttgttttatagattaagataataatagaaacaacttgggaaactgtacaattatgatacatattcttaaaagttattacttcacttgagcaccatattacctagtttttttttttttacttcgtttgtagttttactcctttggatgcaaactgagaaagccacttaacattatttttacatgataacactaatattccacctaagctagcggtccttaaaaagcttagaacacttttaactgcaggaagacaactgtgtattcttaacatgtacctcatttgataaaaaagaaaaaacatgttaaaacatagatgaagaaaatatctattgatgcttttaataaatcctgctagtctagtgcctagaacaaggaagctaaaggtaaaaatatgcactagaaattttgaaatcggggactttgatttcattctctatttaacatatttggtgggcaagatggtcatttaaatatgctgtatcaattgtagatttagtaaacatttctttgttcattcagctaaaattcattgagttcttttgaaatatgttgatgtattaatttggcttgtctttgtaggtccagttgataggcagtcacaatagagtgccttagaaagacaagagctgcctgattactagtctagggcagtgatattatggttagaaggttatagtttggcacaaatagcctagatcagatttgcagcccagttacttgttagtaacttaattgtgtgcaacttatttaacataagccttgattttttatctgtaaagtaggcatactattgtctatgccatacagctgttatgaagattaaatgaaattatgattgaagggcatttgttatagtatctatcatacaaagcatgctcagtaactggcagctcttgttatttatgaactctgaactttactaatggtaattatctatgaaaatatatcagataggtacactctgtcttatatgccatacttcagtgatgataggtttagacttcatggtgttttttattttcgcctgctttaaaacatatgattctttaattatattagaacatttaaagtctgaatattggaaaataactttgtactgtgtgtatacaaatttggccatgtaaatataaaacttactgaattatcaaatatctgatctcatttttgtggtattaattgatccaagtaatttaccacctgtcaatccctgtggatagctggaaggcccaagttgatagattgtttaaagaaagcacactttgtttcccaaaaattgaaaaaaacatgctagctttatgagctgactagctaaaccaagaagaaattaaaaagaaaaacacttaaatagcataagaggaagtaatgagtatactcttactgtagtccttgtaactcctctgaagaaaatacaaaaatattttctttgaagtgtattaagttctgtgagtttcagaaatatagaaaatgttctcatgtaagatataaaaaaggttgaaaatgaaggaattagtttgcattgcctgtgtaatcaccttaaagtaataaattaatgaattatctcaaatcaagaatttatggacattcctgtcatatttcaataaaagggaagcttaaaaattaatgtatccaaaggaactgaaagcttgtattcacacagaaacctgtacatggatagttatagcagcctttttcataattgccaaaacttggaaggaaccaagatgttccttagtaggtgaatggttaaattaagtgtgacccatccagacaatggaatgattcagtgttaaaaaacgaataatcaagccatgtaaagacgtggtgggtggagtaaacttaaatgcatattactaagtgaaaaaagctaatctggaaaggctacatactgtatgatttcaactatatgacagtccagaaaaagggaaaactatggagacagtaaaatgatcagtggtttccagggatatccagggaggaagggctgaatgggtgagtacagagtatttttagggcagtgaaactactctgtatgatactataatggtggatacatgtcattataaatttgtccaaacccataggatacgcaagaccaagcatgaactctaatgaaatttcagactctgggtgataatgatgtgtaaatgtaggctgtgcatgtgtaggagcagggggtatatgggaaatctctataacttctgttcaattttttagtgaacctaaaactgctctaaaaaataaaatctgttaaaaattaattatcatgtcaacaaagagataattctctcttcccagaaactacgtttggcattttagtctaaggcaatgaggatgtgggctggcagcaatatttatttcaacacagtggataggagcaaactgttggaaacaatcaaaatgtccagcaatatgggcagtgtttcagtaagttatatccatgtgaaagtattcgaagtaattttctagagttctgttttgtggcagattccatcagttgaattcccaatatcttttcctttgttctcgtatgctaacaaaacccagatattgttcagggtagcagtgtccactgctccaggcacaaaatggtaacaatcctatttccactttcctagctttttttttttttttttgcaactaggtgtggtggtgtgttccagttctggtcaatgaaatgtaagggaagtctaatggatgcttttgagaaagcttttttctctcctaataaagggggcaaatgtgaatgccagcaatcctccactgcagaccttatgttaagtgagaaaaaattagctatttgttaagcaagagttggttgggttttctgttacttagagtctgtaacgtactgtccagatccttttcgagacttccagatagtgggatactgattgacagcctttatccttcacttatctccaggagttgcactcagttgaagtcagctgccttgcccagtgtcatacccgcttcccaggggccagcccacatcaaaatacacaagagtataagggcccagccttgtttctttaatttgggcaaactctcccaggctctctcagctccagagctggagtctttctggatactgcacctttctgcctaatccttctttattccctttccccatagatactgatttcaagagcatttcctaataattttcctgctcagatacacacacacacacacacacacacacacacacaatcttagctcattgtcttatacattctattgctcaagcaatagtatatgaagcattagagtttttgaaataactgtaacattttacagaaatgacagtgaaatatgagctaatataactattagggataggaaaagcaagtgtttttgctactctcccgaacagatggaaaccagatgcatctgtgggttttttccatacatcaagccatcagttttcctttggacaccagctgggtgtcctaaaatgcaactgtgacactatgtaccttgagatagtgtcagatcctacaggttaaggtctcagttccactagactacccctatatcagatgccacttgccagccccaggttgagatctgtgcttctgaccagttgattataaattagggttcccacgaccccctccttgggcttcattaatttgccagatcagctcacataactcagaacactatgcttacttttacccatttattataaaggatattataaaggatacagatgactagccagattaaagagatggataggttaaggtatggtagaaggggtgccacagtccaggcagctccacaatttgagcaacctggaaactctcagaaatccatcttttttggaaccctcatatactgttggtgggaatataagttagtacaaccactatggagaacagtttggaggttcctcaaaaaattaaagactggacctaccatatgattcagcaatctcattactgggtatataccccaaagaaaggatagcagtatatccaagagataactgcactctcatgtttgttgcagcactcttaacaacagacaagatttggaaacaacctaactgtccatcaacagatgaatggataaaggaaatgtggtacatatacactgtggagtactattctgccataaaaagaatgagatcctgtcatttgcaacaacatggatggaaccggaggtcattatgttaggtgaaataagccagacacagaaagacaaacatcacatgttctcacttatttgtgggaactaaaaatcaaaacaattgaatacagggagatagagagtagaaggatgggtaccagaggctgggaagggtagtgggaggtgggtggaggtggggacagttaatggttacaaaaaaaaaaatagaatgactaagccatactattgactataggcacaacagggtgctcacagtcagtaattatacatttgaaaataactgtttaagagtaaattagattgttagtatcacaaagaataaatgcttgaagggatggataccccattcttcatgttgtacttatttcacattgcatacctgtatcaaaacatctcatgtaccccataaacatatacacctattatgtaccaacaaaaatttaaaagttaaaaattaaaatatagaaatctgcccttttaggtttatttggagtcttcattacctaggcatgattgattaaatcattggccattggtgatcaactcaacctttgttccttcttccttcccctgaagttgtgtgggtgggtgggaaatgaaagttcctttctttttctaatcatatggctggttcccctggcaaatactcccccatcctgaggctatccaggctatgctgattagtcatctaatcagcatgaaaaagataccactgcttgtagatcccaagggttttagaaactatttgccaggaaccagaggcagacaccaaatatacatttcttatatcacaatatcacagtatttggtgctgtgctaggtttggtgctatgtaagaacaggaatagaaacagattttttttaaactttctgtatcatggtgaaatactttttgacccttgatgttgcaaatcaagacttgaacatgaaattttaggtgaacttcatcttggtgaatttcaactctggaaggattcagcttttgcagaaaacttcaattcacttttgtctatagtcagcaataaaatggatgcttcctgacctttaaatttcaaaagaactatttcaaatcaattttgtaagagacctttcgatgataatgtgcaaacccatccgtccaaaaagagcaccttctttgaaaaaagtgatgaagaatcaataaaaattgttttcagaaatctctataaagctttgcatgaataggatagttatgctaatataaatgttttgaaactttttagattattcaaatctttacatttattgtgactgtctttgagctaagtatcagttttggctacaactttaaaacaattttttttcaacagactcatctttcacttatgaaaaaacaaattgtcaatcttttcactaatctccttacctgtctgctatacattttcaagcgtctgatacacagagactcgaagattatcccaatcttttgtaacaagaaaccaacccattgctgtacccagctggtcagcagtctttaggtttgcaaatagtgattttgaaacagatttgtaatttggaatcttcttctgagatttctatactttaaatacttttaaaaagggtattgtaacagaatactcaattaaaatattataggccaagcccataaatattttaacattttattaatattagaatagcagaattgatctacaggctataatgggcctctacttgttatttactttttctctaaatgaagaacatgtacaaattctggtaatatttgctgaaaatcctatttaatcatttcattaccccttttgtttttccatcaaatactatctaacatctaatcaaagtcaatataattgctattatggtaatgatttgttaacatgaaacaatttttccaactctgtaataaaacaaattattgtataattaaaaatgtacataaacccaactgtacataacttactcttccagttctctcctttgcctctcaaggaaagtaaaattgactgaagaaaaaaaatatgtatggagagagactttagctaatcagtgcttaattaatctggtataatccttcttcagaaccatgggatcatcaagtcctggcacttataaaattagtgggtttgggttacaatagattttgtgtttttttcacactcatgtatggtaattttaatagttactatgttttgaagcatgtcgatgtgcccatctccttacatataatattgctaatgctcacaaacttgatatttgcttctcacagaaaagcaatcctagattcgctaaagaagtttgcccaatattgcatagcaattaagtggaagagttaaggttccaatttatggtgtttactccaatgcaatatttttcccattacattattaacatttcctcgatcccctaccctggaggcaccctccactccctgacatgcgtgcacgcagacacacacacacacacacacacacacacacacttttttttctgactgctgttagcctaattaggctgttagcctaattagtagcacccagttccctaaaacctgaagtcatgatggcatattgtgttatctccttcccagagtacatgtctctggaccatcccacacctgaaatattttctcaaagtaagcagaatcttcctgcctcatatttaattctttctgagactgccctctaaattctactgaggattatgtaattaataatggcttactacattatttttcctagagagcaaaattaatattttaacccagaataataaatgggcacacaaatatcttgatacctgcaagagatatttttccttatttagaggattttttcagctaaaaaaaaatttctaaaaaactttttagaaaatcatacaaaaaaacccagcaaagccctctttgcttatgaacaatggccattctagagctttcagcacttaactgctatgaagttatggtaattccttaggaaacagataagattacggctgttaggattttcagtagcctaaaaaatagatgagtgtattaataaacataatttgacttggcaagggtttttgtttaacatattaccaagagaccttataaagattacctactagtttactatatacataataatatacataatgtatatattatgtgcataatagattgcctactaatctaccttagcatccttaaaaacagtcaacttttgttttttatagattgtcagtacttatatagctcctatgtactatgtataatgatgctttttataaatgtagagatgaataggaaatacttcctgtcttcaagactttcagtatgtgggtgaaatcagcagcattttttatttaacatttatggtatcatatatgcagatatcccaaagagacactccagaaagctttcaaaatagagtccataatgtcttccaaaccttgtccaggaatatgagaagaagagtagacaaaaatccctcaataagccaattcttagagtgcatgcttcacatgcaaatagaattgcagaaacagctttggctgttccttaccattcctagggcaaatatacacattaaactctcatttcagaaccagcttacaattaaaataaataattcagtttttacttggtgcaataaatcagcgtatttattttgcatgaatattacgtaaacttttttgggttctatatatcttgtagacacttgctcttaaagaacatgctgtagtgataggaaaagaaggtagcaaagatattataaaattagcacaagatgttatataattgagtaaaatgcataatgtaggccaagaccattctgtaaaaatatgtgagtcacatgtgtgattttgttatctcatagccatagttttaaaaagttgaacaggtgaaattaattttattaataaatgtattaaatttaatatatctaaaatattataatttaacataatataaaattattgagacatttataatttttatactaaatctttgaaatcctgtgtgtatttacacttacggaacatcttaatttggacaagatgcatttaaaagcaccaatagccatgtgtggctataggctactgtattgaacagttcaggataaggttagaattacagatgttcagagaaagagaagaggtgtatagtatatgcaacacttgttctgggtcatgaaagttgtgtagaatttgtgtagatggagggcaggagtttataatagtaaggaggaatgccagatttgaaacactgtttactgaagattatcatagtagttccagctgttgaacaggttaccagtttatcatatacttcaggttactattaaggaaagttgatacataatttaaggagtgtatagtacccaattagttattcttaatattttttcccaaggacattggacaaaaccataaggttacacagtatttccaaagaggtattaattaagtataatagtaatctttcaagatattatgaaagtctaattctttggtttaaatgtttcaaaaactaactctttttggtgattcataatgaaccctgacatactacattttcttggattcttggatgtactgtaagtaaaactttttttttttttttgagactgagtgtcgctctgtcacccaagctgctggagtgcagtggtgctatcttggctcactgcaacctctgcctcccaggttcaagcgattcttgtgcctcagcctcctgaatagctgggattacaggcacccgtcaccatgcctggctaactttggtatttttagtagagatagggttttgccgtgttgtccaggctagtctcgaactcctgacctcaggtgattcacctgccttggcctcccagagtgctggaattataggcatgagccactgtgacccgccgtaaataaactgtttaaattctgtttattacaatcttcccaaactggctggactaagggtctcattttcacagcactgctgttaatgttgatggatctggtatcctatagaatataggcttgagagcactgctctaatgcattttgtattttcagaagtctgtgtaagatatatttgaagagtgttttatcactgcttccacaatttaggaatgctttctaattctgtctttctgattacatggcaagtccgtcacatttaggtgatgagatttattcatttattcactgaaattactacctttcttctcatttatagaaatgcatttttcgtgaaccacagctgcttatgtgatttctaatggctcatataaattgataaatagtagacacagtactttgtttgtaactcattaaatattattttgttaaaatgtccaggaatatttgcaatctgtatttgattatccatgtatttttaactgattttcaaaaaatgatagtaaactgtaaaattttcagcagttttaaaaaagtataattacttaacactcacaaggtacatgcctacaccttgtctcaagaaacaactatgatttctgtacatattcacaatgtagacacagatactatcatgatttgtcacatgagtctacttttaaatatttaatcgtttatgataaagtagttgatgattttttctttttttattagactttaagttctgggatacatgtgcagaacgtgcaggtttgttacataagtatacatgtgccatggtggtttgctgcacccatcaacctgtcatctatattaggtatttctcctaatgctatccctctcctagctccccaccaccaacagaccccggtgtgtgatgttcccctccctgtgtccatgtgttctcattgttcaattcccacttatgagtgagaacatgcaatgtttagttttctgttcctgtgttagtttgctgagaatgacggtttccagcttcatccatgtccctgcaaaggacatgacttcatcctttttatggctgcatagtattccatggtgtatatgtgccacattttctttatccagtttatcattgatgggcatttgagttggttccaagtctttgctattgtgaatagtgctgcaataaacatacgtgtgcatgtgtatgtatagtagaatgatttataatcctttatataccaagtaatgggattgctgggtcaaatggtatttctggatctagagccatgaggaatcgccaccctgtcttccacaatggttgaactaacttacactcccaccaacagtgtaaaagcgttcctattgctccacatcatctccagcatctgttgtttcctgattttttaatgatcaccattctaactggcacgagatggtatctcattgtggttttgatttgcatttctctaattaccagggattatgagctttttttcctatgtttgttggctgtataaatgtctatttttgagaagtgtctgttcacatccttcacccacttttggatggggttgtttgttttctcttgtaaatttgtttaagttccttataaattctggatattggccctttgtcagatggatagattgcaaaaattttctcccattctgtaggttgccttttcactctgacgatagtttcttttgctgtgcagaagccctttagtttaattagatcccatttgtcaattttggcttttgttgccattgcttttggtgtttcagtcatgaagtctttgcccatgcctgtgtcctgaatggtattgcctaggttatcttctagagtttttatgatttttaggtcttacatttaagtctttaatccatcttgagttaatttttgtataaggggtaaggaaggggtccagtttcaattttctgcatatggctagccagttttcccaacaccatttattaaatatggaatcctttcccttttgattgtttttgtgaggtttgtcaaagatcagatggctctagatgtgtggcattatttctgagacctctgttgtgttccattggtctatatatctgttttggtaccagtaccatgctgtgttggttactgtagccttgtagtatagtttgaagtcaggtagtgtgatgtttccagctttgttctttttgcttaggattgtcttggctatgtgggctcttttttggttccatgtgaaatttaaagtagttttttctaattctgtgaagaaagtcaatggtagcttgatggggatagcattgaatctataaattactttgagcagtatggccattttcatgatattgattcttcctatccatgagcatgggatgtttttccatttgtttgtgtcctctcttatttctttgagcagaagtttgtagttcttctttaagaggtcctttacatcccttgtaagttgtattcctaggtatttaattctctttgtagcaattggtgaatggaagttcactcaagatttggctctctgtttgtctgttattggtgtataggaatgcttgtgattttcacacgttgattttgtatcctgagactgctgaagttgcttatcagcttaaggaaattttgggctgagatgatggagttttctaaatatccaatcatgtcatctgcaaacagagataatttgatgttctgtcttcgtttttgaataccctttatttctttctcttgcctgattgccctggccagaacttccaatactatgttgaataggagtggtgagagagggcatccttgtcttgtgccagttttcaaaggcaatgcctccagcttttgcccattcagtatgatattggctgtgggtttgtcataaagagctcttattattttgagataggttccctcaatacctagtttattgagagtttttagcatgaaggggtgttgaagcagaaaggtatgaaggccttttctgcatctattgagataatcatgtggtttttgtcttcggttctgtttatgtaatggatgactttattgatttgcatatgttgaaccaatcttgcatcccagggatgaagcctacttgattgtggtggataagctttttgatgtcctgctggattcagtttgccaatattttattgaggatttttgcatcgatgttcatcagggatattggcctgaaattttctttttttgttgtatctctgcctcgttttggtatcaggatgatactggcttcataaaacaagttagggaggagtccctctttttctattgtttggaatagtttcaaaagtaatggtaccagctcctctttgtacttctggtagaattcggctatgaatccatctggtcctgggctttttttggttggtaggctattaattactgcctcaatttcagaactttttattggtctattcagggatttgacttcttcctggtttagtattgagagggtgtatgtgttcaggaatttatccattttttctagattttctagtttatttgcgtaggggtgtttatagtattctctgatagaagtttgtatttttgtgggatcagtggggatatctcctttatcattttttattgtgtctatttgattcttctctcttttcttctttattagtctggctagcattctatctattttgtaatcttttcaaaaaaccagcttctggattcattgattttttgaagggtttttttgtgtctccatctccttcagttctgctctgatcttagttatttcttatcttctgctagcttttgaatttgtttgctcttgcttctctagttcttttaatagtgatgttagggtgtcaattttagatctttcccgctgtctcctgtgggcatttactgctataaatttccctctaaacactgctttagctgtgtcctagagattctggtacgttgtgtcttggttctcattggtttcaaagaacttatttatttctaccttaatttcattatttacccagcagtctttcaggagcaggttgttcagtttccatgtagttgtgtggctttgagtgattttcttaatgctgagttctaatttgattgcactgtggtctgacagactgttatgatttccattcttttgcatttgctgaggagtgttttatttccaattatttggtcaattttagaataagtgtgatgtggtgctgagaagaatgtatattctgttgatttgaggtggagagttctgtagatgtctattaggtctgcttggtccagagctgagttcaagtcctgaatatccttgttaattttctgtctcattgatctgtctaatattaaagtctcccactattactttgtgggagtctgagtctctttgtaggtctctaagaacttgctttttgaatctgggtgctcctgttttgggtgcatatatatttaggatagttagcttttcttgttgcattgatccctttaccgttatttaatgcccttctttgtctcttttgatctttgttggttcaaagtgttttatcagagacgaggattgcaacccctgttttttttctttttcttttttccatttgcttgataattattcctccatccctttattttgagcctgttgtgtgtctttgcatgtgagatgggtctcctgaataccgcacacccatgaatcttgactctttatccaatttgccggtctgtgtcttttaattggggcatttagcctgtttacatttaaggttaatattgttatgtgtgatctgatcctgtcattatgatgcattaagttgatcttcaatctctgatatcctttcttctgctggattgatttgtctgttgatacttgtgaatgcctcatgaaattctcatgctgtgtttttcagctccatcaggtcatttatgttcttctctaaactggttattctagttagcaattcctctaaccttttttcaaggttcttagcttccttgcattgggttagaacatgctcctttagctcggaggagtttgttattacccaccttctgaagcctacttctgtcaattcgtcaagctcattcaccacccagttttgttcccttgctgccgaggggctgtgattctttcgaggagacaaggcgttctggtttttggaattttcagcgtttttgtgctggtttttccttatctttgtggatgtatctacctttggtctttgatgttggtgaccttctgctggggtttttgtggggacgtcctttttgttgatgttgatcctatttctttctgtttgttagttttccttctaacagtcaggcccctctgctgcaggtctgctggagtttgcttgaggtccactccagaacctgtttgcctgcgtatcaacagtagaggctgcagaacagcaaagattgctgcctattccttcttctggaagcttcgtcctagaggggcacccgccagatgccagccagagtgctcctgtgtgaggtgtgtgtcgacccctgctgggaggtgtctcccagtcagggggaatgggggttggggactcactttaggaagcaatctgtcccttagcagagcttgagcactgtgccgggagatctgctgctctcttcagaggctgcaggcaggaacgtttaagtctgctgaagctgcgcccgcagccaccccttcccccaggtgctctgtcccagggaaataggagttttatctataagtccctgactggggctgctgcctttctttcagagatgccctacacagaggggaggaatctagagaggcaggcagtctggctacagtggttttgtggcgctgcagttggcttcacccagttcggacttcccagcagctttgtttatgctgtaaagggaaaatcgcctactcaagcctcagtaatggcagatgcccctcccccaaccaagctcaagtgtcccatgtcgacttcagactgctgtactggcagcaagaatttcaagccattggatcttagcttgctgggctctgtagacatgggatccactgagctagaccacttggctccctggcttcagcccctctttccaggggcgtgaacggttttgtctcggtggcattccaggcaccactggggtatgaaaaaaaactcctgcagctagctcaatgtctgcccaaacggccacccagttttatgcttgaaacccaggtccctggtgatgtaggcacctgaaagaatctcctggtctgtgggttgcaaagactctgggaaaagcatagtatctgggccagaatgcactgttcctcacagtacagtccctcctggcttcccttggctaggggagggagttccccaaccccttttgcttcccaggtgaggtgatgccctatcttgcttcagctcgccctccgtgggctgcacccagtttctaaccagtcccactgagatgagccaggtacttcaggtggaaatgcaaaaatcacctgccttctgcctttatctccctgggagctgcagaccggagccgttcgtatttggccatcttgccagccaccgagtgccaaacatctacctattttttcttatgtattgtttttgttaggctttgtactgacaataattaaaatatttgcctgagataattttcaggtctcctatttttacccttccagaagatgctcagaggcttacttgtttataagaaattgggccagtgaccatttggacagtcttctattccttattgcctcccttcactgtataaagaagctgtaaagggtgacccgctgaaatagatggcggtatgggtgtggaaatcagtagacactaagtgttctggtcatgagagcccaagtgaggggcacccctagtcaagccttgcacagaggagtggatttgcccttggagcattctgtgtactactatcattggtagggatctgggcaatgagtagtggaacagatggtggaggggcagaatctgagggcaatcagttctaaggtaaaggtgaaggagtagcagcctgactaccctaggccagtggtgtggtcccagtcttgcttggagtagaagtctggccatgccccttttgatctgcgtatgtctgcactaccagaggggcccatgacctttgcctaaaaaataatactagatttctcatgatctaatcagtgagaccttaagacagttctaattttatttgagaacaatggaatgtataataacatgttttctgtgtgtggcattgcattttgaatttcagttttcctttactttgggccaattaaatctttaggacttcctttccaaactaaatttctctgagtgaccaagctcattgtgtctgtttgtctagtgtttttttttttttttaatttttcggtatagtactgttttaaaatgtaaatcagattaagaattaatctttatcaatcattgttaaaggactgtcctgtttaatttttctcctctgggattaagtgacagcatccccttatatgttttgttttggtttggtttggtttgtgcagtactttaatcaggcagttttgtctgttattaaaatttctgaagcctttctctctcggtatcttgctgtttttctatgccctaatgttagcaaagtaaacacttggacttcctgcataatactaactggaggaatctctttttcccttccatgctctgtttgcactctttcaatggcccaagaaacagctatgtaggtaaaaggtcttttgttaaaaagaaggaaattgagcagtcatttcccttttccttctttgacctgtatcagcaggcaagtggttgttgctatgatcttttcagtttacactgtttaaaagaatcaatgattgtttcccagaactttgaaaaatctacacaaaaataatttaaaatgaactatacatatatatgttttgtcttaaagttgaattatgaagtttaagcagttgtcttcatttgaattgatgatagctatttgttgtatgagtttcaggtattctgctatcatttcttttcttttcttttcttttcttttttttttttggacaggatttcactctgttgcccaggctgaagtgaagtggtgaaatcacaactgagtacagcctcaacctctggggctcaagcgatcctcctgcctcagcctcttgagtagctgagactacaggcatgtgccaccatacctggttaattttttaaattatttgtagagacagagtctccctatacttcccaggctgctctagaactcctgagctcaagcaatcctctggcctcagcctcccaaagtgctgggattatgggcatgaactaccgtgcctggcctggcgtctgctatcatttctaataaaataaaagacacagatggcaaaactctaaatgattgtatgactttgttaggcagtggttttgaaaagcagaatacttaaaatcctatgtaaaacattttgtttttttttaattaaaataattccattttcacaattatgctttatgatttaattagctttatgagaattctgttgtcttatgggagagatgtgatttttgtttatttcagttgtcttgagtgtattctcagactttcaacagtttatatttcccttagtctactagctgttaaaaacagtccagtttcataggcatttttgttttacatagtaatatcagacaatgatagggaacttagtaacttttctttcaattttggggaaaaagataaagtccttgaaaaattctttttaaactgttccttggaagaataaaagcatttgaaatccccatgtgcaacaagatcagcagatcttcaattctcaactttaagaactgcaagcccagaaatttgtgggtttcttaaacccctatttttagctatttgtaaaagtcatatctctaccttcattgtctcttgcttcagagaagacatggttagtcctgtaatagtccagcattagtgctttcaagggaaggagaatgattgcataactggttacatttaaaatgagtaagaatgaagattcttgagtgttgctcacaggtatataggaaaaggagctactgttatgactgtggaatctccattgcattttattagatacaagaaaagcacgaatgccagaccagactcaagaagagaacaatttgactctgctttcaaatggagtggcaaaatcacattgaaggaaagctggtgggatgtagtattcttatacccatggttggcaaatacagtcagccacaacagtttaccctaagaatcttggatttcattccatatgtgattaacagttagtgaataatattagttgtaataatgtaatcagaaacatgttttaggaagtttactgatgaattcttgagaggaagaagataatcaaggaagtcattgtgttttgttttttgcttttttttcctctcaaagattcttgagcacatctgtaggcagaatagacagaagtagaaaagaagaaaataacaaataatcttaaagttggacggaaacacagaatacttctttaacaggacaaacgatcttagcagaatgtcaagttcaagtgcagacaacaaccgctgtcagccctttagttatttgaatacagctctcatcatatacctgctttcattaggtagaaaaatttcaagatgtatcataaaattggatactttcttcgggagattctttgtcttgtctatatcactttcatcaaagcatcttatagtccagagatttttaaattgccacaataagattcccaaatattcccacatattcactgtaaagagctcaagttttgaggagttcggaaaagcagctgtatttgtttgggttgtcatgtatgtatatatatctccacccaatatacaaattggttttgtttctttaaatgtatgatggaaactaatgcatttgagtatctaataatcacaatattttcatcttgaaatatatattactctgaatattaaaaagttgaaaattccatcttaagggactttactttctctgtttttattcacatcaagtttgctttctttatgttgtatcacttaaaatggtgacccatctcttatagttaaatacatttgaaggattgactttcttcagtttttaaggaatacaagaacaaagtagagaataaatttaaccctgaataaactatattacatatttaatcaagttagaaagttgtttactagaactagtttatatctgacgtactggaaataagtggtatttggagagtttgaaactccaaaagagtatagatatattgtatgtctgataatgctaaggagaaaattaaagtaagatgaggagaaataggagtgcaatggtagttgcattttatgtaagatgttcacaaaaggtctttctgcaaagatagcatttgagcagagatctttgggtggctaatttgtgggaagaatattttaggcaaagagaacatcaagtgtaaagacctcttagcaggagaggactgggcctgttgatgaatgagccaggagaacagtgttgtagcagagtggttaagagggagagtaatggcagatgaggcctaacatgtgtatgggggaagttagatcatgaaggcatttgtaaggattttgggttttatctgtgtgacatagtaaaggttatgcgtgctttataaggaagagcaacatgatctgacttctgatttgacaggtgcactctggcatcagtgttgaaaataccctgatagcagggtaatcaggagaaagcaatggtagctgacagggtggtagcagtggagagagagtcataaggaattgctagaggattaatatgaagtgtgtgagaaagggacataggatgcctggtttttagattggactgtaaatatggaattgccattttctgagatggggaaggagattgtgagatgagcaagtatttggaggaaaaccaggtatttcctttgggatgtggtaaggttgagatgtctattggacatctaagtgaaaatgttgagtaggccatagaatatgtgattctggatttcacaggctagatctgggctggggatagagatttggaagtccacggtatatagctgggcatttaccacgtggaactaggtgagatcacctggcagaggggtgtacataataaagaggagaggtccacgaactgaactctgaggagtgtgcacttgtggagattgtggaaactatgaagaagaaccagcaaatgcttggtgagggacaagccaagaagtgaggaggaaaaccaggagagtttgttgtactcgacgccaagtaaggaaagtacatcaagaagggattagtcaacactgacagatgctagttcttaaataaggtgaggactgaatttagcagtggtcttagcaatatgaagatcattcattacttggacaaaagctgcttcattgaaattgtggtgacaaaaacttgactggaatatctttaaatgaaaattggagaaaacagaagtagagacagaaaggatgagagatgcttttgaatgatttagccataaaagagagaatagaataagtcaatagctggagggaggagagggattaaggaatttttgtttgtttttaaggttaatacattatgtttataaggaataatctgaataaatttgtaggcaataatctaaagaagataaaattaaccatgtaatggagaaggaatgcaatttctggaatgaggcgattaatttgctgagaggggatggaacgcagtgcaaatatgggagagctggccttggatagacacaggaggtgtttatctttagcagtggtaagaaagggagattacatggacagagttgcaagtggattgggaatgtggaactaggagtctatagaagttcttttcaaaatgcttctatgttttcagtaatagaccaatgtgagagtgaggataataggagaaggtgttggaggtttgagaggagagtaaagaatatgaatatatcacctaggcgagttagggatgcactaataggattgctggagagcacccagggaaacgctggagattaaagcttatgattctaaaatgtgatcactcagcataatcagtaaatattgttcacaaaaatgaattaactgtgaatttctcagttattttgacatcatgtagccatgcagttgctaggtcattacaaggcaataaaaagtagatgtatttcctaaagaaatactgtaagatctggccaagtcagtggatttgctacataacaaaggcacaatcagagtttctgctaattcagtcctagatgagagtaaattgtgaaattagaacaatcatataggcttttgagataacagactttaaaaaaacatttttctacttttataaatgaagaagctgaggtccagagaggttaaaggattcccttgttgtgaatcacattaccttttacaaagaattttgaatattctagtaaatatgctcttccaggaatgttacattttattctaattttattccttttaatatagcattcctgttaggtttttcaatttgtgtttgattgtacagttatgtaaattctttttgacagatttgttattaagggaagaaagatgagtatgaattctaacagctcattaattttaaagaaatgtgtcatgaattaatgctttgagtgctatatttttctctttacattatgtttttctggttgaatagaattctatcaaaataaataggttatttaaaaatgattaggtaggagctatataaagattctcctaagcatgttcaccgttcctgagaaataggttgaatgtaatacccaactagtgaagcattatcatcagcaatacatgattacattgtagcctttctttacaaagctagttataaaaaatattttctttgtaaaaggttttcaaagtgtctttcacttgagtgagcatttagtgaattaaagtcctttcaccaaagtatatatttcttaagcatattgactacaaaaaggatgtccttgacctacttgtttacaggaagtgaaatcagttactttcgacctttagtatagtagcaagtttaatgaggggtgagtaagctttcactgtatagatttcaacatcacctgactttcttgaagttcaggaaaaacaccatttatctcagtttaaaaatatgcacacctggttaaaaaaaataaaagcaagttcacactcctctgtgctctatttgacagataaaatatacacagggcactagtgatcaaatgtgggtcaaagtatctgctttaataatgggcaagatagttcccaataatttcaaaatatagaactttctggcaaaggtgcaatggaaaatgtatcttagacctgaggctaaattgaaaacctgcctcagatctaatctttggaaccccagatctaatctttggaacccactcactgtccaacaggctttactacctgagaacatgaagcaggagagaagggcaggggcgaggtgggggcctgcacagggtcaggatgtaggaggtgcagaagacagagtttgtagtgtgtgtgaatatgtgtgtgtgttctgtatgtacgtggataatatctaatgaattccgctcaccaactgtgaaaaattctgatggataaaatttgtcactctttatccctgaagagatttgaataagttggtagaaaggagcagaaactttttatataacacagacccttgctactcaaatgtgtggtggttcttgaatcagcaccgtctgcatcacctggaagcttgttagaaatgcagaatttaaggcttaatcccggacctactgaatcagaatgcgctttttaacaatacttctctctactcctgggtgattgattcatgcattgaatttgaaaagcgcttcactagttgccagatgttttgctctaaattccttcttctgtgtactaaggcataatataggaaagactcaaaggatttctccctacagctggagttcataagcttccattattgaagtgaggtgtatagtgtttttgagatagtccagtggatgggaatgtttttaagatctttcaactacaaaactgtgacagtcagagcaacttatattaaagatgtgcacattacagttctgtattagatatcatttataaaagagatttccattgactttgttgaagatcagatggctgtaggtgtgtgactttgtttctgggttctctagtctgtttcattgatctatgcatctttttttgtaccagtaccatcctgttttggctactgtagcattatagtatagtttgaagtccatagtacagtgtgatgcttccagctttgttctttttgtttaggatttctttggatatttaggctggttttcggttccatatgaattttagaatcatttttcttctaattctgtgataaatgatgttggtcacttggcaaccaacaggaatagcattgaatctggaggtttcctttggcagtatgacaattttaacaatgattgattcttccgacccttgaacatgggatgttttccatttgtttttgtcatctgtgatttcttttagcagtgttttgtagttctccttgtagtgatcttttacgtccttggttagatttattcctaggtatttaatttttttgtgtgttgctgttgtaaatgagattacattcttgatttgacttggatgttattggtgtatagcagtgctactaattttcgtacattgattttgtatcctgaaactttcctgaagtcatttatcagctccaggagccttttggtggagtctttagacgtttttttgttttttatttttgagatggagtcttgctccatttcccaggctggagtgcagtggtgcgatctcggctcactgcagcctccacctccggggttcaagtgattctcttgcctcagcctcctgagtagctggaattacaggtgcctgccaccatgcctggctaatttttgtatttttttagtagaaacagggtttcatcatgttggccaggctggtctcaaaactcctgaccttgtattccgcccgcctcggcctcccaaagtactgggattataggcatgagccaccatgcccagccctctttagggctttctaggtatagaattatattgtcccaaaagagagataggctgacttcttcttctcctatttggatgccttttatttccttctcttgcctgatagctctggctggcacttccagtactatgttgaataggagtggtgagagtaggcattttttgtcttgttctggttctcaaggggaatgtgtccagtttttgcctgttcactatgatattggctgtgtgtttgttataaatggctcttaatattttgaattatattcctacaatgcctaatttctttttctttattattattattgtttttttgagacaggatctcactctgttacccaggctggagtgcagtggtatgatcatggctcagtgcagccttgacctcccaggctcaagagatcctgccacctcagccttatgagtagctgagactacagacacacaccaccacatctggcaaattttaaaatttttattgtatgtaggtgggggtcttactatgttgcccaagctggtctcaaactcctaggcttaagtgaccctgctgcctcagcctcccaaagttctgggattacaggcatgggtccccatacccatcccttaatgtctagtttcttaagggtttttatcatgaaaggaggttagattttattgaaagctttatccatgtctactgagatgatcatgcggtttttgtttttaattcattcatatgctgaatcacatttatttatttgagtatgttgaaccaaccttacatctcaggaatgaagcagacttgatcctggtgaattaactttttggtgtgctgttggattcagtttgctagtattttgtatagtatttaactattgagtactatgttcagcatatgggtgctgggatcatttgtaccccaaaacccagcatcacacggtgtttacttttgtaacaaacttgcacgtgtacccctgaatttaaaataaaaattgaaaaaagagagatttgtgctgctaatttaaaaaagttgtaaaactcaaataagaaataaaacattaaacttgcagtgaggcagtctggctttaattattgagttatatacagctagctacataataagggcaagtgataacttttcagggtcttaatttccttaggagtagtttactcttcatgggctggaagtggggttggaactatataaaaatgtaaacatgatacgaaaacctgaaactttaaaataacttgaaaaagattaggccaggtgtggtgactcatgcctgtaattccagagctttggaaggccaaagtgggagaatagttaggaccaggagttcaagaccagcctggacaacatagcaaaaccctgtctttacaaaataaataaataaatattaatatgtctatggagtaggatgcctgtatatgtgtttggtgttagcaatgaagggggttatactattgagatttgatattgatgatcaaggctttttacgccctgtgaaagggtttggaatttgacctaaggttaaggagaaattattaaaggatttatgcaaaggagtgaagttggcattttagaaggctaattctggcttcagggcaaagaacaggagttgaaagatcacagagagagatgggttagaaatcatttgaataatctacatgagaataatggtaacatgaattagaagtatggaaatagggatgaggaaaatgaactttttgtgagaatgtatctacaggatgcactgacgtatttgttggggattgatggggagaacaatgtcattggtaattcctatgttttgggacttcattgtgataggaaatataggaggagaagtaagtttggaaagaaatgattaattctcttatcaggttattttttagaatggacatccaattgtagatgtctggtaaacaggtatgcctgaaatatttatcttgaacggtgtcagggcttatttttcacactacataatttatatattactcattctcatcatcccaattattatatatatgttgtcgccttcaaatctacattatcattctgtgtcacttacctaaaccctagtcccaagtatatttatctgtctcacttgtgagtttaatcttattttcaataaaaatcatgccttgctcttcattgtaaatgaagtggggatttttcagatcccactacttgtattgggcatatggactattgttcagttttagatactgacaagcatacttattttgtgagaaagattatgattgtactggttttgatatcactcttgtacctgaaataataccttgtaagtatcccatgcttaaataaagttattgagttaaatgctagaactctgagtctttagattgcttctataaattaggaataaggaaatagatctacgggaaatagcgtaataatgataagtaaaatattattaagaacttttatgttgctaatatttctctgtcttaaaattactaagaccatgtacagtagtttccccttatctgcagtttcgatttctatgatttcagttaacctgtggtcaatcctagtctgaaaataggtatgtatagtacaataagatgccttgagagaaaatgagaacacacatcacctttattacagtatgttgttataaaatattttgtttttagttatttttgttaatctttcactgtgcctaatttagaaattaaactttatcataggtgtgtatgtataaggaaaaacacagtatagataggacttggtactatctgtggcttcaggcatctgctgggggtcttggaaggtatcctctgtagataaggggcaaatacggtaattcaaaacatttaatttcatcacattagcacttatctcaaaacaacaaactatgcttctctggggcttattcttctatgattttttttttaactttgtcgcctatgtgattttttcccctgcacatgaatatatatttctttttgatttgcttttttttttgctttctgtgacttaagctatcactcttagattttaatgaacaggatttctgacaacataacaaaacagaaatcaggtttgatgggcttcagcatacatgaagtgcatatcctctctgaaaaaaattcaagcatgcaacacatctggcacgtttctgtactttgtatccgtctctcctggccaatcttgtgcatttgcgacagcaatgacattgatgaatcgctttaatttaccaggcagtggacaccttgccaaggctatctgtaagaaccagctagagctggtcctgatcatttcagatatgtgtattgtttcagaaaactgtaactgatcagatgcaatttagatgtatcattgcaccacaatcacacagaaatacatattttaataacctctggattttaatttttcttattcccttctccatttttgaaataaagataaataactatataaatatatgctaatttagttatgtggtaaaattaatcatgaaataatttggcaattttttgcattttgaagatgatttagaaattgaatttatataaatgggaattgatttttacaaaacaatattatctttatgtcatttaataagcaaggaatcattattttgacaataaaaaagttgtatcaatttttcacttaaatacttctaacctgaggtgggaaacaggcaatagaatacgtaaaatcctaaactattataagtttccgtggaaatatgcttaatggtagtctaagaaaaaataatcttgggaacattgtggagagagtagataattacatgtaatatgaagaggttatgttctcttgatgcttagagtatatgacagttatatatttttgaaaatcattcagagctaatattatatttaggtagactagatagcttgctataattatgtggtacaattacagcattaaaaaattcagcatatttacagagcacctaccatatgctaagacctgtaccaggcattttcacacataggcagtgcattagacagcatattgtattataacacacaagcaggatctggtgtcctcgaaacaaacgtcttcgcttgtcattttttgatattgatacctggaattctgatcaaacctcaaaacataaaactttcatcactattaaaatacaaattgtatctctatttcttaaaaatatatatttattctttcagggaattattacttgagtctttaataacatctaccctttggcatgaatgattactgtataatgtctgctgtaagcgagctttgacagcggaagtaggaatgagtttagatgccttgactatttgaactgatctggtacaggacaaaaactaagagccatatgataaagattgtttatttgttttgcctacattacatatcaagtgggactgatcctggctgcttttattaccactaattgaataaaacataactcatatattagataaatgaaatatttatacctaaatatctaagttattctttgttttttctttgtaatattctcagaatgactcgcatgttttcactctgtaacagtagtacaagcacatcaaattatcaaagagtaaattttgcaggctcaggtaacaaagcaagctggtgcatggaaatgatttctggggtggggatattcatgagacataatcttggggcaactctggtttaaagacacagggtcccgtatttggagaggagcgtatttagaaggggtcttcctggggccttctttccttaagaagatgtcttatttctcattagcattttaaaaaagagacctggataaaataattataatttaaaatatacttctatccattcctatcttttgtgttcttataattaattttccttccttctctttcacttcactattcatgccaccacattgaaacatttcctattgttgttagtaggagttatgtgcatagttcacaagatgaaatgttttaatagcattgcttctcttttaaaggcaagtttgggcttggctagatttaggagttgctttgaaaatgtggcttagtgtattgtttctaaatgacaatatgggaattagaacaagggaaggaacagatcacacaatttacgcacgtttattttatagtggaatttttctgttatctaaatttcaaagtgcctttttaatcccttggtactctctaccaacattggttttttaaattttgtttttccttgttttcaatgtatatctttcatattcacatttgcatgaataccttccataattatttcaaatgggaccttaatgaatacaaactctttctgatttcttttaattgaaaatttattgagtaaattatagattcatatgcagttttacatgcagagtttctgtgaaccctttgccaatttcccccagtgctaatatcttgcaaaattatagtacagtattataccctaggtatttactcaatccaccaaacagttagatttcattagttttccatgtatttatttgtatgtatatatgtgtgtgtgtgtttagttctatacagtttttcacatatataggttcacgcatccatcaccacagtcaagatgctgaacagttccagcaccacaagggttcctcctattccctttgtgtaactacactcatctcccttctgttcccccattcctaaccccatgcaatcactgatatattcctcatttctaaaattttgtagtttcaaaatgttgtataaatggaatgatacagtatgtaacctttttgattgactttgcctatgtgttttaaacaattgatatgtatttttttcactatggatttttgtcaaaagactgtaagtatgtgataaaagataatattgattttactgttatagattcagggtaaatttgtacttctttacattttagcatttatggaaattactaacccttcattatttatattgatggagggaccagagacccaattgcatggtacaaaatactacaggctatgaacaagaagtatgtgactgtgggtcagagaaatattgattgcattgatttttaacatggatgattcatgtggacattgatcattggagtgtaatatggaccaggttatctcaagggtgtcccaagtgagagacagaggtagatttggcatcagaatgtctagtagtttaccttatcttgagcctactttatgaccttaatggactgtaactgaagggaatgtgttaaatgtatacactgttaatccagtgatttcagtgaaataattttggatctagaagaaacaatataacgtaaaaaaagtctgtattgcattgaatatgacatgggtcaaagaaacttgctcattgtaggcccaaattacagaatttattttattgccttctcagtttatttgtcctatgggagaggaaataaacaaaaattaattaatattcttcacaattagacctttatgacttcaagaaggtagataatgtctttttcatctttgtatctcagtgcctagctagatagaacatgctcagtaaatatgtgtcgaataactgtagcttatgagattgggaagttgctaatgtaagtgcatattgccctagtactcttttcagtcaatattttcttcatgtgttagtaagagataggttggaatttttagcagcagtatcatacaaatctttagagattttatatttatctgtgtacagaacccagctaatcaatttgagttcattgttagagccccaattcatcagaagacggagaaaaggcagactcctgaggttgacatatgacaagggaatttctatagtttgcattttattcactttttcccaatgcccctttctattatcattgctttgtggggtgtcagtatcacctaacaaacatttgaagtgattttgaagatattgttataaaacagcagttgtaatggattactcggggtgctgcattgtacaatgaaaataggcttaagtagaaaactgctggctatctagaagtgtcttttgtggcaggaaatattttagatagtttgttcatcacctgtgtttatcgtttgctatcccagtctattataacatattttttctttcaattctctaattattataaagaaatgattacactgtggaacacacataatgattaacacatgaaacacacacgtatgttttacttcacactgatttaagatacattcgatggaagaagagatttctggcttttccacagttaatgtgtaatgtttggcatgtaatagacactcaaaacagatttttttgaataaatgagtggtagtatttgtaatttaaaactgatgcagagggatgtgccagtttcagtactgtaagggctccataaaggcaggatcataattagcctaattcttattagtatatttcttaatgactctgaattttccaagaacatcagagacttctagttcctggcttgtgtactctagcagctctcagtggtttagtgtgcaggcccttatccctctcatgtatacaacttcccaatcataagacaggcctgtaagatcctgcaaaatttggttctactctttctgcttctacccttcctgagtttaaaatgacttccttttttttttcttttttatttttgagacagttttcactccattgcccaggctggagtgcagtggcaccatcatggctaactgcagcctcagcctccatgggttcaagttatcctcccaacttggactcctgagtatttgggaccaccggtgcacaccagcatacccggctaatttttttttttttttttttttttttgtagagacaaggtttttccatgtttcccaggctggtctcagactcctgggttcaagccttctgcccaccatggcctcctaaagtgctgggattacaggcatgagccaccatgcccagcctaaagtgactttctgttacctattctaaagttaagaagaaaacaaaaatggaaaaacaagcaacctaaactataacctccactcttgagtgggacagatttctatagatctattatctcatttgagtctcatgacaacctgagaggtgggcattatattatctatttggcaattgagaaaatagaggcttatagaggctatgaaactaggctaatgtcataagtgctggaactagtctttggtcttatagcaataagattctaaagctatacagttaggttattgctggatttgtctctcctgcttttggtatagatcctacttgctctgtctgggccatctctactttttgatctattgctgttttcctcatttttgtctcttttcattccctggagattgatgctttagatatgctactggtttgataacagctttgcttcagtagtggattaaaattggccacagatgctttgctgcttctctcatcaagaagtgggatctatttttcctcctcttgaacccaggagataaacttgtgacttgctttgactaatagaatgtggtataagtaatactatatcagttatgggctttaagaggcctggcagccatcactttcactctcttggacccctaggccatcatgcaatgtggttggctaccctattagagatgctgcaaggagaatgagagagatgcctggttagctagcagttcttccacctagctcagctgaatcaccaggtgtgtgagtggggtaattttggatttcagccccaaatgagtgtgcagaaaactgcttctgcatgaatggcctatgtgagatcagcagaaaagccagccagctgagccttgctcagattgtaaaatcataagcagatacacagtcatgttaagccattaaatttgggagtgttttgttttgtagaaatagatatctgaaatacccagtgacttacacatttacttcatctccatatactgaagaccgagtgttagtttctatcatacctatgcccgtcccaagatactgggccctcaggcaaggtgaggttctagttcctctaggaaaggcaaagaaatttaagggatatggggtgttaaaattagacaagtgaagatgcagttggtataagaaaattcatatcaactatcagaaggctgcttttgcaagaggaatatagttggttttgagaattcaaggaatgggaagataaaacatgttgagaatccacatatgaataaatatatttaacttcagtgtgatgaagctttctttacaggtgcttcacaaaggggctttggctttccaccttgttgagatacgtgactgttgtggaggtgtgcttcttggtcttccttcaagaaagagcttgttcttcagctatgaggaatacagatagatgacaggtcttggctcccaaacctttagaatcctctgcaggattcaagctaaggtcatacttttccagatcatctcccagccaatgactgagcatgatggggtactagggacctgaccatttcttccaatgtaggattcacttgaccagttgtctttttggcagagtgccacatgggttagtcaagacagtgtggaatttttattgcattccctgcattgttctccatgtccaattcttcttaccctcttttttccccccacaaatgtcagatctgccttgtggtctgaaggctttctctgcataaccctttttcattcccctttacctttcctggtgttactcccagcaatctcgtacttctaactctggctcagcatctgcttctgagcaaggtacagttgagagaactaaaatggcaaatctatcagattaatatgatctgtagtttgtttgcttttaggtagagttggataatcattttacaacaattctaagaaaacttagtgtgttttactgcatgagatgccttttgaagtagagaagacatctgtctaaatcaccaactttatactttgggaaatctgtgttttttgccgaattgcaaaattgcattcgtcttatagtccttaaaatttattttacttcctaatatttgtaactacacagagtcatttgaatctgctaaacatagcacaaaaggtggatatacatcagtatttagtaaaagacatctatttaaattaagcaccttgcaacatgtattcagctatgaggaattttccgagcaagtagcattaacattgaaaattattatagagcttatggggggaggagccaagatggccgaataggaacagctctggtctacagctcccagcgtgagcgacgcagaagatgggtgatttctgcattttcgtctgaggtactgggttcatctcactagggagtgccagacagtgggcgcaagtcaatgggtgcgcgcaccatgcacgagccgaagcagggcgaggcattgcctcactcgggaagcgcaaagagtcagggagttccctttcctagtcaaagaaaggggtgacagatggcacctggaaaatcgggtcacttccacccgaatacagcgcttttccgacgggcttaaaaaacgccgcaccaggagattatatcccgcacctggctcggagggtcctacgcccatggagtctcactgattgctagcacagcagtctgagatcaaactgcaaggtggcagcgaggcttggggaggggcgcccgccattgcccaggcttgcttaggtaaacagagcagccgggaagctccaactgggtggagcccaccacagctcaaggaggcctgcctgcctctggaggctccacctctgggggcagggcacacacaaacaaaaagaccgcagtaacctctgcagacttaaatgtccctgtctgacagctttgaagagagcagtgtttctcccagcacgcagctggagatctgagaacgggcagactgcctcctcaagtgggtccctgacccctgacccccgagcagcctaactgggaggcaccccccagcaggggcagactgacacctcacagggctgggtactccaacagacctgcagctgagggtcctgtcagatagaaggaaaactaaaacagaaaggacatccacaccaaaaacccatctgtatatcaccatcatcaaagaccaaaagtagataaaaccaccaagatggggaaaaaacagagcagaaaaactggaaactctaaaacgcagagcgcctctcctcctccaaaggaacataattcatcaccagcaacggaacaaagctggacggagaatgactttgacgagctgagagaagaaggcttcagatgatcaaattactccgagctacaggaggaaattcaaaccaaaggcaaagaagttgaaaactttgagaaaagtttagaagaatgtataactagaataaccaatacagagaagtgcttaaaggagctgatggagctgaagaccaaggctcgagaactacgtgaagaatgcagaagcctcaggagccgatgcgatcaactggaagaaagggtatcagcgatggaagatgaagtgaatgaaatgaagcaagaagggaactttagagaaaaaagaataaaaagaaacgagcaaagcctccaagaaatatgggactacgtgtaaagacgaaatctacgtctgattggtgtaactgaaagtgatggggagaatggaaccaagttggaaaacactctgcaggatgtcatccaggagaacttccccaatctagcaaggcaggccaacattcagattcagaaatacagagaacgccacaaagctactcctcgagaagagcaactccaagacacataattgtcagattcattgaagttgaaatgaaggaaaatatgttaagggcagccagagagaaaggtcgggttacccacaaagggaagcccatcagactgacagcagatctctcagcagaaattctacaagccagaagagagtgggggccaatattcaacattcttaaagaaaagaattttcaacccagaatttcatatccagccaaactaagctttataagtgagggagaaataaaatactttacagacaagcaaatgctgagagattttgtcaccacgaggcctgccctaaaagtgctcctgaaggaagtgccaaacatggaaaggaacaactgataccagccgctgcaaaatcatgccaaaatgtaaagaccatcgagactaggaagaaactgcatgaactaatgagcaaaataaccagctaacatcataatgacaggatcaaattcacacataacaatattacctttaaatgtaactggactaaatgctccaattaaaagacacagactggcaaattggataaagagtcatgacccatcagtgtgctgtattcaggaaacccatctcacatgcagagacacacgtaggctcaaaataaaaggatagaggaagatctacgaagcaaatggaaaacaaaaaaaggcaggggttgcaatcctagtctctgataaaacagactttaaaccaacaaagatcaaaagagacaaagaaggccattacataatgggaaagggatcaattcaacaagaagagctaactatcctaaatatatatgcacccaaaataggagcacccagattcataaggcaagtcctgagcgacctacaaagagacttagactcccacacaataataatgggagactttaacaccccactgtcaacattagacagatcaacgagacagaaagttagcaaggatatccaggagttggactcagctctgcaccaagcggacctaatagacatctacagaactctccaccccatatcaacagaatatacatttttttcagcaccacaccacacctattccaaaattgaccacatacttggaagtaaagctctcctcagcaaatgtaaaagaacagaaattataacaaactgtctctcagaccacagtgcaatcaaactagaactcaggatgaagaaactcactcaaaaccgctcaactacatggaaactgaacaacctgctcctgaatgactactgggtatataacgaaatgaaggcagaaataaagatgttctttgaaaccaacgagaacaaagacacaacataccagaatctctgggatgcattcaaagcagtgtgtagagggaaatttatagcactaaatgcccacaagaggaagcaggaaagatccaaaattgacaccctaacatcacaattaaaagaaccagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccaatcccacagaaatacaaactaccatcagagaatactacaaacacctctacgcaaataaaccagaaaatctagaagaaatggataaattccttgacacatacactctcccaagactaaaccaggaagaagttgaatctctgaatagaccaataacaggatctgaaattgtggcaataaacaataccttaccaaccaaaaagagtccaggaacagatggattcacagctgaattctaccagaggtacaaggaggaactgataccattccttctgaaactattccaatcaacagaaaaagagggaatcctccctaactcattttatgaggccagcatcatcctgatagcaaagccgggcagagacacaaccaaaaaagacaattttagaccaatatccttgatgaacattgatgcaaaaatcctcaataaaatactggcaaactgaatccaacagcacatcaaaaagcttatccaccatgatcaagtgggttcatccctgggatgcaaggatggttcaatatacgcaaatcaataaatgtaatccagcatataaacagaaccaaagacaaaaaccacatgattatctcaatagatgcggaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcacgactcctattcaacatagtgttggaagttctggccagggcaatcaggcaggagaaggaaataaagggtattcaattaggaaaagaggaagtcaaattgtccctgtttgcagatgacatgattgtatgtctagaaaactccattgtcttagcccaaaatctccttaagctgctaagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcttgaaaatggccattctgcccaaggtaatttatagattcaatgccatccccatcaagctaccactgactttcttcacagaattggaaaaaactactttaaagttcctatgaaaccaaaaaagagcccacatcgccaagtcaatcctaatccaaaagaacaaagctggaggcatcacactacctgacttcaaactatactacaaggctacagtaaccaaaacagcatggtaccggtaccaaaacagagatgtagatcaatggaacagaacagagccctcagaaataatgccgcatatctacaactatctgatctttgacaaacctgacaaaaacaagcaatggggaaaggattccctatttaataaatggtgctaggaaaactggctagccatatgtagaaagctgaaactggatcccttccttacaccttatacagaaatcaattcaagatggattaaagacttaaatgttagacctaaaaccataaaaaccctagaagaaaacctaggcagtaccattcaggacataggcatgggcaaggacttcatgtctaaaacaccaaaagcaatggcaagaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaccacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacactttgacactgttggtgggactgtaagctagttcaaccattgtggaagtcagtgtggcgattcctcagggatctagaactagaaataccatttgacccagccatcccattactgggtatatacccaaaggactataaatcatgctgctataaagagacatgacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacacggatgaaattggaaatcatcattctcagtaaactatcacaagaacaaaaaacccaacaccgcatattctcactcataggtgggaattgaacaatgagaacacatggacacaggaaggggaacatcacactctggggactgttgtggggtggggaaagtggggagggatagcatggggagatatacctaacgctagatgatgagttagtgggtgcagcacaccagcatggcacatgtatacatatgtaactaacctgcacattgtgcacatgtaccctaaaacttaaagtataataataataaattaaaaaaaaaaaacaaaacaaactggccttatgaaccttagaccaatcttgagggtataaaagccttcgcagtgaagtggccataaaaaaaaaaaaaagagaaaattattatagaaaaagcagtagaaatcatggtgctgtttattatcatttgaaaagtatttttttattttgttctattaatatgtttcaatatgaatgatgcactgagatcttggataattagcacataacaacataaataataaaaatcatttattggacacaattaaattatgcctttcttacatacgttgtttctattaaaatgtgctgaaatttacttcttaatcttgagatgtaataaagtgttttaaggttacttttaaaaataaacatttaaaaaatgttgtgcttatatgatatcaatggaaaacaaatacttttgaggtttgaaattttaaatccgaaaataataatattaggcagcctttgtatttccagacctcttgtatttatacagggggatctagggcaaaaataattgctgaaatttaacatttatctgggtgggcctctgcgtacctcagcctctcttattcttttttttttttttcttttgagatggtgtctcgctcttgtcacccaggctggagtgtgatggcatgatctcagctcactgcaaagttttgctccctagctcaagcaattctcctacctcagcctcccaaatagctgggattacaggtgcccgccaccacgcccagctaatttttgtatttttagtagagatgaggtttcactacgttggccaggctggtcttggcctcctgacctcagatgatccgcccgccttggcctcccaaagtgctaggattacaggcttgagcgactgcgcctggcccaacctttcttattcttttgaaaatgcttctggagtccattgatacattctgtgagacctggtgggaagaaataggcctcaaggcacactgagtttttgagttgccctctacatttttcaagctgatcattattgagtccctattatctgacagatactctgctaagttatttatttaaattatctcattaaacattatcacaatcatattagatggggactgttattatttccatcttatacacaataaatttgaggcatagagaggttaaatttgagcagtgtcactgtaactcacttttaaaaactgtgtgataattaaatggcagtccttagttttaacccagttatggctggctgtaagttccatcccgtcatgaccattatgtttcctcaacttttctattttcctacttcctttgctctgctctcagtcactgggagacgaaagtgctgctggttagcacagaagaaactgctgctgctgcggcttctactgttgtctgccatctctgttaccatcgagaccggggctgtgtatgctcgaggtgcagggagctaatgtataaggagttaaatgaactcttgctgctgccaaatatgttgttatcactaactgcaccgctgctgtcattagtgctgctgccaacactgcaagccctgctgctgccagtgccaattctgctgatgccttgggctctccatgtcccagggtgattccatagacaagcagctgcttttagatttcacttgctcattacctgtagatcctttgccttaggactcaagcttaagcccatgaagcctgggatagaagacaattggaggtatgttttatcttctctagcatctgggacaactggccttgaaccaaacatgtgcacctcgtttttcttttcccttcttcctctgagatttcttttcccataggctcttatttcatgcaatgatccactagccctggaaacaggaacataaacactcgaaccctagaatgaacataatttagtcttaactacattagatattttagtttgaaagaaatcactcacatttcataatcctgaaacatataaatttatacttagttatctgtgcaaaaattgaatcatgataattattaaagaattactatgcaagtgtaaatagctttggtattaaccaagagtggtttcagtgtgcttttgtaaaaaaaaaaatactagagttcaaaaattcaggtctatatttgaagctctgtcaataattcatatacctcatatcaaaaagcttaccaagggacaagatgattttgttagtgggagtggtttactttttacttttgcttccaaccctaactcagaagaagggcaatagtctatcaaacctggaaaataagaaaacagcattcaaatttacaaagctctatttactaaaaacatgcaaaataagtaatttttttttgagagagtgtctcattgtgtctcccaggctggaatgcagtggcatgatcatggcttactgcagccttgacctcccaggctcaagacatcctcccaccttagtgcccccaagtagctgggacttcagatgcatgccacgatgcttggctaatttttaattttttgtagagatgttgctcacgctgctcttgaactcttgagctcaagcagtcctcccgctgtggcctcgcaaaatgttgggatgacagccgtaagccactgcgcctggctaaaataaagaatttttaactggaggaaaagaatcttatgttgttgaattctttattgtcttaactgaaagcaaaagcctgtttgaacttttttcttaatcgagaaaagcatatgaggagaaaagagctctaagttctatgccagatgcttacaaaacaaattgtttaccagtagtttagtgggacagggggtgggggtaaaagaaaaagttgtattaaaatcttgatgaagatattctgcatcaaggactattttatttttcttaagggcgaaacaatctgttttcttatttgaggccagtgaaagtttatatttctattccacctgggataataacaattgagagttttgtgttttattttccctaattgagaatatggggattggtaaataatatggtaagtaatttgcatttagaataaggtgaggttcttggttttccaaattattgatttgtggagtgaatttgcatctaggactctaattttttttttcagtaaatttcatgagaaatgttattgtttttaggaatgtaattttattaaaaaatttgcgggaattttgggatgtatttatatttaaagttatcataacatgttagatgttgtcatactgtgtgtgtatatgtgtatcctatatgtgtgtatgtgtgtatatttagcacgcatttttctttttatttgattaggttttcttaattttaaagttggaatgaaagaaaaatgtgttagtatatgattcataaaaaacaaaccagtgatggtactgtgtttaaacatctcaatatggatatgggttttgttatattttgcgagctacatgccagagtatattgtaaagaagtctatttataggtaaaataaagatgagaaagcagtgcagagagaaatcaaatataattgtcttacatttctgattctccttcatttttagtttttaatgggaatttctgtcttttatctgcatgaagatgctaatgttctcttaatgtacttaaaattgtagagtaagaatttcgaaatttgtaggaagacaaatggcatttataaatattagagtttatgagtacttaatatcccctctgtcatctgcatttaatgttttcgtttccttttaacagtatgtgtaagaactttctgtgctgtgcttagagtttttttcctagataaatgtttttcttatgctgtaaacctgtttaaggagatgagatttgaaagtagttgaattcagagctcttacttgagcagagtgtttctcaatagcttttccaagaaaattttaaaagattaaaatcaattttaatctttgtcgtataggccacagaaacttccattcatacatccttagaaaattaaaacaaggcaaaataacaatttgggaaataatcaattaaaaccataactatatgggaagtctttggaaatggaaggcccacaacctacctatatatgaagccagtgttgtctgaactgaattctaccgtagggtggactttttcttaacgtctgaatttatgaacctgtgaaagaggaacgttaaattgaaaataacgacaacatcttaattatggtgattttactgaaagactactaccataataagatgtattctaggtttccagagtagtggcagctgtcaaacaccaacatttctccctgagaataggtttagtgtagtgtgtttttcaaggacaagttgctcagtgagccctgctagttaatattcaacagttttcttaatcaaaattgtggtcttgctccctagagtgtttgtgaaaatgattgtatgtttatccgagccttcaacagcagaaagagaattcttgggctaggtgctggtaatgagaacctatattaatcccagggtgctgataagaaaaggaaaatcctgtcagaatacattgtttgtaaaaaaatgattactgtagctcaaaaagtcaaaccttttttttgaagcccttgtaccttatataacttcagttgtttatctgggataatggggaggtaggggtatggtgatgtccagcaatccactccaggaatggtattttagtgatcgagtagtctggggttctgttaatcattgcttctgttgcataccttattaagggtcctcacatgattcctttagattacaagaaggtcttaatgaagtaaagcttgtgaggtattagagagctcagtctggcattgtacaaatggtattgaagactcacataggaaaaacaagcttgccaaataaaataatgcaacagctaacattttctatgaaatattttgcttaggatgcaggttttgttagtgcttttgtttttaaccctaaactgttttctactgtcaggtgatactgcccttgaaacagagctgtcctggttgaatgtgacttttttctgccgtgggtacctatcacttccttctcacaccccctcaactcgtgcgcacatacacacacatacatctgaaagaatcaagatgaacagtttgaacaatatgatctctgtaatactataaagaacatttacttttggattttgttttgttttgtctgtaatggagctctataggaattaaatcttctgaaaacagtctttttaaaatattagcttggtggatttcttctagcattaatttttttttttttgagacagagtctcactttgttgcccaggctgcagtgcaatggcatgatctcggctcattgcaatctccatctcccaggttcaagcgattctccttcctcagccttctgagtagctgggattacaggcatctgccaccacacccagctaatttttgtatttttagtagagacggggttttaccatgttggccaggctggttccgaactcctgaccgcaggtgatccgcctgcctgggcctcccaaagtgttgggacaggtgtgagccaccgtgcccagccagaaagttttagtcaataacaaaaacacattttttgagtagttgtttaacatgattaaaagcacacttggactttaattaggaaacaataaacatacatcccataggagttaatctttgtaaacaacaccaattttgaaggctacagtcagttatattgatcacttcagtgatactgagacatatactgcactttatgcattgatctttgacatagaaagatcagcacgttaatgtaaaaaattgccactatgtatttgaaatttaagccctactattagctaatattcaaaataactcatttacttgatactgtaatgtgtagtcaactgatttttccttttaaatagattgatctgttatatatatattagaggcagagtctcactctgtcacttaggctggagagcagtggtacaattatggttcactgcagcttccaactcctgggcacaaacagtcctcctgccttagccaccactatgctcagctaattatttttaatttttttttgtaaatgtgggctcttgcattgttgctcagtctaatctcgaacgcctggtctcaagtgactcctgcttcagcctcccaaagtactgggattataggcacgatcctgcacctgccccaattctgtatttttatttgttcttagttgtagcttgtaattatttccaaatgtgaatcataatcagattgattcaataccaagttttagaagaattgtgtatcaactagtccactttgaagaggaaaaccacatagtaggttaaactagtgagtttaatttaaaaatattattaaagtatgacaaaagagtaacttctctctaagatatagagaaacctaagtggtaccctgaagctaaaggagtgtaaccaaagaatgacaaacttggaagaggatcagatcttaaagagaaggtgtaattcatctcactggagagcagagaagttttcgagtttggctgagcatccagagatggcccatagtcatggggcaagctggcggccagtagaatagtcggcatggataaccaaaccagtggctatgtttcagaggacatgagcaccctccagggaagagtatggggcctgtagtggactcagtaggactcaggaggactgccagaggggagggggcttcaggtagatggcccatagccctacagagggaattctgactctgatgggcatttctttctggagaaggccttgggaagattgtctctagcttgagactgcaagattggcaagcaaccacacgttcttataccctgcatggcttggcagggctacactgaatgtcctcacacctctacccaaatcactgactcctgtgtcaccagaagtcatggaagagccccttcctcctgcagtgtccctccagcttcctctactgggaacactcagcatcacacccattgtaaagaagaaatacttaaaagaattctatctatgatcataggacatatatttgtggaaaagtgcatttggagctgggaggcaattaattcataactagcacacattgccttacatttaggtgctggttatagctaatattgtggcaaaaatgacaactctaaatgccgtaagaatgtcatgttgctttcaggtgcccaattttagccccttggacttgtccatctggattagtcacattatcctagttttcagtagctgatcttaggcctgtgcttatttttcaccatatccttcaaagacaccacctatagctctctgcagtgggaatgaaagcctgtctacatataccactgtaaatatgctcaaattctttgagtgtttgagcagctttagtcaaaggaattcatggtgtatcaatagactctattctaattaaaaccatttaaatcacttttataagcaagtgaggaaactgtttagccccagagtgtgcactagtaatagcacatagttcatttcacaaagctaaagagcaatattgatgatagggcactaaggagcatgcgagtgcatagatcaatttgttactagtcagtcattgtttttctctgttattagtacaaccactattgtggtttaggtgagaaaatgttattagtgactgctttctggtgctttataggtgctatcatttactttcatgttcatatactgttgtaatcatgtatgaatgagttgccaactattatatattatgtatacgtaagagacaggtaaagaggtgcatgccggtatcaaatatgatatttacaaagatacatattaataattcctagataatggtggtttattatgaacgacagtaacagctagatggtaaatcattcacaatatttatgtctattgttgctttaacataggaattaccaatggcaatcacattttattttcctagcagccagaacacttttgttatacatcatttattctttcttaaaagaaaaaaaatcctttctagaaacactgttattcctttgacaatttgctttggatttgtaatctttccttagggtgttatttttttttctttagggaaaagaaggaaagggatacacgtggttaaaaaaatgccaacatgaataaatccaacagataaattgttagcaattacatttttaagagtgttgcaggagcattaacattgagaaactaatacttaagtacaaatggtttaattgtaatatggaaaataggtgatgctataaaaactattatgattcatatctataaaattagtaatggaatgattataggacaagaaatatgctttggtatgaaattgtattctaagaatcttctatcatcaaatctagttagttaaatctactaaccctgaatttaagatctgtgaatgaatttacctttatctaccatgaaaataacaaagcataggctgggcgcagtggctcccacctataatcccagcacttttggaagccgaggtgggcagatcacttgaggtcaggagttcaagaccagcctggccaacatggtgaaatccggtcttactaaaaataaaaaaaattagctgggcatggtggtgcatgcctgtaatcccagttacttgggaggttgaggcaggagaatcatctgagcatgggagacggagcttgcagtgagccgagattgtgccagtgcactctagcctgggctacagagcaagactccgtctcaaaaagaaaagaaaagaaaagaacaaagcataaatgtagtggacctaggagtactcttaggcactattcccaatgttaaggaacttaaaatctgtagcttttaaactgttgatattttttatactatagtacgaagaaatgtacaaaataattgagtcaaaagtatacaatttatttagaacaaaaaagcatatgaaaaggatgatgataataaatgagtgtattgaagagataataaaatgatggacaagaacatgaacctagtgaacaatgtagtaagctatcagttagcagataaccacaaaatgcatcatttccatggctctgtgaaaactaagcttacaaaaatgatttttcccctttggttataaggataacaattaattatagagcacgtttattgagtgtccactaggtatgtgactgatatgcacacaattagttgtttttactgatcgtttcactaagatacaaattattcaggacctgttgtaagttttaaatacaagttcaaacaccacaagggacttgcacaaggtcatacagccaaaagtaatgaacagagatacaaatcttagattgcacatcctcaaagcccaggccctttctactacatagtgtggcttctaaaaattaaaaatagtgaaactgcttggttcttgatgtgctggggacttgataatttcataaattccatgtggaatttaaagactgaatattcagctagttgatctctctctcttttctctctctctctttttttttttttttttttaaaataggatcttggtctcttgtccaggctgaagtgtagtggtgtggtcatagctcactgcagcttcaaactcctgggctgaagtaatccttctgcctcagcctcccaagcagctaggactacaagtgcacatcactatgccagtcctgtttttatttacttatttatttatttactatttttttgagatggagtctcgctctgttgcccaggctggaatgcagtgggacaatctagactcactgcaacctccgtctcccgggttcaagcaattctcctgcttcagcctcctgagtagctgggattacaggagcgtgccaccatgctcagctaatttttgtatttttagtagagatggggtttcaccatgttggtcaggctggtcttgaactcctgacctcatgattcacctgcctcagcctcccagagtgttgggattacaggtgtgagccactgctcccggccatgtttttattttttattttggggaggtggggggtcttgctttgttgcccaggctagtcttgaactcctggcctcaaacaatcctacagtctcaacctcccaaagcgctggggttacagacatgtgccaccatatcagccctcagctggtaatttccattacatatatagtcacttgactttcattatgtttttccctaaagtgcatacacaggtgaaaacgaaaatgtgacataaataagcagggtgaatatattataattttttaaaaaattattacttctcttacaagtgggaacctttttttttttcgctgttgtagcattcactggtattttcctgttaacctcttggtacacataacaaaaattaagtgtgtttatttcaacgttatgacttatttatagattcttattaaactttgcttcttaactagaatagaaatgaaaataattatcacaatagtgaataatcccttttgttttctgttatctcattataccaatgaatattttgagtattttgaggattatttatcatacttttccaattagaaaacgagtttcttaaagattgtattattttctcttaatgagagaggctgcacacagaggttatttaacagatattgtaggttaaacatctgactattgtgagtggagagaaaattatgagatagagttttgctaaatgtaacaagtaagatgcttaatggactcatggagtttctaaacttggcaagatgagtctgttttaataggcaaatttaccagtttagaataagaaatattacattctcatcagtaagtgccctgacaaatggtccagcattagaaacatttatcaattgttttaataaggaactgttgtgatattatcaggcagaggttaaatgctttgctagaaagacctatgtattagtctgttctcacaatgccataaaaaaatacctgagactgggtaatttataaaggaaagaggtttaattgactcacagctccacatggctggggaggcctcaggaaacttataattatggcagaaggggaaggggaagcaaggaccttcttcacgtggtggcaggagagagaagtgaggatgcaggaaaagctgccatttataaaaccatcagatctcatgagagttcactcactattatgagaacagcatggggaaaccgcccccataatccagtcacttcctaccaggtctctccttcaacacctggggattacaattcagaatgagatttgcgtggggacacaaagcctaaccatatcagtctaaaaatgtatatgtcataaaaattgcttagaaatatgtttagaggtatcatagacaggtgaatagaaaatgagctttagagtcacacgaccttggtttgaattccagctctgtcattagctctgtgaatttagccacagagtaatctcattaagatgtttcttcacttacaaaataaaaataatactatctcttcatgtaaggtttttatgaggattaactgtagtaatgaataaaaaagtaactggcatcaaaacgatgcacaacaaatgtagcttcttttaatttgaaatattaaagtgatatatttgatgctgattattgtatgtactggagattatatttttctgaatttttagaaagaaaaatcaagggaattttaaacatcatgaaaggcctacttgttcacacagtttttaaattgtgaatgacatttaaaaaataattttcattatgtttttaggctaaatatgtccaatgctttatagctcttgaaaaaatttagcctgatttttgttgctgttcttttgtggtgtaattagtgtcctcagctgaaacaaggtgctggtagctgaccccttctctaaggtcatggtaggatctttaggcttccttcttataagtcacagaggtcaggaaaaagacattattgttgggttggacttatcgcatgctcttataacagcccattgttagtgtagaattaactacagagtttttatttcttatgtcttgtaaaaatcagagcacttttgtaaaaatgacgattgaacatcaaggtaacctttatgttatatttccaaatgggtacatggatctatatatgaagaatttttagttgaaacagtttatagtgtttctgtttttggctctataactgacttccttcagaccaacttcatatactctctccttcaccttctggtgtttgtgaaacaaagggtgaaaaggacaagtgcagtgatgatttttagctcaaaatgttgggcttttctatctaatttagttgtccaagaacacattataaaatatttgcaaccacaaggaatctaatagcctaagaaaagtgaaaaaaaagcagccttttgtgtgtttgttttctccttagggaataactataaatggaaattagagataagatagttaatattgttctgtaaatattcagtcatcctgaaatagtcacgcctgtcataggagggagaattattatttactaggattacaagccagttgatcaactgacatcctgtggctaattgtggattggtatttcaaagataatgtagtctttattaagcatctgcaattttatagttacatttcacacattaccattttgatttttagcaacattttgtccttaaaaataatgtgtatgtgtgtgtgtgtattcctcattttacacatgaggtaattaaggttcagacaagtcaaacttttttcaaggtcgtacagttaaaaagtggcaaaatcaaatttcaaccctgtttggtttgattggtttgttaacatgtgcctttgtttctgtacttatcatttttagtgccttgctgactaaaatacaaagtttactcatttttatacaattcctcttatttttaggagatacaaataaaaacactgtagttaattctcaactaacaatggactactataagagcatgtagtaaacccagtccaacaagaatggcttttgtcggaactctttttctcctgttctcagtaaaaatttattgcttgaaatgtttattgagtctctgctggtgcttggtattctatttcactgctgggtacagcaatgaaaacagatggatgcaatccctgctttcataaagcatactttctaattcccaacatatgtacctatgataaagtttaatatataaattaggcccagtaagagattaacaataactaataataaaatagaacaattataacatctatgtaagaagttatgtgaatgtggtctatttctttctttcaaaatatcttattgtactgttgatcttagctaacctcactatagggtttttttttctttctttattaggttgagaactttcaccttttcacttaaaggaaacactttgcggcttctctttgacatatccaaatggccagcatcacgggggccattattaagtaaaaaaaaggttctttgaacacaagcacagttgatatgataacctactcagctacaaaatgactaaagggcaggtagcgcctacagcatgaatctgttggacaaagggatgattcacatgaggaacaaagcaggatactgtgagatttcatcatgctcctcagaatggcatataatttaaaactaatgaattgtttatttatggaatattcaagttaatatttttagattgccattggcagcgagtgactgaaactgtggaaagcaaaactgcagctccatcccatagcaaacattaggcataaaatctttatcaaattcttatctcgtacagagttgaggacaggtaaaagggaacttgtcgtagttgttgatacatcctggttgctatgtgaataataattcacaacaatatcggaataatatagatagaaaatataacaagaaaatatattgaagaaaacttgttgtgagaaatgcagtgaatattaaagtgactgacttttcacaccatcagattttattttaaagcataattttccatagaattaaactaatcagttaatgtaaacatgggatttttagtttgaaaactgagaaagtattacagatcatttaaaattagtactgctactttgaatttggaaaacatgtttctataccaagagagaatggaagcgaccatcttagtataatgtaaatccagactaaacgtataattaggaatatataataaattacgtatttatagggagatatctgggctattaaatgaattctacagttattttaatatatagtcagttttatatatattatatatgaattcctcctttgcacttcttttatttttagactagctggttcttatttatggttttttttgaaaaaagcatttttgatctgatctttagaatgaagcaatttcccaacctgtagtgaaagatattatttaccataaattttccagtattgccaatatatcttttttgggtcaaaaaatacgacagagacaaaatttaaaaattatttcagctgtctacattcattaaataaaatactggcaggagttgtatattatattagtttgaataagttgggcaaatatatttagctatttctttgattagatttataggtttcaaagttctatatatgcatgtgttgaaaataaaacacatggtaaattggtaaaggactttagaaacaagtacatataacactggcagaaggaccttgtctctcttgcataccattgttttcctagggcgtgtcacacaacaggtccttaataaatatgtattgaatgaatgtattaaattataaaagtaatgatgaaaagctggacataaaaaatttctgatgataacttcacatgcattagcaggttcttaatgtcacttgactgtattccttgcttctggcttcctaagtgggttttgctttgctggtcctgtactacagaccctgcctctgaatcatgacacattttgtcagtaatgtacacatcagtatgtagagagcttcaaaagcttgggcacttaacactaaccttctgctcaggtccttaggtaaatgttgggtatgcgccaccattaaataccctgtaactctccgatgctacttctctgctacatcttgtattctaccaaggtctagaggagggtggatttaaatgatcaattttcttagcattgactgatttatgtgtagaattttagatttttttttttttttgagacggtttctcactctgttgcccaggctggagtgcagtggtgtgatcaccgttcactgaagcctcgaccttctaggcttaagcgatcctcccacttcaccctttcaagtagctgggaccacaggtgcacgccatcacagtcagctaatttttgtgttttttttgtagagacagggtttcaccatgttgcccaggctgatctcaaactcctaatctcagacgatccgccttggcttcctagaagtgctgggattacatgcatgagccacaatgcctggccagaatttttaaaatcttaattatttttgttgagtcatagactgcagtagcaaatgtctagattataattacaggaaaataaaatcatttgtggcaaagacatggcatacttctttttaattcctcaaatagtactgtattccacagccctactcgtatataacccaccagacaagaaagctgatctgtgtaacaacttgaacttcttacttgccatgtttaaaaagggaagaccatcgactagagacaggggtggctacctttagagattactaattttgtcaatgcaaagcttgctaggataacagttgataatatcaaattgcttattaatagttttatcaggatgtaatttacatgttaaacaagtcaaccatttaaagtatacagttcaatgattttttagtatattcacagaattgtgcaactcagagtaaattttaaaccattttcattacccccaaaagaaatgcaattcttattagcaatcacccacaatattctccactctctcccagccctgagcaactactaatatattttctgtctctatagatttacttattctgaacacttcatataaatagaacatacaatatgtggtcttttgtgactggctcctttcacttagcataatgttttcaaggtgcatccatgttgtagcatgtatcagtactttattccttttattgctgaataatattccattgtatggatctaccacatgtatttttttattgatccattgatgaacatttgagttattttcactttttggttattatgaataatgctgctatgaacattcatgcgcaactgccaacatgtttttcaacacacttgcaccattttatatttccatcagcaatgcaggacgattccagtttctctaccatctggagaacacttattaatatcaatctccattattataaccatcctagtgggcataaagtggtgcctcattgtgggtttgatttgcatttccttaatggctaattatgttgagcatcttttcatgtccttggggtcatttatatatcttctttgcataaatatcgatttagattctttgccttttttaaaaaaattgggttgtatttttgagttgagaggtccttaaaatattatagataatttgttattagatctatggtttgcgaatattttcttccattctctgggcttttaccttcctgatggtatcttttgcagaacaaagttggtaattttgatgaagtctaatttatttatatgcttacttttgcttatacatttggcattgtatctaagaaggttttgtttaactcaaagttgttaagatttactcccattttcttctaagacttttatagctttagcacttacatttgggcttaagatctattttgattcactttttgtgtagagtgcaggaaaagaagttaaacttcattgttttgtccctgggtctgggaccatctgatgaaaagacaattctttcctccattgattttccctctcacccttgttaaaaatcacctgaccaaaaatataagggctatctgtactcttggttctgttccactgctttatatatctgtccttatgccagtatcacagtgtcatgattactgtagtttggtagtaagttttgaaattggaaactgtgtgttcactaactttgttccctttttcaaaattgttttggctattgtggcttcattttcatatgaaatttagcagcagcttatcaatttctgcaattttaaaaaggcagttgggattttgacaaggattgtgttgaatctgtatcagtttggggtgatttgtcatctttgtaataacacgtgttctaatcaatgaccatcaaatgtcttcaatttctttcaataatgttctgtcattttcagagtacaagtattgcactttttattaaacttattcctagagattttttcttgtgaatgctactgtaaatggaggactattttcttaactcatttttagattattttctactgtatagagatacaattgattttggtgtattcatcttgtatctgtcaaccttatcaaacttgtttattagttgcaatagtttatttttgtttgtgtatgtgtatgtgtgttccttaggaattattaaaaatataagatcataagatcattccctttgcaaatagaggtacatttatttctttttttctaatctggattcctttattttatttaagtgttataaatttttactttttgcctacttgtgctggctagaatgttcggtataataatgaataaatatgatgatattgaacagtcttatttttttctaattttagatgtgaaagcatttggatttttaccagtaggtataatgatagccagggatttttctacacatccttatcaggttgaggagatgttcttactagtttgctgagagtttttatcatgaaagttgtgttggaatttgtcccatgctgtttctgcatctataacagaaacatgtgctttttgttctttagtcgattgatatggtatattatattgattaatttttggacattaaaccagcattagatttctggaaaaattccacttcctcatggtgtatgacctttttattatgttgctggatgtttgctagtattttgttgaggattttatatataaaataataaaagacattgttcttttctttattataggtgtatttagagttttctatttactctgagtcaattttggtagtttacatctttttaggaatttctccatttcttctaagttatgatctgttggaatgcagttgttcatagtattccttttaattcttttatttctgtgaggtttgtagtgatcttttattatttcaaaaataatttgagtcttttctcatttttcttgcttgttctttttaaaggtttgattttgttgatttactgtattgtttttctatgttttatttcagccgtttgtgctgtaatctttattattttcttaattctgctggcttttaagtttcatttggtcttctttggtcagtgtcttaaggtgaaagataatgttattgatgtgagatgcttctttttaaatacaggttgagtatcccgtatctgaaatgcatggaattagaagtgctttggatttcagattttttttagaatttggaattcttgaattatacaggttgagcaacccaaatccaaaaatttgaaatccaaaagtgctccgatgagcatttcttttgagcatcatgtttttgcataaaaactttcagattctggagcatattgtattttcagatttgagatgctcaacctatatatgtttatggatagttatagctctaagcattgcttaagttgcatctcacaagttttattttcttcttcattaatctcaaagtatttccaatttctcttttgatttatttttcttttttaacacattggtaatataagaacgtgttttttactatttatatatttgtaaattttccaattttttattttaagatttttaatttttgtgggtacatatatttaagggatacatgaggtattttgacacaggcatgtaattcataataatcacatcatggaaaatggtacatctatcctctcaagcatttatcctttgtgttacaaaaatccacttatattattttagttatttttaaatgttcaattaaattattattgattatagtgcccctgttgtgttatcaaatactaggccaattttccaaattaaaaaaattaatttttaatgttattcctttgtggctggagaacatatttttgtattatttcattttttcaattgttcaatgtgtctatttctactaacttttaaattttcataatatattttgtctgatattaatatagccatttttgcattcctgtcatttttatttttatggtatagttttactttcttcgtttttgcatcttggaatctaaaatgtggctcctgtagaaggcatactttgaattttgttgtttttatttagtctgacaatctctttttgattggattatttaatacattcatgtttcatataattggtgatatggttggatttgtcatttaactttttgtttggtgtcattttttctccactacagcttttttcccagccaattcctttgtgctattataaatatgttacatttctatatgtcataggcccaacaatataattatgtacatattattgtaaaaaatagcttttaaaatcagttaagaaaaggaatggaaagaaatgtgcaattgtatgtcatactttctaatatgattacctttactgaaattttaatttttagtgggtttcaaattattgttgggtgtcacttgctttcagcttgaagaatttttttagtatttcttgagaagtagatgtgctagcaatgaattctgtttttgttaattaaagaatgtttttattcaacaacatttttgaaagattgtttcaatatgaaatacttgattgagatttttttcctttcaactttgaatatgtgatcccactgccttatattctacattatttttggtgaaaactcagctgttattgttattggggttccttaatatgtgacaaaccatttttctcttgatgctttcaagattttccttagtcttattgttgttgttcacttgtttatctgtttagtgactttgctcaacaactttggtgaagtccatttccccaatgggattcaatctctgatattgttcctaagaggcacaaccgtgggcatgcacacactctggtctttgttctccatcaacttctcaagagatgacagtggattttagttagtctctttttgattgtctctttctttcttctccctattaaatttctagctagtctgcatctactggtatcatatccatctgttagccttcactaattgctagctgattgctccattgtttttgacaatacctagtgcatagattgctctacagtctgatccaattaaatttaggcacctttgcagaggtattttttgaaatgagactttgagacttattcctaccctgggaatgctctttagttgtgtcttttcctggttttatctgttaaactctagcttgcttactgttatatttcttgctttcatgaagctatctgtctcctcttaaatttctcaccatcaaaatctttgttctttacaacagtgtcccaagacttgaacttcccatgccctgtcccaaataaagccagatcttttaggaagacctatagagcattagttccttctggcttgcctcgttctctgggcagtacccctgcaccagtgttccagagctggtggtcaggaagtcgctcacttctctaggaatgacagccttctctaatgagtagaatgcttggcaggggcagtagcctctgttcttgtcaacttgatattatcttgatgttgaacctccaccgtaaacttgctgaaacaaggacattcagggctcagtattatcagccagctatgcctgggggtagatcttccattctatgagtaaggctgagtagaggaaaggaacagggatcatttgactgttcttgcctgcagtggagcttcagcagcaatgggctgggcaggatgagaaaggctggtgatcagctcctcctgggaagaaactgtagccctaaacttgggtctaggaggagacagagccctgtgttcttgtctgtacatgccgatagtagagcttccataaagttgagctgggtaggagggaatgggccatggctcacatgccatagactgtcacttattgagatttatttgattttgctgaataaatgtttctccattttttgcatgtcattagggaaacttcctgataatttaagtggttactttatataatttttacctgttatggttgttcctcctgtagtgttcttagcatttactttcatttactaaaatatctgtatgttttttaaaagtatatgttgatatacatatcaacatatatatcaacacacacacacacacacacacacacacacacgcacactttatgaacatattgattctaccagcatttattctgcttctaccagtaatggtcttctttttaattaaaatggtagtgttttttaaagcataagtcaagcaaaatttagcgcttttcgtcagcaagtaacaattcttttattaaacactattttcaagtcctttttcaaataccatcagaatttccatttattaatttacaaagaaaattataaaaattacatagaactatttgaataagcataaccatatattttttttttctcagagtgatctacatgggaaccacattcacaagtagaaggttgcttggtgaccagggaatctgcgcaatcattaatctttgatgattggaatgattaatgatatcaagccattttgttttgcctgtccttttgcatcttcaccatctctgctctgcatttaataaatatgaatcattttatagaaatacagattgttataaattatggttattttaatcataaggatagtaattctcaaagcttagtttacagtttgacaatggtaaatgaaaaatttatatgttcacaaaaatattttgcaaacataggatttgtactttctaacaattttcagatatctgtttttaaaataagttttacaaaaactactgattacagaatagatatctagcctttaaatgcaacatattacatagaaattatagttgttgcaatcatccaaagaggtgtaaaaaaaacacagttaaagcaagagaagtctttatagaacagattgccagtagttagtgtacaagtatggtaacacttaatgtttattttcagtgtttgggacattattcactttacatgtataatgtcacccaattgtcacaataggtaggaacttgtcattcactttatagatgaggatactgaagctctagatgtttatgtaacttatctaagctagctagtgatggaactgtggcatttctagttaatgatagaactgtggcatttaccttgcagcctaactctagagttctcactcttactctgccacattgtatccagaagtatgccaaaatttttcttcatcttatataatttgttttcatatttttcacatatttgtaaagagcatgtttattgaccctgttccatgtccatctgaagttctctcttggttatttgagtaatggaggagccaattcctatagtctccattcatgctcaaaatcttcctgcagtctttgtgacctgactcattctttctattacaaaaatatgtaatataaacatgattaagatgaagaggatataatagccaaaatgtattgtgccaggcattgttctagtgtcttgtgtatgttatctcatttaatctatggtaaaattctctggggtgggcattattgacttagtgattaagaaacttcaaatcggagaaactaactgtgcttttggctacacagtttttaagtgttgattctgaattatgcctggtgattctgaagacattgccctttccctgtcatattctaaaatgtttactgagtgctgggtcttacatgccctgtgagtaggctgtcagcagaatacttctctagaggtagttatattaaaaatacattaaggttgagaaactcagaatcagaaagattcattataagatataagtttgcatagttcaccttgagattgctatggcaggttcataaatggattgacaaatgaaaagtgggtcactgatcattttatttactgtagttccccattatctgtggttttgctttccacgacttaagttatctgcagtcaaccatggtataaaaatagttgaatacagtaaaataagacattttgagagagagaaagagggagctcacatttatataacttttattacagtatattgctttgttttataattattattaatctcattgtttttcatttataaattaaattttaccatatatatgtatgtataagaaaatacatagtatttatgacattccgtactatctgtagtttcaggcatccactgcgggggggtcttcgaagatatgcctgatgggtaagagagggattgctatattcactgttatggaaaatagtggtggtcttaacagcagatataaaaattatttgcaaattaacagtatgttaacaaacaaaggaaaggagatggcataaaatatcagtgtcttatgttataaaatgaaatgttatatatatatatataggtatatgtctatataagcaatgcatcattgctattcattatcaaatactattcatcaaaaatgagtgcttatgattctaggacagggaccttgtatggttcttttgtttttatttataaaacatgacacataaagggcacttgataaatgtttaagggagcaaaaaatattttttggtgtatttaaaagtcaaatgagcaaagcagggatttatgctggtggaaaagagattaattatggtctaaatagcatagcatgctccttgtgttagtccagagagagagagtgccaataggatacagatagatagatagatagatagatagatagatacatagatacatagatacatagatacttagatagataaagaaggagagagatttaacataaacatgtaaatacttaagtaaatgtttatttattataaggaattggctcacacgattatggaggttggaaaattccaagatttgctgttggctgtctgatgacccaggagagtcaattacatagttccagtctgaatctgagtctgaagacaggagaattttgatattgtagctcccagacagtcaagtagaggagtgaattccccctgactcagccttttattctattcaggccatcaagggattggataagccccactcatattggagaaggcaatccgattgattcaggctactgatttcatatgctaatctcatccagaaacatcttcatagactcacagacataccctcaataatgtttaaccaaatacctgggcagtctgtggtccagtcaagttgacacataaaattaaccgccacactgttcagttttcctagctgttaactccaatcatttgaaaggaagcgatctcaaacttaaggttccagactctatagccagataataatttctggtttttataggctgatgactcccattctgtatttaagggctactggtatgacatcacagaaaaataattatttactcatttaaaaaaatatcggatgggcacggtggctcatgcctgtaatcccagcactttgggaggccgcggcaggtggatcatgaggtcaagagattgagatcatcttggccaacatggtaacaccccgtttctactaaacatacaaaattagctgggcgtggtggtgcacgcctgtaatcccagctactcgggagactgaggcaggagaatcacttgaacctgggaggcagaggttgcagtgagctgagatcacgccactgcattccagcctggcgaaaggtgagactccatctcaaaaacaaacaaacaaaaatatcaaagtgaaatatgtgtaagaaactcaaagaatattttaagagagtataataatgttaaaatacacaaagttccttatttatagtttcactttcaaagataaacagtcataatgatttgattttctagccatttttcaatacactatacaattaatagtacatatgtgttagttttattttttatttcaatagtttttggggtacaggtgttttttggctacatggatgagttctttagtggtgaattatgagattttaatgcactcctcacctaagcagtgtacactgtatcaaatatgtagtcttacacccctcactttctttgcaaccatgctgttttggtaactacagccttgtagtataatttgaagtctggcaatgtgatacctccagatttgttctttttgcttagtattgctttggttatgtgggctcttttttggttccatatgaattttaggattgttttttctagttctgtgaggaatgatggtggtattttgatgggaatagcattgaatctgcaggttgcttcaggcagtatggtcattttcacaatattgattcttcctatctatgagcatgggatgtgttttcatttgtgtcatctgtgatttctttcagtagtgttttgtagttttcctttatagttttcacctttttagttaagtatattcctaggtattttattgtttttgcagctattgcaaaagggattgcgttcttgatgtgattctcagcttgatcattgttggtgaatagcagtgctttgtatacattgattttgtaatgtgagactttactgaatttgtttatcagatctaggtgccttttggatgagtatttatggttttctaggtatatgatcatatcatcagtgaacagtgacagtttgacttctttttttttcccaatttgtatgtcctttatttctttctcttgcctaattgctctggctaagacttcctgtactatgttgaatagaaatggtgaaagtgggcatccttgtcttgctccagttctcaggggaaatgcttttagctaagatgttagctgtgggtttgtcatatatggcttttattactttgaggtaagtcccttctatgcctattttgttaagagtttttattatgaagggatgctggattttaccaagtgcttttcccttatctattgagatgatcatatggtttttgttttcaattctagctatgtgatatatcacatttattgacttgtgtatgttaaaccatccctgcatctctgtgactaaactcattttgtcatgatgtattatcattttgatcatccaccagctgttggatttggtgagctagtattttgttgatgatttttgcatctatgtttatcagtgatattggtctgtagttttctcttttttgttatgtcctttcctggttttgctattagggtggtactggcttcatcgaatgacttagggaagattctctctttatcttttggaataatttcagtaggattagtaccaattcttctttgaatgtctggtagaattcaattgtacatccatctggtcctgtacttcttttcactggcaattttttaaaattattgattcagtctcaccacttggtattggtctgttcagtgttcctgtttcttcctgatttaatctaagagggttgtatatttctaagaatttatccatttcctctgggttttctagtttgtgcatgtaaaggtgttcatagtagacttcagtgaacttttgtatttttgtggtattggttataaaatcgttgactttctgccttgatgatctgtctagtgttctgtggagtattgaagtcttccactattattgtgctgctatctcatttctttggtccagcagtaattgttttataaatctgggagctccagtgttagttgcatataggtttaggattgtaatgtcttcttgttggactgctacttttatgatgatataatattgttctttgtcttttttttactagtgttgccttaaagtctgttttgtctgacataagaatagctactcctacttcttctggttttcatttacatggaatatctttttctatccctttgaccttgagtttatgtgaatgcttatgtgtaagatgagtctgttgaagacagtagatattgtttggtggttttctaattttttatttgatttatttcttgatttattaagacagagtttcactcttgttgcccaggctggagtgcaatggcactattttggctcactgcaacctccgcctcctgggttcaagcaattttcctgcctcagcctcccgagtagctaggattacaggcgtgtgccagcacacctggctaatttttctatttttagtagaaacggaatttcaccatgttggccaggctggtcttgaactcctgacctcaagtgatctgcttgccttggcctcccaaagtactaggattagaggtgtgaggcaccacacctggctaggtgttggttttgttaaacccattcggccattctttaccttttaagtggagcatttaggccatttacattcaatgttattattgagatacgaagtactgttatattcatcatattcatcatattagttgttacctagatacactgttttttttttcactgtgttattgttttataggccctgtgagcttaatgctttcaggaggttctattttggtgcacattgagcttttggttcaagatttagaacttttagcatttttcgtagtgctggtttggtagtggcaaataccctcagcatttgtttgtctggaaaacactttatctcttcatcatttatgaagctaagtttcactggaaacaaaaatcttggctgacaattgttctgtttaaggaggctaaagataggaactcagttccttctagtttgtgaggtttctgctgagaagtcttctgttagtctgatagcttttcctctgtgggttacctgatgcttttgtctcacagctcttagaattctttccttcatgttgactttagatagcctgatgactatgtaccttggtgatgatctttttgcaatgaatttcccaggagttctttgtgcttcttgtatttggatatctaaatctctagcaaggtcaggaaagtttttctcaattattccctgaaatatcttttcaaacttttagtcttctcttcttcctcaggaacaccaattattcttaggtttggccatattacataatcccatatttcttggagactttgtgtatttcttttgattctttttgcttcatctttgtctgattggttaatttgaaagctgtgtcttcaagctttgaaatgttttcttatacttattttattgttgaaactttctgttacattttgtatttccctaaatgtgtctttcatttctagaagttctgattggtttttctttaagatatctatctgtctggaaactttttcacttatatattgaattttttttaaatttatttttgttgattttcacctttctctggtatttccttgagtagcttaataataaaccttctgaatttttatttgctatttcaaatatttcatcttggtttggatccattgctagggagcttctgtgattttttggggatattaaagaaccctgttttgtcatattacaaatccctgtcttaggtagagtattgctttaaattgtttttaaatttatatttgatttcttttaaatttctttttatcctcttgaggatgtggctttaatgtttatagtttattatagcctcatttgattcttggtgcttttagggctgaagactgtatgagttcgtttgttacagagtctttgtgtgctggctttcttagctgctcattgtattagttatgtacttgatgtgtgggcaagttcactgtctcctatggggttggaaaagcaaggatctcttgaagcttatttcattgccccatcgtatgcatttttaaaattttaattagttttttcctgttattttatttactgagttaatggttcaagttttaggccaatagaggatgtatctccgggtaggaatcagttgttgctaaagccagtgggtagatgcaatacccaatggtgggcagggatcccagccttgatgaaggtggctgggagagctctccattagatgcactgaagttttagcagggggaagggtgggagctaccttaactcccctgccaggccagtaggaaatctgtctacctcccagcctcactcctgcccctgtgttctggctgttcagatcagacaggtacctctttttgtctgtaagaacattgatattccaagtagagaggaattatgactctgccactcatgcaatcctgaacctggggagtgctcctcctgtggggacataatcaccctgaaatgttccaggaaggctgtctatagatgtgtcctcgctgagttcctgtgggaggagtctcagttgtgtctgcagttgtggacaaggcagaaacaagggccccttctccaagacccttcatgtgctgcctgactgttggggtagaggtgcagactttctccactgagcccagtgctgcaatagcatctctgctatgagaaacttcccaccagcggaaagatctgggactcaagtcctgccatccggattcttttgtcccatggcatgttccctagaagtggcattctccctcttcccctagtagtaggagttcctgagagccagactacagtgattggtattgcctttctggggctagccacccagtggggctgccacactctggactcgtactggggatgtctgcaaagaatccggctatgtgaactgactttaagtctcccagcattgggaagcagcaccagctctgatggaggtggcaggggagtgatgtagaccctgtgagattccttggttgtagataggcttagtgtgctggctttttcaaatgctggttataatcatagtgaacttgtcatgtggacagactcaggacctctggttaaccagagtactgcaggcaaagttgatagccgaagtcacacagccattttctttttcctgggcacagagttattctacctagagatgctgtaatggcccgagttgattgacctccaacagaggtggcgcttgaaaaggggcatcagctggcacagaggcagtgggatttgagcttgccctaagtagtctggggtaagtattctggtttctcaggtgatgggtggagctataaagctcccaaaagtttatgtcctttgtgttaagctagtagggccagtggaggggcatggccaactgctactccataacccctttgtgaattcttctgtgcagcagactattatactcccctctggaacattaccccagtggcctgagagccaccgccaaccctcacaggggccatgacttgtccccatcaaggaaagtcagagcacagacccccctaactttgcccccacttggggaagcattttttaggcataaagctacaaaagaaagatatagcagttttcaagtcacacttgacttttagagcaccatagtaaagaggacctcttgttaaaatacaccgtgggcttgatgaatttccttatgagcataatctgtgatattccaaatgtgctctttattgctattcttgtcaatattctcttcttccacaattaactggtgttacagtcccaatttgtaaatggctttgagtgttttgagcagttttctaccctcactttcataaattgagtggaatcttgcactttttacatgttctgctttggaatttattgtattgtgtatacattgcatttttggttgtttatactgcaaacctgactcccaaagacattaacatgatatctatcgagtcagtctagtactaactggggtgaaaaatttcattggctattaactttataaaaagttagtttattacagaatattttcatattaggatcatttatgtcactgccccacctacaacacaaactaacaagagaagaactgacaagaacatccttcatattgtgttactttcctgtttactggaatgctttttgtaggttgtttttgtatatttctaaactttatttttctccttttggtgtcaatcagtaaatctgctctactattcagtgtctacatagctgtctaatacacttttttttttatcctggatggttgagtttgctggaatattttgagacaattaacatttataacattttaatccagctatctgagcatttaatattcctgtctggattattaaggttatcttgatgattatgaagtgattttatttttccagtcctctaagttgatatattaattctgaatttattcgtttataaaaagaagtcttaataagctccagattacattgtcccactaaacataacccattttccttttctgatattctttgactattttattttaaattgagggtataattttcttctgtcttcataaactatgtgaatatcttaaaaatgacatctagtaaagaatattcttgtatctcagatagcttatgtattatatataatctttaattttgcgagatacagacctttatagagtgtgttgaagggaagagtgtatgaactacttgcaatctcttccttgactattttttagttcttaaaataattatacctacctatattcctgaggcaatattttttattttactttttcttttgaatggaattcagtatgtatttttatggcaaaaatgtgctttcatagaaagtaactttcatatttagaataaaatatatttgtatgtatattatgtatttatataaatgtatatcaaaggtaaatgacagtaatgattcatcaggtattaaaaaagtaaagtaaaatttaaatgatcaaatttcactagtgtaatattaggactggttaatattttttcttgaacataatgatttagaaatgaaaatttgtgattattacttgattacattaaaatagtcttaaagatatttctgtccacattgccatgtttttaaaaatgccaatgaaataagctatcaaaaattataataaaatattctatactattaagttatatcaatttcccaattattacaaaataaaacgtattgttctgaatgtaacgaagaggagatatttcatacttaaattctgaatccagctgttttacactatgaaatattaattgcatgatcttaaggataagaacctcttttatagtacttctgtaagagaaataaattggtcataattgtatttcattttcttgattgaatagatacatagaataaaatgcactgcagtcttctgacaatcacatcctgagactctgcttaaatagctctattataatcttacagcatttttagtcatttaaatacaagtttagttctgttgtagccttcagatattttgcaccaagatatttaactttgtagccttcagatattttgcagcaagatgtttaactgggaaaacccttagttattcatattcagatttaaattatttcacttacaaccatagctaaatatttaaaactgcaatgtcccactaaaacatagctgttataaatattataattatcatcataatagaactgacaggaaccactatcatttatcttacatttcaatacttcaggttatatgattcagtatgaaagtattgagatagatttttaaattctaaaaccaactaacctacctttcctttcttctttggttccttctacccttcctaattttctctagagaactaaaatgaatgtcatgtggctaagaaaactcatgaaatgttttctctgtattgtatgtaaatcattgttactctccagtatgtatagtattttaatctatatagtccagagcatattaaaattgggaattttttttttttgtggagcaagatgaccaaatggaaacctccactgacttgtctacacaaaaaagcacctacatacgaactgaaaatcaggttaaccatcctagtacgtggttttaactttatattgctaaaagaggcactgaagatggtaggaaagaaagtcttgaattgctgatgccacccctcccccattctctgacagtagctgcacagcacaggagagagaatctgtgcttctgggggagggagagtgagcaatcaggattttgcactggaagaactcagctggtacccatggagggagcatttagactagccctagccagagagaaattgcccattcctggggttggaacttgagtttcgacaagcctcatcaccattggctaaactgtctggggtcctaaataaacttgaaaggctcactaggccacagggactacaaatcctaggcaagtcttagtactatgctgtgcttggagcaagtggacttgggggctataaggagaggcctcttctgcttgagaaaagcagagatataagaataaaggggactttgttttgcatcttaagtagcagctctgccactgtggggtagagcaccaagccaactcttggggtccccaattttaggctttggcttttggacagcatttctaggcctaccctgggccagaggggagcccagtgttagaaagggtagtcttaggcctggcagcatttgccacaagctgactgaagagtacttgggccttacttcagtgaacatcagtggtaccctggcagtacattccatgggcccttggtggtagtggacacagggagaatctcctgcttggggaaagaggaatgaagagggggaaagactttgtcatgtggcttgtattccagctcagccacagtagaacagagaactaggtagattcctaaggtttctgactataagcactggctcctggacagcatctctggacccacctggggcctggggaccttgcaacccttcagaaaagaacacaaatctggctgggttcgctacctgctgattgtagagccctggaccttgagcaaacatagagataggtagtggctatagcaggccttggaaaagacccagtgctattctggcttcgggtctgacccagcatagtcccagtgggggtgaccacaggggtgcttgtgtcaccccttccccagctgcaggcagctgagcacagagagaaggacttcatttgtttgggagaaagtaagaacaagagtctctccctggtcatccagataattcttccagatcttatcccaaactgtcaaggtggtacctctctaagtatgcaagaactacaacataactgggcttgggtaccccctaatgcagatatggcttcagtgaacaaaactttagaccatatgcccaattctcttctaacacctggaaaaccttcccaagaagggtaagtacaaacaagcacagattgcaagggaatagaaacaaataacctacaatggagttctagtacatctgtcagtagacgcttccaaggaaaccttacaggccaggagataggaatatggcatatttaaagtgatgaaggaaaaaaaccttttaccctagaatagtatattcagttaaaatattcctcaagcaaaaaggagaaataaagactttctcagacaaatagaagctgagagatttcattaataccagatctgttgtacaagaaatgctaaagggagttcttcagtctgaaagaaaataatgttaatgagcaataaggaatcatctgaaggttctcactggtagtaataaatatgcagaaaaacacagaatattataatgttgtaattgtggtgtgtaaagtactcatatcttaagtagaaagatgaaaagatgaaacaatcaaaaataataactacaacaatttcagacatggatagtataataaaatagaaacaatgataagttaaaaagtgggaatacgaagttaaagtgcagagtttatattagttttctttttgcttattagtttgtctatgcaatcactgttgtcatcagtttaaaataatgggttatactatattatttgcaagcctcatggtaatctcaaataaaaaaataaaacagatacacaaaaaataaaaaacaagaactcaaaacataccagcagagaaaatcaacttcactaaaagggagacagaaaggaagaaaagaaggaagtgggaccacacaaaacatcagaaaaataaataacaaaatggcaggagtaagtccttacttatcaatgagaacattgaatgtaaatggattacatgcaccaatcaaaaaacagagttggtcaatgaatgaaaaaacaagaccaaacgatctgttgcctacaagaaatgtacttcacctataaagacacacctagacagaaaataaaggaatgtaaaaagatactccatggaaatggaaacaaaaaaaaataagagtagctacacttacatcagacaaaatagatttctaaacaaagactacaaaaagaggcaaagagggacattatttaatgataaatgggtcaattcagcaagaggatataacaattataaatatacgtgcattcaacaccagagtacccagatatgtaaggcagatgttagagctaaagagagaggtagatcaatacaatagctggagacttcaacacccaactttcagcattggacagattatccagttggaaaactagcaaagaaacatttaatctgtatttagattgaatagacttaatagacttttacagaacatttcatgcaacagctgcagagtacatagtcttctccttagcacagggatcattctcaaggatagaccatatgttaggtcaaaaaacaagtcttaaaacatttaatataattgaaatcatatggattatcttctttgatcatgattgaataaaactagaaataaataacacaagaaattttgaaagatgtacaacacatggaacttaaatagtttgtttctgagtgactagtgggtcaatgaagagattaacaaggaaactgaaaaatttcttgaaacaattgataatgaaaacagcataccaaaatctataggctacagcaaaggtagtacaaaaaggaattttatagctataagtatctacatcaaaatagaagaaaaacttcaaataaacaacacaacagtgcatcttaaagaactggaaaagcaaaagaagtctgaacccaaaattagtagaagaaaagaaataatgaatattagagcagaaataaatgaaattgaagaaaacaatacaaaagatcaatgaaacaaaaagttggttttgtaaaaagattaaaaaaaaacctgacaaacctttagcctgactaagaaaacagaagaggaaatccaaataaaaccagagatgaaaaaggggacattacaattgataccgcaaaaattcaaaggatcattagaggttactttgaggaactatatgcttataaattggaaaactgagaagaaattgagaaatccctagacacatataacctaccaagattgacctgtgaagaaatctaaaatctgagcagaccagaaacaagtaatgagattgaagctctaatgaaagggatccagaaaagaaaagcccaagacccaatggattcactgctgaatttttccaaacctttaaagagctaataccagtcccactgcaactactccaaatattataggaagtgggaatacttccaaactcattctgtaaggccagcattacctcaataccaaaaccagataagcatcagaaaaggaaaactacaggtcaatatcattgataaacgttgattcggaaatactcaacaaatactagcaaactgaattcagcaacacattaaaaagatcattcataatgaccaactgggatttattccagggatgcaaggatgattcaacatatgcaaattagtcaatgtaataaattgacaagatgaaggacaaacaccatatgatcatttcaattgacactgaaaaatcatttgataaaataataaaactgtaaaaaatactggatatagaaggaacacacctcaacataataaaatccatatgtgatagacccagagctagtatcatacagactagggaaaaactgaaagactttcctctaagatctggaacatgacatggatgttcactttcaccactattattcaaaatagtactggaagttctagatagaggaatcagactactgtctgattgaaagaaataaagagcatttaaattggatcatactatccctgtttgcagatgatatgatcttatatttggaaaaacctaaagacttcaaaaatctatttgaactgataaacaacttctgtaaagttgtaggatacaaaatcaatatatacaattcagtagcatttctatgtgccaacagtgaacaatctgaaaaagaaatcaagaaagtaattgcatttataatagctacaaataaaattaaatacttaggaattaatgtagccaaagacatgaaagatctcttcaatggaaactataaaatattgatgaaagaattggataaggacacaagaaaatggaaagatattccatgttcatggattggaaaaataaattttgttaaaatgtccatggtacccacatcaatctacagatttaatacaattcctctcgaaatacctagacatttctctcagaaatagaaaaaaaatgctaaaatttatatggagccacaaaaggctctgaataggcaaagctctactgaacaaaaagaagaagactggaggaatcacattacctgacttcaaattattatacaaagctatggtaaacaaaactgcatggcactggtgcaaaaatcagacatatagatcaatggagcataattgagaaaccagaaataaatccatacatctatggtgagctcatttttgataaagctgtgaagaacatacactggggaaaggatagtcttttcaataaatggttctgggaagactggatgtccatatgcagaagaatgaaactagactgctatctcttaccatatacaaaaatcaaataaaagtgggttaaagacttaaatctgagatctcaaactgtgaaactactaaaataaaactttggggaaactcttcaggaaattgaactgggcaaagattttttgagtaatactccaccaagcacaggcaactaaagcaaaagtggacgaatgagatcacaacaagttaaaaagcatctgcacagcaaaggaaacaatcaacaatgtaaagagacaacccacagaatgggagaaaatatttgcaaactgtccatctgacaaggaattaataaccagattatatatgtattagtccattttcacactgctataaagatactacctgagactggacaatttatatatatatatatatatatatatatatatatatattttttttttttttttttttttttttttaaaaggaggtttaattgactcacagttctagatgactccggaggcttcaggaagcttacaatcatggcagaacggaagcaggcaccttttttacaaggcaggagagagtgtgagtgtgtgaggaaggaactgtcaaacacttataaaaccatcagatctcatgagaactcactgtcacgacaacagcgtgggggaaaccacccctgtgattcaatcacctcccaccaggtctctccctggacacatgaggattacaattcaagatgagatttggatggggacacagccaaaccgtatcaatataagtagcacaaacagttctgtaggaacaatctattaatctgatttttaaatggtcaaacggtctgaatagacatttgtcaagacatgcaaatggcaaacaggtatatgaaaggtgttcagtatcattaatcatcagagaaatacaaattaaaactgcaaagatatatcatctcatgccagttaaaatggcttttatccaaaaggcagacaataacaaatgcagacaaggatgtggagaaaaggaaactctcatgcgctgttggtgggaatgtaaattaatacaaccactattgagaacaatttggatgttcctcaaaaaactaaaaatagagctaccatatgacctaggtatcccactgctaggtatattattgaaataaaagaaatcaatatgttaaagagatatggacactcctatgtttattgcagcactcttcatgatagccaagatatggaagaaaccttcacatttatcaactgatgaatagataaagaaagtgtggtacatatacagcatggagtactattcagccataaaatggctcacgcctgtaatcccagcactttgggaggccaaggagggtggatcacctgaggtcaggagtttgagaccagcctggacaacatggtgaaacctcgtctctactaaaaatacaaaaattcgctgagcatggtggcatgcgcctgtaatcccagctactcgggaggctgaggcaggagaatcgcttgaacccaggaggcggagtttgcagtgagctgagattgtgccaatgcactccagcctgggtgacagagtgagactctatctcaaaaaaacaaacaaacaaacaaaaaaaaacagaactatgatatcctgtcgtgtgtagcaacatggatggaactggatgtcattctgttaagtgaaattagccaggcacagaaagacaaactttgcatgttctcacttatttgtgggagctaaagattaaaacgtttgtactcatggagatacagagtaaaatgatggttaccagaggctggggagggtagtagtgggggtggatgggaagatgggatagttaatgggtacagaaaagtagaatgaatgaatgagatctagtatttgacaggctaacagggtcattatattcaataacaatttaatcgcatgtttaaagataattgaaagaatataattgtttgtaacacaaaggatcagggcttgaggtgatagatacctcatttgccctgatgtaattattatacattgtatgcctgtatcagaatacctcatataacccatatatacctactatgtacccacaaaaataattttaaaaaactgaagttttaaatcagaaacattttcttttagagactttattttgtggatgttaatgaagttttgtggtgaactcactaaaaccaagttgtatagttaatataacatgcaaaatcacttactgtatggcagtatgtctcgaacatataaaactttgcctctttattgaaaaacacattctgaggtcaatctcaaaacctgtgaagaattctccctgcttcacaagccaaactagtagggatagtgatttcctcttctgcaccacaccagaacaacatgagtaagagttccaggcacttgaaaaacatagaagaaaggaagggaaagaagcacctgtgcattcttccattctttcaagtggttacgtcttgtcaactatgttgtgataagagcagagaagataattattcaagatatttgcaattattcaagataattttgcatatttgagtaatgcaaatttaaaaactttttaaaaatttaaaaacactaatgcaaatttaaaaacaaattttgcatatttgagtaatgcaaatttaaaaacatctgtaggtgcatactactcatgtatgtttgtgagacatgaattcagtgattccaagtcttcaacatcatttcatgtccaaactccctgtctgtcccatcctctgagatttgggtaaaaaagaatttgtcttggggtagagctttacccaaactttaagaaaggacattggttaagggcacaagaggcatctctttagtggtagattcatgtcatcaggtgtggaagtcatggtggaaaaaaaatagaaaactaccagggagttgtggaatactggactttggaaaaaatagctcattaaagacatactgaataacattttacatgctgtgtgtgtcttttcttatcactttgtcattttgtttgcttaaatacgtgttatctatcagctttgctgttaagaaaactatgtcatggaaaggtagttgaatatttagtttgttactattgttcagtggtcaagtgagaactccagtaaagtttttagaatttaaaactagaattgggtatgaataagaggagcaaaatatatacatataatgtttcttttaatattttagatatgtctacgagatccaaagtatattttttataccttactttattacaattacaaagtctgtatttttcttttgcaaaatttgcacttgaccatcttggtcccagaatatcatactttcagaattttctaatgttcttaatattatgctttatattatatcacacaattactgaataaattaggtgaattcaaattttaaatggatacattaaacatatcaaaaggaaaagatcaaattagaaatagttttagaatgaaagattgggcttacactgtcttgctgtaagataaatatttctgcatagcacatgtgaagtaattaagacacagcagaaatatcctaagcagtgtaaaagcactaaaaatgggaaattggtaatcactttctatgagcaaatgaaattacttacaataccaattcccttccattgtaatctctttctaactttatcgtacttggaaaattgctatggtgacaaagaagtttttattttccctgggtagatagaaattcattggaagactttataagtagccagaacatggtctcataatcagttagcagatttgtatcctcgactactacttgtattctgtaaataaacatcttttgactagcaagctggattaagaatgagttttcaaacatgcagtcacataagtgtgacttttaagtcaatgtgtcttttaagcaattataatttcacgtatcttatgattagtttcatatacataaggattcatagtagaggagaataataaatacaaatgtgaaaataaaaggggcatactgaagaggttaattttgttaaaatgtgataatcgtaagcctaatttataaaaaaatgttcagaatgtcatcaccttgctaatgaaataaaacttttggtgataacattttagcaaggctgactgtgtaatttacagtgtccagtgaaaaaagaaaacgtagtgccccttcgacaaaaattttaagttggtgacaacagagagtttaccaagaagaaggccctgtgtggttgcatagattgtatattcatgaagcagatcttgcttgttagtctaaatttgctattagaaaagttttgaatacagtagataaaatatctggggaatatgcttggttgtcactcaggagtgtttatacaagtgtgatcaaaattataagtaacatcaggaaattgattatacaagcatattcactatacaagtgatgtcaaaatgatctgtaaggttaacgaaattcagcaaaagtgttaatgaaatatcaatagacctttgtgaaatataaattaaaattagtaatctaaattttatatactgaaatgaagtgtgagatgtatgcctaatttacagagagcattaaaagtttgggagaagagtatgatctcccatgagtggtctttacaatgtcttaaacataaggctatatctttaataattctgttgccttctagcccacaacctgacatatcttgatatttgatgagtctcaatgagaaaaccattttgtgtgtgtgtctcctggaatctttattactctagcaggaaagacttgaacactgttttctttctttctttctttctttctttctttctttctttctttctttctttctttctttctttctttccttccttccttccttccttccttccttccttccttccttccttccttccttcctttctttctttttctttctttctttctttcttctttctttctttttttttttttttggaaacggagtctcactctgttgcccaggctggagtgcagtggcacgatctctgctcactgcaaccttcacctcctggattcaagcgattctcctgcttcagcctcctgagtagctgggattacaataagtgccaccatgcccagctaacttttgtatttttagtagagatggggtttcaccatgttggtcaggctggtctcgaaatcctggcctcagttgatccacctgccttgcccacccaaagtgctgggattataggcgtgagccactgtgcctggccttgagttttctaatgcataatgcactgaagagttctctttcataaattcagaactgaggaagaggagaaagaagacagaacaacagagctgttattgaaaaatagacgtcttggtttcttttaacagtgttttgtcattctccttgtggagatatttcacctccttggttagatgcatttctaggtatttaatgttttgttttttttgtatgtggctattgtaaatgagattgtgttcttgacttgactctcagctagaatgttattggtgtataggaatgctagtgttttttatacattggttttgcatcctgaaacattactgaagtcattttcagttctaggagatttttggcagagtctttagagttttctaggtatagaatcatattgtctgtgaagacagatagtttgacttatttggatgccttttttttttctcttgcctggctgctctcactgtgacttccagaactatgttaaatacgagtggttagagtgggcattcctgtctaggcaacacaaataaatggaaaccattccatgctcatggattgggagaattaatatagttaaaatggtcatactgcccagagcaatttatggacttaatgcatttccaaactaccaatgtcattttttaacagaagtagagaaaactattctgaaattcacatgaagttaaaagagagcctgaataggcaaagcaatcctaagcaaaaagaacaaagccagaggccacacattacctgtcttcaaactatactacaaggctatagtatagtttgtatagtatagtaaccaaaacagcatggtactagtacgaaaacagacacataggtcaatggaacaaaatagagaaggcagaaataaagccaaatatctacaaccatctgatcttaaacaaactcaacaaaaattaagcaatgaggaaaagacttcttattcaataaatggtgctgggataaagggctatccatatgcagaagaatgcaactggatccctacctatcaccatatatgaaagttaacacaagatggattaaagacttaaacataagccctcaaaataaaaaaaaatcctagaagaaagcctaggaagtgctcttctcaatatcagccttggcaataatttatgactaagtcctcaaaaggcaattgcaacaacagcaaaaaaattgacaagtgaggcctaattaaagtaaagagcttctgcacagcaagagaaactattaaaggagtaaacagacagcccatagagtgggagaaaatatttgcaaactctgcatttgacaaagatctaatatccagattctataaggaacttaattcagcaagcaaaattcaaaaacccccattaaaaagggggcaaagaacatgaaagacacttctcaagagaagacttacaatggacccacaagcttatgaaaaaatgctcatcatcatcaatcattagagaaatgcaaatcaaaatcacagtgagataccatctcacaccaatcagaatggcttctgttgaaaagtcaaaaaatggcagatgttgatgaagatgcagagaaaaggggacacatacactattggtgggaatgcaaattcgtccagccactgtggagagcaatttggagattactcaaagtactaagtgttgaactaccattcaacccagcaatcccattactgggtatatacttagagaaaaataaatcattctaccaaaatgacacaagtacccatatgttcacgcaatgctattcataatacaaaaaacatagaatcatccctggggcccatcaaaggtggattggataaagaaaatgtggtccatatacaccatggaatactatgcagccataaaaataatgaaatcagtcctttgcagcaacatgggtacagctgaaggccattatcctaagtgaactaacccagaaacagaaaaccaaatacttcatgttattacttaccggtgagagtttaacattgggcacacatggacataaagatgggaacaatagacattgaggaccactagaaaaaggggggatggaagggggcaagggctgaaaagtttcctcttgggtactatgctcactacctgggtcacaggttcattcatacctcaagcctcaacattacacattatttacctttggaacaaacctgcacatataccccctgattctaaaataaaagttgaaaaaaatggagttgataagatataggtcaaacaagtgaaagtttgctctctttcattggttgttggcaaaacattgtctaatcagggcatatttaatgaccctagggtttttccataagcgtaggtttatacctgggaaagtccaggttatggtggaaaatacatagcatataagctgccaatttttcctttattgcccatgttttacattatattctataatggcacttttttcctgctgaacttgaatagacatcataaatattttcagtacttcactctacgtagctccactaattaaagttggacttgagataaaatctgtttcctatattgggcatggtgtaatctagtaatttctggaatgtataaaacttaattaatatacagatatacggacacttgtattctgctggagtcttgcattctgaaattcttggaaaatagactgtatgcacatagttttatctgggtggtgttggaattaggggagataagaataagaatatggattataagccaatccactatatggatgtgtggaatttaaatctaagagcttataaaatttattatattctgaaagaggtagccacatagaaatgctgcagagtaagcaatagcagacttctaggaaggtgctggaattcccaagatgagataaagaattgggctaggaattgaatgaaagatttagtgtactacctctggtatttgcacaatgaagccaactcagataaactctttttctgcttctcgctgcactgttttccagcatttttttctcattgtgtgcaagtagctaggacatagcaggatataccagataaaagaaatggtctagtatccagagagccttacagtcatacctactgaccgacctcccatttccaatgattagaattgtaatccgtatgctgttataggataaaatgttttagcactaccctctagatgtgattttctatttgaactagctgtggcctgtattaatgtatggtatgaatgaaaattgtatattttgaaacacaagtagatggcttgtgaatgctagttaaatattaagagcatactgggggactaatctttgacattttctctgccaagacaacccaagcaaagaatatttaattctcatgctttataaaaatgataggagttaagggatctcgttttaagtaaatttatatcaaagaaggagataaatatccttcagaggcccatgttaataaaatatgaagttatgaggagtttgttgaatactataaagaaaaaacaaattccaacaagttggtaagaggcaaataacaaactaatgaatctgattaaagtcttttccatatctgatttcaagaacctatagactgaagtagtaaagtcactacagtattccaaatctggtagacaaactgtaatgatgaatttttgggcacccagaaaatatttccctgaacaaatcatgaagtcaccctatccctttctccctcccttccttcttctctcccttcctctctctcttcattcatttctcccttccctccctccttccatctcctgtttttttcttcttcttcttctttttaaatcacaaggactcactgaacccagagataagcattgtcacagctctggatagtaaggaggaaagggaattgcaggactgtgctgtttcatcttacatgacaaatggatccccaataaataggcctctattttaataattaaattgtatggtgtttgattgattgaactcagaaaagataaccaagaatgtggaaagtagaaatcaagagtctataaatcagatctaacgtaggtctttgattatacatgcatataaattctccaactctcctctttcagtgagagttgccagagtgtttccttgtcagtttaaaaaattagaataagaaagcccagaatgtgctgacacttgaggaggagaaggtctttaatctaaatattttatcacattggttaaagaaccattggaacacttccaataatagagtcgtatttcagcttagattattattttagtagttccattccttttgccttgtaaatcacgtggtcacattacacagcccaatgttaattcatatataaagttatttgaaattaaataggccaaaaacatttgaaatcatactgacattttcatacatccatactattttccaacttcaaaagtattttaaacacaatggtctcattttggttactagacaaatctagccttgttgtagtgtggatgttaagaatttcttagccataaaaaagaatgagataatgtcctttgcagcaatagggatggagctggaggccattatcctaagagaactaatgcaagaatagaaaactaaacgccacgtgatctcacttatatgtgggagctaaacactgagtacacatgcacacaaagaaagaaacaacagacattggggcctatttaaagatggagggtaggacagggtttttcgtagggacagggtttttccatgttgccaggaaaggcaaggattgaaaaactacctattgggaactatgcttattacctgggtgatgaaataatatgtacagcaaacccccatgacatgcagtttatctataaagtcaaggtgcacatgtacccctgaagctaaaataaaagttaaaaaaataattttttccatattttatatattctgtaaagagtgtggatttgagttatatagtttcccagcctgtccaggcccaggtgacgttctttgttcattgcttaataagaaaataaaggtgaaactattaccatatgtagtaaagtgattcataggaatgaattactgccattctcaagtctatttttatctgtattagctttttctttatggtgttggaaagtctgaaaaccgtaattagtaaccagtactttaaaaagatatctatagattttgtactcatttacatttgcaattactttattatcctggactttcagacttgaacatgagcaaaattgtgttaactaagacagcattagtttatttattcaatgaataaaaatccaacttgagtcaccatgggaatacccgtgattgacttgcctatttggctgcatttcactctcacacattgtgatgggataaaaacactatattttctaaactgaattttcaaaaaggcactaaggatgactgagcaaagcattctgttatcaatagcgctgtactcagataccagcatgtgaaatctacatttatgtctgcaattttggagaactaagaaccatatggtatcttggttttatacttcctgaatcagcttaattgcatctgcataccaattaaacttgaataaatatgtttgagtgctttttagttgttgatattttgttataaagcttttactccaatttgactaaaagcatttttaactgcacttggtttataaatgggttatcattttatattaatacacatcatataccatgttatttctttttatgataaaagcactgtttggcgtatccatatttcttagcaagtgttaagtaaaagtgatatagaaagtatctaatccatctgtgaatcaagttaaattatatatatttatgtatatatttatatatgtatacatatattattgttattgttgctgttaatttctataatgcaatctagaacatgaatgaacttttaacttgttgacactgtttctagagcattttgagtggttaaataaatgtaagtataaatatagaactaaacttgaggcttatatacattgaaataattgatgtttcagatgctgctcatctcatcttacccaaattactgtaccagcagactttggttacaaatcactgaatactattggttaaagaaagtcatatacatatacctgtcctcattaggttactatagaggctgcaatccttatgagctttttggttaagactctttaaaggagttgcatcatttatggaggacctttattggtcactgtatttcacaagagtcagattaaggtccattactctgttcaatctactcttagatccgtttgatgctgatgagagttttctatccagggtaaagggataggtgagtactaagtgatcaaagtcacatcaaagcatttggtataaggaaacaaaatgattgtgatactgcattaatggaaggttgctttctcatgctttgaaaataaacggctttgctttacctgaatatttatttccagtatatttcttccttgcaatctactacatgaaacagagggggaccgttatctagtgataacatgtttttctagttacattatatgttaagcaaactccttggttattcatatttctaatagaaacgctaatatttcatggtattttgtgatttaacaccatccccgatcccatgcaccattttgaatgattatgtggcattgtataccactaagtattctattaaatagaatttataatattcaagttaagtatattttattttttatttgtatttttattatacatgtttttaaattgttatggatacctaacagttgcacatatttatggggtacatgtgatattttgatacaagcatatagcatgcaatgatcaaatcaggataattggaaaaatatcaggataattaggatatccataatattaaagatctatcatttcatgttaagaacattacagttccactcttctagtaattttaaaatatacaataaaatgtttttaactgtagtcaccttattgtgctattgaacattagatcttattccttatatctaactgcatttttgtactcatcgagcaatccctctttatctctgcctccttatggttgaataatattccattgtgtatatggatcacattttctctatccattcatatgttgatggacacttaggttgattccatatcttggctcttgtgaatagggctgcagtaagcatggaaatgtatatctcttttcgttgtattgatttcctttcttttggatgtacacccagcagtgggattgctgggtcacatggtagctctttttttagttttttgagaaacctccataatattctccacagtagctatattaatttacattcccactgtgtataagggttcccctttctccacatcctcaccagcatcagttatttcctgtctttaggataaaaaccattttaactgggatgagatgatatctcattgtatttttgatttgcatttctcttattagtgatgttgagcaattttcatataccagtaggccattttaatgtctttttctgagaaatgtctgttcatttgctgatttttattgtattatttttcttattacatttttgctattgatttatttgagttccttatgtattctgattattagtcccttgtcatatgggtagtttgcaaatatattctcccactatgtgggttgtcccttcactttgttgattattttctttgctatgcacaagcaagcttttttagttgacgtgatatcttttgtacatttttgctttatttgccagtgcttttgtgatcttactcaagaaatatttgcccagacacatgtcctggattgtttccccaatgttttattttagtagttttatagtttcaggtattaggtttgtcttcagtctactttgaattgatttttttttttttttttgagacaggggcttgttctgtcacttaggctggagtacagtggtgcaatcatggctcactgcaacctcagcctcctgggcttaagccatcctcccatcttagcttctggagtagctgggaccacaggcatgtgccaccatgcctgcctaatttttgtatttttcatagagacagggtttttccatgttgccaggctggtcttgaactgctgagctcaagcaatctgcccaccttggcctcccaaaatgctgggattacaggcatgagccactgtgcctggccttgagttgatttttgtatatggagagagatatgggtctagttttattcttctgcatatggatatccagttttcccagcaccatttattgaagagacagactgtcctttccccaaggtatatccttggcaactttgtcaaaaatgagtttactctagatgtatggatttgtttctgggttctctattctgttcaattggtctacatgtttgtttttatgctagtatcatgctgttttgggggttattgtagctcttgtttcaaagttattaatttgaagtcaggtaatgcaattgctccagttttgttctctttgctcagaattgctttggctattctgggttgtttgtggttcaatataaattttaatttttttctatttttgtgaagaatgtcattggtgttttgatacagattgccttgaatctgtagaattcttcaagtaatatgggcattttaacaatattgattcttctaattcatgaacatggaatatctttccattttgtgcatatcttcttcaatttctttcatcaatgttttatagtttccattgtagatatctttcacttgtaaagtttacttgtaggtatttaattttacttctagttattgtaaatgggattactttcttagtttctttttcaaattgttcactgttggtgaatagaaatggtactgatttttgtatgttgtttttgtatcctgtaactttactgaatttgtctgtgagttataatagttttctggttaagtctttcagtttttctaaatataagatcatattatctgcaatcaaagataagttgacttcttcctttccaatatggttgccctttatttattcagcttgtctaattgctctggctagggtttccagtactatatttaataaaagtgatgaaagcatacatccttgtcttttctatattatagaggaagggcttttagttttttcccatttaatacatagctagttgtggatttgtcatatatggccttttatcatgttgaggtatgttcctttcacactgttgagagcttttatcatgaagggatgttgaattatattaaatgatttttttggcacttattgaaatgatcatgtgtttttgtccttcattctgttgatgtgatttattgcctttattgagttgagtatattgaagcatccttgcattcctgagatgaatcccacttgatcatgatgaatgatctatttaatgtgttctgaaattcagtttgccagtattttcttgaggatttctgtatctatgttcactagagatatcggcctgcatttttctttttttgtcatgtcattgtctggttttggtattggggtaatactggccccatggaatgagtttggaaatagcctctcctcctcaacttttttggaatagtttaaacagtttatatttgttcttctttaaatgtttggtagaagttagcagtaaagctatcaggtcctgggctttttttcattgggagacttcctagtactgtttctctttcactacctgttattgtatacattttagaaatattttgcaattttattgtttgtaaaagaaagtgaagcagactatgatttcacataaggtgacaatttcaataaagcagaagaacagtttagttcattaaaaattttatagaattatttggatagtttgtgccacttacacagtttattgatggggatgcttttttataaaaattatttttcataaaggttaatataacataaataaaaaaatgacttgactcacaacttaaaatgtgatttcttatgcaaagtgaaattttgaagctttaaataatttaattttactgaacatttgtaacagatacattttctcagtcttggacagggctagtgttggcttagaaaaattcatacacttaacattctatatttattttgcattttcctttatgcctaatgcagatctcccatgtagtagtagaattttaataaagtttgttaagtcattaacttataaacagattttacattctttggaaatatcactgttctttggaaacttcaccctgtggcctgtcttcatgacttgatttcttaaactgctacaaagaggtgttctttctctgtctgcatggcctcaagtgaattaatcattgcagaatggagagagacattttgaagaaaaataatgtagtgtgattagacacatttgcctcaggttgctgcagccagagtgtgttgtggtggtaatttactaaatggtaccctggtggtatgaatgagtttttaggttttatgactgctttacttttttccaagaagcgatttacacataggactttgctactgctcctaaaagaagcaatagaatcattgatctgaaattcaaaaaagcatcaccttgggttcttacattaataattaaaaaaaaaccctacaaaatagggtcagccaaaatcagaagcatttaatgctataaaattattatttagaagtaaaatgtataagttactttatagtgatatagtaaatattgctattttaaatagccaatgattgaaactacctacatgttttataataggagaaaccttaagtaatttgtggtaactccttttaagaaatcctatctgttaaaactttcatgaagagttgataatatgtatgaaattctttagcaggatacaacattgcataggcactttatctcggtgactcctcactgttctgcattatttccatgttacatgagtctcatcagagttttcacaaagccattcaagatgaggacatagttctgataagaacatgtttcattcaacataatgccatgtaaaggattcctgcatttaaaaataaactaacatagtagattcatgagattagacgttttccattttttatattcttcatgtcccccaaaatttccaactttgatattagaaatgaatttatttttaaagagtctattttaggaacattttgctttaaatatgaaaaagaaattacttacaagtaaatatttaatctaatttgaaactttatgtatttatgtttcatttttctattccatcctgacttttccattgtgattgtgattttgagtagtatttcttctcccagttaaaacaaatagcaaaacaacaaaccaacaactttaaacaaacaaaaaccaactgaacaacaacaaaaaaaaccctgggcatttttttattcttttctttctctcatccctctatcaataaacaattattactagtgttacccacaagattaccaagtttgttatcttgtttatctgtaccatgctatttaagcgagaatgtcgttatctctcctttggattattgcaatagaatcctaactgggtggctagttttggcaatcaatcctgtacaaagaggctatctctcttaatttagctccctacaaggatctggacctctaagttcctgacacttcatctcaaatagttattccctttactcacactgctacttggaatgatcaggcctgccccagggagtttgcacttgattctgcctctgctggaagtgttcttctcactcttcttcattcagctcaaatatcaccacctccatacttgtcttcttcattatttatctcattacagtaattatttttgtaagacatacatcactgttaaagatcatctaatatgcttatttgttttgtttatattctgtctccctcattggagtagatactcctccagaaaagggactagcccctctaattcccttctgaatcctctgtgcctggaggagaatatgtttcctgtttttgaattatttgagaattcacttagtattttgtgctagaagagtggtattcagactgtagtataataatcagggtgtaaaggacacccctgccctacataggcatggataccttttagataactaatttctcaattctcaatttttatttgtgattttccatacaaattacttgtttgagaagcttctgagttttgtcagtcatcttcctcatgtttctttcacaatctcccactttacaaaaaaacaagcaaatttatgaattcagattcacttgtgaatctgtttaggatgcattgttcagtttctaaaaacctctagtgtatcaaccaagggataaattactcagggagtcttttgagggcttcctaaataaatattggaaggtgcagtgccctgtttcctagaggcaatattctggtgagccattctcccctttccttcctcctctcctcctctctccctttggattccagaagtgagaaagtaagaatgttgctgtggggtattaacaggtttacttgatgctttcttctgaagaagaattttgactggatgatttgtttgacaaagaggattgctttgccaagtgcattgtgacacacatttgcatatatttttcttaaatcaaataagctaaatatgtggcttgacagtattgatgaaaatatattttaagcccacttagagcatataacagtcagaaaaatatgtccttttaccttataggaaatttgttaatggttaacttttaggtcttctagagattatgtagattttcaaagttattttagtaaaaagataatttgaaattattgtgctagacaatgtgagcaacatcaaattgttcaaaatatctctgtataaagtacacttgatatagaagaaagtgaaaaagagagttcatctttcacatggaatataagagaccactatctttcctcatttccagagtatctgtacactcctttaccctaataaattttacagggatagtatctctttattcaaatttgtacaatcttaatttgtagctcacatagatgcaaataagtttattaagaaaacacagttctgtagagggtgctgattcagtagtttttcacagtattcagtcaagaatttgatgtcttaaactcttgactaaattaaaaaggttaaaacactttacctaattttgtaataaaaataatgacatttatcctttgcttccctttatgttgagcagaggtctaagccctcaacttctttagtccttataatagttaaatttcttatggtaggtgctatgtatgactcaatttcacacattgtgaaattgaagctcaaagggagattaaaatactgtagattgcccaaagttagtgagagcagaaaccaaaatccaaacctagataatatgtctccagaattttttattaatacacattaggtatacatatttttagggtacatgtgatattggatatatttatataatcaaatctgggtaattggaatactcattatcttaaatatttatctttatttttaactcctggtacatttgaattattctcttctagctattttgaaatgtatattccattaccattaactgtagtctggaatgttaacccatatattatacaggaccaaaccagaatgctatactaagatgtgcagaagaaagttaaaataatgttttgagcaacattgaccctcatcagtaattattttttatattaccgaacatttatatatagtgtatactatatgctaggaaatatatacataggattccaatgccagtatgtggtttttctacaaacaaagcaaatagggtctcttttaggttttccttccagtttctgggtacccttatgtttgttgtatgatattctttctccactctgtctaagctaggatgtctgtttctttctttgaatattttattttgaatcacaaaatgttctcagatcctacataagtacttgtttagtattcaattctgaatatgcaactgttagcctgaggaaatctgtaggacggtacaactgtctctctctctctcgctcgcttgttttttgttgaaattgttgctagtggctgcatttttttcccttgtggaattaatattttctgtatttcctgtgaactatagtgattggaaagtcgcttaaaacttttcttgattacctaacagtggatctgtcattggaatactaatttggaatactaagccacttccaatgaaacattcctagagcagcaatagcattcagaatattattttgcaatattatatgatgttattgttactgttgtatatgtaatatcaggatatctttcttgtgcattcatcattgttataatttccgaatttgtctttagcatcagcaagatctagattaaaatttagatttgcctttacttttctgaacccaaatttatttatctgataggaataattatattccttaaaaataatttttatttcaaagtcataaaaaataaaacaatattcaattacaagagatatcaggtgcttacagagcaagagtgtttttacttgattgaaataaggacatatctctggcagtgagagtctctgcttttatttgattggattagatttaattctattatcaggaatactgtgttctataaatgttagtgcagctactatttgcatgtttctgagtgaagtacttaactagtttaggtttccatttattatcctcaaaaaacaagttcattttccaaatataaaattcaatacaatagttggtcgccaaggcagaactacctaaatgttccaagatgcaaaatccccacttagtggccactcaagtcggtcacatcacccttgctactgggcacagctgaaaaggcccttgtgccataaacacaagtccttttctcatgaatgctttcttacctattattctgtcaaattagcaatatattagtataaacccaatatagtttagtcattcctgatagtgatatttgatgcagtcccatagtctcaaagaagacaatttactgaatttattaacaaagtttaaagggttttcttaagaaaggaaagaaatgagctaaatttgttgtatctcctttattataatcttcattatgtaactccttttaaaaaaacttttaaagtcaaagaacaatataggcaatatgctttaatatatttagtaaagtctactttgaaataaaatttatgaatttaggtgaatttgttaattattggtataatatttaacattgccaccaatttaaaacttatttctccataacttgaaacaatttcaatctgacactctattagaatgttatattatgtaaatatgttaattatcagacatacttccttggttctaaaacctatatccctgttctaactcatgaattacaaaccaaaacattaagtaatagcagaaatgtaagaaaataggtatatgatttggttaagcccattgattacattagcaattaaagtaaaagaggaaggcaaacttgtcatcacatttctaattttatcatataccagacatactttgactgtctttactatcattttgctctttttttcctctctttttctgtaacacactacatttatgtgttagtggtaatggcttataacacattatttttcccttcatatctatggaatattgattctagtttgttgttaactttgaactagaaaaaatgatattcagatatatatgagtatatatgtgtgtatgtatatttgtatgtgtactaaatttcacagactgcatgcatatgttttaataaatcagaggggctcacataattcatctaatcagttgtctaatcttaataatagagaaacagaacccaagagaaattatatccacaaatatattgtgaaagtgttattaatgaatgtgatcattatatgttgagttcaaagacagctcttttaaaaaagccaaacccaagattctgtttttcacatgattgtaacagaattagtacacaatgccaatacatgactgaatggaaatcagcatattccttaacatgctgcagtcagcattatataggagacacctataacagcacttacttaaaaaaaaagctgcaattgtttgtggatatactcatattttttttttcctttcaccagaccaatgctgactttcagttctattgatctaacatttgtgtttgaactagaacatgcactgaaaatgttggattccatattactgcctatactgatttttattgtcaggtatctgtattactgactctacacacacagacacagaaataattataaatgtccaatgtagccaccttttaatttactatcctaacatgtattccgattagtactttaaaattctttttctcagactttggtattcatcctatgttgatataagatagttttttcattttcttctttacgttcgtatctgttactattagctgctgtatggagtatgtttaatacaataaaaaataaagtgatacctaaaatttataatcagaataaaatgttaccatctttatacatcttttacactaatatgttttctacaaagcagtacagttttattttagacatatgttcatgatgtttcaaaaacaacaagaaactatcagaaaaatgaaaaataaatttgaattgatatatatatgagtgtgaatccctttaaaaatatagatcctatacatatttataagagaaaaactttagaaactctgatttttattattctgttgtttcaagctttcaagttgaatcgagtttttctttgatctaaaaggcaatttatttttatcagatactaattgttttaaaaagatttaatttgttaatatactttaaggattttgtgatatttttaataattaaatgcccaataagagttagaataaaaaattaactttaccgtcaaaaaggaagatctcctgcaccctctgctgctatgtaaatgaaactgcaggttatttattataaacttatttttattttataaaataaaaaaagaaaataaaaaatttaagaagattttttaaagatcttttcaaagattttttaaatttaagaaaataaaaaatttaaagaaaataaaaaatttaaggcaaatccagtcattttaatatacagtaaacaaacgaaccattatagatgtctcaaaagaacatgcatctcagatatatagtttacttaaaaataagtaaaatataaactgacaaactagctttgaaaggaagaggtataatggcatcaatttgttattaatgagaaaaagtcataatgctacatacttctaaatcatcatattacttaaatttattaaccaacatacaaaaatctattgtggtttattgtttgtaatatggaaatattaaacattaaaaagattgtgaaaaacctggagtgaattatttgtgtcttatggctcactgccattttagatgaattattgtgttgttaaaataaattgactttttttctaagaggcaggaaatagcttgcaatagtgaaaccagatagaatccgagctgttacaaaagttgatcccaatttataaacagataccacttggattgaaaatctatataaagtataaattttactattaaaatgtagtttaataaaaaatagtcttgccgggcgcagtggctcatgcctgtaatcccagctcttagggaggcagaggcaggaggatagcttgagcctaggatttgagacctgcctgggcaatatagcgagaccccgttctccataaaaaggaaaaaaaatacaaagtctttatattattttaaggattcttagcacttccatatgttttatttatttaaatattttatattaaactataaaaattgaagcagttattaaaacactaggaattgatgtttgtattttgtcgaacttggtgaaattatttttagaaaaggcattttctgatatgtccaatctcctattccttcccagtggaaaccactgttaataatttttgtgtatcttccaagttgcttttaagacatttacatgcgtatttctatatccttccatattttgtagtttttaaataggctatatatctcatactcccttattttgatttttaaagtcttaaatataaaagtaattcatgaattcattctgattgttgaagcatcgtattacatataacaccatgtccccgttgacgacaacctcaattcaaaggccctctttaagggtaatcactgttaatgctttgaagtacatccttcaagatttttttcaggaagaaaaaaaatcatacacacatatgattctgcagagtatttaatattatacatactatttgataataaattttgaattgacataaaatgtattccgaatagtatatcacttaccaatttgattttattaacacaatgccttggaaatttttcctttgtttgttcatatctttgaccttatatgtttagctcttatatattatgctgtggaataaatagaccatttttagaattttaaaaattctcatattaatgaacatttatattattttatattttcactacaataagcctgagtatccctgtacatgcttctttgagcagatctgtgagtattattctagggtaaatgctgagaagtagaattattttttcattttatactttgataaataattttaatttttaaatgactttaacaatttggatttctttgtaaatgtctgtccatatatactactttttcaccaaacctgatattattaagttttaaaaagttataaatgaaaaatattgtatttatttctggttgataatggagttgaatatctgctcgtaatgttgattagtgatttatatttccttttctataaatttcctgttactattctttgctcccttttattctttgtgttttctgtttcttactggctcataggagttctttctatttccccgattactaatgagtttgagtattttaaatatatattcattggtgatttgtatttcttctttcaggaattacttgttcttattctttgctcacttatttttgattttagattctttttcttattgatttatagttctttatatattccagatattaattatctgactggcataggataccaaagaccagcccctgtcttaatgtatcaattagtgctccagagctttcccatgggatcagtctgaagctagtgtccagttttgaccacatcctggcttagcttcttatccacatatccccagtgtccccatcttattagactttctttctttaatcagcttctcatgtttgaacaagaattccttactcaggctctgcttctaggaaatctatcctggacctgtgatgacattttttttgaaatcagtgttttaaaatcaagccaattctccaatggaagatataattataaaaaaaaacaactgctctttactaataaacatatattttaagatgtgtgctatcctctttaaagttgtatttttgttatactgacattgccaccgctcaacaaatttatcaaattcagcttttggaaatcatgttcagactctgagacagtctttgaatgttcataatattgtcagttctttgctccctgactaaactattttgttgacagtgaacaattattcagtcatgtgcagtcaaagtgatcaatgtggtcaaatattttgaaattatttgtaacagacggttttaaaaatgagaagtgtctgttcatatcctttgcccactttttgatggggttgttttttttcttgtaaatttgtttgagttgtagattctggatattagccctttgccagatgagtaggatgcaaaaattttctcctattctgtaggttgccggttcactctgatggtggcttcttttgctgtgcagaagctctttagtttaattagaccccatttgtcaattttggcttttgttgccattgcttttggtgctttagacatgaagtccttgcccatgcctatgtcctgaatggtaatgcctaggttttcttctagggtttttatggttttaggtctaacgtttaagtctttaatccatcttggattaatttttgtataaggtgtaaggaaggcatccagtttcagctttctacatatggctacccagtttccccagcaccatttattaaatagggaatcatttccccattgcttgttttcctcagatttgtcaaagatcagatagttgtagatatgcggcattatttctgagggctctgttctgttccattgatctatatctgtgttttggtaccagtaccatgctgttttggttactgtagccttgtagtatagtttgaagtcaggtagcgtgatgcttccagctttgttcttttggcttaggattgacttggcaatgtgggctcttttttgtttccatatgaactttaaagtagttttttccaattctgtgaagaaagtcagtggtagcttgatggggatggcattggatctataaattaccttgggcagtatggccattttcacaatattgattcttcctacccatgagcatggaatgttcttccatttgtttgtatcctcttttatttcattgagaagtagtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttatatcctgagactttgctgaagttgcttatcagcttaaggagattttgggctgagacagtggggttttctagatatataatcatgtcatctgcaaacagggacagtttgacttcctcttttcctaattgaatgccctttatttccttctcctgcctgattgccctggccagaacttccaacactatgttgaataggagtcgtgagagagggcatccctgtcttgtgccagttttcaaagggaatgcttccagtttttgcccattcagtatgatattggctgtgggtttgtcatagatagctcttattattttgagatacatcccatcaacacctaatttattgagagtttttagcatgaagggttgttgaattttgtcaaaggccttttctgcatctattgagaaaatcatgtggtttttgtctttggttctgtttatatgctggattacatttattgatttgcgtatattgaaccagccttgcatcccaggaatgaagcccacttgatcatggtggataagctttttgatgtgctgctggattcggtttgccagtattttattgaggatttttgtatcaatgttcatcaaggatattggtctaaaattctcttttttggttgtgtctctgccaggctttggtgtcaggatgatgctggcctcataaaatgagttagggaggatcccctcttttctattgattggaatagtttcaggaggaatggtaccagttcctccttgtacctctggtagaattccactgtgaatccatctggtcctggactctttttggttggtaagctattgattattgccacaatttcagctcctgttattggtctattcagagattcaacttcttcctggtttagtcttgggagggtgtatgtgtcgaggaatttatccatttcttctagattttctagtttatttatgtaggggtgtttgtagtattatctgatgttagtttgtatttctgtgggatcggtggtgatatcccctttatcattttttcttgcgtctatttgattcttctctcttttcttctttattagtcttgctagtggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctggttcttttaattgtgatgttagggtgtcaattttggatctttcctgcttcctcttgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgaatttaaacccagctgttcttgtatcagagtctgaattcttaacagttatgcattcactgtgtctaaaccttagtacatggaaccgtaagattatttaaacataaatatgcctcttattatttacttaagcctgggtcatatgcttttacacttctttcttcttttaccactaacttctttctaaatctgaccaaagcccatctttctctatttctcttttctctctgtttcttctggtcattaaaaactaagattgtatctggctgagtatcaagattacgtatataaatgtgtaacttatgtctttctaaatatatatcatcatcccttaattaattaatccaaacgactcatctgctttcctaaatcctgctagaataatttctttcaaatgtgttcttcccttttgtagcttttcccattgtcatgctacttgcacaccactcaccctctttctctttttatctgggggattgatttatacaaatctaatcagagacagtctgtctttgcttatataccatgttttgtgtcaattcatttttaggagtgacccaaagactgacatttcttatataagcaattatttgttttggttattatgtttatttgttgagaacaacttagtgtactcaatatagctaaattatatacaaatttaataaattgttaattaaacatatctaatcaattatgtgatttctggctttttctaccttaggctgacaatctcattctcttttctgtgactgatcatccacttggtccagattagccatccttttaatgtgtctcatattctcctcactgaccttactggcagaagtggctttcgtcattgttgtgggagtcatttagctgttaaaagtgcctccattattttcccatttatttaaggggaaacagcaaaacattttggaaatgcatttagagataaactgaaaaagtgttgagatgtagatagcatggtctttctagtagaaagagcctggactgcaagaatcctcacaagtgtgagccctgtttaaatctgggttaaatgatataattaggtaagactgggaaattacttcaagctgatatcctacttattttagtaaaaaatgatcaatgtcctttgatatgtttacatattattaattttctgccatcattttcttaatgttaaaattattacctaggaaatatctgttgtttttttggggatcttcttttattttcaccaagtataatggaagattttctttttagtgtggtcattaaggctctaccaggttattttctgaatgtttttctgagaaagaatcttgctgggaccagatttaacttatgcagcattcccctaaacacttcaagtattgataatttgttttcaaatgccaataaaaatataaatttagggactttgattacaagaggtcagactactgatctcacattatatacgtcttttcagtattattttatgtcatttttaatagactggttgggacacatgttttgttaggtagatgattttcataactattctaagagctacaccaccatgtacctcttgtttgaatatatttcctcagaaaaggcagagctctatacctaatctgtgccaagcagtgtgttagtgtctttgtgatgtagtatcttctcattcttaaaaaactctataaaataattattattgatgttccagtttatagtcttagtaagtggtagtacttgcatttaagtgccaaccaactgcatgtgtgcgtaaaaagtaattaagagagacaaaaatacttaggattatctcatatatgagaccaggtgtcatgtcattagctctgactcataatgaaaaaatatgaggggtgtccaaattctaggaaaatatttgaaaagcaatgagaaagaagaaaagcgaaggcaattttgctttccttttacctgtacagacagatagacctatttaagtgtatggtagttagcttccaagatgatacagctctgaaaccctgcaggactgttttatgctgttggttaatgtatgcatttggaatcacaaaagaaagagtatttgttttttgagacagggtctcgctctgtcacccaggctggagtgcaatggtgctattgtggtttactgcagccttgacctccaaggctcatgtgatcctcccacttcagccttccaggtagctgggacaacaggtgtgtgccaccatgcctagttaattaatttttttttctttttttctaagagatgggttctccctatgttgctcaggctggtctccaacccctgggctcaatttatcctcctgcttcagcctcccgaaatgttgggattgacaggcatgaaccagtgaacccagagaataatttttaaaatgtcttaattatgtaatatattttacttttagtccaactttaagtaggtaacatattaatgatccatatccaaattatgaatcatttaactagaattcatgtcttcttcaaccatatcaaataagaaatttgactctaattttatttagaatagatcctcctataatgtggtactctgttcagggtaatgattgtgtttactaaagttggagaggtcattgaataaagtactgtactttctggaagccttttgttaaatcctggtgctaaagaacaaaagtactgtttcttcaggttgccattgtaaatttctaagagatcaaactgagttttatttctaatagggtctgtatacatttgtgtagtagtattgtcttcaagttaatcttatcttttgtttatttacatagcattaaagttataattaaaaaacacttctcttatgtaacaaatttgttttttcaaaataaaataacgtttatggtaataaagacccctagataatggataggtctagttcaaccttcatatttttaagacctattattattaaagtgactatgacttctgaattgagaaatattagataagaattgagaaaagatgtttattttatccaatttggaaatttataaaaatatatacaaggtttgctaagggattaaaggtaactgttataaaaacattgtagtaaaaagaaataaaattagcagttatgatgttgttacatttatctttcatgaataattgaagttgctatgatgacatattgtttcattaaacttattcagcattattttttcatgttttcaactgtttattagcaaatttcagattattgaactttttacagtttggaagacttttaataaatatgcatctctaaaagttgtaatttagcataattaccctcaggattataagatttattcatggcagtgagacagaaaatatatttatgtaggtttgaaatcctgaagtgttgaagctaaaacttcattttttaaaatctatgtattctataggtacaaattgcgtattttatcaggcactgggtattaaagcaaggagaaatggtttttggcattaagaagcttaagacaaaatagtaaattgagataaatatacagatgcttactatgtaagctaatacttgaggatatgtaaaggaggagtaccaggtccaaaatgagagacagtgggaatggggtgtcaggtagggaaggagtgtcagggatggcaacttggaagaggcaatgttataatagtaggaggcttttgccatggagttacaggaagggcatcccaagctggtggacccaaatctccaaaggtcttgaaggtgaaagtgattagaatatggcagtcatgaccaagtgcagtggctcatgcctgtactcccaacactttgggacaccgaggcaggaggattgcttgaggccaggagtttgagatcagcctgtgcaacatagcaagactctgtctctatgaaattttttttaaagttaattgggcatgatgctgtatgcctgtagtcccagctacttgggaggctgaggtagaaggatggcttgagcccaggaattcgaggatgtagttaactatgtttgctacactgcattctagcctgggtgacagagcaagaccttgtctccaaaaacaaaacaaaacaaaacaaaacaaaaaggaagaaagaaaaggaaaaggaaagaaagataagaaaatggcagtcatcagtgaaagcggagcatgaagtgtgacgagaggactaatgaatctggagatgtagacagcatccaagccttaaagagccttcctaaagaatatggataatcttgacctatagtctattttcctcttatttggctgagaaactctcaagggaaatacaagttcatattaaaaataaaagacatgtgaaggatatttacctctagtagatttatatctactccaggttattcaataatgtgcagatatcttttagtatctatgatgtttttacttaaagaaactaggacaaacatatcactgacctaaatagattatttgtgcccagtggaagtctggtggttttcattaagtatttaggagcaagagtgattttaaaattgctgccaatgactttctttacagaattggaaaaaactactttaaagttcatatggaaccaaaaaagagcctgcatcgccaagtcaatcctaagccaaaagaacaaagctggaggcatcacactacctgacttcaaactatactacaaggctacagtaaccaaaacagcatggtactggtaccaaaacacagatatagatcaatggaacagaacagagccctcagaaataatgccgcatatctacaactatctgatctttgacaaatctgagaaaaacaagcaatggggaaaggattccctatttaataaatggtgctgggaaaactggctagccacatgtagaaagctgaaactggatcccttccttacaccttatacaaaaatcaattcaagatggattaaagacttaaatgttagacctaataccataaaaaccctagaagaaaacctaggcattaccattcaggacataggcatgcgcaaggacttcatgtctaaaacaccaaaaacaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagagaaaaccaaacaaccccatcaaaaagtgggcgaaggacatgaacagacacttctcgaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacagatgctggagaggatgtggagaaataggaacacttttacactgttggtggaactgtaaactagttcaaccattgtggaagtcagtgtggcgattcctcagggatctagaactacaaataccacttgacccagccatcccattactgggtatatacccaaaggactgtaaatcatgctgctataaagacacatgcacacgtatgtttattgcggcattattcacaacagcaaagacttggaaccaacccaaatgtccatcaatgatagactggattaagaaaatgtggcacatatacaccatggaatactatgcagccataaaaaatgatgagttcatgtcctttgtagggacacggatgaaattggaaatcatcattctcagtaaactatcacaagaacaaaaaacccaacactgcatattctcactcatagatgggaattgaacaatgagaacacatggacacaggaaggggaacatcacactctggggactgttgtggggtggggagagtggggagggatagctttaggagatatacctaatgctagatgacaagttaatgggtgcagcacagcagcatggcacatgtatacatatgtaactaacctgcacattgcgcacatgtaccctaaaacttaaagtataataataataaaaaataaaaaaaaataaaattgtttaaaaatgtttctcattagttgaatcctttgaatacttgctaaagagttatgggactgactctttcatttactgttgttgttggtgttttttatttttttttttgagacagagtgtcactctgtccacccaggctggagtgcagtggcctgatctggctcactgcaacctccgcttcctgggttcatgccattctcccgcctcagcctccctagtagctgggactacaggcgcccaccaccatgcctggataattttttgtatttttagtagagacggggtttcaccgtgttagccaggatggtctcaatctcctgacctcgtgatctgcctgccttggcttcccaaagtgctgggattacaggcgtgagccaccgcgcccggcctcatttactgttaatgctgatccaaatgcaggaaatactttaaaaatggccaataaatattttaatatacataaatttgagtatttcagtaatgatggttgacatcttgacattcatgcattgaagtctgtaggttcacaaccagctgcaaatcattatggttgattatattctaattagagcaaaattcttcaataggcattgaatggaaataaatgttgtatataagtgaaaaatatcgtggctgtaagtgatgttagttaaaccattttaaagaatatagtcatgaaaaaatgtattattcattgtatacactttggaaaatctaagctgtgaggaaaatcacacatttttatttgtgaaaaattgtaagagctaaaatgtctgtttatgttttaggttttcttcaagcaaagccttacaagaatactgaaatgttttggagtgtttcacatatagtttgatttaaattcaaattcatatggagaaaagggaactcttgcacactgttggtgggggtgtaaattagcacagcctctatggaacacagtatggaggttcctcaaaaactaaagacagaactaccatatgatccagcaatcctacttctgggtatatagccaaacaattgaaatcagtatgtcaaagagatatctgtactcctatgcttattgcatcattattcatgatagccaagatatgtaacaaacctaagtgtacatctgtggatgaatggattaagaaaatgtggtttatttatataatgaaatgctattcagcctaaaaaagaaattctgtcacatgtcacaacatggatgaacctggaggacattatgctcaatgaaataacctagacacagaaagacaaatattgcatgatctcagttatatatggaatctaaataattaaactcatagaagtagaaagtagaatggctaccaggccccaggatggaaggaccgggggctggggtgtcggggccaggggaatggggaaataatgttcagagggtacagagtttcagttagacaggagaaataagttttagaggttgattcgacagcatggtgactatagttaataataatgtactgcatatttcaaaatggctaaaagagtagattttaagtgctgtcactacaaaaaatgatatgtatatgaggtgataagtatgttaatttgcttatttcataatataaaaatatcaaaacatcacgttatacctcataagtatatacaattgtcatctgtcaattaaaaataaaatcaatttttaaaattaaattcattgactgtagtgaaaaatcatccatcaaaaatcttataatacaaatatgttagattttatgttgtttggagaaaaatattaaatacttatgaatgcatatctgaaagcaaatatttgtcatttttgtcacatacttgttcaaggaaatgaaagtattttacttgatcagttctcatatttatcaggatgataaaatagaggattttaaattttgtatagtatttgttaatttttagtcacgtagttttggttgtaaagactaagaaatgaaacagagtctgattcaatttacaaagggagagatcgtattacagttgaaggattaagcaaaactcataaacaaaacagcaaccaaatcaggtacagtttaaaaatcagtgaaaaatggcagtcactagaatagcaatatttgctgtacaagtttgaatccttgatgtagaaacatagctgggccttcattcagcagtaggagttcatgactaattactttagtgaatgcagtatgtatcatgctgattatgagctgaccctgtagggttttttattcctgctttaccaggtgttggctgaatgacattatgcaagttgcttttctgttgtaaaatgttcatagtcttattacttatttctagaaatataaggtgtgaaagagataatctgtgggaaagtacctggtacgtagcagttgatgagttgtagctgccacatctcctcactcgtgtcctcctcctcctttatcttctccattgataccctgaatatactgacattaatatggttcataaatgttctatgcttctgattctctcagtatgtattgtcacttctctcaaggttaccaactgtcttagtttttactcaagtattttcttcaactgatacctgtggttctctcataagtttaacttgtttataaccctatgttatatccttgtgatttagtttcttcttctaatggcctgcttatctctcagcttcccaaaccaaacttgtcctggggtggggggaggggggagggatggcataagagaattacctattgtaaatgacgagttaatgggtgcagcacaccaacatggcacatgaatacatatgtaactaacttgctcattgtccacatgtaccttagaacttaaagcataatttaaaaaaaaaaaagagaagaaaaaaagtctatagccattggcttttctttgagtgctgattgtagtgtcaggctataccattgtcttgtttgtgattctgttgagctcacgtcagtaacttgttgagtcgtgtggtgtaaaatgaaaatacttctagtggtctctgacaggagtcatggtggggcatttacccagacagaaatttttatgtctgtcacgtgcctactgcatctaaataaataaacataaaaagttaagaataaacagtttaccaaaattatggaacagctataagtaggaagtctgggtcttaaatacctggtgtctccaaagccaacactcttgcataaactttaaatatttctgttaatcttaaaatgtttgcatcattacaaaatatcaatactagctattgggtcatttttactacttataaattcaaaaaatctttattaggtatcagatttttgttatttatcgtcttagtataaactaaattctattttgtgtctcgaaaagcaatattttgttttaaaatgtattatttgtagttgaattctattgacttgttgtttttgttttaacctttctcaggctgcaaagttggctttcacagtgcaagcctttgattcccaatgggggactcaggatcaagacgatctaccctggtctcccggttgccaatattcagaagaagtattaacagaagacatgattctcttccttcttcaccttcttccagtaatacagttggtgtccacagttcctctccttccagcactaactcaagctcaggtagcacaggtaaacggaggagcatattccgtactccttccattagcttccaccataagaaggggagtgagcctaagcaagagcctaccaaccagaaccttagtatttcaaatggtgctcaacctggtcacagcaatatgcagaaactgagtttggaagaacatattaagaccaggggaagacattctgttggttttagtagttcacgaaataagaagataacaagatctttgacagaggattttgaaagggaaaaagagcactcaactaacaagaatgtctttataaattgtctaagttctggcaaaagtgaaggggatgattctggtttcacagaagaccaaactcgtcgttctgttaagcagtcaacaaggaagctactccctaaatctttttcatctcactataaattttctaagccagttctacagagccaatccatttcattggtacaacagtctgaattctcattggaagttacacagtaccaagagagagaacctgtattagtaagagcttcgccatcctgttctgtggatgtaacagaacgggcaggaagctctttacaatctcctttgctttctgctgatcttaccacagctcagacaccttcagaatttttagccttgactgaagattctgtgtctgaaatggatgcattttctaaaagtggaagcatggcatcccactgtgacaactttggccacaatgattctacctctcagatgtccctcaattctgctgctgttacaaagacaacaacagaacttacgggaactgttccctgtgcaattatgtctcctgggaaatataggttagagggtcaatgtagcactgaatctaattcattaccggaaacctctgctgctaatcagaaggaagtgttattacaaattgctgaactacctgctacaagtgtgagccactcagagagtaacctaccagcagatagtgaaagagaagaaaatatagggttacaaaatggtgaaacaatgctggggacaaactccccaaggaaacttggattttatgagcaacataaagcaatagcggaacatgtaaaagggatccatcctatttcagattcaaagataatacctacttctggtgatcatcatatttttaacaaaacatcacatggatatgaagcaaatcctgccaaaggtatgctgattttttttgtataacaaatgatatgaattaattttcattatactttattcagttttcttattccatctcatgaatggaaaccacatttttcttgtttttcactttcgaaatggtttcctattcataatttgtgttaaatgtttcccctgcttgattttaaacttacatcaattgtgttatgctgaaaatgtaattcagcaatattactcattttttctcacttatgttatccataactaagaagcagcctcttagttacggtgtttattggagcaccttcagaagaaagtgaatggaaagtaattgtttgcaatgtggatttctccaaagtaaggactgtcttttatagagtttattatagaggcattggtatttcttatttaatgaaatggatatattccagctaaaatcactataaaatttgtataatttaatacgaattttataatttcctttgttaactaagctttcattattaattaggatccatgtttcaacataaataattcctatctctagatacaataacagaattgtaagcttaaaaaaacctatctttggaagctggagacaggtttcaactctgcctctgacattaactaactgtgcaactttggacaccttccctttagtttaaaaaaagtgttagtatatgtccattactgtaatatggctacagaaaactttgtttttttaacatgaaattcagttcaagaaaatttttgaatatataccacctgctgggctatctttgacatattttaattcctttttctctactatcattaatgctactactgctactaataattttcccaaatttggaagtgattattatgtcctagatattattctgtatactttatatacattaattaaaatgattgaaattgctactattattataagctattttgcaggcaagaagatgggagcaaagataaactgtgtgtccacaatcacaaaactaataattcatttattgggatataaatcctatgaggtaggctcctatgtttcccattttacaaatgtgaaaacaggctaaagaatcatacagctggtaagtagtgcagtcagattacaactctctgaatccaaagctctggctctccataactatgctttactacatgtcatgacttaaaatattaaataaaatttatgtgacataatgtcacgagtaataggattataaagtttatccataaacatagaatttcaaagttttaaatgcatgagttaattttccagctgtcttaatacttttctcatttgatacaagatcacttttatgcacgtgaccatgtttgtccatttttggaactttgtattctttagtcatatatgcctagctcctttacctgtaatataatcatgagaatatgataatgatgatgatattaatgatggttacccttttgtataattaatatatgcccaaaaatgtactaagaagattgcatgcactgtttcatatagtccttataaaaattttgcatgtcatgttaataactaaaatttataataagttaaataactttatagggtcacatagttagcaaatgatggacttgatattgaaatccaggaagttttaaaattatataaaaaagagatagaaatgcaattatcctgacatatctaattcttatttagtaatgatgactttcctcaaagcctaattgaatactgcatatttttctctctctggaaattagagaatgatcagttatcttggagactattactatgttgattgggatcctatttgtaacacaataacacattaattttgctgatttgataatgtgttggctgttcttggataaataagctggtaatgtcaacaaactaaactatcctttagtttttgaaaatattcatgtgctatttataaggattttataattttgaagtttaaaattttaaaaacagctaagtaaatgtattttatccaataaagagttgctatagacactaactttcataatgctaaatttagtttgtattttgtatgaaatatttaagccagtactttatacacatctaagtgttctaggtgtacaatcatgtcagaactaatgagttatctggcaatttaacttttattcattgtcttaaaaagttatttaaaaagaactgctatatattggactaatagattctggacagtctttaaactagtagatgagcctaattagaacaattttttcatttactcattcattcattcagcaaatatttattgttttaacactatgttaggcactagggatgtagcaatacacaaaacaggcctagatccctgccttcctgaggcttactttccactggggatactcagttaacatgctatatatatcagatggtgataactgctgagggtaagtttaaagcagaataaaggcttaggaagcagaagtgggattccagtttgcatttttaaatgtaacaggatgatacccaaggtaacatattggtaaaggtttgaaggaacttaaataataagtcatacagatatttgagagaaatatattagtgcaaggttgtgagtcaaaggctgtgtagggctggagcatgccagtgatgtaccagagcagcaagagtccagtgtggcatgagcagagtgatggaggggagagcaggacatgagattgcagaggtgagcaggtgaacagggtgctcctcctgtccctggtttggggacagagagagcagtcatatgggtcatattatgaagaatttgttatgccatttgaaaaacatcaccttttggctagaggagtggtggtgatggccctcacttatgttttaagtatatgattctggctactatgtggaatgtagattgtgttgcgggtggagaggcagatgagagtaggcagaggtaggagaattgtagcaaatattgcagtaaccaagccagcatagatttggtccagggtcttagaaggagaggtagaaggaatcagattctgtatacagtttgaaggaaataaggacaggattcatttatgtgattaatgtgagcaacgaagcaacaaaggatgactccaaacgttttgggcttcaaagagattacatgattaagtgaactaaactgatgctatacatttaaaagttttcttgtgatagagaaactttgaataacactaagagtttttcatgatctttcagtgggacatttgtaaaaactacatttaaatatttaccttcatttttatttattttcctttccatagttcttgccagtagtctcagtccatttcgtgaaggaagatttatagagaggagactgcgatcctcgtcagaaggcactgcagggagtagcagaatgattttgaaaccgaaagatggaaatatagaagaagttaatagtttaagaaagcaaagagcaggttcttcatcttcaaaaatgaacagtttggtaagtatatacatatgtctgcctctaataaaataatgctgtctatatccgacatgttcatgtctcttgcaaaatgaacacagactacaggatagacacctcatatttgaagggaaaatttgtttccatagttgacattacaagtcagagaaacaaatttttcacctaggtcaggatggagttcaccatgacagctgtctttagttcctgtcttccttgcttccatggaaagtttgacattctttattctagaacaagacacttgaatacagaaactagggaaaatgctgaacatgaggctcccctttgacaccattatttcacatcttctctccaccatatagccctccagaaaatacccttttgtaaatcacacttactccagtaccactcttagtccctgtagaccctatcctcgctgtcctcctgcagtgcccttccacaaagggtgaggagttggtgtgaagcttatgaggaccaatgtgaaatgcccatccaatgcttgcatacattggaggtaatcaagataccctattcctggtccaaattgtagagcctgcttttagtatgagggtggaggtggggtgtgtggggagaggcatggtctgagtttgtatgtgtgaactagggtgtcacagaggcattagtatgaagctccctcatggtatgagatggacccaggggtgggaagagatgaggggcgaactgcagccttgggtccatgtggcctcaggtttcacaagtattagagtgtgattgccttttggagatcactttgctcaccttctcacaaatgtgtcctttttcagcagtgtatttaacatctattatctaaaaatgttccttaaaataatctttctacctacctatccatgcatatatgtgaaaaatgctcaaaaataaatcacttatgatatctctattgttttacataattgggtttcaaatgaaaatattaggtaattgagatctgataattattttgtgaagaagccttaagttagtaaggtaacattgtgtgatagcaaaatcactgtgcttgatgttagaggttttaatcgtttttttctggtgtgaccatttcttaatcctgggcaaatttgtaaccacaaaatagcaagtgataataggtgtcttgtttccattatactaaagaatgactatgtgagtatgtgtttacatttgtacatatggaaacatatatttcatgcttcgttttgttcttttgtgcattggctattatattattattgttgcagtggatatttttggtctaagtatgaaaatatgttaaagcggatttccaattgatgcaccattaaaagttaggactaatgaagtattacaaaacatttatcatcacaacattttcagtatttcttcatggagaggcatttatattaatagggttacactattcaacttgctcaaagttgtgccttttacatattctctcatatctcatgtgtttttcatactgcatttaatttaaataattctagtttgagacaagcctaggcaaaatattgagaactcatctctaaaaaaaaatttaataattagctagaagtggttgcacctgtagttccagctactcaggaggctgatgtgggaggatcacttgggtccaggagttggaggctgcagtgagttattgcaccactgcacttcggcctgggcaacagagcaagacctggtctcgataagataaataaaaaataaataaataaataaataaaatgtaaaaagtgcttcttataatatcacaaagtcactcttctcagatttactttttttttttttttttttttttttttgagacagagtctcgctctgtctcctaggctggagtgcactggtgcgatctcggttcactgcaacctctacctccccagttcaagcaattctcctgcctgagcctcccgagtacctgggattacaggcacctgccaccatgcacagataatttttgtatttttagcagagagggggtttcaccatgttggccaggctggtcttgaactcctcctgacctcaagtgatccacccgcctcagcctcccagcgtgctgggattacaagcgtgagccaccacgctcagccctccgatccgcttttaagatttaaaacttaagaaacaaaagtggttttgttcctttgaggccttatatttaaattttcaaaagtgtgcctgtagtattatagtctgtccactagatggcagaaagacaccactgccgtggtggtggacagtatatcagggttggaacagaaacttggtaaaatattgtacatgttcattggatttacagatgaaacttactgaaataaatactgaaacttttgaatttcctaaagagaactaccaaaaactacttcacgatcttaccatcttcctttggattttacaagttatgtctcatctttcagttactttacagtttattcattttttattttaatttttaatttttttaaggcagagtctcactctgtcacccaggctggagtgcagtggtgcagtctcggctctctgcaacctcccctccccggttcaagtgattcttgtgcctcagcctcccgagtagctgggaccacaagtgtgtgccaccatgcctgcctaatttttgtatttttagtagagatgtggtttcaccatgttggcctgattggtcttgaacacctgacctcaggtgatccactcacatcacctcccaaagtgctgggattacaggtgtgagtcaccgcacctgagcagttacttcacacttaattaattaatttaaaatgcatgaaatatgttttttaacttgtagcactgtaaggaagaaatggtagggattatttagttctagatacatgtgaaacaagtgatgtatatttggaaaattgtagctgtctgtgtgaacactggcacattttctatattcctcttccaaaataatttaagcaactgcatgtatttaagaatgtatccatggttcagttattttattttaaagcaattataatagaaacatgtgtttttaatgcttgttggaaccaagtgactacttttaatgcctgacatgtattatcacattcagtcctcacaacagtactatcaactaaatgattctgtggtgatcaaattttgcgaaagaggaaaataaggtactgagaagataagcaggttgcctaaaatgacatagctcataaatggcagagataagatttggatttggatcctttctaagttcaaatcctacaatcttttgggaaaatgtattcgatttaaaattaagttgagccatttttcaattgtttgcatcaatttggtgtaatgaaattaaaacatttaaagcaatctaaccttgcttgctctaagtctaggctgcagcattctgtaagagatacaaaagaggaaaacagaaacaaaatttagtgcttaatctgaacttaaaatgcggtcatgtttcttgaaatgctgatgaatagtatcaatgtccttactgagagatatcccatcaaaaaggaactttgtcacaaaagaggatattcatacttagcagttttgtaatacttctttactcctaacttttaatgttagcattaatgcagcccttcatgtagttcatggggatttcaattctcataataaaatatggctctatttattaagatgctgagcatttcctgaaagaccgaagatattacctgatggattagatatagttagatataccacagttctgttgtttttgtgtacttctggggtatttcaatctggaagcgaaaggacaggatgtatgaactcttcaaacatcaaatgccgagaacaaattgggattggcttaggtttattaaaggaatccaaagtaaatttggaacaatttgataagtgttcacatttattatattttttcaaacctctttatagtatttttccaatttttctctaatgagtagctttctgaatacatttcttgcgattgtccaaaaaatttaaaatgctgttctagaaaaaagttaaagaacatatttctttaaagaacttacttcaggaagtttctctccagactatggtatataaatgtatacatgtaaggatttctcatgggttctccaatggctttacatagggaattctaactctaaatatttacaagattactctctaaaaaagttaatgtgagagtagattcatatataatgaacaatacagaagacctggtaccgttaaaggaaggaaaaatgcctaagtggatgagtcaggataaacttggctaagtgataaaaaataccgctgggcgtggtggctcaagcctgtagtcccagcactttgggaggctgaggcaggcagatcacttgaggtcaggagttcaagaccagcgtggccaagatggtgaaaccccgtctctatttgcattttgtaaaaatacaaaaattagctgggcatggtggccagtgcctgtaatcccagctactcggaaggctgaggcaggagaattgcctgaacctgggaggtgaaggttgcagtcagctgagatcatgccactgcactccagcttgaacaacaaagtgaaactctgtctcaaaaataaataaataaaataaaataaataaataataacttccaaatctagcgacttatataatatagatttctttctcacttaggctacatgtttattgtggaaggcattggggttctgttcaatgtctcctcctcctgtattcaggctgtggaagcagctaactctgcaaacattgccttttaccatggcaaaaagaaagagatctctggaggtccctgtaataaaatactttgaattgtgaaactcactttcttctgctcacaactcattggtcagatctaatcatatggcccaaactagaaacaaaagcagccaagaataataatgagtttcctgtatctagaggcggagacttaggtttggtgaacacttaatgactcatattcccaaatattttgttgtatccaagttcttttaattaatcgagatttactgactgcctcctctttcccttttgtccagagtcatttaatgggccctgactttgtgcttcacactgtcctggtctttgtggttgaaaagatgaaaacatctctgtaactgaagaattcatatatactacaggttttattctttagaatattctctcttccttacttaaaggccttgagatgtgtatcttaagtgaactaagtttacttttttccttgactcaaggaatctttactatttttgtaagtatttattttcattgcaccaagcagttggttttgaaggttgcattatcttcagattactcagcaaatgcatttgcaaagttgccctgtactatttgtgctaagtgattcagacaactttcatttatggccaattttactctgacacagcatgttttctttcatttagcatcctgctgcttttatgtggaaactgtgaatgacacagtaaaaacataactgtaggactttggtagaagaacaaatccgatttatatttgattaataagaagtagttagttgcagatcgttagcatctcatatcacatttaattttttggtatgttgaactgcagaatttacttattattgataatagtagaataatatgactgtaccctatttgagatagccaaacactttactattcatttacttttcttctggggcctgctgttttctcatttattagcttatcctttattcattataattcttcatttcttcattcattaaaacattcacagtttcttacaataaatatttattgacaatctgctctgaagaatcaaagatgaaagagacagtgcttgaggatttttgagttcccaaagggagagataaggttaaacattatcttgccaatacaacagatttaaccattttgaccatctctaagttcagaatgggtggggcatgcttcatttggattgtgagcatcgaaatccaaagttaagaagagttaaaatgggcacatgaactcctgtttcccagctttgtctgtgccttatctcacacactcaatgacactgttaaatatatgcataactttcttgtgtcttttgttcatttctctaactgagacccagctgctagtgctgagcaggtttgctgaaagaaagttgggacagtaaagaagaacgtacaaaatgaatctcatgattaatattaaaacaaatcagtctcaaaacaccccacttgtacaatccgccaagcaaaagaatcccactgggctcatttggtatatacaccttcacacttctgtttcacggcatgaaagttgctcaagcttgaaattaaaaacaagacagcctgggtgcagtggctcaaatctgtaatccctgcaatttgggaggccgaggtgggcgggtcatgaggttaggagatcaagactatcctggctaacacggtgaaaccctgtctctactacaaatacaaaaaattagccaggcgtggtggcacgcgcctgtagtcccagctacttgggaggctgaggcaaggagaatcccttgaatgtgggaggcagaggttgcagtgagccgagatcgcgccactgcactacagtctgggcaacagagcaagactctctcaaaaaaaagcaaagatgataattagaagatctgattttgaaaatttcttaatcttgaaatccttaatgagactttccagtatgtaaaaatgttaatggctttggggagttaaaataacgattgcagtttttagtgtaactgactgttaatagaattaaagcaaatattgcttggttacagggacatctaataaaaatggaagccattaatatttttcaggaaatggagccatatgaatcattctcctcaattcttataaattttaaggaagaaaatcacaagtatcactcattaaacatgaaattacatttgttgataactggcatacattttaggttaatagccctaatcctttatgcttttatttgtttttccagttactaatcatattttcctttcagtacccttctaaattgtatcatggacgtaacactcaccacatagttatttgaatgtgtctcattttacctgaaaggtttcaatcgtttaaatggaaggagctgtgtatatactggcatttcttgcggtcattaatatagcacctggtggaaaaataggcatctaataaatatgaataaattaaaggtaaaatttctggttaaataatgatacatgtttatatagatgtgaattaaggcttctagtacaagaattgtgtgtggagtgcttatgcacagttttgacattttaacttattattcaaatatacaggtatttcttatgatgcattgtctgataaagctctggcttttttgacactaaatccttgatcaggaaggccataccaattatgacattgttccagtggaagcacaatttattttaggattatcagccttatagaatggtttctaggattatatgagtacgatagttataaactggccatacaatgaggacaagaaatagtcaaatatttgtggtattcattaagcccattaaaatataatatcttggtcaaatatgggtaagcgaagatttttaaaatccgctgctattttatctagtccagctcacttcgtttcttataagcttatagattcagagttgcctttagaagcaggattgaataaaaatattccattcatttttgtctttctgaactttgagatgagtcattttcatttagaagctgtcacaatttgtatgtttgttgggcaaaattagtaatagtttattcatacacttaactcacttcttaaatgatttaaagatcggtttgagtaatacttagcacctacattgttacctctgtgataacataatttaataattattacaggtacataataggtggatatatttatggggtacatgtgatattttgatacaggaatgcaatttatattaatactaatcacatcaaggtaattgggttatctatcacctcaagcatttatcatttgtttgtgttagggacattccaattccaggtttttgttattttaaaatatacaataaataattttttcactatagttaccctattgtgctataaagtactagatcttattcattctacataactatatttttgcatacattaatgtccccccaaccctccaactctttccagctcctgttacccatcattctattctgtatttctgtgacttcaaatgttttaatttttagctcctgtatatgagtaagaataggcaaaatttgtctttccacacttcattaattttatttaaaataaggtcctccagtctcattcatgttgttgcaattgacaggatctcatctgatttttatggctgaataatattctattgtgtgtatgtaccacattttctttatccttttgcttgctgatggacacttaagttgattgcatgtcctggctattgtgaatagtgctgcaataaacatgggagtgcagatatctctttgatatattaatttcttttttccgagtgcatacttagcagtgagaaagctggatcatatggtagctgtatttttagtttttcaaggaatctccaaaatgttctccatactggttgttctactttaccttttcatcaacagtgtacaagggttcccttttctccacatcctgttagcatttgttatttgcctgtcgtttggataaaagacactttttatatgcctgttgtccatttgcttgtcttcttttgagaaatgtctcttcagatatttttgcctatttttaaattggattatttagttatcttttctattgagttgtgttagctgcttatatattctgagtattaataccttgtcagatgggtattttctccccttctgtgggttgtctcttgactttgttgatagtttcctttgctgtgcagaagctttttagcttgatgtgatcccatttttccatttatgctttggttgcctgtgtttttgaggtcttagtcaggacatttttgccaagaccaatgtcttggagagtttccctaatgttttcttccatagttccatagtttgaggtcttagatttaagtgttaatccattttgatttgatttttatatatggcaagagataggcgtgtaggttcattctctgcatgtggatatccagttttccagcaccatttattgaggaatctgtcctttcctccatgtatgttattggcacttttgttgaaaatgaattcactgtatatgtgtggatttatttctgagatctctactctgttccattggtctgcgtgtctgtttttatgatactaccatgctattttggttattatagctttgtaatgtaatttgaagtcagataatgtgattcctccagttttattctttttgttcatgatggttttggctattctgggtattttgaattgttacatcaaaattttaggatcatttttctatatctgtgaagaatgtcattagtattttgatatggattgcattcaatctgtagattgcttaggtaagtgtggatattttaacaatattgatttttcagtttcatcttcagtttactttatcagtgtttcatagtttttattgtagagatctttcacttctttggttaagtttattccagtaaagtttacatattttattattattgctgttgtaaatggtaatgcttaccaggcaaagtctctttttctcttccttcactttcccctaaacagaaggagactctgtggtaaggtggcctggagctgagggaggggtaatgtaagtacttccattgccaccacagctggaactgcactgggtcatgcctgaagccagtgcagtactgggtcttacccaaggtctgtgacaactgctgcatggctaccactgatgtttacgcaaggtccaaatgttctttagttagcaaatggtgaatcctgccaggtctggatccttccttccgggcagcaggttcccttctagcccaggctgggtctagaaatgccatccaggcgctggggtctagaatcagtggcttcaggaatatgcagggtgcttcattttaatgtagctgagctggttaccagttgcaagacaaaatcctctgtactcctccctctcctttcctcaagcaggagtctctccccatgctgcacagcctggaattgggagaggggtgatgcaaggactcccttggctgccacaggtgttgtctcactgggtcatgtgtaccccaagtccactggctccaagtccagtgcagaactgggatttgcccaaggactgaagttcttgtgacctgtctttcaaagttatttgggaccccatgccactttggtcagctggtggtggagctagctggagctcagattcctacccctaggagggaggattctcctctggcaggaggggaaacctctaaatggtttctctgtgagcactggcagaatttggttctgtgttgtgttctcttgtgacaagacagcaccgagtcccaatgcaaagcctcacaatcacttcactctccctcccacaagctcacaaattttctgtctgtgctgccagaggatggagtaatggtggtttgggcaatgcaacagtgtctttcctatcctcttttttttttaaattttattattatactttaagttttagagtacatgtgcacaatgtgcaggttagttacatatgtatacatgtgccatgctggtgtgctgcacccactaactcgtcatttagcattaggtatatctcctaaagctatccctcccctctcttcccaccccacaacagtccccagagtgtgatgttccccttcctgtgtccatgtgttctcattgttcagttcccatctatgagtgagaatatgcggtatttggttttttgttcttgcgatagtttactgagaatgatgatttccaatttcattcatgtccctacaaaggacatgaactcatcattgtttatggctgcatagtattccatggtgtataggtgccacattttcttgatccagtctatcatggttggacatttgggttggttccaagtctttgctattgtgaatagtgccgcaataaacatacgtgtgcatgtgtctttatagcagcatgatttacaatcctttgggtatatacccagtaattggatggctgggtcaaatggtatttctagttctagatacctgaggaatcgccacactgacttccacaatggttgaactagcttacagtcccaccaacagtgtcaaagtgttcctatttctccacatcctctccagcacctgttgtttcctgactttttaatgattgccattctaactggtgtgagatggtatctcattatggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccgtttgtcagatgagtaggttgcgaaaattttctcccattttgtaggttgcctgttcactctgatggtagtttcttttgctgtgcagaagctctttagtttaattagatcccatttgtcaattttggcttttgttgccgttgcttttggtgttttagacatgaagtccttgcccatgcctacatcctgaatggtaatgcctaggttttcttctagggtttttatggttttaggtctaaagtttaagtctttaatccatcttgacttaatttttgtataaggtgtaaggaagggatccagtttcagctttctacatatggctagccagttttcccagcaccatttattaaatagggaatcctttccccattgcttgtttttctcagatttgtcaaagatcagatagttgtatatacgtggcgttatttctgagggctctgttctattccattgatctatatctctgttttggtacctatcctctttaatgcctctccttcacatgttattaaaaccaggtactatgattgctcacctgacttttggttcttatgaatgtgctttcttgcctgaatatttgttcagtttggtgttccgatgtggggacaatcactcggggttctattcagccacattgctctacctcctacattattaaacttactataaatagtcatgttgtaacaatagcagtatgaaatatgtatgttagaataaactgtacttatttattaagaaaataatttaaaaggacagcagtaaatgagaattagatatcttttacctgtaaccctacgaatctaggatatactttagatattaatagttcatatccctttaaaattaagaagttagaaaactaagattgtttatcttttatttttcaagttatattatttttaattggatcagttaagtttatctcttaattttccgtgagaggacaactgctttgttccttatttagctaactgaatgggctgggacagcttccatagcataagagataatatttattgattcagggtctgcgacagatctctgaccatctgaatagatgcttcacaatttgcagcacagaattgaccttcagtaaactaactacctgttctgaggtgacagtcactggaatctgaggtttgtacattattcattttagacaatgaagacgatttattttatacttattttatggtgttgaaatttaaacacattaaattaacatcaataaattaaataagtcaaagaaattctgactccaaaggtcaagaaatatagtactactgaagaattatattcagtattgaccattagaattaaaaaatatagaaatatctaaatatattcatactctttttaagtaattttaaaattgagacatttataattgtctcacaaactatcacatttgtaatgtaagtgtaaaacagtgtaatttacaagtgaatctgcatatgcaatttcacaatcttcctatgtgatacctttttttttttttttttttttgagacggaatctcactctttcacccaggctggagtgcagtggcgcaatctcggctcactgcaagctccgcctcccaggttcaggccattctcctgcctcagcctcctgagtagctgggactacaggcacctgccaccacgcccggctaattttttttgtatttttagtagagacggggtttcactgtgttagccaaggtggtctccatctcctgacctcgtgatcctcctgcctcggcctcccagagtgctgggattacaggcgtgagccaccgtgcccagccgataactttttgttttaaactagccgtttctaaattagagtagctgccatttttatcacttttataatctcattcattgattattttactcgtgctaaaagtttgctctgaaattccatatatatatatatatcttctgttgttcttagtttggtacatcccacctaaaacagactacctactaattcttttaaatctctctgttaggctctttattgtatacatttgtaattatatacaaaattattttcatactcagctagttatctcaataccacacagtgattaatttatgtgtcagtgagaaacattaagaattttattgccaagagagactcacataaatcagaattcttatcaggtttcaagagagataggtgcagtagggggtggtctggaatatccctcttgctccccaggccctttctttcggcatccgatgagccctggcccagggtattggatgaggtttggagggttgggtgtgtaccagtgacctcatttgtacaggaggagccatctcaatatgaagcatctccattttatactcagtgatacagcatagatggacatttttcagggaaccatagcctatatatttttagattccatcttcatttttcataagcaattcagacatattctgccaaaagcagtatatagataaactgccctagtgaaaacccttcagtttgtttgctaggaagtctgtcattagtatgtttccaaagagatcctaccaggtcatctgctttcttactttcaggaaagcagacaccattttcccctgtaagagggaaaatggatcacaggctagctgcttaactcaggcagcaagtggaaactttgaatgctctcctcaaaatatctgttctattcttgcaatccccctcacttgtatttttacccattggtgttcatttcctttgatcttagggaaatacttgttttctcatttcttctaagcaaaaattctaccacttgtccccattttaactgctcatctactttagaacggtactccatcagtatgtttcttctgctgtcttgagtttctttcccatctcttcattgctgtcagtttaaaacactgccaagttttccatctttgaagaaacaaataaaaaataatatttttctgtatcctacttgctcctaaagttctccatcctatccctctttttccctacaaggcaaacagtcgtgacacttgccatactcattttctcactgcctatgaattcctcgatttcatgtactttagccattataatacaggttctcaacatcagcattattgagattttgtcctggataattccgtgttagggggactgtgttgtgcattgcaggatgttaaatagcattcattacccctacctaataaatgccagtgggaccccctggttgtgacaactaaaaatatttccagacattgccatgtgtgccctggtagataaaaattgcccccagttgagaactatctaaaggtatcagtgactttgccaattttcttttttttaatcttaattttgtattcatttaacagtgttgaggactctgcgcacttactctctttctttcacagtgcgaaatctcctgtggttattctcattcttctttgctcttttcagattcctttggaggcttcttcacacccacactttaaacacagctatttctgccatttgatcctttattgcttttttatttacctgtcctatctaaaaacttaagatagaggggaagttataagtggattccaaacacaaaggctgggaatttctattatattggaaatctgacaaaattgaataggcacgacaatcacaatatattagatttatagaaatataatgagggcctatgaaaaattatttccatagggagaatagccaaaactctgaaggcaattatctttggagtggatatagagaaatatgcagtgattttgccctaatagttaatggattctctccttttttttttgatgtatattgctattgtaatttttgtttttatacaactatatttcagcctgcttttaaaatagtcaagtaattcttaatatccccttctgtgtctaaagtcactttggagaagcagcaattctgtcatttaaagtaggacctccctattagaatcagaaatgtaatacattgtaatactattttctactctcactgctatcactgaccattatgcattatttttccaaattgaaagcagcttaagtcaagcaaaaggcagtggcaaaagttgcgggcattgtgcaagcagcatgtattaaacaatccaggaaacttggcaacccccagagacacagatgttgcccacttctgccctgcagtgtggcctctgctactgttgtctctgctttgtctccttcagagcttcccagggactgtgcctcaggctgaattgtgcctcaggctggctctggtccaagaggagcttgtggtgtgcagagggcatgtgttggggaggggtgggaagttttgactatgactttagaaaaaacgaaaatctataaaatacctttagtgtctaaaaataaaaaaagtaataaagtaataaaatgtactaaattagtgaacacaaacacttttgtaatattttcatgcttttccacacttctttgttttttaaaggcttttggtacctcctaatctttcatatgctgtaagaatatgcacttgtattttatctttatgaaacttgtctgaaataaaagtgcattgtttaaaaatcaaaggtacactttcttctaaaacacaatatgaacaaagtaggaaaacttacaaaattggaatacttttttgtcagttagatgtgattttattttaatcaagtacatggtatgatgaaaagaatgattgatttgggaaaggacactgaactccaatgttacctgtttcagaagataataataatactgcccacctcatacagttgtcatagaatcaaataatatagtttatgtgaaaaggctttgtaagatttaaagtgctatacaagtgaatatgacagttgttttatcaataacgtgtcaaaactagaaacattgaaaaacaaatagtattgccttttaaagtagtgatttagaaaagaaatattttaaaagtcaaactcacatttagggtatatctttaccatgacagtgttagttcctttcagccacaactaaaaattcctaaatgttcaagttatttatctattagatctttataagggtaatgtgctatttacttgatttgtatttggctattttttgaaaagtcatacatttttcacagtcttcaaaatcgatttataatcacttagaaaaaaattaattgagcagtatgcttaagatttgaatgctatgatttatgttatactttagttagaaagtttactcaactcagttattttctgattattaaactgggaaaaaagcatctgctcagaagacaggtgtcttggctatttacagagaaatttaatttgcatttttttatttcttaaataaatacaagtttaaccattgtagacatttatgtgactacttatgtaacttatataataactcgataaattactaattttaaagtatcttttgtcaaattttaaggtaatgctattcaaaataggcaataacttcaaagaccaaaaaataacatagaagaaaataatgatagattatttattttcctttaagaataaattttgaacgtagtatatttagtagtaatggtcatttctatgataatttaagatctctaatcttttgtgagagaaacttttgtaacacactcgagtttttgcacttgtctttcttctttctttattctattggaaggatacttccaccagtaggttattcagcttgaatatttaaactatcagggattagaactagagggtaaccagctgtcagataattcatatcatgtattaggcttcagttgggatgagacagtatatctcagcatgctgttaccttcagtaagatttatgttccaaagtgtggatacattaatacaaatagtgattttaaatgaaaagcagatcagccacctagctatggttcatgaatcacagtgattctcactttatctttctctcttttattttttaataataataataaaagtacatagaaagtatctctgagccaagtgggtgccagagtacattgatgctaaagctttaacttgacccagccgtccactggaagttgctatagctgagaaaaaaagaagtgaggcatagatgctgggtttacatttagaaaaagagaaaggaactattaatgcgtgcttttctctaatagcatttatctctctaggaagtcctgcataacaaaagaagttgggatgccattaagttttatgaagtgatactatgatttcttgaagggaacttactattacgctgctggaagcctgtaaggtctgttaactaaagaagttcaaagatagccacagttgttcagtatatagttttgctttgtatttttttgattcagtgcagtggggttgaacataaaagatgcttgaatcttcagcttttcatgattctctgcttgttataaatagactattaagtaatttttaggaaatcagaacaagcgacctattcaaatgatttctacagaatttttttttccttttgtaaaacaatataaaatacagtgatttataaattttggtactatagctttgctaaaaatttctatattatttaaaaaataagaatacttttaccataagataggaaattattctggttcaataagcaagcctattttactgaaacaatagataaaaacttcactaaaaatatttttttctttttttttctttttttaagaagcatgagtgcataataaagtaacagtagaaatgctcaggataaaacagcaacccaaattaaagagagtgttaaaaagatgattttattagatggacttaatgtccacctaatggacaaataaagtaaattctgtttgacccagtgctaactatgtgcccgttatgcattaggtactattttagggcatggggatgacatagtcaacaggaagagaagatttctttacttgtggcagctgagttacatggtattaaaagaaactaaaagaaagtcttgaatctgaaacatttagatttcctaccagagtcctgaaatgcctgcattctgaaaatagaggctcctttcccacaaggacaccttactagaataagtaagaaattactagttctggattctattacagatctaagtaatcaatcaaatggtgaacagcccacaaccaaatctgaaaatagaagtgaggggatataattggcttataattattggtgaggtagagcaaaggtttaagtaaagtgagtccaatgcatttcttcagtgaacgttgtggactaccatgagccagaaactgggcattatgtcttccaagaaatgtaagacagcttttttttttttttaaactttgaaaggttgtattatacatttgttcagataatctgtttccacgaattgtcagattcacaaaacagaacttgtaggaagtagaactcagagaagtaaaatgaggtatcttcatctctatttttattttttcccctctgtcccctttttctgcctcttcttagtgtcaacttatttcttaaaaataaaagcattactgaaaataacaaaactcagttgcatattaatagtatcagactcaagagaacagataaattaggtattgcttcttctactgttcccgcatgtgaatcttttactttaaagaaaaagttaaccaaacttactttcatgctttatagaacgagcatcactttagttatgccacgtcgctacagttttcataagtaaattttattttatttttttgagatggagttttttttttttgctcttattgcccaggctggagtgcagtggcttgattttggctcactgcaacctccgcctactgggttcaagcaattctcctgcctcagcctcccacgtagctgggattacaagcgtgcgctaccaccctgggctaactttgtatttttagtagagacggggtttcactatgttggtcaggctggtctcaaactcctgaactcaggtgatccacctgccttggccctccaaagtgctgtatttacaggcatgagccaccatacccggctatttttatttaacaataatttcatagttacaaggaagttagatggattaagtaaagaactctcataggacctttagatagatttacaaattggtgatttttatcacattgtctttctttctctctccttctgtctctgtgataaaacaaacatatattatctatattatttttgtgaatcatgtgagtgttggttgtagacatcatgattctttactcctatatactttagcatgtattttctaagaagaaggatattctcttacatcagaaagtaagtatcaaaatctgcaaatttaaccttgccacagtattttatttaatataaatctatattcagtttttcctagttgtttcaattaaaacaaaatctaggctccaatccagaaccacgtgttatgtttagttgttatgtctcttttctctcctttaatctgaaatagtttctcatcattttttctcttacatggcactaacactcatgacagttatttgcagactaattcatgattgtctggtttttcactattagattcagcttatgcaatttttggaagagaaactacatgtgtaatatattgttcttcttagtggatcatgtcagggggtgcaaaatgtcaatttatctcattcctggtgatgttacttttgatcacttggtaaagaaagtgtttactagttcctcacctctctgtggaaagggacacagctgaagccatgccttttacatagggtgctctcttgcctacacagttgtaaccgggagtggttcaagacaagacatagactcaacagttttgatgatgaattgtggaaaagaacatagcactaaccaggaattagacaagaaacagaataacagaatttctcagaaacaaacacaaaacaaacaaaacgaaacaaaaaaagaaataaaaccaagaaaaaaatcagaagaaaaaaacaaacagaaattcagcaaacgtgaaatgctattgccacttgaaagtcactttgagatccaagaagagacatgcctggtcttaatcagaccgtgaagttacttctccagcaatgcagtttaagtggttctagcatgtgagtttacttcagcatctcagtgagttgtccacaattgtcaaagtgtaattttcaaaagtttaaaaatgattttttacaaatatagattggacaagaatcaaagatctactcaattcattaataagaaaacctgcacaatagtaaattggttcaaagagcatttgattaactggatatttatagcaatttgatagaagaatgctagagtaatattggaaagttggatacaaaatcggttcaggtcctgcaggacaattatcaattactagacaaaaacatttgtatcatcattggatacaaatttgcaagttaccttttaacttcactgagtcagagctcttacagtaaatagcaaaatcaaacaattatataatctattgaatgtagtaatctttgggaaagccttttaggtaatacttcagtatgcgatcaccttcttggccttctttctgttttgtattcttaacacaaccattaccttggtgagctcaagagaaaccaagagaacagcaatttagaccaagagaaattcatgtataattgcgataatgcacaaagtatttcagtaaggcaggagagttagaataaaggtgagatgctatgatagaaaggggtaggagatagagaagagctaggccagggagagtcactattatataatgagggtttgggtaggaagtcaggagcgattgactttttttaagcgattggttttaagcaggaaagtagcacaaacagataggccttctggaatcatcattcatttaattttaaatatattaaatgaattcattatgtggctataggttagagtaaaaaatactttacataaaaaaagacagtgttctttattattgtgactacagaacagcacattgcttttttgttgacatttgagataaactttatattgcaatttgtttgagatactttgctgccaaaaaaaaaagttttctctcagcatttagccaaagtttcatattatttattcaattatgcattgttttatgcttgttcttaaaaataatagagttgtgtatttaaaagctttcccattagtgaatagttacccaataatcatgaacttatcaattaaatctattagggagaatggcaataatgacgttcctaagagaaggacaccaatgaattatttatattttggctatttttcttttattcagtagtttgtgtaccattctaatattttgacttcaattataaaataccacaatttattagtgactgaagtcacacagcccaatttatgataaacctattttctagtcacaaaccaaactgtcattctgtaaaatatcctcatagtcttgcacatagggtagtgtgaaaggtgacaaaaggtaacaggaagaatttataaaagtcaaaaatcttatgtgtaggcagtggatgtgactatagggatttatacttattgtattgtaagtagcagcgggtttttggtttggctcctgtgtgttaattctgaaatcaactaccttattcaaaggcattattttttctaaaagacactggacatgaagaaacaagtagccagagatgcagttggcatgagctgattgcaagattattttctaattaaaatacgtcatggcaaagaaagaataattaggtatcatataggcttcttcattgacagaaaataaaagtgccacacttaatttttaaaccattcacaaatccaattcatgcgtaaagtgaacttaaagatgacagactaattaattaatgatgagtggattagaaatgagaaatacaaacaaacatgtctgaagagaggtagtaattatatataagcttgtaggttgtcaggattttcttaagtatttattattaggagaccttaagatgtttttcctaatacctaagaatatgagctttctatgacatttcatctataattttcatgattaagccttatataacattttcccttttcttttttagccctatgaaagcaaatatttgttccctaaatttgctcattgtcagggatggaaaatttggaaagttaatatttattggaagtttattatatatcaaaacttacatagtcatatttcccccatgaaaaactgtgcacttttagtaaatggatgtagtcattaaaattctttctcctattgaatcctacctccctgtaacttgtgtattgttctctgttgcaacacacaattctgcagtgttggccaggctggactcaaactcctgattttaagtggtcctcccgccttgtctttccaaagtgctgggattacaggcgtgagccatcacgcccgacatagatatttatagcttttttatatttttggcttttataaaatatgtatattctttcaatattaagaacactcaccatttctatgccatggatacactgttttgggaaataatctttaaaaacatgttacattcatagaaaaatagcataaatcacatgtctgaaaactgattagaaagtgataattaatcctttttttctagacactagaccttagattttctaaattttgttttattccaagagaatttggccttgactgcagaaatttccacagaatgattattttggctactgactaggttaactgacagttatgtaatcttgagttaaaggactaaagagacaatagtagatttatttattttggtggtatagatttagttaaagagttatccttaggatcactgataatgtggaggaacaatatttcagattccaaacataggactctacatgtgtcatgtaagaaagtgtaaaatgaataaaaacacttaggaccaatttgaactgacaattctgtgctttcattaatagactattgaatctcaaccagttttcacctgtcttcttcctagacttaatttgaagtgactgggtttaagtaagaatggtttaagtaagaacaggctgttaaagacttcaaaaacatttaataaatttatgatttcccttatcattatgtgagaagaactacaaatcagcttggtcctttccttgaggatatgtgtcctagatttgtgtctttgagtaaaggtattgcatagggagtttatttttgctttgattgtcaagaaagtagcaatcctggtgatgatggtggtgcgtgtatactttgctaaagtgaatccaatatgtaaaaatacacatttataaagcaagggaattcagccagtttttttgcatacaatttataataaatatactcaatagcaaatccttctgcattcgtcagcaatattagctgatgtttattaatggctgatgtttattaatctacagactggccctaagcctaaaatcaaaggtgaacacatcacaaatggtttatttacaaaacattacaaactgcaagacaaggtaatatctggcctagaaaataaggtgaagtagaaaaaacagaacttgcaatcagaatcaataaggcctgaatatctgttctctggctcttcccatgtaccagttctctactcacttccatcaattatgtttgtaaaaggtggttgaatgaagaaagcagaattgcacagaaggataagttgaaatgtaatgcagtgggaacagggcctcaactgatcatataatgaactctcagactgagatgagtcttcatatttgctctacatcagggcaagaggaagcattctctatacctccatattgatcaaggagtgcagactgctcggagaaggggttgtgacccacagtggacaaggcagtaagggctgagagctgaggccaagtcgtgaagagggatttagttgagagcagatagtagtcaaaacacagcagctgggagaatgcatgtttcagtcctgattgtggggatctggaaagtatagcacttcagccattggagtatctgtcttcacaaaaatcccttaaagttagacattattatttttcacatactacaaatgaggaaattgagatatatagatagtaattaatactaataaatatgctaatgtagttgtttttaatctttttttttttacaagatcccttaacattcttaaaaattactgaggatcaaaaagaatgttggtttctgtgagttgtatcaattaatacttacctaattaataatgaaaacagacatctgaaaaaaagtaagctattttcagataatagtatttaacccattatatgttaaataaaataattttttagaaacatctatattttcccaaacaaaaaaaatgatgagaagtgcggtattgctttacagttttgcaaatttcttcattgtctggctgggattttctctttcttcattcaatctggtgcaatatgttgttttgtgaagaatattagcccacacatagatatgttgttcgaaaagggtagttcctcacagtttagttgaaggcaggatctgaagccatattgatgaattttttatactctgaaataaaatgctgatactaatgtgaatattgtactcatagaaacacttttgactctttgttcttaaaaccagtcacattcactgctagttttgggacttgccccatctaagatagtggttgtcctcacctcccactatcttcatgcttcccacttcacttgctcctttctacctattcctgaatgtctaatgcaagttcttcaccccatgtgaaactctcctgaaatattccagcctttactgacttaaacttctgttttggacaaatgattttctgattgttttctttctgttgttttcaattttcttttccttctgctttttatcatctgcagttgtatttgtaacttgttttaaacaaaaagaattgaaaaattgaagttcctaacaatgttcattcttttgcagcttacacaggaaaaagaagcaaaacccacaatatatgtcatcttctgttgtgaaacaaagatatttcacactgattaccttatgagggcttgagtgtcactgattgttttactccagcatagtgcttaagcatagtatagtattcagttaattaatgtttattgagcttaattgaattgactgctttctagctctgcattttcgtttatacaaaaaataatgaaaatttgttattttaatcagacgtactcgccttctgattcagataaaattactaattttagtgagctgcaatagtgacaaaatctatctcctgttatgcctttgtatatgttgtattcttgactgttcagctattccacataaggtacatagctttttattgtattgacatcatatcaaagtccagatctaaaccatttcatgcaataaaataagtaagtcctatgagttccaatttgtagacgatacattcttggtagggagcttagtttctacaaggagtctcgagtaaaagcagcatttgttgaataaatgacatgttgcacatacatgtgtttctgtggatttaaaggtttgttgtagttttcataaattgtttatatatttatagcgtttacaagatgatttttgggaaaaataattttctttctatagaactccagactagtaaatccaattaccaactttccccgttactcatgccaaaaaacttgaacttcttcctgcctgtgttccttctctgagaactcacatttatgtcattcccaaattcttttgtcataagacacccagaatttgaccagttctcaccatctctgtcattgccatatgtcggggtggcctctctggctggagtcttgccatcgcctcccagctgctcccctacttttggttcactcttgcttgcttagtctgctctcctcagagctgctcaattgatccttttaatatctaaattaaattatgttatgtctgttctcaacacttcccaatggcttcccactatggcctgcatttccctacacaattccattccttgctttcgctctccagttatctcctattattttaccttcctttcgctccactaaccactttatccttcttaatttttcttgggcttgtcaagcaattacccaccccagtgtctttgcacttgtaattcttgctgcttggaacacccttcctccagattactgcatgttgtcctccctcattttctttgggtttctgctcaagtgtcaccttatcattatgtcatccctgaccattctctataaaacagcaactgctgtttttttaatctttccgtatctgctttaccatgcttccttttttctcaataatatttatcactattttacataatatatgtttgcttacttatttaatgtgaggctcacccaatactggagcaaaagatactttagagcatgtactattttatatatatatatataatgaaacatccccaaagcctagaacagggcatcaaacaaagaaagcatggaatacatattaagcaaatagaagaaagaaaaagtaaataatccagaaaaatattttctaatttgttttaaccttttgttattttatattttctccttagtgacaattaaaaattccatctactattatattttccccccaacacttccaatggttttctgccgttggaataggaccttgctaaaacaggcttttcataaagttctgaattacatattaatttctcttttggcctcacagtaggaggatgaaatactgcaagtggtagaagattatttttaccttagaatacacatcctagtgcatgttgcaaggctccaaatatatctattctaaagcgttgatttacatttaccctcaaaaactaaaagcaagcggagtttgacttctttgttctttcatagtaaatatcctgtgtaatgagagacttttgttttcttaaaaaaagtcctcagagaaagctgcactattactcaaattgtttctgtcaaattgaatttcatttgtgaatttgtgctagtttaaaacatttaaaaatcagacattttggcatattgtttttggattcaaaggaaattataattacagcagttacaaagcaaggaaaaaatagctgttgaatcatctatggagcatattgcataatttgtaattttagactctcagtaattcaattaatttaacatgacaacttttctgtgctttacaatttggcaatttctagcaatttaataggtttccccctttttatttccaaacattcccataaggtttacaagtctttgaaatgctaatttcaatcaaagtacagtttaatttaaaatttcattgttaattgtagttatttatccatttcagttatcgatgatccagcccagtggcatttgtcaaaatgagcagtcagttcatcttgggtttagatactaaactggaacatttaaaagttaacctaatgatatgtttagtaataataaagctgtaaacaaatttataatctatgcttaatacaaattgtaacataactttaaaaatactcaagacatgaataacagtaatgagttttcgctgtaaagagagctgtgatataatgtgggagaaattgaaattattataaatagaaaataattttgagaactgctactgtcatagaattaataattttgcactgtttttgaaaatcactccatttagaagatcagctggaatgtctgtttcctcatagataaatttttaacagaatagcatctttactgctgcatcatgcagtgaaatcagtgaaagtgttatttgttgaagtgcttagctctgtgatcttatgagagttttattatcttcttcctagatgaaaaatatctcttcttgtaatcatctttgacattaacttgacaatgtttagatggcatgtaaatcagattatgatgcctaaccattattaacacagcaaatgaatttttactctcgagttcataaatccacaaggagcattttttaaatataatatccttttaataaacctagatatttaaaaattaatttttacattatccccaaatactccaaatattatactttttgttatatttgtttttactagtctagacaactcaaataaaatagctaatcttctatgatatttatttaccaattctatttatatttatactgcattgtgttttatgatctatggataaaagctttaacttgtcaacctgactattaggctgtttagacattaaattcagtttctttttctctaggctgaatctgatttattattgcaccaaatacagttaataaatactcttttatggaaattatttattctgacctgaatctgccttaatcatggagattaaatgagactgacaaaaaatagaaagaaccttaaggtgtctggttacatattttgttgtagaatgtttaccttatatgcatagatagactaataaaacctcaatgtaaatataagctttagaatgcaggggtttatttggtggattagatggcactgatctagtcttttcatgactacctccccttgaggtaccgaaaatctggattatctttacttccagaagaaattaccagagacccactggcaaagtatttaataagacaattattttcttttaagtgcagtaaatgcaggcagtgtgtaaaatctgaattgaatacaagagatttgaaagcgagggatatacaaagagagaacatgcttattttctggtttctttagtccaagaaagataatgttgaactgagaatgggtgagaacaaggtaactgacctggggatctcacagttttgtggaaacagtgatttgctaccaatgcatatatgaggcctttacacttgttctattcttattaccatttgggcaatttcacgtctcttgtcatcttgctctccatagctcactgttaagtcttcagacattgactatcctcacccttacgccatcctcctttctcagaaagtaatcatgcctacctttcttttcacagagaaaatggagacaatgagagttctactcactcaatttctggcaatacttcccacatatacatttctatacttttgcattcagcattatttttttcattccagtcataaaggaaaggtcatttatcaagaatcttgtttgcaagtgaaagaaccatagcaccgagtatccctctgtcacctgctcattttcccgtaatagttaatcactctgaaataatattcttattttctcttactttctcaccatgaagttttccatactccaggactttgtggaaactgatcttgttaaggatgtccatagtttcctcattgttaccatcggtggacttcatcctctttctcttctctgtcatgttatattgctgattattcctttattcttaaaacatcctttttggcttttagatcatagtattttttaagattttttcttatcttattgctcttttcttatcagttgccttctctagtatcttttccttaggtattgatgtcctccagatattgattctgggtgcctctcttcttcttcactgcattttcccccaaatgatttaattaacttcaattctcaattgatgataataaaagtctctttcttcaggtcagcctctttatctgtatgacttgcaggcatgtcatctttaatatgttcaaaataaactatccttgctatcttgcaaactttctcttctattttttgggggcctttatcaacttgcttatcaaagtcatttatcatatccttttaattataaagtcttatttatacagcttcttaattaaaacttcagtctgccttccttccattctcactgtcattacctaaattcagggcccattatttatcacctaggtgattgcagtagccttaaaactagactctaggccgggcatggtggaggccaaggtggatggatcatttgaggtcaggggttccagaccagcctggccgacacggtgaaaccccgtctctactgaaaatacaaaaattagctgggtggtagtggagcgcgtttgtaatccagctcctcaggaggctgaggcaggagaatcacttgagcctgggagacggaggttgcagtgagctgagattgcaccaccacaccccagcctggcgacagagtgagaccctgtcccaaaaaacaaaacgaaacaaaacaaaactagactatattttttagacttgatggactttggtgtattctcacaccagactttttggtaacacaaagtgtttcatgttacttttctgcaatttattttatttttcttaatttttgtgggtacatagtggtatatatatgtatgaggtacatgcgacattttcatacaggcatgcaatgtgtaagaatcacatcatggaaaatggggtagccatgccctcaaggatttatcctttgtgttacaaaccatccaattatactcttttagttgtttaaaagtgtagaattaaattattgactataataactctgttgcgctatcaaatactaggtcttattcattcttactaactattttttgtacccattaaccatcctgactcccctccccaagtccactaacctccccagcctctggtaaccatccttttactttctatctccatgagttcaattgtttcaacttttagatcccataaataagtgagaacatatgatgtttgtctttctgtgcctggcttatttcacttaacataatgacctccagttccatccatgttgttccagatgaaaggatgccactcttttttacagtcgaatagtacttcattgtgtatgtgtaccacattcatttatttttctgcctaaatattcttgacatacaaataatttttccatttagtatcatatttcaagatttaacttagtcttctcctaaagtgctgtgttctgcacgtgttcttattatacttcttatcacacttacttgaatctgtttgtgtaactttttttttgactggtttctcagtacatcataaatgtagagactgtgtggtacagatacttctcgccttacaatggggttacataccaataaacccaatagatattaaaaatattgtgaaatcggaaatgcatttagtacccccataaactccttgtaaagttgaaaatttataagttgagccatcaaagatccagatgctccttgacttatgatggggttacatcctgttaaattcatgataaggtcaaaaaattgttaagttgaactattattaagttggggagcatctgtacttatccatctgccctcatgccaggtatagtaacttgtgcttaataaaactttaatacacctctgaatgaatgtatgtgtgaattgtctaatagatgtaactaagaataaaatgaggataacttcaaaagagaacatatgtatattaaatatgctatttttacagaatttattcaatgagactactttctcgttgtgtataaaatattgaatgcatataaattcaatttcctcgtaacattcatttgaccaacttcagccagacagtccttgattcccatgtttgacagtttgctcatctgcttagaaaaagggaaaggaagaaaaaaagaaaaccatgctctttccattaaaagagttggcactatcaactgttttattgtcaaaactaaatataattttaccaatgatgatgacatttaagaatacacgtttgtgtgtaagctggcctttaatacaaacatttaacagaaatatgtgtaggaatgtagtaggagaaccaccagcattgaagtcattgattgccatgttactgacaaagtatttaaatggaagaaacaagagattgagttgtctcccaaacagtaagggtactatgtgtgtttttgcaggtttattattttggaattgaaaaattttaagaaaaagttatcatttgggatgacaaatgctaagtgaagaatcctgtagcagaagtttattgttggttactgctgctaattcttcccagtgtggtactttataaaacaaattttaaattctacttggttattctcaggaccaaaaggtgataattttttgtgtgtgtctgcttgaaaatatgcagtatgaaaactcttaaatcaatagtttgtagtacagagaaataattactgcttggaaaagagtaattttcaatcatatactaaatgaacagacaaattaacaaaaacgtttattgaacttatgctaaaggcactgagcacaaccatgaacaacacacatggcccttactctcttcgaacccagcagcataatttatctcttagattaattcaatagcctcctataagatctccacatctctctatcttctaaaccatattttagagtaattattgtaaaacagaaatcttatgtaatctcactgtttaaatcatttcagaaatcatttcagaaattaaccattactcttagaattaagagaaaaagtattttattttttctctataggctgtgatggttttggctctacctgtcttcatagtctcctttaataccctcccccatttatttctgtggtctaaccactctttccttccttaatttatgtaaataccctactttttttctgccatatgacctgtgcacattctgctttttctatataaaatggtgtttaaatattttaatgaagttaaaacacattttacccaaataatggatgccgcttggactaatggttatagaagctgttacataaagaatcctttgtaaatttatagaaatgtcatagcttaaccaaatatttcttgcataaatataaataggcaaaatgtgatcaaaacaatatttaaaattatacatttaatacagatttcttattattcagttaagtggtatatttcttaagcacttataaccgtgtagatctctcttctttattgcagtaaaattatggtaatttatatttattttgttttgtggcactttatataattatgtgatatttcaattatagctagattgtcagtgaaagcttagattatactcaatataattctacttaagtataagatttaatttgaatactaaacctgaaagcttcttaacttcgaatgctttccattatcaagtaatgcttgatttttaatttgtctagatttatgaagagctttagagtacttgatgaaattttatttgaaagcatcaatatggtcacaattttctattactgaaaaaatgtgtgcctgtgtatgtctgtgtttgtggcatgccacataaataatgtattacaatacttgtatgtacataagtactggttgctttggaaaatatattgctcttctatctagtttgacttgacaatgaaattacaaagaattgttgcagttttaaatttattatttttaatttcatcttattaataaaaataataatgtaaatggtcacagaatttctttccccagtaaccttttattgaggctacagtagacaacatatttactttcagtggaagaaatagtaaacttcccatgaattaaagtagatcagattttatagaaatgtttctatgccctatgcaggtgaattcaatatggatagctctgatctttccgaaggctctttgtttgaaggttaaagaaataaggttattttgtttgtatgtttataacttaattttatattcctgtagtttttctatatgattaagtacattatagaagcactacagagtataattggaataaacaaaagcataaataataggacagatttgcctataatttttacttgtttatcaggctgccaatttataaggaactaatttcacctcataagactaaatactatgtattttttaaacattcagtgataactattaacataagctctatctatctatctatctatctatctatctatctatctatatactttattggtagaatagaatgagctttttagtttacctaatagggactatctcttggattacagtggctatctctggtttcacttttggcaggtggagctatccacagtcatccacagtccaaaaatatgaaatggaaaattccagaaataaacaattcatgctttaaatttcaggctgctcttgtatctcaccctgaccttcccagaacgtgaatcatctctttgtccagcatgtgcatgctgaatatgtcccctacattttactctttttagtagctgtcatgatttatcagaggcccaagctgaggtcccatcagaggcccagttgaggccacagcagcaacctcaccagagaaactggcagagtaactgatagaagagggaaagaaagaagggaaagatacggaaaaataagtagaagaaaactagaaaatagaagaaaatgttcagttgaagtaaaaggcaaatgtatcaaacactttaagcaccaaaggaatgtgagaagcaaggtttaggtggaaaaacataggtccactggctctgatatcccagtaaacaccatggaatattatgcagccataaaaaagaacaagatcatgttctttgcagggacatagatggagctggaggacattatctttagcaagctaatgaaggaacagaaaaccaaatactgcatgttctcacttataaatgggagctaaatgatgaggacatatggacacatggaggggaacaacacacactggggccttttggaggctggagggtgggaggagggagaagatcaggaaaaataacaaatgggtactaggtgaaatacctgggtgacgaagtaatttgtacaacaaacccccatggtgcacgtttacctatgtaaccaacctgaacttgtacacctgaacttaaaataaaagttaaaaaaaaggtatcaatgttattctaaaatgaaagtttttctactctcataaaatatttcagtatttttgttatgtgtacgtatttgaaatcatagattatataatattattttactatgttcttttatccatttcataaaaccatattattcaattattcacatgtatcttggacattaacattcttatctcaatagggcaaatttttaattttccccaaactgtttttcagggcatgctatattccagctacattgtattgcacatagtactgtctctatctgtttttaattatcagtggacttttcatctcaataaaaattactcagtatattaagacaattgttcatttgattattttaattattctgttaatgtacactgattaaatgaaaggagtttataattccaaagatagaattatattttcagattaaaaaaaagaaaaaacgtagtgaatttagggtttagcattatctgaggtttctgacatccactggtggtcttttttcccacaaactattatgtgtatcactgccagaataattgccctaagcaacggtcttaaacgttgttgtgaaccacattttaactatctggaatgtggctttgtccatatttttatatatcttttttctattaatctctgagtttatagaaggtagaaagcattttttatttatctctgtggctagcactgtatctgatgtttcctaaatataagtttatggctttgaaagaatgagttccagtgtgcataaaaatcctaatggggtccctcctaacataaaatggaggccaaactgtaagggattctgttttatttgcctaagagacaaaaagtcagtctatattagggaatttgggaaggtgaaatttgaagtaaacaagtatattgactttctagttttaggttatcacttatttagtaggcatgaaattattttttaaatcatatcctgaacttgtatttattcaacagatatatttacaaataactcaggtaaatacgtggcaaaataattttgaaacctagcccttgcattttagatttctaattatataattttagcagtcaaaagatcttaggaataataaaataaagtaattgtataaaggcattggtgagcacttgtttaggatataggatagaaacgtggtggcatacaattctagaatttacttttctatcttgtctcctggttgtgagctctaattttagtgaaacaaattcatttctcagaatggcatgttcttatttttttgtattccattcaccttgtatatactgtttcttcctctgtaatcttccatcctttaaaattctttacccttgtttgtcacgtatttcattttcttcttttcataccattactctctgctttcctaaaagactccttatctcttagtatacattgtgtgaacctctaacagtgcttaactctattaattataacaataattagagttacaacagtaactaattttcattcttgtgctcagagctgttcaagcactgtcacgtataaccacaggaaacctctgtgagtaacactcttcattcacgtgaggtaaatgaggcatagtgagtttaagtaaagtgttcacagttccacagatggaaagacttagaaaccctaaactgtcataacccaaagtgcataatcataaacactactccatgttgtaaaagaagataaacagttctgcatctttcattgtacttttagccctggaaatacaggaatgatgccatttcaaaaatgtttaaaacaaaagtatcagattcagggcctggcacataatagatgaacaatcattattgaattaataagtcatgaacaagtaagtaaatgtatcaaaaatacatgctagagggatgactatagggtgattctgcaaggtagagggactgaagaaactcttatagagaagacgaatatgaactgagcattcaaatatgtatgtggaaaaaagagggtgcaggtaaacccagcagattatttgcgagtgttataagagaatcatgggaaaatttttggaatcctggcaatgctcagggaaaaatccagttttcccattactatgaggaataaggcaagtatattcttgattatgagtattatttagtgttgttttgaaggtatatgctaaagtaattggacaagatgaagaaataaaaattggaaaggaagaggtaagattgttattatttgctaagcatgtaattgtttacatagaaaactaaggagagtaatttgaaaaacaacaaggccaaaataaaaaccaacaatttaattaatatggcactatataatactaatctacagacataaattaattggctttttatattcaaacaaaaagtatttggaatatgtaacggaagtaaagctaccatttataatggcaccaaatataacaaatatagctgtctataaaacgggaaagatgatttcaaagagaaattttaaaagatcttgaagtacacaaaaggaatcttgaagaaaagcatagtcaaccatattctctgataaaagaatctgtttcataaagataataaattcccccagttaatctaaaaatgtattttactgcaataaaatatcaatggtttttaaaaagaattatacaaatctaaaaatttagttaatctaaaaatgtattgcactgcaataaaatatcagtggtttttttgaaagaattatgacaaatgacttatagtactaataagaaaatgaacaaataagataatccagggcatgttcgaaagggaaaaataacaagagggcactagccctatcagatattaaaatatataaagctgctgtaattaagaagggatgctgttttaacaggtattaaaatatattgtaaatctacaggtactagtgcacatacagtcaatcagattgatggaacatttttaaaaagcaataaatccaaatacagagagaaattcaataggatagtaagggtgacatttctaatcagcgggcaaagataccttgtccagtaaatggtttagggtatcttggtgttcacttggagaaaaagttgtgtctccccttttcatgttttataccaaaaggaattccagagagaagtcaaaatatgaagccatgagaagctgtaacaaagcatgcaagatttctatggagaaatctcaagttggaaaagatatttctaatgataccatacacttgaagaaatgaagtaaataataatttgagtatatataaatggaacagaattccacttataataacaaaaatttttttagaaaatagtgaataagctgaaaacagtgtgtatgttcaacaatagtgtaaaaaaaagtacattgtgtgtatgtatttctagaagaaaacaaaataaatatgtagcaatgattgactctggaaaaatagattatttatggactgggtagtaatgaaacacacacacattcttctgcagattttgtctacattttatctttgcataaaattttttgttttttgtctacttttttgtctacattttatctttgcataagaaattatgaataaaactacttagtcataataaatagaaatgttgacaatgagtgtgttgatggcagatctgtggatggatgacttccatttatactttttttgtgtgtgtttttaaatagaaaaactctataattgtttccaaatatctttatatcctcaactttataatttatgagcagtgtatcatatttctaaatctatgttctcattaaaaaatacggagattaggccgggcgcagcggctcacgcctgtaatcccagcactttgggaggccgagccgagcggatcacaaggtcaggagatcgaaaccatcctggctaacacggtgaaaccccgtctgtactaaaaatacaaaaaattagccgggcgtggtggcgggcgcctgttgtcccagctactcgggaggctgaggcaggagaatggcgggaacccgggaggccgagcttgcaatgagctgagattgcgccactgcactccagcctgggcgacagaccgagactctgtctcaaaaaaatcaaaaaccaaaaaaacaaaacaaaacaaataaacaaaaaatacagagattggccaggcgcggtgactgacacctgtaatactagcactatgggcagtccaggtgggcggatcacctgaggtcaggagttccagaccagcctggccaacatgatgaaacccgtccctactaaaatacaaaaattagctgggtgaggtggcaggtgcctgtaatcccagctacttgggaggttgaggcaggagaatcacttgaacccaggaggcaaagggtgcagtgagccgagatcgtgccattgcactacagcctgggcgacagagcaagactgtctcaaaaaacaaaaaaaaaacatatatgtatatatacacacacacacacacgcagatagtaacaggtagcatgatttagtaaacataacattgaataactgtttttcctgtaaaatgggggaataatatataccttgaggactaaggaaaacaatgttgttaaggcacttagtaaagtatactatttttgaatgtctatgtgtttctttagataatatttaatttgtttagcttactgctccccagagccatttttgatgtttaactgataccacctgtgattgtttacccagtattgatagcctgcaatatgcagagctattttaggaactgaggaaatattagcaatcatcaggcattctaataagtgatacaagtggaagatgttatgaaaaaacagaagaggaacatcacgaatgtaggagtcaggagatacttctcttcccacttccttccctgaggtgtggacatctgaggctatatcttaaatctcgagtataacttaaagaaaataattatttatactgggcatttgttgggatgggcattgagatgtatctggaaagaacctgggatttgaagtagcatacatatagctagagtgaagaatgtatgcagaaacatggtgagaattgaggattaaaaattatgggaccacagagaacactatttcatgctaaagacattgattctcagccttgaatgactttttaaaaactactttgtcagattgaacattaaatagtcactcaagaagttttcagtttggacaagatgtcatggacctgtttttctctgcttctttctgctaagtacagctataaactctgaaaatgatggaagaggcaaataaaggaaaattcttaaagatggtaagaggaatgaaaattggtttgagatcacagaatacaaataagagcacagaagaatggcatctcacatcctctcacccaacaaaaggttgtgatccaggccttaattttcctgactccaagctagcaacagaaaacaaggtaggcttatgtctcctttggaacaataggagtctttctgaaaacacaagacaatatccactgcaggaaagcactctcctcctctgtaggatctgatgcttccttctacaatgaatagatatgaggcagctaggtggtactggccggaggaaccccaccagaacaagtggcctcatgctggaagccattatggaaagagtatgacattcctcaaaacattaaaaatagatctgtcatatgatccagtaatccctacttctgactgtatatctgaaggaaacaaaattggcttcctttgagagatctcaaagagatatctgcacgccgtgttcattgcagcattcttcacaatagctaatatatggaaacattctatatgtgcaccaatggataaacagataaagaatatgtggtatatattaatgtaatgaaatactatttagtaataaaaaagaaggaattctgccatttgcaatcaattgagtgaaacttgagaacattatactaactgaaataagccagacagaaagacagctactatatgatctcacttatttgtggaatataaaaaagttggagtattaacagctgagagtaaacagtgtttaccagcagattagggggctagggaaatgaggagatattgatcaaagggtataaacgttctaagatgaatataaatatttggcattatgtatataaaataacatgagatgaatatgttccagggatttaatgtacagcatggtgacagtagttaataatactgtaatgtatagtttaaatttcctaagaaagtatgtcttaagtgttctcaacacacgcacacaaacacacacacgcacaatagtaactgtgtgatcaacttgattatggtactcatttcacagtgtgtatgtatatcaaatcatcatattgtacaccttaaattaatacaattactacttttcaattataccccaatacatctgaaataaaaagaaaaataactaaataaaggtattaatgacttccatttgatggttctcgtgctaggtattttttacagacttttatcattttaagtactacaagaaccaactagcatgtggccttagaaatgttcaaatagaatttagataacttctgatttttttttcctagtggaacgattctatctctattagaagttttgccatattgcaaatgcgggcttttctcagtttctttattctccttcccagtgctctttgtggtggtggtggttgtgttttgtaactagaaataaatttctatcttaatacaaagctttctttaatccctcagtgccatattactctccttgtttctaccatttgattcttctagtctatctcattaactctactaaaaaagagtatttgagcctcaaatagtttatttcctaagaacaaacagttaagtaatatgcagactgaagacttctggataagactcaaatctttacctaatatattaagctgtatttataaaaaggaaattactctttaaaaacaatacacatgctataaattgtttctttggaataatggcacacattcttcctatttatcaaatagatacatttcccagaaggaagtgggtaatgatatattatagtaaaagaaagaaagaaaagaagagaaaagaaagaaaaagaaagaaagaaacagtatttaattttatcagcattcctattacacagctggcatagatttttaacttactttgtgttaggtctcctgctttatgcaatttataatcttattttatttactttttgtaatcctataaaggctgttaaaatctgtctgtaagcattatgtatataaaataaaatgagttaccatacctattttcatatcagaaaatccatgtttggtggaagtcaaataacttgttgaggttcccacatactcctgctacatagggaagctgagataggatgctctgtgttaagattctaaagactgacttcttcctctgtgccatagacagtagagaatatgaacaggtctattactcttcttaatctgtaattatatattttacaacattattgacagaaaaatcaccttgcttcttggcatttgttcagatgctgatttaatgccacttatgatggaatatacagacttctgcacttgctgaacaaattggaaagtaaaggtttccaaggactttatggctgccaaagggatattgtaaattattgtaaatataaattatccccttgccagactacagagattacttttatgttagaaataggcaaatgtgaattggcttatttggtgggcattagtgaaaagtccattgtcttaattggccaactacaaatcattatatttagaaatttttagctgtatcatttgattcacttgacatcgtgtatctttataaaagtatgtaattaacaagaactcttctgtaattatcctgacaaatttcctggtttcttttaataaaattaatagtttgcccaacttacagtatatcaaacacactatatatatctattctgtgtttagacattgtaatgtctgtgtagctatactgttttataacgtctaatattttaagtcttataacatttcttccatcccacagctttccttttaaaaactaatttttcattggttatgaattggatgaactaattatcttaatgtgattgcaatatatgtagttattttaaatcataaatattgaaatgattgtatttataacatttcttgaaatagacaactatatgtattttatgtaaaaaattaaactctatagtttacagtgtcttgaataacaactagtgtttgggaatgagactatgttaaacatttattagctatttgacattggaatatcaggttaaaatgtgtaagcctcattttctttatctacaaaatcaggataataatccctacctcatagatatgaagtgagaattaagtgaggtaataaatttaaaatcttatagggagacaataaactttagctacgatctttatttttgttgcattttaatattattaaatcgtttatgtatccaatactgataccatataaattcatgcattaatcttgtaacctttttatttttaaatattttctgggactattttagacggcaatttagatagtatctaatctgctagaaaatatcaatgaagctgtctgatatttacaccataacttactaagattctctgtattacagattctgaaaactcaggggatttaagagggaaataaagtgagcttgttgaaataaatgtatacataaatagacctgcagaaaacattcctatcaatcaaatgtatttggaatatttaagtatattataaaactactttttgcgggtctggtaaaaatggtggtgcctgcctcttttaactcaatagaaaaagaaataattggagatgaatttaatgttctttggcctttttatcatgcaacccttatttaattatagaatttcagtgttatattacataactgtgcaaaatattacttaataatcacttctgagatggttttaaaaaaccatattatgcatgtttatcatagttccccatagcaggtataggccacttatcaaaggaacttgcatttagtaattctgtgcagttagtcttattgaggtccacttgatggcagtattgcacttggtaaggtcagtctttttgcgtgatttttttatacttgatttcccgtgtaatggtggaagtaaacttttcaattaaaccatgaattatgagagacttattttctgctaatacctcagaggttatgattcagaaatgttttgtggaggaaccaaatggaacatagtaaaattgttacacgtcagaggagagatactcttgggaaatgagaaaatcaggattttccaatttttaaaattcatgactctgaaggattttagctttcatcatttttaatagaattttcacttataggaaaaggtaaccaggaattgtattaaaaaaggaatgtgcattcattagttaagaggtcaagtaacaaacttaaaatttgacaaatcatggtgtgtaccacaaaaataattgacctcaaacatcaggataaatgtttctgcttctatccaattgaaatgatttagaaggtcaattctaaaactatcgtgtcagcttctttgctagcaagaagcagtaaaagggcatttcctgcttctcagtttttaaagctttactgaaagcaaatctcacaaatgatattcaaaatattatagtcagaaagaaaaaatagttactcctgtccttattgttaaaaggccttatcccccaaattaaatcaatcttccataaagtccctaaaaaaaatatgaagtccttgggaactcacttggttttaaaacctaattaataaaactttagtgagataacttttagtttttatctgaagtgtaactataaggaaaatgatattataaaatgatattttgacaaaagatgttttaaaaataggagtaaataatacatcaaatattcacttcaatatggtgatttttttgtttatctatttaaacttttgtctagtacacatttatattacctctacttgagtgttaatgattcagatttaaaatgaagttacacattccatgtagtcaaagtgcttctgtctctagtctagtcagctaactccactgacttttacatcctccaccaccaactagctctgtatgactttggtcagattacttaatcacattttcctcacttcaaacctgatagtagtattgatattaattagtacatggaaagtacttagaaacagcagcgagtacaaaataattctcagtaaatgtcagttattttctttatccagcacttgatgataatttgtggacttatatatttaaaagcatatcttaaatacattttattaggagaaaagattaaattgatattttatgtggtcttgccaaatttgttgtatttataatacaaaatatgagttatattattaaatatggtatatttgatgttttgtgaagattacatttgggggagaaacaaatattaaacctttgtaacaaaataagcttagtaaaatgtcagtataatttgagttaataaattgcaaacaggcatcagggaattgtcatttttgactctattggttgggatgccagttatgaatgcttaatcacaaacatcaacaaatattcattcattactttataaggcacttaagtcattgtagagcatgccaggaattataaatgatcatttcatccataagttactcagaatatagttggagatatattgactaaaattcatgaaaagatacttttaaaaatgtgatgacagtaatctggtgtcacatggtatcatgtatccaactgccaaatgaacatcataaggcacgatgtgttacgaattcagagagaagatatgacaggcctaaatgttgctgaaagagattaacagaaggggtgatagtctagttgagcctgagcaataagttttgaataggaacaacagaaagaaaagaccatccagagagactattgttagtccacagtactcaaaaaggggagtaatgttaatatagcaatttaaataaaaatagtatatgagaatgctttcaaaattgtaagctaatataaaaatgagttataactgtgtacttttggaaaccatttttaaattcagtagagtatacctctttcatttatttatttgccaaaactagtagtttacatactgagcatataacctctggagcatggcttttagagtacataaaatcagtcctctgggcagggcgcggtgcctcatgcctgtaatcccagcagtttgggaggctgaggtgggtggatcatgaggtcaggagttcaagaccagcctggcaaggatggtgaagccccatctctactgaaaatacaaaaattagccgggcgtgatggtgggcacctgtaatcccagctacttgggaggctaaggcagagaattgcttaaaaccaggaggtggaggttgcagtgagccgacatgtcaccactgcactccagcctgggcaacagagcaagactccatctcaaaaaaaataaaaataaataaaataaataaatcagtcttatctatggttttatggtagataacttgtaaaaactttatatatagatatgtgtatatatatgtgtatatatatgtgtgtatatatatgtgtatatatatgtgtgtatatatatgtgtgtgtgtatatatatatatatatgtatataattttttttttttttgagacggagtctcacactgttgccctggctggtgtgtgggagcaagatctcggcttgctacaacctctgcctcccaggttaaagcgattccctgcctcagcctctcgagcagcaagggttacaggtgcccgccatcacgcctggctaattttttgtatttttagtagagacaggttttcactatgttggccaggctggtctcgaactcctgacctcgtgatccgcccgcctcagcctccgaaagtgctgggattacaggcgtgagccaccgcgcccggccacaatattcttataataaaaaaacatccacggccagacgtggtggctcacgcctgtaatctcagccctttgggaggccgaggcgggcggatcacgaggtcaggagattgataccatcctggctaacacggtgaaaccccgtgtctactaaaaataaaaaaaaaattagccgggtgtggtggtgggtgcctgtagtcccagctactcgggaggctgctcgggaggctgaggcaggagaatggggagactgctcgggaggctgaggcaggagaatggtgtgaacccgggaggcagagcttgcagtgagccgagatcacgccactgcactccgtccagcctggacgacagagcgagactccgtctcaaaaaaaaaaaaaaaaaaaaaaagcttccacatgggatgcgtccaagggagcttggaaacgtagaagcttcgtcgttcttttatggtctttgtctggtgaggtttaagagtccattctgcagaaaagagttgttcatggatgtatttctgtcaacatccattggcctagctgatcatggtcaatataatgcttcatggccaacataatgcatatgaattaccatacggttaaagatcaccatattttcaaagaaaagattgtataccttctgatataaattagacatttcaagcagtactcaactttagtttattttatagtgcacaacttttgtcatagtattttcatttactctgagaccataataaagataaataaaattgaatgatttttatgatattaatttacataatttacaatggtacatccatagttcattctgtctaggtaaaggctttaaaggacctgtaggtgacattatctaaacatactttgagtctaattttctcaaaatgaatcaaatgttgttttcctaagaaatgacaatctatattttttcattcccaatgataggcactctttaaacatatacgatggtttctatagtagtagagaaatagtttatgatagtagctaaaaagttaattattaatttacctcaggtttcagcaaatagcaggttctcaataattattagcaactattgtgagtggtacaaatcctactgctctccatgttgcttctgctccacctctccctctctatttccatttgttttacaatatctaactaaaataaaattacaacttactttcttctatttgtcctttttgactatttctctgggaattttagattatgtccaaattggacaagaaggcctatgcctcaaaattgacttagaaaacactctttttaaaaaattttaagttttattttgggttcgggggtatttgtgaaagtttgttatatgcatatattatgtgacactgaagtttagggtgcaattgagcctatcacccaggtagtgagcacagtacccaataggtagtttttcagcccttgccctcctttgcctctcgtctagcagtccccagtgcccattgttgcagtctttatgtccacatgtacccaatgttttgctgccatttttaagtgataacatgtggtatttggtttagaatgaacaattaaccaatattatggtggagccaagggataatgggagacagttctctgtgagtctcttgtgtttctgcaagtcttgtaagcagaggcactgactatcttcaacttcaaactacctttccaggcaagtttatataggaatgtctgtttagaagatatatacagtttctttcttgagcaaaaagcaggttgttcactctccactataataatgtgtccttctagtgcaaaagtcaggcaggcttactttctacgttaaaagattctgagtctcaagctcaggattcttctcttgtgttaccttaatgaaaattagggctcagagaacccaagcaaatactgacactctggttattattgttgccatgagtagtaaagttctttgactctcacacagggatcttgtgtcttatgtcaacatgcatgaaattatttcatgaaatttaaattttggacgataatactgtcatgcatggtaaaatctcacaacctttacagttcttgatagggtgtagggcaatagagaaagttttggtgaaaaacaattcagaatgccaaaatgacatgctgaaggtatttaatataaacttatacagttaaaattacatccagaatttaagaaaacatttagtgtttttcatatatcaccacaaatgtaaaaatgatgctagtcaaatggtttagaagcattaatcaatacataaattctttcctttagaaaaaccaaaggctaggtgtaattgagaatgatcacatattgatttctagctcttattcaaaatctcatttcttcagaaaaggagaatattggaatattagaatgggaccaaattagttagaaaagagtcctacccacatgctgcctgaatatttctttccttttccgctggcttctccacttttcttgccctgattctgcagagaggctaccatagccacagacgtccctctgtgtttttgatcctcagtctactcttctttgatttgccaggagtttctggtaaagcagaaaggtatcattccatgggctacattctgattacaatgaaccaggcttcctcctttgcagttaacagtataatatcaatagtttcatacaagggatgcctttctaagttgtgtgagtacatttattttgtcaatctgtagacttacagatttgctcttggataattgcaaattgagtaaatttatattattatttagagtgaatatggatctgggatatttatttattaaacatttaatgttgtactgacatgagcttatcagtattaagtcattaatccacacaataattctgttatccctcttttacattatagaaagcttacctaagattatacagtaaaatatggcaaagctgagacaaatatgaacaaaggaacatagagtcgaaatagctgtggttcctgttttctaattttctacaaattctagattgcttctctccttgtcaattgcttatcaagcacttgtcatagtattttgtagtcatttgattttgttgccttcttaaaataaatagtacgcacactgacaccaagaatatatttaatttttctgttaaatttgtttttctttcatttttgcattgctaatcctgaagagaaaatcatagactttttgacatataatagttgccacataaattggtgaatgaatatcactgtggcacctaaagtacaccagatctgttggggggttctctttgttttatatttcctgactttaagtgcactcatgtgtttgagagttttattctaaaaagactacttatccaaatgcaacttggctgcctaccatgatttggcaaataaagactttcaagggcagaaagaaaaaaaaaatcttaagattatttaataacagcatgtaccttccaaagaagctaaagaaaattgtcaagtgaaacagaaaactgtgacattattttattaaaatatgacctacagttttaaacttaacgtatcttataattttatttttcagtaattgtatccatttcattttcccactcattattagagcagagcctttctgtagtggtctgatgttgccaggtagagtgtggaaaaattttcctatagatacatgttcattctgcaaaaagatgggattatattctgtaatgtaaagtgaatatttatgcttttgtggtatcccataaaaaatgtttgggaacaactttgcctttttagcttttgaaaatgagcatttttttatgtgaaagtttgctttattgttggaaagcaagagcaagaaaaaaaagtaggaaatgattttgctttagtaaattgggtttaccaagtctttcttcttctcttgaaacatagtgggaggagagagctttatattcaagctaaaaataatctttgggtaacacctacatttttaccctgaaatagacaataaaatacattcccagggactgaccataaaggggtgtggggagtagaatacttgagccttttcaaattgtctgtctctctcccccaagttcaggaaaccatctgtctccctctactcacatttttcccactaactgaatcctctttattccaaggattaagttcagtgtctttaaatagaaaaatgtggagattttatgaattgccaaatgaaaatgaaaggttcggaatcactaaaattgatggtgttctgattttagaagttagaagaaaattgcaattaaaaatatgatattcaacttattcattggtgaaaatataagctatggaataaaatgtaaagccaaatatatatttatcaaaaatctgcttaaacattgtatagagtttatataataaaaagcattaaagtagtttgatatttaaaaatatgtagtcagttctactttaaattgcatttttattactatgtactcagccctaattcacaagttggggaatattaatgttttgtgcctaccagattgattgctgtaaagaagacagttagtgtgatgatgtagatattaaacaaagtaaaaggcagttaatgcctgaaaatgggaagttcttaaatgtggagctcacactgaaaagaaaaacataaaagagaatcttataggtcaaaataaaattttgaaaatatgaaacaaaaaattataaactaacctatttttttttcattaatccatacaatgactgaacattttacagcagtatttcatggtgtgataaagaacctaatgatagctatttttaagaaacaccatcagtatggaactttgaaggcctaaactcaggacaaaatatatgagatgttgacagcctatggcagatttttaattgatattgcaatcagtgaaattagtagtattgcatatatttttgaggggaaaaagataaaaggaaattatttttgagtttgaagtttagtgtgtgctttagcctacagctagtattcacagaagattttcacagtctcagttgtgtttaatgtgaaaaatttaaagcataatacataaggttaatacagaattcaatgagcaacataaattttatatttttataacatcccatttggctgtcccaattcatgttgatgtgtgtgtattctaataccatatttacatatgtatataaatatatatgtgcatatatacatatacacatatatacatacatttctaatatgttccttctatttccttctcaatttctacttgaactaatcaaaatatgcagactttaaagatcataatttaaggaattcgtgataatttttaaacaattgtatgtacataggatgattttaaaattcatgtgtgcctgtcagttaattcactgctttgtaggctcctatttgatgctcaaaattaataggtaaacactggatatgcaaagggttattggacaagacaatcctttgaatacttactattttgaaatacttgaagaatcagaaaaccataaatatataagcaactgttgaactgtgaataaagtctgagtgagttaagagaaggaaggtgatttcgtcttttaaaccatgtttaaagtaaatacatatttaaatattcctgcttgataatcataatcgataagtgagcaaacatttgtttttgcaatgggcaaagaccttgctatcaattatacatgtgagattatctttgttttagttttccttctagcatattattgtaaaattaatagtatatagaataacagtttcttgcatactacagcatttttgtctgattttttttcgtagtagccatagccaaatattacatttcaatgccaaaaaaacatgaagctcaatatttctataacaggcgtaatcaaagtatgattgaaaccttggttaccagtaaagctgttcagtattcatagccatggtaacagtaagatttaaaataatagcaatagcatatctatcatgacattatattcatgttattcttattagtcattgcatttataaaattataattatgtttccaaataaatatcttagcaaatactactttctattcaggttcatttataacagctgaagacaaagatgttagtatcttaatcactttggaatcaatatcattgtgtgtgtattttctctttttcttctaacagagaactgggtttaactttttaaattgtaaattaacaattcataagtgtataaatttatggggtacaaagtgatgttataatttatgaatacagtgtggaataattaagccagttaatatatccatcacctcaaatacttaacatttattatggtgagaacatttgaaatttagattttgaaatgtgcatactctattattaactatattcaccaggctgtgcaatagaactcaaaagggaaaaaaaatcccacatttctgagattttgtaccctttgaccatcatctcattctccccacctccagcctctgtaacccattgtgtattttaaacacaacatttgaggtaagtgtttaattatttgggtttttagtatacccagtgaaaactggatttaagggacacagttcaggagatttcattaattttgtatggaatagttgaactaactaaataaataagtggatattcttagaaaccatgtgtagagtaggagtcttttgtgatggccaaataaagagagatcatagaattcccttagtacgaaatttaataaaaggtatgtataacttaacaaaatcaaaacaaacaaaatattttttaacctgtttgcatacaataccatgtctctaaaatgaagcatataggggtagataagcaatcactgtggaaagccaatgaaaatttacatgcgctcattggaatgattacatggtattgagagaattgtcagcattaataaaaccaaagagagatataaaatgaagaattgtgataactaacactactaaagcaaaaagacaagagacggtaacaaagagtggaacaaacaaacatttaaaaatgcattctggaagcaatgacaaatattctgttctggaaaaaaacaactacaaacagaagaaaattccctacaaaaagtgctatgcattttagggtagcgaatgagcatgaaggctttataagccggggatcccttatgatcttgtacaataacttaaagtttctgtgtttagtgtcctcatatataatatgaggtaacatgaaataataataataacattttcctccagaatttgtatgtaattagtagtggtatcatatggaaaacagtgcttggcaaatagtgcttgtgttttagctagccatattttgtctttagacaaacttaaaagaaaaaaagaatttaaaaataagtaaaggaagaaagaatttagaaataaggccacaaagacaaaagaatatatgcacaaaagaaagcagaatttgtacagctaagaatataaaatgaggaaaaaaatgaaacagaaagacctttgcaagaataagtaattaaatataagaacaaacatgaaaattatgactgaaaacggagttggtgacagaggtgaaaggttccagaaaacagtccggttgaatgcagagggaagtaccagcaattaaaacatgtaaaaaggacaaactagatggacagagttttccaaatgagcatgcttggggtccctgaaataaagaagttaacacatttgagcagaaaataatcctcaactatttactaatatagaaaattactgaaaaaaagaaaaatatatggattaaaagagttttacagtattttagggaatttgatgcaaaatgtttaacaggcctttcctgttaggttctgaaattcaataataaataatcataaaaactttaggcattaaactcaaatgcccctcagaaaaaattatgaagtttctcagacttctacaaaagaacactccaatgctataaattaataaattaacagataggaagttctgatgaacagaaagtgtgatctgagagtttataaatacctggttgtcattcaaataaagacaagctgttaaacaggcagaaactcaggcaaggtgactccctcccatggacccatgagcacttatgagaaaaaccaaaaacaaatgaaattttgtcaaccatgatatgaatgaataagtttttgcttaaaaaaagggaatgcggcttggcatggtggctcatgcctgtaatcccaatacttttggagaccagggcaggaggatcacttgaggccagggattcaagaccagcctggtcaagggaacaagaccttgtctccacaaaagaaaaaaatacctgggcattgtggtgtgcacctgtagtcttagctcctggggtggctgacgcaggaggatcacttgagccaggagtttgaggctgaagtgagccatgatggcactactgcacttcagcctgggtgacagagtgatactctgtctcaaaacaaaaacaaagtctttactcaaatgtcatctctcaattaggccattcctgatcatcatatatgaaattgaaacttgtctacctcgccttccttatctctgttttatttttatccatagcatcatataaatacgcacacacacacacacactactaaaaaaatttaaatgacaaccaaaaagtcttttccatatagatcaaataaaaataaaatgaaaaattttaatttgtatcaatcattattagaagcaaaacttatggatgttgctgtctgtgtcagaaagaaatacaaacccttaaccatttattccactaatcaataaaataaaaattaattaagctctaaaataaattagaaaacctatacaatgaaacaattgaatgccaaagaaataaattttaaaaattatacctgcagaaattttaaaatcagtaaataatatctgtggaattaataaataaagccaaaagctatttagtaaaaccactggtctggctaattaattggaaaacaggaaggaaggagaggaggaggaaaaggagaaggacaaagattaggatgaggaggaagaaagaagaagaaagaaagggggaggaaaaggagaaggacaaagatgaggatgaggaggaagaaagaagaagaagaaagaaaggaggaggaaaagaagaaggacaaagatgaggatgaggaggaagaaagaagaagaagaaagaaaagaggaggaaaaggaaaagaaggaagaggagagaaaagggaaagaaagggaagaaaaagaacatgtaagtgggagcacagaggtataaaaaaagagaattgaagaagatatagggagattgagagtaaaataaaagaacattagaatacatgatatatttatttacaagtatatttgagaagttagatgaagtaataattttcttggaaacctttaactaacagaattcaacaatatatcaaaaatgcagttcactccagaaatgtgaggtgggtttattaattgggagtgtactaatataaatgtatctattaagacatcacaggagaaaactacatgatcttacagatcttagataaaaattgttaacattacttaaggctctgaaagttttgtcctccacctacccctccagttctaacttatattacactctaagaaatattttgctgctgtttctttgagatactgggaagtgataaatgtgttgcattttcttagcagcacttttaaacttaatattacttgacaattaactggtataatgaaaacttttcagtttattagatgaaaataaaattcaaagaatataatagtattgtcttttatgtcgttaatttttgttttatttaatactaggagttttacctaacaattatttttaaaaccttactcaaagaagcacagcaaatgtttgtcttcttgttttgtttttgtttacttttccaaaaaagccaaatgaaactgtatacaaggaaacatgttggttattaggtgtcatgccatctggcactgacatctgccaccacattgaccccaggttattttggctgctttgcctggcaaggagggcacctgcctcttacttcacagctccatgctgggcattccacgtctgcagtttccgtgaagatgtcaatcttcccacatagaggagtatgttttaaaattaaggttataggaaaaagaaggtagctttctagaacttctaagtatgctatggagtccataaaaagtatgctgattttcacttatttctagaaaattaagtataaatggtaggttggattttcactttcaactactgaagccttaagaagaggttatattgtaatcttgaatttaaaataaatggattcacatgtttcatatgcttttggtcatctacatttctccattttaatagtaaaattaaacattattcataatttaccttgttttgtatgtcttctttgggagacttgcttataaaaatcacatcacaaggtttgcaaggtttgtgtttccttttccagcctattacacatattcttttaagaaagctcattttaaatgagccctttcaagaataaaagctttttagattattttttgtatgaaatatattcaaaagttacacctcatgcacctagcattttaaaccatggttccaaaggattctgcagatttaaaggtcctaccgttttttattgttatttttattacttattttctttttcctttgaagtatttaaagttacagaaggtggaatatttaactttggccatgaattattcatatttgtttagaattaacattggcttaaatggcttaacatttttctttagttagtgattcttagattttctaatgcagctcataaggctacatttctcagctgggtacaaaacttgatgaattagcagctacaagctatcacaggaaacaaacccagaccttgcctataaataactgtctagttttaatctgattttcttgcatcatataaggtacagctgcatataggtttatatgttgtgtgttcatatctacttttgagtagatagtggaagcaaatgaatccaataaatctccttaaaatatttctgcttcaagaaattcagtatccttccagaaaataattgctattttgtcttttttttaaaataacaaattgtgaagtatatagataatatattcttcaggaagtaattcttttgattctatattttataattacactagcatctataattgaataattgaataaaatttgtttacaaatatattgctatgccttaagatatgacatattttgcacattttacataacttgaaattgtgagataacatcattattcaaaatatgagtgggagtttatacataatgaaaataaataataaccaactcccttaagactagtaataagccaaagaaaaaaaacagttatgaaaaaggttaacttaaaggcaccatggaaacaaaaatactgttgtttttataatcaacatcataattaggaataatttggaactacaagaggtcctagccatcatttagttcaatttgtttttattgtggacaaacagacttggttaatagcaccataaactaaaaacagtgttaggatcagggtcatatcacaggtcaaatgataataagaatttccttgctaataatagtttgatgagagccatgggaaaaactgtccttaggagactgcctgtgtcaatctattataaacaaatgtgggtggcctcaaaaatatgaatgtgaatgtaattaatttagaacactaatgaataaactgtgtacactaacctatatatatgttaaagagaaaatatgaaaataaattacaaagatcaatctaagaatgtgttcacatattaacccatacctgtggtctctgaaagttgacgacttgttcaactactgatcaaaaatcgtttggaactctgtggatatgcttgtttttttcaattgctgtatacctccatagagtacaaaagactgggggacctagtttctgccatcagggagctcaaattcctcctgggaaaaaatgatgctgaaatctaaaataaaaacataacactctgtggcttatatggccacataactctgtggtctaatctaaataatttgttcaataaaagtttaaaaatggtaactcactttgaatggaccaataagagaaagtttaaaatttgagtagcaatgaaatagtgggtaatgggagaagaaagcaatattgtgagaaggataatgtaagtgaaggacagaaggggaaatatctgagtgatattggagcatggtgtgagagatgtttagtagatcatttttaaaagctagattagggggctgggcgctcaggcctgtaatcccagcattttgggaggccgaggcaggcagatcacttgaggttagaagttcgagaccaccctggccaacatggtgaaactccatctctactaaaaatccaaaatttagccgggcctggtggcaggcacctgtaatcctagctactcaggaggctgaggcaggagaatcgcttgaacctgggagatggagtttgcagtgagctgagattgtgccactgcactccagcctgggcaacagaatgaaaacccatctgaaaaaacgtataaaaaaaaaagctagattagggttatacttttggggttttgaaatgccatgtcaatagcctgggaatcaatctctcattttattataagtgattatgatttttttcagaagagaaatgatataagtctgatgcttaaagatatttatctttagtatgtggagcacactaaagaaataaaaggataaaggagatgcaaactgttgcattagccatggtataagatattaaggaccccaactttattaagtcacactactattcaagcatccaaccatccatctgtccattcaacacttatctgttgagagttgactgatttttaggtagtatgctggagcaaaacaggactcaaacagatatctcatcctcaatttaccttgagtttacagatgtatagggagtgtatgtgtgtgtgcttgtatgtttatggatggtatgtaatgaagtgacgagacatataaagtgaaaattatcatatatattgctctaagtgatatgatagggttatatttgggcgtaaagacccataaccaccatgatgaggaagattttctagaaataatgctttatggactaaaaaatcaccttgatttacagaaatattggaagcagtgggattagtatgtggaaaatatagcactggagagtattaaagacttgccaaacttaatatggtgcaatatggttggaataaagttcatagtgaaataataagtcatgaaactggaaacagttgcactccttgaaagtacagttaaacaatactcttctatcagaaacatcactccattatttttcattttaattaggtcatttatttagtgatcaattgctttaagacatgtagttaggtctatatttaaaaagtgtgaaaaaatgatacaactgatgcataattttgggggaacattctaggtctttcatgggagacaattcttcatgggtctccagcattttttcatgtgttgtgagtaaacttgctgtttttgttatggaccgtcttttcaaggatatttttacaaggaaagctatagaagatatagtgcctccccttggaacaaaggacaagtatgtttactacccatggtaaaatatttgagtttataaactcatggttcttctcctgtaatgcaaaccactgcatgtacagatgtccccctttgcattcccctgggggagctagggcactgaattggcaaagaaaatgccgatactctagatactgctatagttgtgactaataaagtccttttccttctgacccaggagtcttgtggcttttgccaacatccacgaaactgtagcaggctaacttattagcttgcaagtaaggtaaaatcttagacccttcatagttcctgacagttttggctatgaggatgtgaaaataaaaaatgttttatttctagaataggatcgatgagacgcttgtgggtcaattaacagaatttgaagaaagtgtataagaattggcagtaaacatgttgatcacattaatggtcaaccaagcaataaattatccttcacttcattgctctttaataaggagaaattggaaagttattagcagatagaatactggaaagcgtgcataaagagagctgcttgaacagtgctggacttgttgcaaattcgcctccttttttgggaggggggatttccttgacaatcaattcaactgatgggattcaggcaaggtttgcagtggagcaaggaatctaaaataatcttgtgagtgaggccctttgggaaaattctatgtattgttttggttgctgtcattctgaatatatattagaaatttgatgcattatatgctcatacttccctgtcccatatgtgtcaggtaaaaactactgatgaggaattacacaaagcattgtcctcacccactcatggtacattgacatcattggacaattgacctcctctcagggcacttagtagtacctcactgctgatggtattttttcagattacaatgctattccagttaaatcagctgactttggccatacctttatggaccttgcaactaatcattgtcatgtactttaattttcagacttttgcagtctgatattagtgcttcttttattaccaaaaaaaccccaataattaatgggctgatagttaaagtatatccagtggaacttccacactccctaccatccacgattatctgttgtttttgagctttggaatgggctcctaaataatcaactcaaaaataattctcactctactcccttcacttcctcctggtcaataaacctagaaagaagattggccatgaagtgcagctgtcaacagaaaaggatcttagtttggcagcctcactttggcctggtttatctaccctctgagtagtatctcagccaaaatggggactcaaaacttaattctagttcatccaactggattcttttgttagactgacatgcttctagattggttatgttgctcactaggtcctcctggaatagtccacatgaaccaaaatgggcggtacatcgggtctgtgttggatttaataaaatgtctttgccctttctcactcattccttccagatgacagagctaggcatgagttggggatgactggaaaaaaagtaaaatatagctactagaatgggacacatgggttttgtgttagtagaaggagagtaactgcagaacctggagagagaacaacttagaccctgacaggtacagaggaggaagggccatccgtgatccttctcttcagaaccactcctagatccttcctcgtagagcaaaagaccctgctgtggctctcttaaactactgaaatatccctaaacttaactgaatgctgggtcctctgtgccccaccacataactctaaccatgatttgataatcatttcccttaattgtagtgagaaatctgttggatgcagctggaattgccccagattttccacctcccatgcaaaacattgccaaacctctggatgtcctccacatgctgatttcagtagctgtctccagtcattttgtagagcagacacataccatttgctggctggcatggacataaatgcaagttggactgattaacctgaggcagtccctccaaaaactaggactagattcaagtattcaaatttaaccggagactgtaaggcttcctggccagctgggaggccatgttggaggcactgccagcttgacctccacatggggaggaaaaacagttgtaaaaacacttgttctaggggcactatgtgtggccctgggactgtacattttgtgtagatgccaggaattaacttgcctctcttctgaaaacacagtcatatgcattatagggtgatcacaattgaccttcaagtgtttaaggaaaacatcaccagtagattatataatcttcagatgactgcagagatctcttcaaaattaggctgcctgtggttactcaggggatcttcttggaagagtgtttcattattattgcacaccctatgtgaagttatctctaaaatgggattcactaatctgaaaaggcagtacaacatttctccttgtcttcagctaaagtaatcagtgacatagctttggctcttgaaggcattcagtctcagcctcaattaactggacatggcagacatagaagatagatttgccctagactttctccttacttccaaagctgagcctgtgtgatttctaatacatctttctgtacacctggattaatgccttggatcaagtggaaaggtcaataaagaaagccatttggctttttaaggtagtccctgatgggttgtaggatttgtccagttgtctgtgtctggaaccctggggcacatggttgagatcatttctacaagtcagtctcttattgctgctcacagtcctgtgtaactttaattaaatgctttatgggataaattgaatggatatggtcccagcctctgtcagattaatcagagtggctgacaggtgatgcagtcatgggaaaattctccaaaagttaagacactgtagaaggagtttgatgttaaagacacaattctccatggatctctcatacttcacttcttgcaagcagaggcactcacataatatttttaaggatatttgtacagtgaacagactttgaaggtagagataatgtctccttccagaatgaacagcaggtatggttactgccagtcatcaaaggtttgcgtttcacctgcaccacacatacagtgcttgtctcctgtaacacaacccagagcatgtgcaagtatcatctagttcttcgtgtttacctgtgaaaatggcactcagggaacaggcacctaaaaatgctgtcactctggttattgctattgatctagaaaagttctttgtgtctgtaccaggatttttatgttttcttctagcatgcacaaaatcatggtggactaatagcttacagatgggataaaatttcagacactgcacacacattcttcacagacacattatttttgaagttataaaataatattaatgtgttgttaaagctaattttcagagaggggattctattccaccaacatttatgactaggtaataaaatctcatttttactgaaatttagctccataaaatgcattctatttaaaatctgaacatgtgccaaactatcatcaatactgtataacaccagtataattaggtagaagtactggataaactgtatgtaatatgtgcagcagaatcctaaatcattctaatggaaaacagattatgccagcaacatgtaaatacaaagaacagtggtctccaaggaaaatatcagtagcacatcaaaatctattaatttgttgaagaaatagtatctaagagattcaattaaacaaaataaccagagaatacatgccttatttttggaaacgtaaatattactaaaattgtattaattagcaatctcatgaatattatgttttactaagatgtaggaaaccccatgtaactcaatgtaatatttcataatagatctgattataactgagatgagcatttttacagggattaacaaaacataattggaaataaatgataattagataaattaactgtgggtggaaaattttcatagaaaataattgtcattcatttaaaaaatgtgtttttattatgaagatggggcaaattatagaaatagtgtcattgtcttttgttgttaccattttaaaatttcatctctaattctcctagtcatttagtttttatttcttccctgtccacaaattatattaagcatttgttcattcattaattcattgccttattcatttggcaagtatttatggaacatgtattatttattgaacaatgcttttcagctctttatggcattgtttagaatttaataatttcaagataatcctaggtctgctatcactgaacctacctctgccttcagtaatctcagtgcttgtaaatgaaacagctatttttagctctgatagaactaaaatctatacctgtcttggaaactgcaataattaataacctgtacttgtaaaatactttatagttttctgtcagaattttatgttaacaacaaatgtgagctagaaaagcagaaccgattgtttctattgcacagagaaagagcttaagtctttaagagggtaagtgacccaaggctaggttgcagagtcaaaattagaatttcatttcataataaattgtatgtcctttcactatgctgtacttatactggcaaatgatagagtgggttcagagatttctaattgcattgtgaagttaatccttatatccttagtggcttttggaaattacagtttaagactggatctgactgaaccagcattgaggacataagcttattttactggcaactctgtgatatgtcaaatatgcctaagacaatgtatttgattttgaagttgagaattgcataagtaaatcaagaaatcgtttagtgttataaattggcacctggtttctgacatagttgtttaggttattatttttagcaaaatagtacattataaatgtgcagataccctagattgttttacaattgagacatgaattcttctcccatatgagtttatattattaatgtctctctacagagaatagtactttatcccctaatttaaatatatagtaactcagttcttgccacatcccattgttcatggatgtgaacaggaacacacatctacctagtctcttctagaaaaataattatcaggaaataacagaacttaaagacaggattagaatagagagcatatcagataagagcgaaaacagagtgaaaatttattataatcgactgagctatataatgccaagaaataaaccatgaaaaatttctgtagtttaacagcaacacagatttatttcttgctcacacaaagtttcagttgggtccggcagctcttcaggactgctctcttctatattgtgactcagagagccaagctttccctattttgtactcccatcattttaatgtgtggatttcctgagctatctggacaggggaagacagtattaaaggtttatacgggatgtttttaaggtcaaaacctggccacatggctctaacataactccaaaggaggctgtaatatagaggttaatgccatctataggacatagttgaggctctgaggttaagcaacaaaaataaattttccctcgcgtcagataacaatgtgaggcacactttcaggaacttgtcaaggagcttggggatcagtgattgcaatgctttcccacatgattaatggtgatatagaagatagaatattttgattataggggaaggaaaaaatggtatatcagaggagccattatcccagtagagtgaggcaggattggtgatgatagagttaaggtgttatgactgaaatctataaaataaagaaatggcaatttaacttctacagacactgggatatatatgatatggtataagaaatgggagattgtgttagtctgttctcacattgctctaaagaaatatccgagactgggtaatttataagcaaaagatatttaattgactcatggttctgcaggctgtacaggaagcatagtggatttggcttctggggaggcctcaggaagcttccaaccatggcagaaggcaaagggggaacaagatgtctcacatggcaggagcaggggcaagaggaagagaagggggaattgctacactcttttaaacaaccagatctcaggagaactcactcactttcctaaggatggtaccaagagggatggtgctaaactattcatgagaaagccaaccctcatgatataattacctcctatcagaccctacctccagcatttgggattacgattcaacatgagatttgagcagggacacagatcaaagctatattaaagatcttctcagggttataataaaagcactagtagttgtgataagcattgtgaacgtctcagaaaagtggttaacaaaaataagtgatactttagaggacagatgtatgatgtggctaaagtgagaaagcaataaaatgaattcctctctctttataaaaatacatataaattaaataaatcttcaggttctaattttgataaatcctaaaaagtaatattttagttacttaattattaagtagttaatgatttttaactatgttcaaagcgtttgatatgatatcattattggtgtcttcatatacttttccattcacttttgattgtttgcttattcattatgtacggaaagatacaatatttagcctcgactgaaattgctgttgtccctcagaatacatttaaattgtttgactttgtaaatgtacaagttatttattcccttattcttctttgtaaatttgccttctttgtattttctgaaaatatttcaactattttcaggtttctgttatctggatctagccatgcaaagaaaagttgtcattttccatacctttaaaacttaaaattgacaaccattcccaatttatttcaatttctaggtgagatttagagtttcatttatgatggaatgacctccttagggacagacatctaattaatagttaattcatttaagaaattcaaggtactgtgtttcttctccctgctcccaaagagcttatagtccaatcagggaaacaaacaggaagtgattgcaattcagggctgtgtgctaagtgagaaataagcaggaaacgatgcgggagcacaaagatgggcactagcctggaccagagttgggcactgatggcacccaggagtgctggcccagccagtgtcaaaatcttcaatgaatgtagcaagaacagaggaactaacaatgctaaagcatgtgcctcctatgagcaaggattgttcagtgagggcagagtggccatgacctgaaagcaagcctgggaaaccagtgctgatcgtgccccactacccacccttgtgataattaatatgcaggataattagggcagaagagaatgaccaggcaggccttcattttaacatcctgaattactttggattattcattttagatgtaaagactttttaatttcatatttatgcaagacttttctcagatttatgaaacaaatttgaaaagtcagaatattttggaactaatggtatattttacgggaaaatggtgaaaacaacagctttgtaaaaatataaaggctgattacaaaaggctgaatacatatatattttatattatatatgggtgagtatgtttataaaatgcaaacaaatttatatgtaactattgagaagttttagtttttaatattttcattccatagaataccatggtgtacacagtattaatcatggtcactttgtttcagaaatgtaatgatcctgttgctgtaaaggaaaataaagaaagagggggaaaatgcacttaataaatgcgttccagagtaatgttcatagaaataaatcttagtccataatcatgagaatgaagggttgataagttgccagaggaaaaaatgatttacagtaatatgaattttaacacaactgtaattacatttaaaatttcaatttgtttaattgatgtttctccaaacttattatttttaatactcatcattatttatataccttcaataattattttttaaattccactaatttatatattaatgaatttgaattgactggtttgtatctgtgggtttttagtactgaactagatttctgttaattgtagagcacttcatccatttagaattttttagtctagttagatgcagtaaaaactggtgtgagtggttggacaggaaacaatatttcaattttgtgtctaattttttgagtgatttggataaaataaaaacatttgtgatgatctaatcagtgggataaattcatctgaaaatctttatatcaaataggtaagttagcaaacatgccaaactaaagaaatgaaccacttctattttagcttgactttcatttgctacaattattttttatcctaataatattttttgttctctgcattttagatgaaatgaatattgacatgtatatatttatgaatacatttatgtttgactgtgtttgttttattttagagtatatgtcaatattgtgtgttttaaactaatccttcaaagactaggaaatagaactctataccttaaccgatcagtaggtacttaagcactaaagaaattcctcttgataataaaatacttccaaactactcatgtttgtatattaatattgctgaaatgtttgtccttctttctctgggatgaggtagcaatgattttattttagtaattgaagtataattcttttcagaaaatggaatataaagttagtctttcaaatgaatgggaaattctaatttacaagaaaaataaaagcactctgtaattgcctatgatgtactacttctgcctgtgaggttgcatttctctgtaccttaatacaaagtacagtaatagaaaaatgattcagtaagtgtaattctattactttctaatatgacaccaatatgatacttttaatgaatgaaatacaaagttattttaaaaactgcagatttgtcattaactaaaaaatgttacattttatgtgttagagtgttcttattcaactatttattgctgagtattaaattgcacacttcaacaccgtgtgttattgcacagtacttaacaaatagtaagtccagaataaatagttattgactgaattaatttattaatatattcaaggctgttccaggtgttgtgggagctgcaaagggtgagtaatacaccatagcttctttcaaaatgaatgatacaagtaagaataatatgagatcacatgggaagaaattaatgttgaccgtagccaatgagagaatctttataaaagtcatagaatataagttagatattgaggatagggtaaataaaagagaaatttggctaaatttgcaaccgtggaaaagaaagaaaatgtcaagtaaaatcggaaaggttaggcttaaaaaaaacattttgaaacagcacagtaaagtatcatttgaatacaaaaggaattatagataggcaaaatgaattacagattatcatgaataatacgatcaactttaccctcactttacagcaaaaagaatcacaggccaataggtgagtttacatgtttgagattccatagaaaatagtaaaaatggtagcataactgtttgggaagtcataaggaaagaagtcaagacttctctttcaaaactttccaaactcacgtatattcaaacatctggaaaaatgctagcagccttctaaagaaatggctcttagtatttgagaagattacctgtagtattaccaaaggccacacacacacacgaagggaagcgtagtggagaaagttttattcttcaggccaaaaacacatatatttaagtcttggttcagccacttacttgtgttatggccttaagcaaactatataatttttcttcctttcttttttttttcttttttaaatacaggattttgttttgttgcccaggcttgaggacagtggcacaataataggtctttgtaactgtaaagttctggactcaatcattcctgctattgaaggctcctgagtagctaggactacaggcctgtgtcctgccaccatgcctggctaactattttaaattttttatttattttcttatttttatttttgtagagacagggtcttgctatgttgtccaggctgcgcttgatctcctgggctcaaacaatcctcccaccttgacctccccaaactctgggattaagtgtgaactaccaggcccagccaagctgtttagtttttcgaaccctcgttttttttgttgttgttgtttgtttttttggtgcaatcattttattttattttattttatttttttaattatactttaagttctagggtacgtgtgcacaatgtgcaggtttgttacatatgtatatatgtgccatgttggtgtgctgcacccattaactcgtcatttacattaggtatatttgctaatgctatccctcccccctccccccaccctttgtagggacatggatgaagctggaaaccatcattctcagcaaactatcacaaggacaaaaaacaaatcaccacatgttctcactcaaaggtgggaattgaacaatgagaacacttggacacaggaaggggaacatcacacatcattttttatttttaaaacaatgtatgcctttctggctgttaggatccatttagaaaattttttcttgcaatgcattcttagaagaatgggctaggtgattttcctaaagtgaatatctgagtatcttacattctggtgatttctaaacttcttaccggcctgaaaggtattacaagacctagacactgtattcctctctaacttcctcttggagccactcctctctgttccagtcatccaaggcttctctatgccccactaatggaccaggcttacacacactttacattttaatttttatttcaatagatttgggggtgcaggtggtttttggttacatggatgaattgtatagtgaggaagtctgaacttttagtgtacctatcatctgaatagtgtacctgtacccagtagataattcttcaaatctcactcctccttgcaccattcctctgagtctccagtgtctattataccactctgtatggccctacatatccatagcttagccccaacttataagtgagaatatgctgtatttggttttctgttcctgagttacttcacaagatagtggcctccatttctatccatgttgttgcaaaagacattatttcattcttttttatggatgagtagtattccatggtgtatatgccacattttctttatctactcatcggttgatggacacttagattcattccatatctttgcaattttgaattgtgctgtgataaaaatataagtgcaggtgtctttttgacataatgacttagttttctttgtgtagatacccagtagtgggattgctggatgggatggtagatctacttttagatctttgagaaatcttcatactgtttttcatacaggttgtactaatttacattcccaccaatagtatataagtgttccttttttttttttaaccatatctgtgtcaaagtctaatgttttttgactttttagtaatgaccgttctgactagggaaagatggtgtctcggtgtagtttttttttttttttttgagatggagtctcactctgtcgcccaggctggagtgcagtggcgcgatctctgctcactgcaagctccacctcacgggttcatgccattctcctgcctcagcctcccgagtagctaggactacaggcgctcaccaccacacctggctaattttttgtatttttttggtagagacagggtttcaccgtgttagccaggatggtcttgatctcctgaccttgtgatctcagtgtagttttaatttgcatttccctgatggttagtgatgttaagcattttttcatatatttcttggccatttgtatatcttcttttgaaaaatgtctattcatattgtttgcccactttttaattgattttttcttttttcttgctgatttgtttgagttccttgtagattctctatattagtcctttttcagatgtatcatttgtaaatatttttcccagatacctgagagtatgtttaaccaaagaggtgaaagatctctacaagaagaactccaaaacactgatgaaacaaattgtagataacacaaacaagtggaaaaacatctcattctcatggattagatgaatcaatattgtgaaaatgaacatactacccaaagcaatcgacagattaaatgcaatttctatcaaaataccaccatcatttgttcacagaattagaaaaaacaatcctaaaattcatatggaaccaaaaagagcctgaatagccaaagcaattgtaagcaaaaagaacaaatctggaggcatcgcattaccttccttcaatttacaaggctatagtagcccaaagagtatggtactggtataaagcagatacgtacacaaattgaacagaatagagaatccagaaataaagccaatatctataagcaattgatcttctacaaagcagaccaaaacatactgggaagaggacaccctattcagtaaatggtgctgggacaattggagaggcacatgtagaagaatgaaactggatccctatcactcactatacagaaattaactcaagatggattaaagacaaatatatgacctgaccccataaaataccctaaaaattctaaaaggaaacttaggaaaaactcttcaggacaatgacctacaccaatgatttatgactaaaaccccaaaagcaaataaaaataaataagtaggaccaaattaatctaaaaagcttctgcataacaaaagaaacaatcaatggagtaaaaggacaacctacagaatgggagaaaatattcacacctactttagatgaattgcacctgctgtttcctattttgggaatctttttccttctgattttcatatggctgctgcttatcattcttgactcagcccaaatgacatctttagaaagacattctcggcccacctaatgtaaagtagctgtttcctgcaactaatatggtgtttttttatgtcatttatcagtagctgaaatgatctgttcatttgtttatatatttgtttattgtctaggttaggaaacttttctttcttgttcattgttcagaacttagtactatcctagttggtaagccctcataagagttaatgaataaggaatacgttaatttttattaccagaattatgagttcaatatggaagatttggcggaaagacataaagaaaaaccaggaaggctttaacctagacatatacaaacattttggttattttaacattatgttactttagtaaaatatttgtttttatttttcttaaaaaataagcaatgattaaaaaaaaacctctatgatactccttacctgcagatatggctctaaaatatgacaaaatagaaaatggcacctttttttaactttaggcttaaataatttaaataaggctagattagaagaaagccatgcagagcctatggaaacatagtgtatgtgtaacaaagaatttgaccttgccaaagaaaagaggtctgtcctttgccctcggtttctgagaggtaatctgtgtcatacctgataggagtgtctttgtttagaatggaggctggccacacttaataatcttagagtagaggctgactaagccagaaagatcaatcatgtgatttaggatggtggctttgggtcatgcaatatcagtcaacttggaggctgagattaaccatgtagtcaatcaatcaatcagtcaatgatacctgagtaatgaagccttatgagaaactctggacattatagctcaggcaagcttccctttttggcagtactccatctatgttgccacacatcaattccaggagggtaataggtcctgggtacaacagaagcttacatttgaatccttccagtttctaccctatgtgtcttttcccttggctggtattttatctgtaccctacctccataataaaccataaccaaaaacatagctttcagccagttctgtgagtcctttcagtgaatgattgcattagagggtggttttgtgaatcctgcaatcttgctgttggtgtcaaaagcaaggacagttttgaggactgtgctctcagactttgagtttggctatctcttgctagtatatcaccatgagaaagaagatgttggttgtcttatagatgttaacattttagacttgaacggcttgcaggtaatacctattctaatatttcattttatggaaaagcatgaaggagtttatgatttgctttagttcacaaggctgctttagtgactgggtcagagttagaaatcaggtttatcaatctcattattttgggtttcccactatatactgtgttatttgacacaagagtgacatagtaagtatcacttgagtacaagtgatgtttgtttgtttgtttgtttgtttgtttattgagacagagtctctgtcacccaggctggagtgcagtggcatgatctcagctcactgcaacctttgcccgctgggttcaagcgattctcctgcctcagcctcctgagtagctggtattacaggtgcctgacactgtgcccggctaaattttgtatttttagtagagacggggtttcaccatcttagccaggctggtcttgaactcctgacctcaggagatccgcttgccttggcctcccaaagtgctggaattacaggcgtgagccaccacgcccggcccatttgatgtttatttttaaatattatgataatttttttttttgagacgaagtctcattcttgtcacccaggctggagtgcaatgtcgtgatcttggctcactgcaacctccatctcctcggttcaacggattctcctgtctcagcctccaaagtagctgggattacaggtgcctgccaccacatttggctaatttttgtatttttggtagagactgggtttcaccattttggtcaggctggtcttgaactcctgacctcaggagatctgcccgccttggcctcccaaagtgctgggagtacaggcgtgaaccacctcacctggccctatgataaatattaacttataaattagtaagatgtttatctcatagtattgtatattcaaagataaacttagaataaaacttgtatcttaattacaggaaaaatatccatgccacaaaaatgtccattttttaagaactacaacgatttttaacaagaaggtcttaattttgctttgtgattaacattatggccactggtttaacaagttaatgtattaggttctctttggctaactccagcatatgatgagataataacgtgatgggaaattcatacaattttcagaattatacacactgacagttgtgaaaaataaacatttccagtgaggctgacatgacaactttagggaaaaaaagcaagcattactcggaaatgctaagacaactaagcaagtatagggctatatagcaagtaaatgtctttaaacattcctctgtattacatatgagtgctttttctggataatgtattttcatcaaaataaccaacatattataaaaaatgatgctttaaaaaggaaactgctgttcttcatcaaaatagtttggaaacatgacatctcatttcctgtaattaaatgagttattattatcatttagtgacatcataatgggatattattaggtaaatgagatattattttctttacattatagtgatacaacagtagagactctgaaacctcaagaactgatcagatggagcacaaagagtgagatagttatatttctccagacttttctagcaggaagtacaataaatagtccgtatttattcctttgtaactatcttctacttaagtggacacagcacatggtgtgtctgttctgtgagtccagcacatgctgaacataaaaacaagtattttttaatttctagtttttttttaattaaaagtattatagagatgcagtcttgctatgttgcccaggctggtctccaactcttggccttaagcaatgctctcataaaggtaattcttttgagaaaagctttttaacttgtctgtcattatcatgaggcatttttagcacctattatatgtattgtaaagaaaatctgtcatataataaaatctagatatattaccttgtgtttactctaccggcatttgagaaaaggggatacactcagtaaaggtgcaatgaaagaaattcaaatgacatttttagaaggcagtatgtttggctaaagtctgcaggaatcaattttgcagaggtagagataatgtaggcatttgagtaacaagggatttactgtttagtgttctgtagacacataccatttacatctttttgtgtgttgggcagtgaatatatacaaatgagaactgtatttttcatttcttaatttcaacttttattgaatattcgggggtacatgcacaggtttgttacatgggtatcatgatgctgaggtctgaggtacaatagatcccatcacccaggtaggtagcattgtacccagtggttaggtttttcacccttctgaccctttatctcccacatgccaagtagtccccagtgtctattgttgccatctttttgaccagtattacccaatgtttatctcccacttataagttaggatatgctatatttggttttctgttcctgatttaagttgataatggcctccgcctccatccatgttgctgcaaaagacatgcttttgtccttttttatggctgtgtggtattccatagtgtatatgcaccacattttctttatccagtccaccattgatggggtcctaggattattccatgtctttgctattgtgaatagtgctgcaattaacatagatacaagtgtatatatctttttggtagaattatttattttctttttgatatataccagtaatgggattgctgagttgagtggtaatttcgttttaagttctctgagaaatctccaaactcttttccatagtggctcaactagtttacattcccaccaacaatgtacaactgttcctttttctgtgcagccttgcaaggatctcttgttttttgactttttaatagtggcccttctgggctgggcatggtggctcatgcctgtaatcccagcactttgagaggctgaggcggacagatcacctgaggtcaggagttcaagaccagcctggccaacatgatgaaactcccctctactaaaaatacaaaaaaaaaaaaaaaaaggctgagcatggtggcatgtgcctgtaatcccagctactcgggaggctgaggcaggagaatctcttgaacctgggaggcggaggttgcagtgagccgagatcgtgccattgcgctccagcctgggcgacagagcaagactctgtctcaaaaaaaaaaaaaagaaaaaaaaagaaaaagaagtagcccttttgtttgtaacacaaagaaatgataaatgtttgaggtgatgaataccccatttagcctgatgtgattattacacattgtaggcttgtatcaaaatatctcatgtaccctatatatataaatatatgggggtatatatatatatatatatatatatatatatatatatatatacacacacacagtgggtaaatatatatatatatatatatatatatactgtgtactcataaaattaaaaataaacaatttaaaaacatcaatagtaataatagccattttaactagagtgagatcgtatgtcattgtggttttatattttacaaatgggtaatgagtagtgtgtagaacaaattataaatgagagttgaggaactagaatggtggctggcagaagtttatgggaacacagattagaaggtaatgaagtacactttgttactgaaatattcaattcctctagtacacaaagaagaatgaaggttagaaataatcacttttcccagattttttttatatgtgaaagttttaaatattttaactcttatattattttcccccttaccatgtttatcacctgccaaagaactacagtataattgaggtattttattgaagagaaatgttgctttcagtggagttgactattttataaagaatatttaagtattgctttattgaccgtgatacaaactcatgcagttaggtttagaatcaaggagatggtgtctgtgatgttagttctactttgtcatgagagtagaacctctattatttttgtttttcttctctaatattttaagtgataaaaagaaaaaagcatgaatttttaaactaacagcagtcattaaattttaactttgaaataggaagttttctacttaagtaatatatttatactcatcagttttctttttctattacttaataataaaattatatttactttattcccatgcacacattaaaatgaaagtgttctgagtttagttttaaattttgtatggattcagatattggtttaaattcatataaattatgaatccatataaatattagctttttctaaacagcaaagtattatagcataacttttaagttttagtattttagtagtgtgctacttggaaaaattaatattgtaatttaccttttctcagcataagaggaagaatgaaaaattctgggcatacctttcagaatctcattttgctagatatttcacatttaaatacaaaaacacacagcaatccaaactaaatattctcctttgcaaaaatgtataatgacatcatattataataaggaataacataagctctctattcatatttgcaaaatatatgtttttggacttgtaatgggacttgcctccagagcaagaattcatagaattaagacacatttttgaaaatattcatgaaagatgtattttgagttactcaaaaccataaggtaaatcaatacttagcaaagaacaagtgaaaatactttgtggctgctatgctgagagtttaaggcaattctatcataaggattgagtatgctttcttaacgcaatccagaaatcagagccaaataactatcctcagagcagtaattatataatattgccaggttaattgtcttttcaaaaaataacagtgaaatcacagtattaaaaatatatgcactactggtgtattgttttctcttctccactgcatacgtagtgtgtacaactcaacttttaccaaactgtatgtacccagtctattcctatgtcttgctcttgactgtgtcaatgatgaaatcttgtcacttgtacatctctcatttttttgcaatttataatttatcttcctgggataatgtgatttacttaaggacacttacctaattagtttatctctttttttcccaagtaaaaaggcaaatgtaattaattgtaaggtaagtctcagaatgtttgtgtttagactgacacagggaagtttgactgaggatcttctacaataactatgtcacaagtgttttaataataaaactgtgtttccctgtgagtcactctgtagaatcctatggttggaatagtggagacggaaatgtatatcttggcagcacctgatcgtaaggtagaatgactagaagaatgctgactaggctgtaaacgtcttattaatttaaataatcctctccatttttagacctcacaatgattacagcagttatactatgtcaagtaaatataaaataaaaaaccactgaagtccaaagcagcatgtcaaatattgcccttagatattttaggcctgttctgatagttatttgactaaaatataacagtatagatatgtgattaataacttctctatgagacataattaatgactgttttagtaatttaaaaatattaataaagagattcatgaaactactgggttgtttgggaaccgactttatacaatagttatatcttccttttttttttttttttttttttgggacaggaccttgctccatcgcccatgctggagtgcagtgtggcacagtcatgactcactgcagcctccaagtcctgggctcaagcagacttcttgcctcagccccctgcgtagctggactgtaggcatgcaccaccatacttggctaattaaaaaaaaaaattgcagagaggggggtctcgctgttttgcccaggatggtcttaaattcctggctttaagtgatccttgtgcctcagcctcccaaagtgttgggattacaggtgtgagccactatgcccagctgaatggttacatcttacttttttttttttttttcaattctgtagcttcagaaattcattatttctgccattaggaacaatgatctggagaattgattcacactaaccaaacataaggggctgatttataaatcatatttgatttacttatgaaaggcattgctatttttttactagaatatagttatctataagatatatgaggagagacaccatgccctttacattcattgtcatatccctagagcttagaaaattaattcttgaattacttcactaataattactcagtttagtcttaatgcctcttgatatcaagtcatttgggagattacatgagtagtcagtatggctgaaagatttgtaaatgtctccttttgaagagaatacttcataacattgtgtttggtttagtatgtaatttactaatcttttgacttttgttaataattagcatttccttacagttaaacaaactcttctaaaaatagctacataaatcttacataccaattaattagaacacgtattacataacatttttgatggcctttatatatttgtttaaattttatataagtaaattctttccagtgtgtaattaaaatgcccagtgtaatatatcaatttatcttaaatgctttaaccactttaatgttatttattttatacatatatctttattttttatgattctatgacatttcatgttattagttgaaaaataaaaattctgttttatggattcatggtgtacaacatgattttgatatatgtgtacactgttgaataaatcatatttgtcttcctggataaataacatagccatcacctcacatatttatcatttttgtggtgaaaacattttactttctcagcaattttcaagtatacaacacattattattaataatagtcaccatgttgtacaacagatcttcagaacttacttctcctaactgaggctttgtacttttgtccttgatctcccttttccacacatacctcagcctctggtaaacaccattcaactttctgcttctctgagtttgtttggctgtttaagatttccacacccatgtgagatcatgtggtatttatgttctgtgcgtgacttacttcacttagtgtaatgtcctccatgttcatccatgttgttgtaaatgacacgatttcctacttttagccacttttaaaggagaaaattgtacatgttacagtgatccaaaagcaaatcagtatgcttccattaaaactgattacaaatgtattaatgctaggcatttatatttcttttcatctttttcttgtttttacattttgcagatgtagcatttatatttctctgggatttcagaaatgtaagacaagtccattttttcactttcttaggctttaaccaaactaaacctacatgaaagccatctcttaaatgttaaaattctgagttgtcaactagatgactgtttggtctagtgattggaatttgctgtatattcagagaagcttcaaacccaccatactggccataatgttggagtttgcttttacaattaaactctacttgctatgtgctcttatgtcttttttttttttttaagttaaagcccaccttttaattttgtgtaatatgggtgtcctctcacaaaatgattttctttttaaatcccatttgcttgtgttatttaacacttttcttgttcctgctatgttaacattattaaaaccttcatgcctgtaatcccagcactttgggaggccaaagcggcagacatgaggtcagaagttcaagaccagcctggccaacatggtgaaaccccgtctctactaaaaatacaaaaaaaaaaaaaaaagtagctgggtgtggttgtgcatgcctgtaatcccagctactctggaggctgaagcaggagaattgcttaaacccagggggcagaggttgcagtgagccaagatcgcacccctgcactccagcctaggcaacagagaaagactccatctcgaaaaacaaaaacaaacaaacaaacaaaaactcatggactttcattattatttctttattatgtagggctatctagtgattttatctaccaggagatgagaaactattttttcttagttatcactctacttctacattctgctaatttatcaaatgtctgaaatgcataattgcaccctcttatatttgagatatcatcattagtgttaatcaattgctggatttctttttttacctgattcctacatgtgaccattggtgctaaacagttttttctattcctagtacagtactacttttggtactactggtttacttacagatccttggctatacagacagaaggaaatacatgactacattttataaacataagtataataagaaaaacaaaatacccatatataaactgtaaaaccaatataaattaacaattttctactcaatttgtattttttaaattagtagtacctttttatatccttcattttttcttttctagaaaaaagctaaccttcaacagtctcaaattattctatttagtcatactgattacttttttttcatgctcatattgccagagattacctagggagaagccatctaagttgctttccttatctagcttttgaaaacagccactaatttttttcttaggtgaattttgttttctcggcaacaaaatgattgtcccagaaacattgttttatgtctttcttcttttctttctttctttctttcttttccctttctctgataagtaaaggaccttgatttttattagcattatttattaatagatattagtcagcaagtatccagctgctaggactgaccaatatcagtgctagctgtcggcaaaaggactgttgctgctattggtgactgttgctgctattggtgtcttttagggagagatctggaaaagatgtttttaggtttatgaattcaccattgattattttctgtaacatatcatgttgctgcatctactgttattttattatgaagtttcaccagcttcaaagattctcctctacagtaacaagaaagttgctttgtaagcacaatatcaaaggaaggcaatttagaataagtagatttaggaagcaattcatctagaccagtggcaaatggaaccctgctagtccaagtgtcaagtgttacctgcaaaaggaaaataaaatgagaacaatgtcgtgaattttccaaatttagtttgttcactttattggtgttgctgtcttatgtgaaatgttagaatagcagtggcagagattttaatatttccctgttcaaaaaataaaatattttaaaattttatttcaaattgtgggtgaatgtattaactgtcagaattcaaaaaaggattgaacaaccaccttgaaaacatcatgtatgcctctggatctcaggaactgctggaaacaggaacaacatgacctacctatgacattttttaatttttcaagtaggcttagactggtcttgactacacaattaaatccatagcccctgtgatgacagtgttttgcatcttgcagtatgtatcaccagacagagactttttttcatttctgggatggggctttggtcaccaagtttggttaagatgtccatcttggaccgttcaccaaggagaaggagtttggctcatataagaatctggtagctccctttatagctagatggattgggtagggtggttccaattaaaaaggaggaatgctgtgaaaatctttttctagaagtttacaatgtctaagatgtcctcacttggtataataaaaaatggtagttatgtgctttgcattcatttatttcctttgttctgtccttcactgctttctaagtcttgttggttgtattggtttgccagggctgccataacaaaatactacagactgggtggcttaaacaacagaaatttgttttctcacagttctggaagctggaagtccaagatcaaggtgatggcaagtttggtttctcctgaggcctctctccttggcttgcaaatgacctatcttccctccctctgtgaattcacatggttcatcacatctctgtgtcttcatcactctctgtgtgtgctgtctgtgtcctaatctattcttataagaacaccagtcccattggagtgcccatccatatgagcttgtttaacctttattgtctctttcagggctctgtctccaaatgcagtcatattctaaggtactgggggttaggattttttataaattttggaaggatacaattaaatcccatgaattcaaaatccaagtgtaaaattatttaccccaattagaaattggataaattagtatcctttcactataaaatgtattttgactaatatattattaactaccaggttaagagtctctcatttggatagtgtgtttgataaacactcacatcagtgtcttcacaaaattctccctttaaaaagcttttccttttccacaacttcaattatgttttgttgttgttgttttaattttctgttttgcatttttagtacgacagcttatcttttgctgcctatattttctcatttttaaatgtatatagataagtagtttattcttattggactatcgctgacactgtatggaacagagcttccaataaacaagtgattttatttatagtttaagttattcattaccttcgtttggagaaagaagcacttagatttgggtatacttatcacctttcaaaccatggtatgtgcactattcatggatcccacgtgtttttaaagtttaataatgtttaatttgaattgttaaagaggtttatttaaaagccccagtgtccttacttttaaacccaaggactaaagtgttcactgtctatttgaaaatattattagctttccgtaatgaatactactttaactacaaattatgctaacattcgaattagctgaaaagtgacctgagatggcatgccaccatttagtatttaggctgtttttttgatgtctttgatgttctatttttctgtacatttgttatttcattgttagtctctaataagttcttacttttcttaatatacttatcacccatttatatatatacaaatatacaaatcaggactttattccttcttcagcaattcctgcctgtgcacttcagcacattaccatctcttctcaagacttctcagtgtagccttctagtttattttgctatttgccctcttgaaaataaaataggaaacataatctcagctctgatatattatggtataatgcaagtcaataattaattttaatcgaattaatatagattgttttcctgcccattcttcctgatgtaaaacaaataattggcaaatggtagccaaattttcacttccaagcatggtctaaattaatatttcacagttgtcacaatatacaaaatttgtttgaaaaacaattcattaaatgtgttagaagaatgttacctacatttgaaatataaatattagaaaaagtaactggagtttcatttcacagacttctatttgaaaaatgtgtatatactttttatgtgtttgcagtgagcaaattcctttttaatatcactaaagaagtttttattcaaataaacacttacctgtatttctcatatcaagaaatcatttcctgacttctaatatctttcatatctgcccatatgtacttccatttaattataagttacataaatatcattaaaaaagaaaaaaaatgaatgtgcagataattggaaaagttaagaggttttagaataagtcttggaattttttattggactgataattttaaagcccataggtgtcaaatgatttctgagactcagttaaaacttttcattctgatttggaattcatttttgcttcacggcttccacatatgagtatttcctcatttactcagtgttttggtttctaattgttggttttgatttttcttcaggatgttttgaataatttgggatcttgtgaactggatgaagatgatctaatgcttgatcttgaatttttagaggaacagagtcttcacccttctggtaagtgttaaagagatgaataatatcatacaactcctaccctggtcagtagctttcactgatagcctaaacactgttaaggctgccttctatcttttcaggcctcagtttttatagtctatatgcaaagaacatgctaggtaccatggagacataatttgggtgcgttaaatgattttaaagccttttatggaaatataaatcctgttggaagataattataaataagaaaaactataaaaaaatctttccaaaataggaaatattctagttaaataattaacaaaaagtttaatattttcttctgttttgtggaagaaagcaataattataatctcacttttcatttattttatataaccaaatggaagttttgtggatctaagatttactgctccaaatcttagccacttcctacataggttaatgttgatgcaataaggttgatctcaaaagtactaattaccagtagcagtcacaaatgcacactcataaacatatacacacacatagagttagagaggaggtaaataagtttttgttgaatgacttgagggagcctgatatatttgtaatggcttaaatttatattaaagcataaaatattatgtctccaaattccagaattactctctttaaagttggttataggaattattggtcgtccattcaaatttagatatttgacagcaaaagtaaacatttacacttaatttttttgttgctaataatgtctttaacatagtcattttcaagtggatatagcattaaactaaagctttagaacgttgggacctactgcatacatttaagaaaatcagtctcttatatggtagtgtctttatttttaattcgtggaaattagacataacctctgtagttatttttagttgtaaaactttatgatgaattttcatttatgtagtatatttggataatagataatatcatattatcaattgtcaaaagaaggcaataacaatgttgatattttcttacactctattttaggctaataccaaacaagaaactgcatttaaaattttttcggttgaataccactttatgataaaaatttcttgggacatttttcctgtagttgatttgacagatatccttctaaaaatgtagattttcacacttttatgcagatggtttttacaacttagatccaacaacttaacttctagatatctaattctatgatactggcaaaagacaaaatagtacatgcatataattattcactgcaaaatatttataatggaaaaatattggaagcacctgaaatgctcatcaataggatacttgttgaatatacaatggtttaccgaacagtcattaaaaaggaggaggacagtatccaaatctgctatggcattattgtaaggatatattatttgtttttgttttgttttgtttgaaacaaggtctggctctgttgcccaggctggagtccagtggcgtgatctcagctcaccacaacttccgcctcctgggctcaagtaaatctcccatctcagcctcccaagtagctgggactgcaaatgcatgccaccacatccaatttttgtattttagtagagacagggtttcaccatgttgcccaggctggtcttgaactcttaggctcaaaagatccacttgcctccgtctcccaaagtgcagggattacaagtttgagtcaccatggccacccgattgtaaggatgtattgttgatagagaacttttcttttcaaggatggattagatagggaataccaaaaccaaacccactgatcaattctctaacatcacaaaaagtgtaatgaatatatagtttgcccctcttgatgcaatgctgactgaagtacaacagcacaacctctgaagtgttcgtgtcctctcaccccttcctatccccgtcccagaagaaataatccattcaaatagttcaaactttgattttataggaattattggaatgggtggagggaaaatgttaaatgtcataaaaagattgtgggcaaccaaatataggatttggagattctgcaagataaatggtctggtttcttcaaaagataaatggcatgataaaataggaggagttggagttgtaggttaaaagaggcaaatgcaattgacattcttgttggtatacttatctgaaatatataaactttttctataaagttgtttctgagttaatcagagaaattagaggattgactgttactgcagaattatagttaattttattgggtgttgaaatggtattttgttttgtttagtttttttcaggaaaactttttatagagataaatgtggtggtaccaatatcgtatataggctttgctttaccaacaagtatgagtaaggaaatagatgaaacaaagtagacaaattcttaaaaattgtcaaagccgggcaagagttgcatggggtgaaaagttcatgaattaattataatattctctctattttgtatattttttgaagattttcattgtaaaaaataaaacaaagcaacaattagaaaacactacagttaacatagcagtctcaattatgtttggtagtcaaccacaatgacgagaaaataatgatttaaatatctgaagacttatttcagtgtgtttacttggggacaaaatcaacctctttaaactttagtctctcctttacgaagtaataatggtactgtgtacttcattaatttattttaaataaaaatgaaataatttttacaatgaatctcttgagtctactttaaggtgtaggttgcttagttaaagctcaaaccagggtacctgatgaatcaactgagtcatataaattgttcacaagataaatggtattagtttgcatacatgaagtgcaattctaatagataaaatattacttagagtgactttggattgtttaatgtcacttaataaactgtcttttgaaaatctatttcattttagatgccatgttgtgtggtttttaaaaagcagcaaacacgtttatatactttagctgagaaagaattatttccagttgaattggttttatacaatttattttatttattaagcaacataattaaagacctcagattaggccgggcgcggtggctcacgcctgtaatcccagcactttgggaggctgaggcgggtggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccaagatcccgccactgcactccagcctgggcgacagagcgagactccgtctcaaaaaaaaaaaaaaaaaaaaaagaaaaaagacctcagattataagaagcttatgattgataattgatattgataaaaatcacagcattaaacattcaaaaatgatgtttttaataaaagaacagcgattttcaaaagtctgaaaagtgaaataatgatatcattatattccactgcttatattactgaaaatcattaaaggggttgaaaaaatacttcttaaagacaatgcatatgaatttttggctacagagtcttattatggtagtttatagtagggcttactataatggccaagattgactttttaaaagaccacagaagacaagattaagattgcagatgggaggaaggactagcttgtagctcctgcttggatgaacagagcagggtgtggagactcacatcatgaacttttgctccaagaactaccgcaggaacataccaggaaagccaagagaatccacagacctttgaaggaattggatcaccgccacaggctccctgagatggcaaaaaactgtgagtctgcttgctttctcaatgggaggctcgtggtccggggcaagttctcagttctggtcactggctgcttggaaaatagactcagtgctgttgtgggacacgatgggagtgagataggcccttaagaccgtgggctgcatgggagtggggtgaggcatgtgactgacagctttccccagcttccctggcaaattatatgactcagcagaggcagccataatccccctgggaatataactccactggtctgggaaccacacccccattccccacaaaagtcacagcaagacccgctgcccaaggagaggctgagctcagaaatgcctatccctacccccacctggtggtctttctctaccctccctggtggcctaagacaaaggttataatctcttgggtgttctatggcccttcccacggcctgagaaacctgaatacttaaccaagtgtccctagggcaagtttgcatcctctctatagaactgcagctgatgccttcttgaaagtgttacttcctggctggaggctgaccaacacaaaaccagtgcactaaacaaaaacacaaccaaggaccatcacagagtccacttcactcccctgctacctccaccagagcaggtgctagtatccaggtctgaaagacctgaacatggatctcatcacaggactctgcaggctcagcccagaaccagcccagagcccagtagctctgctggttggctagacctggatgggcaaaaacaatcactgcagttcggctctcaggaagtcccattcctaggggaagggggagagtaccacatcaagggagcactctgtgggacaaaagaatctgaatagcagtccatgagtctcagatcttccctctgacacagtctactcaaatgagaaggaaccagagaaacaattctagtaatatgaaaaaacaatattctttaacgttcccaaaagaccataccagctcaccagcagtggatccaaaccaaaaggaaatctctgaattgccgtaaaaagaattagaaggtcgattattaagctaatgaaggaggcaccagagaaaggtgaagtccaacttaaagaaataaaaaacatgatacaggatatgaaaggaaaaatcttcaatgaaatagatagcataaataaaaaataatcacaacttctggaaatgaaggacacacagaaatgcaaaatgccctggaaagcttcagcaatagaatcaaacaagcagaagaaagaacttcagagctcaaagacaaggctttcaaattaacccaattcattaaagacaaagaaaaaataactaaaaaataaaaataaatcctccaagaagtttggcactgtgttaaatgtccaaacctgtgaataattggtgttcctggggcagaagagatatctaaaagtttggaaaacgtatttgatggaataactgaggaaaacttccccagccttgttagagacctatacatctaaattcaagaagctcaaagaacaccttggaaattcatcacaaaaacatcatgacctacgcacacagtcatcaggttacctaaagtcaagatgaatgaaataattttaagagctgtgaggcaaaagcatcagggaacttataaatgaaaacctatcagattaacagcagatttctcagcagaaaccttacaagctagaagggattgggttctatttttagccttcttaaacaaaacaattatcagacaagaattttgtttccagcaaaactaagcttcataaatgaaggaaagataaagtcttttccagacaaataaacactgaaataattcgccactaccaagccagcactacaggaactgccaaaaggagctctaaatcttgaaacaaattttcaaaatacaccaaaagagaaactccttaaagcataaatctcactgaacctatataacagtaacaaaatgaaaaaaaaaagtatgcaggcaacaaatagcatgatgaatagaatagtacctcatgtctcaatattaacattgaatgtaaatagcctaaatgctccactgaaaagagacagaatggcagaatgggtaataattcactaaacaagtttgttctgttttcaggaaactcacctaacacgtaagaattcacatgaacttaagataaaggggtggaaaaagatattccatgcaaatggacaacaaaattgagcaggagtagctattattataccagacaaagcaaactttaaagcaacagcagttaaaaaaggcaaagagggacactatataatgataagagtagtccaataggaaaatattgcagttctaaatatatatgcacctaacactggagctcccaaatttagaaaacaattacaattagacctaagaaatgagatagatggcaacacaataatggtgggggacttcaatacttcactgacagcactaggcaggtcatcaagacagaaagtcagcaaagaaacaatggacttaactataccctacaacaaatagacttaacagatatttacagaacattctacccaacaactgcagaatatatgttgtattcatcagcacatggaacgttctccaagaccataagacaggccactaaacaagtctcagtaaatttaaggaaatcgaaattatatcaaatattccttcagagcacagtggaataaaattggaaatcaactccaaaaggaatcttcaaaaccatgcaaatacatggaaattaaataacctgcttctgcatgatcattgggtgactaataatatcaagatggaacttaaaaaattatttgaactgaatgataatagtgataaaacctatcaaaacctctgggatatagtaaaagcagtgctaagaggaaagttcatagaattaaatgcctacatcaaaaattctgaaatagcacaaatgggcaatctaagctcacacctcacggaactggagaaacaagaacaaaccaaacacacacccagcagaagaaaataaataatgaaattcagagcagaactaaatgaaactgaaacaacaacaacaaaaaagacaaaagataagtgaatcaaaaagctttttcttcgaaaaaaataaataaaattgatagaccattagcgagattaacctagaaaagaagagagaaaatccaaataatctcaattagaaacaaaatgggaggcattacaactgataccacagaaatataaaagattattcaaagctaccatgaacacctttacacacataaactagtggagatggataaattcctggaaatatatgaccctcgtagattaaaccaggaggatataaaatctctgaacagaccaataataagcagcaagcttgaaatgataatttaaaaactgtcaacaaaaaaagtttaggaccagatggattcacaactgaattctatcagacattcaaagaagaattggtcccaatcctgttgacactattctgaaagatagagaaagagggaatcctccttaaatcattctatgaagccagtatcaccctgataccaaaaccagggaaagacataacaaaagaaaactacagacaaatatccctgatgaacatagatgcaaaaattctcagaaaaatactagcaaactaaatccagcatcatatcaaaaagatgatccagaggtggagccaagatggccgaataggaacagctgcagtctacagctcccagcgtgagcgacgcagaagacgggtgatttctgcatttccaactgaggtactgggttcatctcacgggggagtgctggacagtgggtgcaggacagtgggtgtggcgcaccctacatgagccgaagcagggtgaggcattacctcacctgggaagtgcaaggggtcagggaattccctttcctagtcaaagaaaggggtgacagacggcatctggaaaatcgggtcactcctaccctaatactgcacttttccaacgggcctaacaaacggcacaccaggagattatatcccgcgcatggctcagagggtcctacgtccacggagcctcactcattgctagcacagcagtctaagatcaaactgcaaggcagcagcaaggctgggggaggggcacccgccattgcccaggcttgagtagctaaacagagcggctgggaagctcgaactaggtagagtccacccagctcaaggaggcctgcctgcctctgtaggctccacctatgggggcagggcacagacaaacaaaagacagcaataacctctgcagacttaaatgtccttgtctgacagctttgaagagagtagtgattctcccagcacgcagcttgagatctgagaatgggcagactgcctcctcaagtgggtccctgacccccgagtagcctaactgggaggcatcccccagtaggggaggactgacacctcacacggccggatactcctctgagacaaaacttccagaggaacgattaagcagcagcatttgcggttcaccaatatccactgttctgcagccaccactgctgataccgaggcaaacagggtctggagtggacctccagtaaactccaacagatctgcagctgagtgtcctgactgctagaaggaaaactaaccaacagaaaggacatccacaccaacaacccatctgtacgtcaccatcatcaaagaccaaaggtagataaaaccacaaagataggggaaaaatagaacagaaaaaccagaaatctaaaaatcagagcacctctcctcctccaaaggaatgcagctcctcaccagcaacggaacaaagctggacggacaatgactttgatgagttgagagaagaaggcttcagaagatcaaactactccaagctaaaggaggaagttcgaacaaatggcaaagaagttaaaaactgaaaacaaattagatgaatggataactggaataaccaatgcagagaagtccttaaaggacctcatggagctgaaaaccacagcaggagaactacgtgatgaatgcacaagcctcagtaactgatgcgatcaactggaagaaagggtatcagtgatggaagacaaaatgaatgaaataaagtgagaagagaagtttagagaaaaaagaataaaaagaaacaaacaaagcctccaagaaatatgggactatgtgaaaagaccaaatctacatctaattggtgtacctgaaagtgacagggagaatggaaccaagttggaaaacactctgcaggatattatccaggacaacttccccaatctagcaaggcaggccaacattcaaattcaggaaatacagagaacgccacaaagataatcctcgagaagagcaactccaagaaacataattgtcagattcaccaaagtggaaatgaaggaaaaaatgttaagggcagccagagagaaaggtcgggttacccacaaagggaagcccatcagactaaaagctgatctctcggcagaaactctacaagccagaagagagtgggggccaatattcaacattcttaaagaaaagaattttcaacccagaatttaatatccagccaaactaagcttcataagtgaaggagaaataaaatcctttacatacaagcaaatgctgagagattttgtcaccaccagacctgccctaaaagtgctcctgaaggaagcactaaacatggaaaggaacaactggtaccagccactgcaaaaacatgctaaattttaaagaccatcaaggctaggaagaaactgcatcaactaaagagcaaaataagcagctaacatcataatgacaggatcaaattcacacataacaatactaaccttaaatgtaaatgggctaaatgctgcaattaaaaggcacagactagcaaatcagataaagagttaagacccatctgtgtgctgtattcaggaaacccatctcatgtgcagagacacacataggctcaaaataaagggatggaggaagatctaccaagcaaatggaaaacaaaaaaaggcaggggttgcaatcctagtctcggataaaacagactttaaaccaacaaagatcaaaagggacaaagaaggccattacataatggtaaagggatcaattcaacaagaagaggtaattatcctaaatatgcatgcacccattacaggagcacccagattcataaagcaagtacttagtgacctacaaagagacatagattcccacacaataataatgggagacattaacaccccactgtcaacattagacagatcaatgagacagaaagttagcaaggatatccagcaattgaactcagctctgcaccaagtggacctaatagtcatctgcagaactctccaccccaaatcaacagaatatacattcttttcagcaccacaccacacctattccaaaactgaccacatagttggaagtaaagcactcctcagcaaatgtaaaagaacagaaagtataacaaactgtctctccgaccacagtgcaatccaactagaactcagcactaagaaactcactcaaaaccgctcaagtacatggaaactgaacaacctgttctgaatgactactgggtacataatgaaatgaagcagaaataaagatgttctttgaaaccaacgagaacaaagacacaacatacgagcatctctgggacacattcaaagcagtgtgtagagggaaatttatagcactaaatgcccacaagagaaagcaggaaatatctaaaattgacaccctaacatcacaattaactagagaagcaagagcaaacacattcaacagctaggagaaggcaagaaataactaagatcagagaagagctgaaggaaatagagacacaaaaaacccttcaaaaaatcaatgaatccaggagctggtttttcgaaaggatcaacaaaattgatagaccactagcaagactaataaagaagcaaagagagaagaatcaaatagacacaataaaaaatgacaaagaggatatcaccactgatcccacagaaatacaaaccagcatcagagaatactataaacacctctacacaaataaactagaaaatctagaagaaatggataaattcctggacacatacacctcctaaggctaaaccaggaagaagttgaatcactgaatagaccaataataggctctgaaattgaggcaataattaatagcctaccaaccaaaaaaagtccaggaccagatggattcacagccgaattctaccagaggtacaaggaggagctggtaccattccttctgaaactattccaatcaatagaaaaagagggaatcctccctaactcattttatgaggccagcatcatcctgataccaaagcctggcagagacacaacaaaaaaagagaatttgagaccaatatccctgatgaacactgatgcaaaaatcctcaataaaatactggcaaactgaatccagcaacacatcaaaatcttatccaccacgatcacatgggcttcatccctgggatgcaaggctggttcaacatacgaaaatcaataaacgtaatccagcatataaacagaaccaaagacaaaaaccacatgattatctcaatagatgcagaaaaggcctttgacaaaattcaacaacacttcgtgctaaaaactcaataaattaggtattgatgggatgtatctcaaaataacatgagctatctatgacaaacccacagccaatatcatactgaatggacaaaaactggaagcattccctttgaaaactggcacaagacagggatgccctctctcaccactcctattcaacatagtgttggcagttctggccagggcaatcaggcaggggaaggaaatagcgggcattcaattaggaaaagaggcagtcaaattgtccctgtttgcagataacatgattgtacatctagaaaaccccattgtctcagcccaaaatctccttaagctgataagcaacttcagcaaagtctcaggatacaaaatcaatgtgcaaaaatcacaggcattcttatacaccaaaggattataaatcatgctgctataaagacacatgcacacgtatgtttattgcggcactattcacaatagcaaagactttgaaccaagccaaatgtccaacaatgatagactggattaagaaaatgtggcacatatataccatggaatactatgcagccttaagaaaggatgagttcatatcctttgtagggacatggatgaagctggaaaccatcattctcaggaaactattgcaaggacaaaaaaaccaaacaccgcatgttctcactcataggtgggaactgaacaatgagaacacatggacacaggaagaggaacctcacacactgaggactgttgtggggtggggggaggggggagggatagcatagggagatatacctaatgctacatgacgagttgatgggtgcagcacaccaacatggcacaggtatacatatgtaacaaacttacacgttgtgcatgtgtaccctaaaacttaaagtataataataataaaaaaaagaattttgaatgttaaaaaaagatgctgaatcataaatataaacatcaaaaaaaaaaaaaccaaaaagataatccatgatgatcaagtggttttcatacgagggatgcagggatggtttaacagatgtaagtcaataaaagtgacacacaagcaaaacagaattaaaaacacatatcacatgatcatctcaatagaattagaaaaagcctttgacaaaatccagcattgctttatgattaaaatcgtcagcaaaatcggcatagaagggacataccttaaggtaataaaagccatctatgacagacccacagacaacatcatactgaatggggaaaagttgaaagcattctccctgagaactggaacaagacaaagatgctcacttttactactactattcaacatggtactggaagtcctagccagagccatcagacaagagaaagaaataaagagcatccaaatcagtaaagaggaagtcaagctgtcagaaataaagagcatccaaatcagtaaagaggaagtcaagctgtcactgtttgctgaagacatgatcatatacctagaaaaccctaaagactcattcaaaaacctcctggtaaatgaatttagcaaagtttcaggataccaaattaatgtacacaaatcagtagcccttctatacaccaacagttaccaacctgagaatcaaatgaagaacacaacccctttcacaatagctgcaaaaacataaagtaaaatacttaggaatatacctaaccaaggacatgaaagacctctacaaggtaaactacaaacagtgctgaaagaaattatcagtgacacaaacaaatggaaacacatcctatgctcgtggatgggtagaaccattatcgtgaaaaaaaccatactgctataagcaatctacaaattcagtgcaattcccttcaaaacactaccattattctttgcagaactagaaagaaaaaaccctaaaattcatatggaaccataaaagagctcacatagccaaagcaagactaagcaaacaaatctggaggcacattacccaacttcaaattataaggccatagtcaccaaaacagcatggtactggtataaaaatgatacggggtgtgaatgtttagtttttgctgattgtattgaataatttgaatagtttcataaatccttgtaataaagagtcctaaattaatatatgttcctccctcacgcctgtaatcccagcactttgggaggccaaggcgggcagatcacgaggtcaggagatcaagaccacggtgaaaccccgtctccactaaaaatacaaaaaaaaaaaattagccgcgcgtagtggcgggcgcctgtagttccagctactcgggaggctgaggcaggagaatggcgtgaacccgggaggtggagcttgcagtgagccaagattgcgccactgcaccccagcctgggtgacagagcgagacaccgtctcaaaaaaaaaaaaaaaaaaaaaaaaaaaaaaaaaatatatatatatatatatatatatatatatcttcttcctaaaaggagcagtagtacaaataatgatagaaataaaatatgttttatagtgcagtaagtggatattattatttttatgaaagccaggaagaacaatttcaatgaaagaatggtatatgaattcaaagtgagttcctaaaaggagatagccttgagaggaaaaaaatttaaaaataaaattaaaaatttcaataatttaccatgatcttggcattatctaattttattgttttaaattctaatataaaggctaaggttttcaatttaaaaggttttagatttaaaggatttttttattatattttcttgagtttctgaaaaatgttttctggaaaccattttttgtgaaataatacacattatgtttcaaacacaggattataagttttttactaccagacatttctattttcttgtggtaaaatattacatttattgtttctcctttaaataaataatttataaagcatatatgatcaagcacagggattttatgttagaaaatatgagatgctagcatttatactttgataaactaaaaagtatattagtgacccttcacactttttatctgtcctcactttcttattcatgtttgtatagtattgtttttgtcacaaattgagtcatgcaatatgttagcagcgaggttcgttagataaacctcagcatatttttttaaaaaggggttttaatgatatttactagcatttaatatttcaaagacttgaccttgaaatattcaaggtcaatatttcaaataagttcccttgaagttttcttcacagtgaagtatatgttatgaactatacaatttgtctaaggaaaaataccagcaatacatttttgtttgtttttctttatgtagtttcacatttgttttgaggatatttttctattcacttatgcatcttgcaaaatatttataacacagataaaataataatcatttaaggaaaacaaagtaaccaggatatgaaaaaaaataagatgaggctatggataaggttaaggcacaaaaagtttactagtgttatgacggtgaattgaaaatgttattttgagtgtcctattagcatgtatgaagaaagaaaatcagttgaaaaatcaaaatatatatcatcaatcattcaatcagtgaatgtattttcttaaataaaataattcttgttcctaagaactgaaatgtattttgctcacatgtcttcataaggtgcacatgatttgaatcgggaataatttgcttagcaacccccttcagtacaagctgagacatcatgctgccagttcagtattaacagttctaaacggtgccacgtcagtgtggcaaaagcttggagccttataaggaacgtacttaattcaaaataaaatcgattaactttttttatactttgtattcctcaaataatttcaatatggaaattaggtaaagtaaatattgtcaagaattttagtcagacagaaagtaattaccataaagcttaataaaatatcagatattaagcaatgttatttcctgatgaatcctctgaaatgagctgttgatgaaagataaccactgggtaacaaataagacaattttgcaaatggctgttatcaaataactggttaaatattaagcaatgcatattctaaataagaatttgggtttgtgttttggaatacttaatctttagctatttaatccatggtaaactaaaacaaggtcctgtttctatttcggctactcataggattatcttcgtagtggcagaagctgatgggaaatatgcacctgggtaatgagagtgatgcatcataattaaatgaattaaagttaaaagagggctaaaacacattttagtgttacccatttggagtatattacttacaatactgtttctttaattcttaccctgacttctgtgttagtactggggtaggttgtacataatcattggcaatttatagctggagatctcagttgatgggagtagaactagcagtggcttcagggtagggaaatggagagatgatcaaaagatacaaactttcagttgtaagatgagcacattctgaggatctaatatacagcatgaatggtgagggatgtgttaattaatttgtggctatcactgcacaatatgtacgtatatcaaatcattaccttttttttaccttgactatattcaatcttatttatcaattaaatattttaaaattcataaagttaaaaataggttgatggaaaggaaaattgaatgcctataatgagccagtctctttttgtaaaccctctcaacttaatcctcacaataactctgagagaaaattgcaccttaatgattcattcaaaataaagaaactacaaattaatatcaaaagagagcaggcattttaaagataggcatatccaagttagaattccagctctgcccacagttgctttcaacaaatgatatttctgagctcagtttcctcatttgtaaaatgacaataattatgtctgtctcaaaatataatcctatctaaatgagtgacatgcaaagttctattctcagttgcccaaaatagggtaagagcccagtacaagttggttaccattcttgaaattttagacagttttaattccttgttaaagacgttgtcccattattggttattttttgtagaccctagtttcttaatgttttatcattattataaattattttaaaatgtgctttctgatttaaatgttattatctaaattttatgtaacattttaagtgataatttactagtactaaatattcaaaaatcaaataggacactttgcttataataggtggtatatttctttgtgttaaaaccagtgcatttaccataaaaaagaatgagttcatgttctttgcagggacatggatgaagctgaaaaccattattcttagcaaacttaacacaggaacagaaaaccaaacaccacatgttctcacttataagtgggagctgaacaatgagaacacgtggacacacgcaggggaacatcacacaccagggcctgtcagtgggttgggggcaagaggagggagagaattaggacaaatacctaatgcattcagggcttaaaacctagatgacgggttgataggtgcagcaaaccaccatggcacatgtgtgcctatgtaacaaacctgcaccttctgcacatgtatccctgaacttaaagtataataaatataaaaaaaatttaaaaaaaccaatgcatttaaatgcatgaactttttttctggttgttagtcaaatgtccaaattgccatagcatatttaaaatagaaatttatttgaaaaagaataaatttctattttaaataccttaaaaattattaaccattaatattaaccattaatcattaatactcaaagagaaattatggctgttactttgtattaaggttgatatttacaatttgcagaagagtttttaaattaaattaaaaatatatcttacttatttaatgtttttggataaaaagaatgtaatggtcatttggatgatagaatgaagatattttatgttgttttggttatttatttagtatattagatctgaaaacacctagggcagtgtctcttggtatatatccaaaggaaaatggggaagtaatggcccaatgatatcaatgaggaattaattgcgtagttgctaaattattttgagtttgatgaacaagcaatataaaaattctgcagtgagttaggaactcctcctgtgcctattaattagggagataatttttgttattaatttttaatgaataatagtacagcagagcagagatgaaaccctagtggttttcctaatacgaatggtaatgtacagagaattgcaacaacattcacacagggaaaattatagaaatcaactataaatttctacaagctctgatgtgtcttggtcagaaaaagtgtgtctaaagtatttttaatctgattatataaaactaagaaacatacagcacttaatttttgaagtataacataatggttaaaaatatggatgctggctctggaattagacaaatctcaaccaccagccaggctatgtaaacttgagcaagttatttaatcttttgcagcttttcttcttcatctgaaaatgggcgcgatgatgtatctacctcataaatttgatggagaaacaataagttaaagctttgtagaatatgcaatctcatgtccagcatatatatttttaagaactactgctaataccattttaaaaatatgcatgtaaaatgtgatatacctgtatgtaggccaatcagcatctgattctgacagatttagtgatctttccagtctctattagtggaaaatcttaacatttttaaatatagaatttctcaaattttaagtatagaatgccacagcacatgcaactaatttttatcatttatttctaagcttataaaattatagcactaaataaaataatgggataataaataatatttattgagtctaggtgccaatttatgaggtaaataacatcactttctcatttgagaaagttggagctttgagtgataaagcattataggaataaatatcccagctagactcaaacatggtatttctgactctgaggctctgtaattagccattttgattctgttgactaataaaattaattcatgtaaaatgttaaaatcacatgttcactgaagcatttgttttaaactgaccttctgttctaatagctttttaagttatgggcatcacttaatatatatttgtctttgacttcacctaagaagttggaattaactatgtttatttattgaagcatatacattgtgctgaccactggcctgggcactttgttgtttcaggttttgctttagttttaagctataatttctaagcattttggattatctaatttaatcctcacagcaattctcagaaagtgttatcattctctcttcatagatgaaggaagagaaacccagaagagcactgttatttgtgcatgattacagagctattcttgggtttcaattatgcctatgtggctttgatacccacttactgtttccactataaaagctctcaatgatgtttagttactagaaggagcagttataatagcgtttccaaattttctattacactacaattttgataacactttagtgaggatgaaattgtgatctcagttgtcactttgtgtgtttcatcagcagatcctattactctgtatttctacttcaaaagggatacaatacctgttatctgcttggttgccattagatggcaatcttgttcttctaacgatgatagtaatcctgtcatacatttgtattcagctttatagtttacaagctatttcaaatatgttatctcatcaaattatcacagtaacactctgaaatagatgttaatatacatcaagtacagtggagggagcaaatactctggttaaagaacttattcagccagtattaacctagatcttaacattaaatggcagtttcttttaactgtttttctagaccttgatgcttctaattttatgtacagttctaatatacttggttatatgttttccaaggcactgaaaatcataataacatcttagaagaggagagagaagaggagagagaagcagcagggaatgaagtattgctgtattacaatgtggcacaccattactttttaaaaactattattgtagttcttaatcatcaagaaaaaatacattctgcattattctgagatggagagctgtataattcactttggaaatatatctaaactcttatttattctttaatttattgaatgaaaataaaccctcagttcttcatatgctttaactatccaggaagtgtcattttataatgattccccatggcaaaaatgtgaatataccttaaactttttatatgttttttatgtttttccccatattctttccccaggttcttgcaaaagactacttagatataaggatagctgtgcgaaaggctttcctaattgtcgtacttgaaaaagcagtaatttatagtctactaattgagtatggggaccatgatattccttaaacacaagactatataattatcgataatacatttttagtgtagatatttcaaaatttaatattttttattagctgtttttgctcgaccaatttacaaattgaccaattgattaattcattagtttgatacattcttttacactcccattaaaaaatattgaacttattaattaaaatagtaacattcacctgggtgcactcttttcatactctgtgttaaatgatgtacttaagtgacagaataatgttctaactgggagagaattttagaagtagaagctcctcctacttcttctcctatgaatattaatagttttaaatgttttgttcagggtcacatagtttgcttgtaataaagagatgactcttaagtaagaaattgactagctccatgtagtaagatggcaattatttgatttttatggtagttgccaacagactaaatcatttgcatttcctgatttaaaagtgcttctgcctatctattttgcctttcagactttgctatatttttaagaggattgcttcagtgacaaagaaggcttttagatggaacagttttctaaatccaatcaacagtagctgaaaaatgtttatacatcctgacctaatttagtattaaataacaacaattttaatgaagtcatagtatttacttgtaacctgctattgtagcatttcctactgacataaactctcttctgctgcacaaaagggcagtcaatggcccaagttcattagaggatacagtcaaaagaaaagatgtatttcattcggcatggtttttctggtgcaattagaaaagaaaatatgtgtctcaatataaaatttcatggcctcttacaattatgtggtgacatctccatacaattgcttgaataatgccaggaacatcagctgtcactatcaaaatgaacaagtaattaagaaagcaaacgctggtctttcttctaaaggaatagaatatttatgtatttaaagttgttcaccaacaagaaaaataaccactgacatgaaacataatttcctatcgtgcctgaggcagaaaagagaaataataatgaagattcacacaattacaacaaattaggttgcaattgtgcatactaaaaacaattatagactttctattcatcaggtcatatgatagcatcttatctcttttatttattttctgatactctatcttattaatcacattttctaaaagcttatgatggaattgggaaactcttactcttatcaagaccacattttctgtacccttacatcataacgtgctagcataacctaaagtaggctaagccttgtctggatagtagaatgatagtagatctgattgaagccataatagtgttaaatgctggctcttcaaccttttgataagacagtgttcagtttattgtttactgaggtaagggaaaaacgctaccttgactgaattctggtagttttctgtagaggaaagtacaagataggatttactgagagtatgaatgtggtttaaggcagatgtttcaattgaagggtttgtttgaattggataaaaataatgatttttttatccttatatctatgtagtcttttgcaagaacctggggaaagaatatggggaaaaacataaaaagcatataaaaagtttagagttgtaggattggcggaaacagtgaggggaggattttaacatgaagaatttaatgactcttaggggttgaactctctgttgatgctttttattgaaaaattggtgggtctttggggacagtcagtggtgtaaaatgttttggaattgttagggtacaccaaaaagacaataaaataggaaagtgatgttaaagtagacagtctgctgtttgtgggttggtggttttgggcctcagtctccctactgagggagggagaaggatagaacatttttaactaaaggcataatcaatccagattttcactaatgtttgaggtgttacaatcacatatcagatttctagggctcattatctcaaatgtccatgaaagtcagttttttcctcttgaatgacctttttctttgttggagaacttgacagggcagcagatgtgcaaagtcatttaagactctggaaatcacatctctgaacacaacaacacaaatagaaggattattatcagggtttgtgtccactccttggccagtggccaagagtgctcaattcaacaacggaataaatttcatccctattctgaagagcccatagaaccagacacatgatcctccagcactttgggaggctaggctggaaaattgcttgagcctaggagttcaagactagcctagacaatatagagagaccctcatctttacaaaacataaaagaaattatccaagcatggtggcatgcacctgtagtcccagccagttgggaggctggggtgggaggatcgcttacacccaggaagttgaggctgctgtgagtcatgattgcaccactgcactccagcctgggcaacagagtgagtctctctctctctctctttctataagatcaatgtcaagtcatagagaccctgtttcgaaaacagaaaaaaaaacaccaaacgaacaaacaaaaaaacaccagatatgggattcttaaccaaattacctaattttctgctatgtttatttttaggcaggcgactttgggtaacattacagaagcatcttcaggctgtgtctcaaatggatattcgggataaggtttagatggaaagaaatctctcatgaactaaaatattttcaaactttgtcccaagtgcagtacactctcaacagcctcaaaatgacagggtaaacaggagcattactgagagatggattaaatcagcttatcgttgtaaattcttccatattcgataatgatgacttgggaagtctcttttgttttctccttgtgagattttgtctacttattgaacatcagtatatgcactgaaagatctagtttttttcacatatcttggcatcaatagtaacttgggcctgctcccatatgtagagcattcatagatcagaaaataattaaaatatatattatttggtgtaaataatgataaaaatattgaatgaaaatggaaataaaaattatcaattttaccaggtggttctttttatttatttatttatatttatttattttgagatggagtcttgctctattgccaggctagagtgcagtggcgtcatctcggctcactgcaaccttcacctcctgggttcaaacgattcccctgcctcagcctcctgagtagctgggactacaggcgcgtgccaccatgcccgaataattttttgtagtttagtagagacagggtttcaccatgttggccaggatggtctcaatctcctgatgtcgtgatctgcctgccttggcctcccaaagtgcggggaatacaggtgtgagccaccgcttctggctccaccaggtgattcattttctttttttattaacctccgcctcctgagtttaagtgattcttctgcctcagccccctgagtagctgggattacaggcaagagccactatgcccggctaacttgtttgtatttttagtagagacgggattttaccatgttgcccaggctggtcttgaactcctaacctcaggtgatccgcctgcatcggcttcccaaagtgctgggattacaggcgtgagccactgcaccaggcctaggtggttcttttttaataacacattttaatgaatgaaatattgggctgggcgtggtggctcacgcctgtaatcccagcactttgggaggtcaaggtgggcggatcaccgggtcaggagatcgaaaccatggtgaaaccttgtctctactaaaaatacaaaaaattagctgggcacagtggcgggcgcctgtagtaccagctactcgggaggctgaggcaggagaatggcgtgaacccgggaggctgaggttgcagtgagcagagattgcgccactgcgctccagcctgggtgacagagcaagtctctgtctcaaaaaaaaaaaaaagaaaaattcacagtattttattttttacatctatgatattgatgtgttaataaggtgttttagcattgattagcaacttttttttctttaaagaggtacataaaatgtgcgtcttgcaagtaatgctgtcttagttccaaaaatatattttagataagaaatacaggaatctgaaaaatccataggggtgatttattaattcatgtatcattgccttcagatcttgtccatataaagaattgtgaacagcctccatttctcattatacatccttaatagaatcatgtttgcttttttgttttattttcaaaggtaaaatatgtatcatcctcagtataccgctaactataatactcatatttctttacatgcatacatgaattatatggcaaactttattgttttatgcctatagatgcatttatatatgtagattttgtccaatccctacttactatgatcttcactattctcacatataagatactacacttgagagaagctttgattactaagaattacattactcatagtctacatttttatacccctgtgaaactagaagaagccagcttcaaccatcccttagaatgattgtctccaaagtctacttccagttcagtcctctttcctgatgtgcacatacatgtatttcatggcctgctagcaattttatcggatgtcaattatatgcatcagatttaacagatccaagattaactttattcttcctgcccataactttgtttttgcttcatatttatttcctcttttgtgaatagcaccaacatcagtgctgacttcaaaatttgaaaccaggtgtcactagttttaacggattctactttttacctgttcttaattctcacatttctttttataatttttgttttagtctttattcaggccatcgttttcctctaactaactttatgtgatccagttggtcttttacggcccttggtctggcatcagtgtccattagtgccatctttgttgttttttgttttgttttgtttcttcctctcattcttcatacagaactcagagcccctctcagattttatcttttaacccactctataaaaactttctatcatataaacactttcatgattagtatttatttcattttagattttggagtgatagggaggaatcacctggtgcaggtaagagcacagcagttgaaaatgcatgaaggagagagagagagagagaggaagagagagacagagagtattcaagagtttcattttgttatctcttctggactttactcagtttcttccttgtagccatgttcttttccaaattttgagcactttgaattcttgcttttcttaattcaagcaatgtacatctatagtcaactttcagagctaagtgtagactgactcaatgagcccaaaggcacagtctccgccatcaaaaatagcttagcagagaattttctcaacaaaagcaggtctttcccaaatggattttcataacagctgccagagtaataatctagcctctatctccagtttgacctcttatcatccattctctgtattgtccacaaggtgtgctgacccaccaaactgatcttgatcattaacctatttaaaagtcaatattacccattactttcattataaaatctgattttgttggcagagcttacaaagttctcaagcttcaacaccaccactttttctacacactaaacttgacttccagcaaatatttattgaagatttactgtaggccctaggattctagtaacaaataaagctgtgcagcatacagtctaatggaagattctattttttttaaaaaaaaaacgttaatgaagaaaagagcagtatgcaggacatagcagttttggtggtaagaaaagacatcctagagaagtgacgtttttccatgaaggataagtgggtattgataaagtggcatggtgccagagatggtttagaaacttggaactcttcgtggaaagtgcgatacatggtaggacttcacagaggcccaacattccttggcagagtagggagtcagtggcatcagatgaatgacgaatgcagcacattctttctcatctataaaatatttcaagtgctgatttcttaccctgaaatgatctctcttcatttacagttatatcactattcaactaacaaaatagagctgatactcattgatttatttgaagtattaatatttgtccatgaggaagaaagtataatactaggcaatgatgatcagggctaaaataatgtattatattcaggggaaagagatatttctgtgggccgcattaggtgggataggccttagaaggggttgtacttgaactatagtttaataaattgcaatagaggttgggggagtggtgacatattttatgagcaggaatcaatatagggaaaagactgaaggaaaaattccccaagtgtagctgaaaaacaatagaaggtggtaccaacctttaaaagccgagatttcttaggaatcatgtataaaaatttaaatttcataattctttgtctgttttttcttaaatagaaacaaaatacagctttgtttataacttgtgatatgaaataaaatactgagtatgtaaatatttgaataattaaagagtttgttcttcacaattatatgactctattctctatatcagtaaaagccatcatcaagttattaaacagaagtgatagctctatgaattgggagctggcaatatgcttttctaaataatgctctactttatttctactagaataggcttcaagttgttctgaaccattttctcaatgaaaatactgaacaaaacttctagatgattcttctaaaaagtctttaaaaatgtgtgtttataggataagaaaatgatatatctgcaggaaatgaaaataaatgttaaataggaatccttaaaagtaaatacttatcaaagacagcttcctttctaaccagatagtagccaatttataaacgtttagagacaattttgtgtgtctaatagccaaaactgtattcatgtgtttttccctagtggaaactaatatagatagttttcctagctcagtcacttagttcttccaggaatttttggtttgatttgtaactaacattggagaattcggacaaaaattattaaattatgttaaaaaataatagtttaggaaaagaagagacattagatatatttcttgtcttacactctttatatgaggaaattaaaatcatgttactgatggtacatcactaagtaccatctaactggcaaataacagaatataaaatggaaggatttgaaggaatcttttgtttatatgtttttaaaaaattaataaatattataaatataaaaattagtaaaagctttgttaagtgattatgactaaaagtaatatactacaaggcccttctatggcactgtttaagaaatttgtcattcactatctaattgttgttgtcaaaagctatagtgattattttcatgaaacatcatggaacaatcagtggaaagaagagtacagttttaatgtagttttatgcaagcgtatttctttagcacctctatgatctttagagaatatgcacatgatcaaatgtagatctaaaattccacgtgtattttaaattttattttaattatattcagtaatatatatttatatgtgctaattttgaacttaaaggcatgatgaaatttttattctagaataaagcaaaactatactcttaatgattagaatgcaatgttattcagccctattttgtaatctagcttttattatagccatcaggaacagaaactcatttctgtaagcagcatacctatggttttgttatattagctggatcttttattattgatgggtcctgcttgacacattttgtagataatatgcccataggttctgaatcaaacaagtgttatagattgatgtgctaatctaagttttatcttttctttttctattttcagtagtcctcaggaaaccaatatatctgctaaaagtataaaagctttagcctattatgaaaaatgcagatttgttttattatgcagaattttaaagctgaatctgtcctttttattttcctccttctacattaccatctttccctgacctttctctttttccctctccaacaacatcaacaaaaagaaagaaagaaagaaatactttgatgcatttaataagtaacagaattctgtaggaaaatacatacagttagaccttgaactactcagggttgccaaacccccatgcagctagaaatccatgtataacttctgactcccccaaaacttaactcttaatagcctgttgttgattggaagattaatgataacatgaacagtcaactaacatgtatttggtatgttaagtgtattatatgctgtattcttataataaagtaggatagagaaaataaaatgttaaagacaattaaaaggaagataaaatgtatttaatattcattaagtagaagtggatcatcataaaagtctttgttctttcatctccatattcagtaggccaaggaggagaaggaagagaagggattgttcttgctgtcttattgggtgcaagaaatttctcttataagtgaaaccacgcagctgaaacccctgttgttccagagtgaactgtatttatttttgataaagtaaaatattaagtaaacattatgaacatcagaatgtctaaattggcaagattatcaaaaacaaggaaagtctgagaaactgtcacagccaagaggagcctaaggagatatgacaactgaatataatgtggtatactggctgacatcctggaatagcagagggatattaggtaaaaactttggaagtctgaacaaaatatgacctttagttaataataatgtgtcagtatttttgttctttgaaacaaatgtatcacactattgcaagatgttaatatggtaacatttgtgtatttgtgtgtgttggggggtattatataggaaccgtcagtactatcagctcgcttattttgtaaattcaaagtagttttaaaaaaataaagtctattaatgtaaagaaaataataatgcttaaaaattatttgcttagtgttcactttcaaaattagggtcaaatgtgaagtattgatgaaaaaaagatgtagccacattgccattgtagaagtcctcacattattgtaacgacacagagccattggttatataaaaagctgtttggatggcacagtctgttggcaatccatcagaagatagtcatttgaattagtaaactatctgcacatgtgaaatttgaggaatttccgcatgtaatgtttataagcatgcataatatgaaatttaaaggattaagggtgtaagtctttacaattcaggaaaacctactattatagcttatttattttatttccaagcattatagaacaatataggaaaagagtttgtgatagcaactggcatttgaaaaatattgtcagaaaactgtaaattgttacaaactgaacttggtgacagtgttacggacaagaattagttgagactatattttaagtgacataagcagacaaagacttatagttcagaaaatatagagtggacaattattctgaccataaaaatcaacaatatatcatgttgataaagattatgtggcttgtcaaaatttaagtaacaagattttccttagtctggtaaatgtataatttgaatggtttgtatattcgttttccattttcaattgtttagttagagtgaaggtagtagagattgggataaataaatttcatcattttaaaaattttgtttcatatttcacataatttcagcagacactatgtgttgaggaaagatctttactaagtctcacatataattcttaaaatgaaacaaacctgatgttcgtagaatatacaggtagactttaagtccgctcaaaaatctaactctactctccagtgaagtaaatgaacaaacagaggaagaaatacctagtacactctcaaagaggctttcaattgcattttcttctttgtataaattgatgacattacagttacaatttgtacttattttatccaataactgaatttttgataagttatgcaagtgaatatttatgtatcatgttatagctaacatttgaatttctatttcagatttattctcactaaggaataacatctttccaactacactaaaaagtgaaatgtaaaaagagggcaaaactcactgtgacaatgtcaaaattcattttcaaggagatttcagtctttgtaaatgtggagtcagtatgcattgaaatttccaatacaagctctgagtgaaattcattaaaagggaaatcaatccatattgtcttagtactctttaaagcatatgtaaaataaaatatattgcatagcgaattctaattttattgacacttcttactgcctctcagggatttaaatgtttaaatattttagcagccacactggttaatgtttcaggaatgtcagtgcttcaaaagtataacaaaactttactgctgtgaaaaccatacagcaaactttttttcaagttttttttctaataggaaaatatgtgggttctgctagtaaataatctcacttttgtaaaagaaaagatagaaaaaagttgacaacagattgcaagtagaaataacaaaataggactaatgaaatttgttttaattttagggaattatatttatggactgttaactatctttctgtaatgctggcttaaaaaggcatatgctcaaattttaataatttaaatttttagtaggggagtgattggtgatgtttggtgtaacatttttaaaatgaagaacagaaccctttgagctaatttttctcatgctgaacacaaattttttaaaaggtaaatggatggcctgtttttagtttcacaggagcctggttttgttaaggtgattgaaagattcatgtttcattttagatcctcacttggcccaaaggaagtaatgtttgttaatataagttaatatggctctatctttatttagacagatataatggaggaatgttaatttaaaggtggagacaaagagcactgtcattacaacatagaaacacagatctcctaacagctcagtatggagaaaagttagcctttacttgaaatctcagctgttagtgaagttaaagttatattgtgttgtctagctctgtagaggaattagtatggctagaaagagtgtgtaaaataaagccacatgattcatctttagaataccttttataaatccaggaaaattccacaaatgcctgccttttataagaatagtacaccagagagtcttagtgtggggaaagtctcctgttactgatagttcaagaaataataaagtaatgaagtcctatgtcagcttcctactcactgtttcttacgatgcttattgttttaaaacccagcaattttacaactaaatggagataaaatttagaaatctttctgtagctaggagagtgtgtaagaaataaaatagtattgacttgttgctttttattagtgtagccctaacgttcactcagtatttgtatatcttccaacttaatttcatgtagcattgttgggttaggggatgcccctgtatcagcacttatcctctagttgaaataaagagcatatgctctttaaagagtaactttaataaatcggtagtgaatgtttatggctgacaaatgaccattcccacctcctcaaatttgcatttgtcatcagtccttccactagccttggacagctgaatacagttgttctcccatttggtcctctgtccatggacactaatgctggcaaactctggatttcttggaatatgtcactggtcattggtgactctgctgcacggcagtccaccttctttaatttttaaccccctagatctccccatgggtctagaaatcttgggtagtgccagagaataaatgtgttctggcacatagtcctgaaaaatactgttttgaaaggatcaataaataaaatttgagttattacatgatagagtcattatgcaaagtcttagtaactataaccttaaaaataatgacataatacttatggtagtaatcttcttatttcataaaataaagtcttaatcagaggcagttgtcaaaaaaatttgctatttgttgttcaaaaaaatgagagatgggcttagcttttgctgtgcagtcacctgcatgtatggttttctgtctgggataaatgaatcaggctcttatgtcagccacaactctttgtgaactccagttctgacactaactttgtgaacataactagttacttaacgacattgtaatgttttttcttttcagtacaatgttcataacacatgcctgaatcataaaatatttcttcttttcttcttcctccaccttcttgttcttcttccccttgctccctcccttcttccttccttccttccttctttcctctctctctctctttctttctttctttctctctttctttattttcttttcttctgtttggagactgggtgttactgtgttgcccaggctggcctgaaaatcccacaatcaatcaatcctccccactcagtctccccagtagctgagactatgggtatgtgtcaccctgctgggcttaaataataagacagttctaagcattattttcaacaatgaacattaaaaaccaagacattcagcattgagtaaatactagttgttactccttcctcgaattcttaatttgatttctggggaagtatattcttctgtttttctgccttcctcaaaatctccctacctaggtacctcccatctccacgtttggtatgttttaaagctcagttcttagactttcttcctactttgcttatacctacaactttgatagtttcatcaaatctcctagctttaagtggtggtaaatcacaaagcctctaagtttctatctttatcccataaatttcccctgcactgcagacatatatgtatattaactatctacttgagatcttcacatggatgtttacgaggcctctgaaacatgtcccaaaccaaactcctgatttttgtgcattagcgccccacattttgctctttccattataattaatctcaacaactattaagtctattctttcagttgctaagtgttcgggccacccttgactcctcctttttaagttttacatgttctaatatcttgataaattctacaggctcttgtaatagggataaaattgctcattattgactaatctaccaaggggattgaatgacaattattaatttcttagacctatagttcttaaagtatggtcaagggactcttaagagtccccaagaccatttctaggaattcatgatgtcaaaactattttcataatgataccaagatattaaaaaccctaatgtttccttgtctttagcatgataatgacagcagtaccatcaaatcttagcatagtgactcacaccgagtatacattaaaatgtggactacacagcaagttaggtagcctgatttacaaagtcaggctctttactataatgctatagtctatcaaaaaataaaatatagcaatttatttaaaaatctgcttaatgtggaacctttgatggttttctatcttttcttctaataatatcataatttaaatcttttgcataaaattgcaccctaatttcttaggacagcacatataatggtatttttgaatgaatggatgttcataattttgatttcctggagatatatatatatatatatgcaaattgtaagacaagaggtttaaataaaattataggccaatagctgcatatgacaggaactattttaccatattctctttaggattgttatcatctttaagtttttaatatttttatagtttaaaagattatatattattcgaagttacaactttttccccacaattatggttgaaggttttttgtttctctttgtcagttttctcttttgaattttatttgtcttttatatctgtcatattgtccttaacagaattctagtttatccctagtgataacagattatgcatgagctttttcatttatttctcttcatatccattttttccttttaagttaagcaaaaataatttttgatattttattttcagatgaaaaatgtattgtaaatggttagataagaaaatagaacaatttactagtagcccctcatatttaaataattctaccctgccctgttttaaaatggcaagctgaatttttaacccttttctacctgtatgtattcttagacatagggaaatgtggccatcattttttccaggcttatagcctcacatggtggtaaaatttattgggagccacaacaattactaaaacccagcagaactgaagaacttcaaaaatataacatttgactttagttttaaatgataagaagcagtttgttgagctgagaaggaaatgaagcaccatattaaaggcagagagaacagcttgggtaaaaagcagaaacataaaagaccagagggtatttgggatacagcaagcagtttggtgtgatgagaaaggaagatgggagatgagcctgtgaagctagtggtggctgatttgaggaaccttgcattcaatactagagagtttttgctttatcttattagtagttggggatttggtaaagattttctatgtagggacagactatgatcaaacttgtagtttgaaggcattcataaaattttagcagcgtttagattattttacttgttaaatccttttccccacttcttttcgtcttgtcattttcatatcggacaacaatgtggttggtattggcctctgcgtgaatgtaaatggtacctagggagcctccagccatgtcaggatcatgagctttctcactgcttcttcttctttgttttgattttgttcttttaatacaagcaaaagtaatttttgacctttgattttaatatgataacacattaaaaacaagcaaatagtacagtttcctcagctttactaactcagatttcattactataaaaagacaaggaaaataataaatatatatgcgtgaagaataggaagaaagctaaatgtattaatgtttttgtcagaaaattttctgcagactttttaaagcttctgtttattgaataatagcttaaataaagatgttaaaaatatttgtaaatatttcatattgatattgggccattcaattcaaaattaatttacttcttagtaaaataaaaataaaagaaacagaagccctgtttctcctagagagggatctcatctcttaaaatatagatcctatgattatcatgtactgaggaagaaactaaatgaattaactccaatattgtgctccttctattgataaattctgtggaatgtttatctcttgagtaaaagaataatagagtaatagcattataatattctcgtaacttaccactaggctagtaaaaattattcctttggccttaattaagtttgaatctctgtaagaggttgggagacatttagtgatggcaaattaacagtgttttacttgtgctgatttatgtataccattaatgtggcagtattttaatttaactgttcttcacctaagctgtgtaatacatgactgcctcaggtaatgatacgtaaaatttcaatgagtattaaggtttattccagggcagcagataatagagactagtatgtttgaagtatttcttgttggtgaatacttcaaaaaaatcttagattttttttttcaatctatatatgttagatattaaattgtttatggactataaaccaatcaaacacaagggctattttaatttttaccttgcttaattttaactgctttatttcatttaaatggcgtataatgttcccaacttgtttaagtcaaaatgcaaaaatgttaatattcatgatattataaattactagaaaattatgtttcacttacatataagatagcttgacacagataaaaattaaacttgaattaaagcacataacagaaaaaataatagcaatctttacaaattagggttgtgtttttacttaggtatactagcataatcagttatatttaagtgagagatcatgtcttgattaatggtgttattaatcatgaataagcaaatatgtctttttctggaacttaatttgggttgtcttttaagaaaatctaacaaacaaaattctaaataaaatttagatgcttataaatttgttgtgtgaactttcagcagaaaactaagttcaactcaaaatagaaaacagaactgtacacagcttagcagtgatgtaaatattgtgaatgcaaggtgcaaggcacatttgaaaataccgcttgtatttcaaacctcaaagcagagcaataataaaagcttacagctagaaggaaattaaaaatcatctaaattttagttttcagtgtattaagtgaagaaattgagacttaaagttatataagcagttaaactcagatatgtttataagaatccgattttcttttagtctactatgtttatatcacaaaaaattgattcatctgacacaattatatacacatctatagaatgatgtaagagtatatgacatataattatgcatatatgcatattagtaatatatgtacacatatatgtattatattagcatttgtaatcatggagaatattagttccttttttttttttttgagacggagtctcactctgtcgcccaggctggagtgcagtggcgcaatctcagctcactgcaagctcttcctcccgggttcacgccattctcctgcctcagcctcccgagtagctgggactacagcctcccgagtgctggcacccgccaccacgcctggctaatttttttgtatttttagtagagttagggtttcaccgtgttagccaggatggtctcaatctcctgaccttgtgatccacctgcctcagcctcccaaagtgctgggatttcaggcgtgagccaccgcccccggacgagaatattatttcataaagatgaatacccttaaaattagaaacaggaagagaaacaagtactcatttttattttatgttagatttgaagatttaatttataattaaaacacacacgcacacatgcacacatacgcacacatgcacacatgcgcgcgcacacacacacatatatatatacacacagatataggtgttttagtgtacatatataatctatagtgaacaatatatttttatttagatacatgtttttatcttttgagtgataattgtcattgctaaatgtagacagagataatatgatgagataggaatacaaatagtggaagcaaaaaacttaaatttagatttccctttttacttactagttggatgtctttaaaaattgattaatatctctgaatccattttgctttcttttctgtataatgaggataagaaaacaaaatttcctggttttgggaaggttccagataatgcatataatgtggtcagcatagtcatttcatgttgtttggttggtacctaccagaacataccagaacatagcagagagacatcccagaacactgaggcaagcaacctcttcatttgtatctcatcatagtagttccaatgtactaatatgattcaaacctgaaaaattatgatatactgactacttgggtacataattactagaaatgaaattatattaataatattagtatacatgaaatgatccttgagaactgaatagccagaggtgatttcatgtttattctttttggctaattatgatctgagtttttatcaacaatagttaaaaatatggactttgagataagagaggcttggtttaaagtgctgggtttaccacttagtagctgtgtgaacattttatctacatctccacagttctgtaaaatgcaataataataatatttttctgataaagttattgtgaaattaaagaaatagcacattgaaaaagcttattgctatacttgatacagaaaagtcaatacatttcaggtgttatatcattgatgttattactaaggcagtggcattttttgtttctcttaagaaaccagacttgatctttgcacaactttagaagtataaatcttatggttaacaatatagatagcaatgcttttggggcaagatatataaattaagagattcattgctattaatagggtaaaacaattaatggagtaattttattttaagggtcatcacattttgactaagatcctttcaaaggctaattcattcattattttatagtttcacttgtgttcttatgctgccaaatattggtgaatttctgtatactataagagaacaggattataaataacattgttaaggtgatttaccaaaaaaacaaaacaaaacaaaacctgattagtactatagtagggcaataatgaaaagagacaaatttagaaaaagtaaaggaaatgctaaatcatgcacttagacaacatacttgtgaaactgttttactgacataatcataaagtctaatctaaaaaatgtagatacatacatacacaaagatttattgaaggaaaacaggatatgtcatggtagatcagcatccttgacattaatcaaaactgatgatgtcattaaagaatttatagattcttttgatatcttctatctatctatctatctatctatctatctatctactttctgtcagagaacttgattgccctttgattctgaatcattagaaaaattacattcttatttggcacagtgcagatagtgaaataattaattgatctatataagcatattggaaatgagaaacagcactttttatactatttgtgattttttaaaactggcatgctattatgctattattcatttttttaaaaagccttggctgggcacggtggctcacacctgtaatcccagcactttgggaggctgaggcaggtagatcacgaggtcaggagtttgagacaggcttgaccaagatggtgaaaccccgtcactaataaaaaatacgaaaattagtcagtcgtgggcacctgtggtcccagctactcgggagtgctgaggcaggagagtcactggagcccgggaggcggaggttgtagtgagctgagatcacaccactgcactctagcccgtgtgacagagcaagattccttctccaaaaggaaaacaaaacaaaacaaaaacaaacaaacaaaaaaaaccagccttagtagtaaacacacgcatttctaattttatttctatatcatttaggttattgttgttataaactttgaaagaatatatcttaaaatactatttttagtaactataaaacattcttttaactcatttgcaaaagactatacttctaatatatccctaccctaatctttgttgattggagttagaaatcagtttattctgagtctcattctgctctctgccaaggcttttccaaattgtccccttagatattttgcttctatatatcctaattctggcttaaagacatttactgaaaaaagtacaggacaaactggagtaacttctgcttcagtatttacctctgcttgctatctaatatagaagaatctatccctaaagtcttcaatagactaatcctttctttgcttgctggactggattagagtgcagtttgtgttcacaggaatgagtttggggatagcctccaaaacatcttctttcagagtccagatgttctaaaccttttactttttgttctatgcaacttggagtattttatgtcaccctcaagatcttttttatttgttaaaacaattatttttcttttcctgagtgtatagcctatgaaacaattgatatagacccaggagtactggattatatcttcctagtaatgttttgttattttatttttttttttagacagaatcttgctttgtcacctaggctggatggagtacagtggcgtgatcatagctcactgcagccttgagctcctgggctcaagtaatcatcccacctcaacctcctgagtagctggggctacagtagtgtgccactatgcctggctagttttttttactttttgtagagacagcatcttggttagttgcccaggctggtcttaaatgcctgggctcaaggaatcctcctgtctccacttcccaaaatattggggttacagttatgagccactgcatccagtccataggaatattttaaatttctgtgtaaacatgtttctattctgtctaactaaataaaagacaaagagagactctctaaaagccaatgatacttattcaggaatggacactgacatgagaaacgtatgccatagtaagctgtgtatgtattcagggaggtaaagaaaggcaatggcttaggaggattacataattgttttgagataattatccttggctacaagaatcaatagcaaacataactccagtcaaaggttggacaggcagttggtgggcaaatgttcttgcagaattattgttttgtgtaagggtagggtaggctttgtgcagtgctgtgggttttgcagttttttgtgacagttctttttattacctatttgtgcatgagaactcttccttgacgactttccccagctcagtttatcaagatttttaacacaagcgactcatgtttattttgagtttaaatattttaaatttctctgtgaatatctttctattctgtctgagcttcagaaagtcttaaataatcgctcttagctcataacaagaccagggcttaaaatttaagttccttaaaagaagacacttgccctattctcagagagctttaactttaagagccaatttagcttcgaggattttcttctgactagaaaaaaaaaagatagtagggttagaaaagatagcagtgcaaggtaatgaatgcacaagggacgagggaagacaaacaatggcataaaggccattagttagatttaagtggtgttttgggaggatctgaaagagatggtttgaaatttttcaacttagccaagcaatcctttaagaagataattttagaatcagagtttcttttggcggcttcctcacgcaagaaaatctagacacctgaatacttggaattttcctctctctgcttgtgttaaacttccccaaagttgcctatattattgtcgtttttagttcatcttgccataacaaaatagcatagactaagtggcctaaacaatagatatttattttctcacaattctgaagattagaattttaagatcaaggtgccagcatggtccattgctgctaaaggctgtcttcctggcttgtagatggccacctttttgctgtgtcttcatatggtgggggaaagaaagaacaatctctctggggtcttttttttaagggcactaattccaccataagagccccaactttgtgaccttgtctacacctgattatcttccaagagccctgtgtccaaataccatcacattgggggttaacacttcaacataagaatttgggggtggtgacacgattcagtctatagcaattatctgtgttgctactatgccatttagaatgatagcacttgaattgacttatagtgtgaatgtattgcatgtaagagacaaacgtgggagggtccacaagtacctcgtgtctgtgctcctgaacataatagttggctgtgtttaatagaaaacacaagaaataactaatctctgatggatgaatgattatagatgtgatatatctacaattaaactgttctgaataaaggaagactagctaaggaaagttctcataagttttggatagttgccctaaggcaaagtttgtcctgtatgactgttatttaacaagacaatttacttgttagtcctgtgggatggcacacatttcagtcctgtggaacctctgtctactctcggccctatgaactaatctctatattactcacaaaagaaaaagatgaacacaatcaagaagaacagcagtttttttttagtaacaaggcagatttccaccaaaggggagtcttaaattctgatcagacaatcaaaagttctcacaacgaggggggtcatcattcttaagagctaaaataaattggaaactcaacaaaaaaatgagacatcagacttaatacaggatctccctcactgtcacagtcagagaaacccctgaggaggcctgatgtggcctcaggagaactccctgcttacaagttgagggcactaatccatggcaatcaatgacttttactggtgaactctaggattgtctacggtccccaaggaccaccagaaaaacctattgatcaagtaaagctcaatttattaaacttacggcaacagggaaaactctagttccacagagttttcagagtgcctcaagaggagaagttgaggaaagagatttataaatttgagtatctgggatcaaatggtattaagtgttttggagaaaattgagttaaattggagaacttgattaggttgtgggaattttgtcatctaatagttaagaattggtagacacaggaaagcaagaattgaggcaagttttgacgatgtgctgataagtgagcccttggttcatgtaaacaaatagttctcctgataagtaatctgttagcccatataaaatcagtgtttacccagaaatatttaacatatctttccagaagcaaacagtgaattatttattggcaagtaattttatcctcctgggagggaattactgggagaggattatgctgacagagagagtgccggtccttggtctagttaagtggtattgctgcacaaggtctcagttcttacccaaatacagtaatagccccttatcctcagggatacattctaagacccccagtggatgtaagtcccccagtagatgtctgaaaatgctgatagttccaaccctatataaaccatattttttcctaggcatccatgtctatgataatgtttaacttaattaggcacagtaagagattaacaacaacaataataaaatagaaaagttataacaatataagattcacttttatggagagaagattagttctttccatggatcttaggaacctcagcatatgattttttttgtttccttagtaagtcaagaaagttcaccttttcacttaaagggagcactttacagcttctctttggtatatctgaatttccagcatcattattcttctgcattggggccattattaagtaaaataagggttatttgaacagaagcactgagatactaccacagtcagttaggtaactaagatgtttactaagtgactaatgggcaggtagtatagacaaggtagatacactgaacaaagggaagactcacatcctgggtgggacagagcaggacagcaggaaatttcatcatgctactcagaatggggttatttctggaattttacatttaatatttttggactgtggttgaatgtgagtaactgaaaatgcggaaagcaaagccatggataagggggactactgcataagagtagaacatgtgggattacttgtttgctaaaggataaaatatattttatatttttcattggcttcatttctattataagcatataaaatatgatttttcatacattaataaagattgaagtcattaagcgagagcaattcatccaaaattacttattcaaaaccaaatatactagatgctgttttagcccctgccttcatgaggtttaaatttcagaaaacagaggaggttattggtactttataatgaatgcacgcatatacatatagtttatataaacatagaatacagtaatacagacacatataaatataatctttgggaagattaaacttcattctaatgactttttagagtatgcatgctggtaatataattaaatattatgtagggtgtagaatttgtgaatttgtgttttgggacaactgttggttggctggccttgagggggaatggggtaaagaatactataaagttattaacagagaaaatactcaattgcttcctagaatgtgtggaatttcctgcttccttttatcttttgagattcagaagtggtatggaattattttggcacaccgaggtaaaataagttactttaaaagccaggatcaatccataacacgatatagtactatggccagagagagcattcttcatgctttaataatgtcttactgccattctttgttctttttcaatatgtcaaagaaagaagataagtaagggggaagctagaatgcacccacacgtttgaagcattgaccctgtgccacctccataacaattttacaaagttgtcatttttctcatagctatttttagttggtttcataactatttatagttggtttttgccaacttgtcaaaaatgtcatgtttcaaatttcttcagcgtatttagcatccagtatatgataaggatgcattttggtttctgtttgttaatatttacacttcccatggtaaatgacaatactgcagttactgtgatgtcatattctatgatggcaggttagtattattaaggacatttgctgataataatatatctcattttattttctcttgtcacacattttgccatcaataattcaagacagaaatagtctgtatatcaaaatttgaatattagaaactcatgttttatgtacatatagtatttcgacaatacctttattaaaagggtgaaaaattacgggcaactataatttctcaaccaacttttaactgaaaataagaacacatgtcccttaaagtctcatttctgatgtttaacaaacataatttacagtgaacgcatgacatttattatattggaatctaatataacagttccaaaatggtatttactgacacttgttattcatcgtgaagctgatcactgactagtagtcatcacagataaacatcttccctcaattaaaaaaaaacagttacagattagtcattcatgtaactttatatagaaaaagcattagaaagacttgggttccttgccttgaaggagcaagcctggagaaggaactgttaggtcttcaacttcaggatatacattataactcattgcatgccacacctcatgaaattggaactactcacattgttttcataccaagaatctggaacttcatggatctataacacattatttctcatgtcaaagaatttaaatattaaccagtcatattaaatatcgcttcaaagagtgatactttctctgggaagagatcaatagctttttggaaatggtatttcaacaaatacttaagtggaggtttgtgattgcagtgattatttcaagatctttgtggactgggagtcttccattcaacctggggtgtgaattaaattatgctcatgccttatttagatgtacgtgactgcttgatattgtagtgatgtaaaatgtagacataacttccataccattcaggaaagttagcggggcttgagaaaagggagtgttgtaatgcaggaaatgccattcttaagaatttaaaaatctgttagtaaagtatgaaaaattaatgtcctttcaagtaactaaccttttgaagagaggcctagaagaagttaagagaagttttatattgttgatgatgttatcattgtttttgttctcttcttccctattagatagcatgacattcctgtggtaatattgggttattacagttacatttgtcatatttgattgaatgcacagaatgttgctatatatcttgacttgattatgtatttctatatcattttatttaactcattgaactagcaacacatattactcaggattagcttctctggaaatttagcatttgtttatgaattgagaacattggtccaacaggatgaaataccaacaacttgtcttgctatttattgctctgaatatcttggccctattagcctatgcaattgtactccctgcttttcaccaaacacttcacatgaagtgggatagaaaagggcagagggaagaaaatttgtatttttggcaacttagaatctgttctatgatagaaagtggtgagcaaactaaaagcattagctccagtatatttgagttctttgtgttatttcaatcacccattaaaactgtacacttagcacatttctttttggtttgtaattaacatattaaaaatccagaagaatttgagctttggggagataattgaatattttatttaatttcttaaaagtgaggatggacattatgtagattatatgactgttcatcattttgcaaagtgaagcccattgaattactgtcagtattacacaactaaagactaatcaactatgtctcgtaacctgagagagattcttgatatagctaacattgttttttcaacaaagattaataattaatttgatacttattctttttattttggtcagcccaaaaggtagtgcaaggaaggagcagagaaaaggaagatgtaggggaaagagggaggagaagagatggaatgtgacttgtcataaaataatattggctagattatgtttcaagtaaaaggaaatctcttaaggaaaaatataaatacagttgacccttgaacaacatgggttggaactatgtgggtccacttgtgtacagattttcctcaatacaacttttgcggaatgtgccttcctttcctgcttccccttccaccttatccaccttatccatccttgagacagcaataccggcctctcctcttcctcttccttctcagcctacttaatgtgaagatgacgaggatgaagacttttatgatgatccacttccactcaatacattttctcttccttatgattttcttcttaacattttcttttctctagcttactatattgtaagaatacagcaataatgcatatgaaatacaaactgtgtgttgatctgctacttatattatcagtaaaacttcctatcaacagtaggttattagtagttaaatttttggctggtcaaaagttatacatggattttcaactctgcagggattgaaaactgcacgttgtccaagagttaacaaccctgtattgctgtgtagttttgttttcaacagaaagacttagctgtgagaaaatggtccttttttgtatttatttaataactacctgttaattgattatattcaactaaatagtgacaccagagtgtaaatatgtagtggtgcaaaaagtagacaccaaatacgtgagagaaaatttacttgtggtcttcctggggaaaaaaaaaaaagaatgaaatttactagaatgcattctcttactagaacttgagtagttcagctgctacctttctggctgttgaaatcaaatagcaaaaattctctgaaggggcaggaatttctgtctgctttgtgtactattgtattttcagagccaagaatatggctgtctaaatatggactcaatagtagtttttgaataaattgtgttgtttatttaattaagtcacatagactaaatatgtaaagtgactagttatattagactataaattccaggcagattaaaaactaaaacttgcattgtatcttggtttatattgtgttgtgtgtaataagcatcagtattaaaaacaagcaaacacctaacaaaatacccaagtcaaaacaactttgggctgataggtgaaacaacgttaatggatcataacagctgacacacatgaaaattagatatatttttggtaataaataacatttgtagaaaagatatattcaacagttttatttgcatataattacaaagaatattttcttatgcataatttttaaataattgcttttaaaatattatagagttaatttttcagggttttttattgtttccttggcaaattcaggtagaatatgtttcctaacagtgtgtaattttgacatacttctctagatagaatgacagcaaaatgcattttagttaaaccacccttcccctgagggcattgtttattgcttatgtgaaatactttgcaaattctttttattctaatatatcaagcaccttctttttctcctttaaaaaattattgttttctggactctaggatatcagattatagcaattttaagttaagcattatttaaataaaataggccttgtcatacatgttttcttagaatggataacaaccatgattttatcttatgtttggataattcacaaagcattgttttgagtggagagcaggttcttatttatatgtacttgctatagcaaaactgctgcaaggatagctccagggatctttctaagtttgaaatgagaaacataactgggagagtcagcatatttatcagactgctttttttttctctaggtgaattgaatatatatatatatatatatatatatatatatatatatatagcacttttcttctattgttttctacttctgtagtattaagctgtagacaactgctgaatgagaattttaactatcactcccttgaaatcttcgttcataaattccacatacacataacatggacaaatcattgtggcacttatgtcaataattttttttctgtatcatttaggtaccaaatttaatgaaagtctgcctggggaatcaaaatctatttttgttgttaattataaatgctctttacaagtgtatagtttgatactgggccacaagagagaaagcgagaagggctgcagctcttctctccttctctcttttgtcttctttctcatgtttacaacaaggtgagcggagggacgtgtttcaaccctgtttgtgttacagctcttttggtccctccattaggcaggtcccgagttcttgtcctgcatccaggaagaatgaggtatgcagacaactggagggtggacaaggcaaagaggtgctttattgagctacattacacctctcaggagacctgaagttggtagctcatttctgcaggcagattgtcccaacatctgttcagctctcagctaggagggaaaccacagtggatagctcctctccacaggcaggtcaccctgacatctgctcagctctcagctggaaggagacccaatgtggatagctcctctctgcaggcaggtcatcccaacgtctgcctagctcccagctaagaggagacccacagtgggtatctcctctgcaggcaggctgtcccaacatttctttgagtctggctgagtctggggtttttatggacttcacaggggaggaagtgagtgctgatgggttcatgggtggccatgggcaggcctggaaaaagcacagtaaattttcactccagttcacaaaactggcagcccagttcccaggtttcaagctattcccagattcaaggtggggcttcactggggatccacccttttctgcccaggagcctgtcttcctcctgcttccatcaacctgccattcatgacgctcatggtgcccaggctgtttctgccgaggagtgcctgcaggctcgtgtgagctgcccacaacccttcccttggcctccctcccatgctcatcagctctgaaagtccaaagaaggctgaggcagcagggagctagcatatcagcaccaccctgagtgtgtgcacacctggctgggtcataacagttgtcaggcttggcaacaactttgctccgaaatcagagcaggcaccaggtgtggggagaggccagacagtgggaaggtcacttccaagcctccaagagcagagaggcttcccagagagtgcatggatgccagggtccacagccacagctgggtggctgcatctttaccaaggagggtgaggctctgcccctctaacttggaaggggtggggcttttgcctgttcctagctcctgctggctccatggagtgtacagccctggctgtacttccctcatcgcagctggcatcttctcagtggctgccccacacaggccactgttgctatcaatcccccttctgaagaggtacatctaactgctgtgaggatagggatgatgctgctcttcactgcttcgtgctgacaagggacattgttttggggaaaacagcagtcacatctctctcagaggcctatgtaagggtccctggtagaaacggagccattatccaaggctccagttgtatgaccacttggagcatgatggcctctaggtgagaagaaataattttacaaggaggttaaatatgtgaaagaaagtatctagtgctggagataacacaaataagaagtaaaatagactaatcattctgaaaacaatgttgtcactagagtcgtttcacctttgtgaaagaaattaaatcttgtataggtgcagctaagctttaaaggagaaataactgtttagggctgtagggaggtcaagaataaaggggccttgacaaagatgccttatggtgaggaacagaacaaaagcggtaacagtaagcgtagggtatccatggagggttgattgttggtacttatcttttgtgattgttaagttgagatccctgatttctttactctggtacttcgggtgctctcttgggtcaacagaggaaattccgtcagttccctggtcttttactaaagtgtaatgaatccaagaatcaatttcagtgacctttactgctgtaggagtagaaagaagtacacagtaagccctcacccccattctgggactagagagagagaaagggaaggaggtgcctttaccagtgctaagtcccctgggttgaatagaagtggccttattcatgcgattgggcctctgatagttgttgcagtttgtgttgcaaatgggccaaataagttgtatgcttaattaaatcagagctttttcagtctagcaagaaatcattggtgagaaaagtctacaccattttgaagggacttaaatccagctttgaaagggtgtttctaacacatagtagggctatggagagaagagtaatccatggaatatgagtatcttgagacagtttactgaggtgccttttaataatctcatttgtcttttctacctttcctgaggattgtggtctccaagcacagtgaagatagtattgtatgcttattgccttttatacccgctgggtgacagctgccttgaacaaggggccattattgctctgaaggtacttgggaagtccaatgtgaggaattatttcattaattagtgcttttatcacctcagagcctttctctgttcatcatggaaatgcatctacccagttagtgaaggtatctacccatactaggaggtactggatgccccttgtctttggcatatgggtgaaatccatctgccagtcttccccgaggtagactcccatcctttgggttccagggggacacgccattgactgaggggattatttttgaggcaagtctcacaagcattaacaacctgtttgaccatttttagcagattcttacctgagaacaacctttgagcacttgacaggttttatctttatcaaggtgaaaggcttggtggaggatttttaagaacccagctggaacccagctggaagctggtagatgaagcttgctctcctctaattgcagccatcctgaggactgaagtgtgtatccctgagatacagcccattctatctctgcagaggaatactgaggtttcatttcttttatggagtactcccagatcagagggcttcaagtggatcagatatatgaggccctcttgctgccaatttggctgcttggtctgccaacttatttctttcagctattttatgcatccccttttgctggcctttacagtgtattactaccactttccatggaaagaataccatgaataataatctgttaatttcctgatgacacttaatgagagacccattggctgtgaggaagtttgtctctttccagatagtagcatagacatggaggactaggaaagcatgcttagaataagtataaatgttaactgctttccccttgtttaattcaagtgccctcatgagggcaattagctcatctagttgagtactcgtgcctgaggagagaggcgtactctcaataacatcattcagggtgactattgcataccctgccttatggaccccttgctctacaaaggaacttctgtctgtaatgagagtccagtccaggttctctaagggggtttttttgaggtcctctccggctgcataggtttgcactactatctgttcgcagtcctgttcaagctccccagcttcgtctgggaggaaggtggctgagtttagggagagacagtttcttaactatactacagatccctctaatagcagagcttgatatttgagtaggtggttgtctgttagccagaggctccccttagaagacagcagtcctcccacattatatggcacataaactgttaagttattccccatggttaacttaatacctctggttgcaaagctaccactgcaactgccaagaggcaggctggccattctttagctgtcaaaacaagctccttccttaggtaccctatggggtgctgggctggacctcgggcctgggttggaactcccatggccattgccttcctttctgagacataaagattgaacatctcctcattgggaagtctaagggctggtacctcaagcaagatttgttttaataggtcaaaggcccttttagcctctggttcccaagttagggagtggatctggtatttcaccgtgccatgtatctatacctgcagaatactgtagtgcccaagaatgcctcagttgcttgagggttttgaggcaaggaaagaaggacatgggcttgattctttcttcacctagtgcctgggtcccctctgacaagactagacctaggtacttcaccaaagtctggcagagctgagccttagattttgagaccttatatcctgttatccagaaaattaagagctttactgcctccctaagagatttcatcagagttgggacataaaggataatgtatacatattgtaaaactttaacctgagaataaaggaactcagagagatcttttgacacaccttctcaaacaggtgggggctgtctcagaattcctgaggtaacactgtccaggttaactgggtggcctagttggaggaattcttgaatgcaaacaaatactgggagttgaggtgtaggaaggaaaaaggaatcttttagatccaggactgtgaaccatttagttccctcaggtatttcagttagcaggttataggaattgggaaccaccagatgaatagggaccacagcctcattaatgaggcagaggtcctagaccagtctccattccctgttgggtttttgtatccccaatatcagggtattacaagggttgttacagggtttgagaaggccctgaatcttcaggttatcaatgatggcttctagtcatttcctaacttctggtttcagaggatattgtctctggttagagaaggaggtgagatccttaaagtggaccgagaccagtgtggcaattgtggctcagccaattttccctggagtagtccaaacttctgtgttaatattggtctctactatggggagacaaagagtctgtcctggagccataaagatagtggttcccatgtgagccaaaatatccctgcccaagagaggagttgggctttcaggcatgattagaaagcatgagtaaacaagaggtcctgccaactacaactaaggggttgagaaaactattgggttaaaggctttcctgagacaccccttatggtagcactaagagagaagggagtgcctggactggagtggagaacttaaaggactacttcagtgtccaggaggaggtcccctttcctcccttcaactttcagaatcaccctgggttcctggaatgtaatggtggtctggaccaccagagccaggtagaggagccctgggatgtgtgagtcctgctggaccacttgagagactagctctggacctggtgacctgtgtctctggggatagtcttccctccagtggtctccattacctactggacagggtcaaggtggctttctcatgttgcctgggcagtctttcctgaagtgccttggcttgccacatttgtagcagttaacaggtacatctaggggactctggggtttgtgagcctgcaaagagtccattagagcctctgccttttcttttgtttcatgtttttttttttttttttggatttcctcctgatccctattatgaaagaccatggtggccaatttcaggaggttctctaaagtactatctggtcctacagcctatttttgcagcttccttctgatgtctggggctgcccgagtaataaacttatccttcaggttcagttatccttcaactgaatcaagagatagagaggtatgctttaccaagaccccttttagcatttccaggaaggcagtgggtttctcattgaatcccttttctatcatgtttagcttggagtaattaagaggcttagttctagtccttcataagccctccagtatgcacacctgagagtgtttcctcttccattctcccatttcatcattgatgtcccatttattatcctccaatgatactactattcttctaattggattggcactctatgacatacaaagcttatcccccaaattatctgctgctttctgggtggcctgcttttccacagtagtcaggatctgattcaaaagtaacataatgttcttccaggagagttaaaatacttgggttaaattctggaaagcctctatatgcaaatgtcagggtcatttgaaaacttgccaagatctctcttaatctgccttaagttccgtagagaaaagcaaatttggaccttaatgagactatatttgccagcctgttgtaggggcaaaagtgcctaaaactaagatttctaggatggaacaaacttagagagaacctggataagggaagtggaaggagatgattcccccaatggaggtacctctggggtttgcttctctatttccctgggattgccccttgcagccttttctgaaattgccaccaggagggcagaatcaatcctacaatgttggcaaaggtccgaacttccctgcaaggcaaagaaagtctgcacatgtgggacttcaaaccatttgctctcatgtctacagaaaagttccagcttcagaatggtattaaaattaatacttcatttctgaggccatgcttctgcctgcagaacataattcagccacaccttagtgcaaaggaatataaggcagattttctccagagtctgagtattaaggagtcccaggaattcaagatacactctagaggagtataggttaaagatggttgtttacccttctggaagagagaacagaggaggaaaaggtgatttttcttctctccagagtctgagggtcaaaggggtctcagtgattcaggatgcagtcaagaggagtgcaggttgaagatggttggttacccatcaggaaagaggggtaaaaagcatccctttgttcctttctctttccagcaaatacccagggtaggtgaggctaagaaaaaagggcatccctttctttcttctgaccttatatccctaaatccccgtgatctttgcaggtgttgaccatgtgtgcaagtgtgacttcacccatgaggtggggaggcatacccaacaggagtattcacacccacctatatggtgcctaatcctcctgcttttggtaacctttaaattccctagaccttatctatgccatgggtaggaggatgacctccatccacgatgcaggagggcctagttggcaggagttagtcatgctcacctgcgccgtgccccctaaacttcactgtcatgtgcctttggatctctcacatctagtttttctttctagggcctcaaaactaaacttgggacaaaaaaatgcctcaggagggtgtatggacccattaaattagtggcctcaccaaattgcagccagaaactggtggggcagcccatctcttgcttccttattatgaataggtgaagctgtgggaccaggtcctctgcaaacaagggaaagaaagggagtcctgggaattggggacctggcctaacaagatgcttcccaaaagaatgatttaagttcaggggtggggaaggtgcctggggaaaaaaccttttgccctgtgcaaatgggttccttcaacaggggaaagaaaactctcaattgttacatccttcttgcttctaagaatagatagacatcacattgttctgatttacacttctgatgaccaagccaagtgcttattctacccggtattattatctctgtactttgcaacaacacccttatcattgtatataaagaagagataggagccacgacaaccttgaaagaaagaaagaatgataggaaagactggaggtcctagtgctgacaccctaacaggcagtcggggactggagttagttcagaggcctttggataacactgagatatagcctcagccagataccctcatttgccccaggacctccttctgatcccacacgatggctagacctccatgaagggaaactggattggaacaaagccaacattcccaacacccaagggtgatgggggattggcagtgtcctccccagcaagcctgtcctcatgtcttaagtccagcagctatgctagtcactttcaactggccaagagaggcatggcatttttctttcagtttggttgtagtggagtttagggattccccaaaaaaggacagaaagcagcaagtttgcttttactcacccttttgcagatcctggatgagccccccaaaatgtcataggatcctcagggtgttgctttgccagctagaaatctctgtggctggtggtgcctttgcccaagttttgctcaggaccactggacttgatttgctcacttggcctggcagtctgcactcggcttgtactactggctcagatccgatgcctgccaatggtgagccaggcatgaagcggtgaggagtgtgtaagcgagcgatcccagggtccggccactgtgtacaacaaggcacactggctggggctggcgggctgctccaggtgctggcacaggtgctggttccctgcgaggctatggctggaccaggtgtaccgcaagtggcttccactgcaggcaccagggaacactttgtcacccagcagcttggagatcccaggaactgcagaacgccaaatagcgtgtaagagccctggctcagggaactcttagagctgaactccccaaagagcctcaacttttctctcctcttttctctcttttttcttctcctcttctcgtgctcacaacatgctgactaggggggcatgtttcagccctgtttgtgccattcagcaggtcccaagtacttgtcttgtttccaggaagaatgaggtgcgtgggcaactgcaaggtgagcaaggcaaagaggtgttttattgagctacagtacagctctccagagacctgaagtgggtagcttctttcaacaggcagatcatccagatgtctgttcagctctcagctgagagaagacccacagtgggtagctcctccccacaggcaggttgtcctaatgtctctacaaatctggctgagtccaggcttttatgggcttcaaagaggaggaagtgtgtgctgattgttccatgggcggccatggctgggcccggaaaaggcaccataattttcactctgctccaagcaactggcagcctggcacccaggcttcaggccatccctagcataaaggtgagtcttcaccagggacccacctctttccacccaggagcctatctgctttctgccatcatcaacctgccatccacagcctgcagacccatgccaaccttctctttgccgtccctcccatgcttatcagcacccaatgtccagaggggctcgagacagcagggttctggtgtgtcggtgccaccctgagcatgtgcatacccagcagggtcatggccgtgcccaggctttgtcacaactgtgctccaaaattggagagggcaccagaatcagggaaatttcaggcagcaggagcctgctgagatcaggggaattcctgggccctcaagagctcaggaattcctgagtccatagccgcagctggtttgctgcggctcttaggagagcccctccaacttgtaagggggcagggcctccacctgttcctccttccacctgctccatggagtgcaccgccccagctacacctcccacactgcaaccagcatcttcacagccaccactccacatggaccactgctgccatctttagaaaatagagtctgccacaataagttttttttttttgagatggaatcttgctctgttgcccaggctggggtacagtggcaccatcttggctcactgcaacctccacttcctgcattgaagcaattctcctgcctcagttcctgagcaattgggactacagacatgtgccaccatgcctggctaatttttttttattttgagtagagacagggtttcacccttttggccaggctggtctcgaactcctgacctcaggtgatccacccacctcagctccccatattgctgggattaaaggcgtgagccaccatgcctggccttgccacaataagttttaatggtcctgccaatattaaaatgaaatctttaatgaacaacaagtcataaaccttctatgtgaactacttagaaggagcagactacagatgatgatgccattctaatattatgtgtggaatttttgtcagtgatgaaggacttcacagacctccagtggtgctaaagttcttacacatcgcttttgatggaagcttgaaaaccacttaacctaggtagcatcttctgctctaactggtggctgtgcaatggagaaaatgccgataaagtttttaatagctaatttatcagcaataataattgtttgtgactctgttctttctaatgctatctattgtatgcatatgtatgtgtttatagtatatattatatatgttatatatgcatacatgtgtatgtatgtgtatctacatatatagatagtgtatgtgtgtacgtatatatagatacagatataaacacaggcaaattcttacaactatacacgatctagttttaaatacactaaaagcttatgtcacattgggaaggagggaaccataatgacaaggtaacgtattttccagcattagaattattgaagtatgaactggacatctgtcagagatatttggaatgggagaggataggagtagtagcaatgtagattcagccattaggtgggagtttggagtagaactctgagatctttttatttaattattaatattagtaaaagtaattctgtccccctaaaatgctctttaaattagtttgctagggctggcataacaaaaggtattattgtcttggtggcttaaacaacaaacatttattatctcacagttctggaggctagaagttcaaattcagtgtgtccgtagagttgatttctcctgatggcttctttctgtgtctctagacatcttctcctgatggtttctagatggcttctttctgtgtcttcgatgttttttccactatgtctgcctgtgttgtaatctcttcttcttaaaagggcaccagtcgtactggattagcgcccaccataatgacaatattttaacttaattttctatttattaaaataaatgacactttattcataatttgttttactttacaattagtagggactttataaatgcttatttcatgtttgacattcaagaacaccattggctatatcagcttatatttgaagtgaaggacacttttttgccagccccaaacatactaaagtgttttgagttttaataataagataggtaagcttacaaatggagttcataacttttgctatttttctctatcacttgtgagctttcaattttattgtagaaaaaaatttcacaacgaaatatttgtgaaaagaactattcaaaaactaaggcggccgggcgcggtggctcacgcctgtaatcccagcactttgggaggccaagacgggcggatcacgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaactaaggcaagaaaaaaactgagattaaatgggtcaaaaatatgcaatttcaattataatagacctgatatattccaaccatctgtcataaaatgaaaggttactattggcacacagcgacaaagttaccagaatttgggtgatatgaggtaagcctgaccaaatttaatattttcattttcactttatagttttgtctgagtttccagggtatagttattttcatctgtttttcatattttaagaagtttttacttcaggatattgacagttttacgcaattccttcacatcttaacaaatatctcaagatgatattagccttaaataatatggttgtatagaatacttttaaatttaaattgtaaactaaattgtctcctaataatttgaaggtctttgctttcttcttttgatggctcttctctcacacccatctgtactgtggctgtattttctgattttgtaatgtgctgagaattgtatttcatcttaataaagaaaataagtagatatagactgtgactatatatttgaaatgaagtgttaacatttctgaatactctgcactcgactttttcccctctagtccactacactgctacttcaaataataagaagccctcaccatttctcactttgtttatttcaatagtgctgtcagtggtttcactcagtcttgttcctgtacttaggtgttgcccaggctattttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttttagccgggatggtctcgatctcctgacctcgtgatccgcccgcctcggcctcccaaagtgctgggattacaggcgtgagccaccgcgcccggcccggctatttttaaaaatatataaagctgatcatgttgctctttgtttaatgatcggtatcaattcccattaactttaggatcaaatactaatgtttttaagtttttaagtttagaaggtgtttaaggtattgccgatgacctatgcctccagctcagtcttccttaacttcttgtgtcttgtgtcttgtctaggccccaatcacattgaattatttccatttctcaatatatatataacattttctcatatctcaatgccttttagcacactctttcctgtgcttggctagcatcttttcttttcccccatgcctcacttcacttttcttcagtctctcattcatttaccaaagattattgagtgcctcttttgtgcctggcactctactaagtaacaggagtgaacaagactgcaacagtcctactgttttgatcctgccagttactttacttggctggcttctatgattacacttcctaaatggtacaatctcctactacactttaagttactgcaaggcaaatgttttatgttttatcttcacaagttcagcacctactacagtgtctggatatggaatagttcaattaatgctactaaggaatgaatatatatgcctgcttttgctcaatgtgtgctatttacagtcatgatgcaatggcttgtatcttatctgcttcttttttttcatttcttctttcaattctggattaatataatttcatcaaaaaactttgtataggcactaaaaagaaatatttactggttcagtaaatatttactggttcattttggtatttacaataccaaaatgtcattgttacttatgtatttatcaaccaggaaaacagaccagtaaaagatataaagaagtttcttttgtgtatttgtttttgtaacaagtaatcaacgtatgtgattttggagaccggttaggtaagtccaaaatatgtagagctgactatcaggcagagcaggagggaacttttgacaaggatgggatttctatcttcaggaagcctcaactctgctttaagccttttttaactgattgactcagacccatccaggttacctaggataatatcacttaaagctaacagactatggactttacatgtagagaagatattttcacagcaacacttgggttagtatttgaataattggggcttgtagcctagccaagttgacatataaaacaaacaaacaaacaaatcagccaggtatggtggtgtatacctgtagtcccagctactcaggaggctgaggcaggcggatcgcttgagcccaggactttgaggggtagtgcatcatgattgcacctgtgaatagccaccagactccagcttgggcgaataataaaacaccatctcataaagtaaaacagttataaataatatttgctaacattttaaaagaatatcattttcctgatattatactaagcactttacatgcattaattcatttaatcatcaccacaacccaagtgcaagattattattcatagtttactaatgggaaaacaaatgcaaaacactcattctccagtggaacaatagaacaataagtcaatagacttataaccattgttataagtcattttgaaggacagagcttagaacccaaagtatttgtatggtgagtcaaagttgtgatatgttctgatatggattattttttaagaagtttttactttaggatattgataattttgatgcaattctttcacatcttaaaaaaatctcaagatgatattagctttaaatcataaagttgtacaaaatacagtcttaaataatgtggttgtaaaaccaggctgcttgacgttttcacagtttttcttagaataaagaatccagatgtagggatattattgagtataaacaattgaaaaagataaactattacatttacactattacttcagagcagttgatatatttaaatgagaatcagcatgaagtatgttcaatagcatgaggactagcgagaaatagatcaaatttgggtttttctatactcaagctgtgtgaccttgaaaagtgcaatgacagtaataacaatatgccatagaacttttctgaagggtaaaaacaatacagtaagagtaaatgcacagttagtgcagaattgtgtctatcttgtcatttaaatgtttgttaaataatgtattcttttgctaggttaagctttatcagcgggttgttatgtggtagatacatggatcctggatatttggaacagaaaatggaaaagtgaacactctaccaagtcaaaagcaaattctttttttttaaggctgcaatttgccaattaatagtaaactattttggtgaattggagtggtgatctcaaatgtaataaatatgtataaataaaatataatacaagaatatcaaaaacacattacttataactactctaggcaccttcagtcacttaaatgttttaattttgcatgaaagacaaaaatgcctctctgatgaatccttagtagttttgcgaaatttattaaaatataaaatatactgcttttttatgctttaacaatgattttataaattaaaaaaacgatagaaattcagttattaaataaaattattttgatgtagtcaaactggagaaaaggagtaatttaaaattttagtgtttaaatttggcatctcagtttaatatgaatctggaagaaacattttagggaatacagcaataatagaaagtcatttcctgtaatagcatagtttttgtggtgtaataaaaggttacatgacaaggtcagactacttcatttcaaagctaaaaatgatttctactctgccctgaggtttgcagatttctgactgagtggtccctggaaggcttgttcattttgttgtttatatatttaataactatctagaaataaataagactagtgcttagaaccaagttttaggataagcaatttttgtgactatcaagtattttttcttattttaaagtccctatttgtataattaaacatcggtttctcaggcctgaatcatccttttcttatcaactgatggttgctgataaatgacttctactaggtacagttccagtagttgtttagtgaccctgatcttggccaaaaggcctcatctgtctagaaacacatggggacttttattttccaggtatccttgctctgacactctctagtgacagaagcctaagacggaatattctgcacttcatgcaatacattaacaacaaaaattcttttcacagaagagcaaatttagcatataggtttttatgttgttgcctcaaactgttatttatatctatggttggaaataatcgggaaaaatgtattattgatttttcaacccatggatgctgcaaatctatttgaatatggaatggcttgacactgtctcatgttttttatattacattataattgtctgctgttccataattaacctttataaaattaatatgtgaataaaattttttatgcattattaactttttaagtgcaattaaataatggagtaattaaaatttgagtgtttctgtttgttgtactcagtttttatatttgattcaaatgtcacatcagcagtatccattttgttttcgagacggggtctcgccctgtggccaggctagagtgcagtggtgtgatctcggctcactgcaacctccaactccctggatcaagtgattctcctgcctcagcctcccaagtagccgggattacaggcacgtgccaccacatccagctaatttttgtatttttattagagacaggctttcaccatgttgaccagaatggtctcaatctcttgaccttgtgatctgcccacctctgcctcccaaagtgctgggattacaagtgtgaaccaccgcctctgcctcccaaagtgctgggattacaggtgtgaaccaccgcgcccaggcagcactttccgtgttcttttttttttttttttttgaggtgcagtcttgctctgtcacccatactgcagtgcagtggcctgatctcggctcactgcaacctcagcctccccggttcaagcaattctcctgcctcagcctcctgagtagctgggactacagacgtgtgccaccatgcctggctaattttttgtatttttagtagagacagggtttcactatcagtttttatttcttttctctactttcattttcattggcaaattttttccttacctggtctattttttataaaatgtcacataaattaatcacggggagacaaggaagcaatgcaagtacacattattatttatgtgcttgaactgaataagtaatgcctagttatcaataattgacagaatttgaaagaagtgatgtgtgtgtgtcactgatcatgatgtacctcttttgtttacatagtggtttgtgtactgaagtgctagtaaagaagtttgtactttatacaattactcacagttgatataccatgtgaacttcagtttgaaccctgtttttggggagtgactgatgttatttaactaaaccatgtaagtgaagtttttgcatattagaaccatgtaaaaagaggactgaatatacagtatatatattcaatttcattcattatcaggaatatataaattgaagtaacaatgccatactgcactacacacttaaaagaatggctttggtaggcagaattctaagatgacacgtgactccagcccttaatttttatttactgggaagatgatagggcatcactgctgtgattatcagttggcaaaaaggattttgcagatgtaattaaggctactaataagttgactttcagttaatcaaaaaggaaataatgtgggtaggcctcacatgagccctttaaaagcagaaagaatgttttttccctagttggtagcaaaagaagaaatcagagatatttaaagcatgagagggcttcaatgtgaaggatgttccccactgctgagatggatgggccataggccatgaacctgtgagtagccctagaagctcagagtggtccctcgtcacaacagctagcaaggtaaaaggagccttgaatcctgctactggaaggaggtaaattctgtgaacctgagtaagtctggaagtggattattcacacagagacattagataagagcccagattcattgataccttgattttggccttgtaagaccctaatcagggaacccagttgagcccatctggacttctgatctctagaactgtgaaatgattaatggatattgttttaagctcctaagtttgtgttaattttttatgctacaatagaaaattaatataatattaaaactttaataagaaaaaagtgacaaaaccaagtgttggtgtggatgtgaaacaactgaaactctttctctattgttggtaatgcaaattagtacagacagttctgagttgtatttggcagtgactactaaagcagaacataaaacatgactatatcctagaaacgattacagcttattgatatttttccaatataaataagtttgtgcactgtttaaaaaagtacaagaatgttcatagacaattgaaatagccccaaactgaaaatagcttgtgttcattattaacgaaatgtataaataaatcgtggtatattcaccagtggaaagccacacagctatgagaatgaaccagctactactagacatagatgaatcttataatcacacattgaatgaaataaaaaacacataaaagaatatgcgtgggccgggtgcagtggctcatgtctgtaatcccagcactttggaggtggaggtgggcgtatcatgaggtcaagagatcaagaccatcctggccaacatggtgaaaccccgtctctactaaaaaatacaaaaattagcttggcatgatagtgcgcctgtagtcctagctacttgggaggctgaggtaggagaatcacttgaacccaggaggcagaggttgtgttgagctgagatcatgccactgctctccagcctgggtgacagagcgagactccttctaaaaaaataaaaaataaaaaagggcctggctggtggctcatgcctgtaatcccagcactttgggaggctgaggcgggccgatctcgaggtcaggagttcaagaccagcctggccaacctggcaaaatcccatctctactaaaaatacaaaaattagctgacacggtggcgggcgcctgtaatcctagctactcgggaggctgaggaaggagaatcccttggacttgggaggcggaggttgcagtgagccaagatcgtgccactgcactccactctgggagacagagcgagactccgtctcaaaaaacaaaacaaaaccaaaaaaaaaaagaaaagaatatgctcacaaaagaatatgatcccatttgtgtaaaggtcagaaataggcaaaacttatttatggttctataaatgatgataatggttaagttcagaggttccagtagtgtttgggaaggggtaccacaggaggatttagggtgctggtgatgcactgtttattgatcttgatgctgacttagcaggtgtggtcatgttgcaaagattcatttaactgtttatgtataacttaagcacttttcattctttgatgaaaagcttttttagagaaggactataaactgttggcaataccttttccaccctgggatttaaaaaagaaaaattgcccaaggtcatatagctagtgagtgaaaagacttagagcagaaaatatttaaggataatttaataattaatgttttattagaattagatcttttattagactaaatatagaaaggggaaaaaggagatgtgagactagttcataaataattttgacatttacaattcctcggtttttttgaacagtttgccgggaggactcatatcactctgtcgtctcatgtgccgcagtagttcttactcctatggaaccaatgatagaaatgaagaaaagagaagaaccagaatttcctgagccttccaaacagtgagttgttcatttaatttttcaaggccttgtaaaatcaattagataactgataagaaaatgtgatttataataaatgtgttaatattagtataaagaaagaagaaataaattttatgggttaaaaaatcatctattctatattatcttaatgaattaacttctgtgtctcctaacttcatgtctttgaaccatgtgtcattcaagtttcattttgttaccttatcttaaggacatgggcaagtaggctgatgtactttatttccctactctgtgattgtgggtacactgttcttggattgcttactatataagctgtaggctttaatgatataaaatgaaatcagtttttaatataaagtttttaaagttggtttgcatttttataaggaatgtaagttattattttaaaatatttttactaaattagaacaaatttgaactttatactattttagtgttttcatattttttccatttaaacagttcaagctttaatttaaattaaaatttgatcttctattatataaatgataaacttgtactcttataatgactaaagaggcttaagttcatgatgataaatgtaagcttatgtagatgtcaaatattaaataaatggggattatttctgcttatatattaaatacatgaaaaggaaaaaacctgctgagtatttttcagtgagaaatagtatcatgcctcctttaaggtttctggttagtgattaggtgatataaggggctgccaaggattttgggctgaccaccgtaggagtaaggcggaagatatatcttgatgtacctaccatttttctccattggattacactgtgttatagttatttgcttcttgtatgtctttttactagataataagctcttaaggcataattgtgcttgatactgtttgtgaatagggcaatgtatatatttgattgcatgaagatattcagtattaatattcttattatagagggaagaaacactgaccaatttagaaaataatgattttaattcagttttaatacaatctaaaagtcagttaatttaactgctcttcatatagtcttaatttttaagttccaaaagccatttttgtctaatagataattgcatcatgtttgccaattgaattatattagaaagctcaaatgtgttttcctgcaaaacacacacacacacacacacacacacacacacacacacacacatttccttatcttttatttagggtgatatcaccactctctttgttagtattatgtgaaatgatattgagaaaggacctgaaatctaataatccataaagttctagttatgttgaccattctatagcttcagctatcaacattatgggtgacttatggttatatattcttttcatgaaggctcttctgaatgcaaatgtaatatttaaagttgttcatcagacttgtctaactaggcatcctaccgaagtgtcatgcaggttgaatgtcccttattcaaaatgcttgggagcagaagtgtttcagatttcagatgttttcagattttgcaatatttgtattatattagttgagcatcctaaatccaaaaatatgaaatttgaaatggaacatgagcattttctttgattgtcaagttaacactcaaaaagtttcagattttagaacattgggattttcaggtttgggatcttcagtctgttgtaaatatgtctgaagacaaattaataatctcctctaagtactccgtaaattctcaagttgttccatatttaagtaaagctaccatcatttttctttttttaaaatcttggtatgttttcttcctcacatctcatattcaatcagttatcaattacttgattaatgtctccattatattttcttatttcagcagacctggaaggtatatatatcccatattttaaatatctcctaaaatatatcttcagttgtaatcttaatgatgccatctatcaaatggaaattgtttatgtcctacatacccaacactgttattttgagaattaaaagataggtgtgaacatatggcaagaacagagtataaatgcaagcacagtgattaactcaaaactcttgtttgccagtgacagaagccaaatgctaactggtttcagaaaaaaagaatcaagagtgctggtggttattggctcatgtaatttataaagtacaaaggtagcaatttcttcaagtacagttttggttctcaaatgatatcatcaagggtcattctctctatctacatgttttttgcttgactcttctgtctgggcttttcattttctgggaggttcctctagtggtgatattactgccttcagcagccactgggattgattttcattttctccacaaatccagtggaaggagataatttctcattccttttaatcaaagcaaaaaaaaaaaaaaaaaaacaaaacacccagatttgagtgtcattggattggctttgactagcttgccttgtttgacatggcaattctgaaacaatcactatatccaaaagtatttggtggcgattgactagataatttgttgatgttgcatgacaagccctggaacacagaatgaaatttagaggggaaaggtgattccacaattgacatattggtgatattgataaaagaaggcagagatagatgaggtgtcaaaataatgaatgttccatataggtaataatattattatcaccattaattttaaaagtcagaattctttattatatttaaatcataaacattgatatactgaaatataatgcatgtatctttatttcttattttaaatgattttttacctacttaattttattttatgttatttgttctgggtgtgctattgagaggcagtataacacagtggttaggaatccaggcattgggcagattctttccccccaacccccaccaattttcttaacccctgggcactgtggcttgcacctatactcccagatactcacaaggctgaggggaaaggatcatttgaacccaggattttgaggctgcagagagctatgaccatgccactgccttactccagcttgggtgacaaagcaagactgtctctaaaagaaataataaataaataaagcttcttaaccttagtttatttgtttctttttaatatgggagatactttacctcataatgcaatgcctaaaacataatagagatgcaagaacatataaattttgtaatttttttgcaacaaatatatttgttaaatagccacatcaactgtttataaatggtgttactaatgcccttatgatatcagttttgtgtattttggatttcccataagaaaaaaaaaatactagatagggctggacgtggtgactcacacctgtaatcccgcactttgggaggccgaggcgggcggatcacttgaggtcaggagtttgagaccagcctggctaacatggtgaaaccctgtctctactaaaaatacaaaaaaattagccaggcatggtggcagtcacctgtaatcccagctacttgcaaggctgaggcaggagaaccacttgaacctgggaggcagaggttgcagtgagctaagattgtgtcactgcactccagtctgggtgacaagagcaaaacgccatctcaaaaaaaaaaatagtagacataaaataatcacccgccaatataatactaatgctgaaagttgagacactgtctttggataacaaatatttctttttaattttggatggaattacttctttaagtaaattttccccttgaattttacagtcttcacatataaattcataaatcattgagtctttgaaatataggattcatagagtcatctgattcagaacccagtaaattcattgctaagaataactgaaatagtcatctcagaatatgtaagattgtacataagaaagaatatgtaatatataattacatcactttagaaggtaagaaacattttatgactgagatatttgtattatctaaccaatgtttagttatattctgatgataaatattttacttttgactttttttattaaatattctcatgtatttattagtttttagacatttgataaggagaaacaagaattaggaactcctactaggaatgaagtataaatttttcagcatagcaggtgatagggagaaactaactaaatcgttaagaaggaaagctacattgctcattacagtggcggaggaccagagctttccacttcctgcaatatctaaaattcatcttaattcagaaaacaaaggtggggattttacttcacttctgagtttagtttggtatgtaactcagaataccatagaaaggataaactttttaaaaaatagaataatctatgtaatccaaaaagagtgtacaattttcaaatatttaatcataagcatagaatgctggggtcaaagctttgagagtgactgttcacaatagcagagtcatgaaatcaacctaagtgccctcaacagatggttggataaagaaaatgtggtatatatacaccataaaaaagagtgaaatcatgtcttttcagcaacgtggatggagctggaggtcattatcctaagtgaaataactcagaaaatcaaataccacatatccatacgtaataattgggagctaaataatgggcacacatggacatacagaggggaattataaatttataaaaatcctactgttaaaagtataaccaagtatccagctacactcagcatgttcctcaaaactctacatttctcaagtcagttctatgtaaatgagcatttcatgaaatgtacatagaactcaaactctgaagagaatgaaagaataaccatgattggctttggattatattttgtattaatacttttttagaaatgtgcttgttgaaatgcaaatattctgtacataccataactcaatgtctgaatgaagggatttttgtgaccattgtaaagttagaaatgcagaggtaaaagaaaaattattctattacttctttgtccatttccacatttttatattattttatataaataaatctaaccttaggaatagatttgatttattgtttactcttgcatagatgaagcattacttaaacatattgtcattctctccaagtttcaatacctctttgtaatgcttcagtttcttgtcatgaagtaggttctgtaagctccttctgaaaggtaacagacattatcatttagtacaaacgtctcatttttaaagaattgctaacactaacctattttattcttagagggtacttaacacacaggcttaaagttttgtcagctctgtttgtttatttatctgaatgaatagtatatgttagatttggaacagttaagtactctctctaaggtcacctctttagactctctaaagttgttacacaaactctgtggttatattggagacatatcaaagaataatattactagctgatctccaattttcctttaacaatcttcaggagaacatatttatttatgcttttaggcagatatttatttgttaatttatcaaaaataggtaattcttcagtgtctgctttgtttttggcactctgcatagtgctaggggttttgtgttgaaaagcaggtgaaatcccttctgtactaaaaatacaaaaattagctgggcgtggtggcgcacgcctatagttccagctacttgagaggctgaggcaggagaatcacttgaacctgggaggtggaggttgcagtgagccgagattgcgccactgcactccagcctggtgacagagcaagattccctctcaaaaaaaaaaaaaaaatgcaaaagtgtagctgtggctataatgtagatgtgtatctcattataagggctgtagtaagaagttgtaacatagccaaggaggtcaggtaaaacgtccctgaggaggtgactctcgagctaacatccacaggctattagttaactaactgaaaaaacaaaatagcttcttaaagtgttctgtgatggatgggagtgtggagaaattgaaggaaggctcgtgggaggaaaaggaagccaaatcatgttagcagggccaagtgacatggttagatttgccttttgaaaactttctctttgtttgttatagagaacgaattagatgtggttggggtaatggtgaaatggagccgacttgggagagccaatttgatagcagttctccccagctctagattcagtgatttcacagtgaaagtttgaaatcagccatggtgggtgtatttacatcatagcattgggaaattctataaatgaggactttcctcctcccctggagagctagttaaatatttatcagcacattagtaaatggaggatagactgagtggctacagtgagaacatttaggtgattgctgatagtagcttgcactaggttgctggcattgggagtggagaaatgtgaaaagagaactgtgtcaatatgtatttatgaaccttggcaagttaaatatagttattaaactaataacttataatacattactaagtatttgcaataaggatgaaaatgagaaattatctttattactaattgtaattatgttaaatatataatattgtggaaatcctaacatgttatcttgaattagtaatagtttaatgaatggagagtcatgatattcttttaatttatgttgagtattatatcagttgaactataagtgtaacatgcacacacacacacacataaatgcactttgcataaaattcctgtctgaatcattgtcattgattttcactgaaaatgtccacaatataagtaaattccacttaggttcttatgtaaattcttatgattctttactaacaattttccttcatttaccctccatcacttcgtgccttcaaattcttccatttaaaaaattcaatactgaggcatggctaggataaatatcaggataatactatgattaggaaacagccttcttcctcatgcaggcattcaaaagaaacggctagtgtttcatgattttggtcaattcaagggtggaagcagcatctgaggagatcagtgaggagataagatttccatggtgaaagctgttgcctaaatataggtctcttccacagcttttggaggaagttagggatgggaggagaaactttctaacctcaagtctatagtggattttcagaagaatcattcagtgcttcaaatgtgttctctgcagttggaagcacaagggacagatgtggattcatgcctgagaaacttaagcagactgcccagaaaacctcgagggtgaaaaatcgctggccagctgtgaaagcagcaccatctaggactctagagttagtcagggaggctgtagtgtttttgtgaattatctggaggatgaggatacccccataaagaggggcaaaggactctcatgcacccatgactagggaactacagaatactggcccagaaggagacctttgaaaagatcacttgtgggccaatttgctagtctctaaagccaattaaatctccttaaagctcctctgaccgagtaccactacccgctacctttcaccctggtagcaggaatgcattagctgtaccactgaggaagtttaatcttcaggggtcagctttacaatgggccccacataaagccctagaagcaatcctggaaatttttccttcttttctcgtgtgtgtgtgtgtgtgtgtgtgtatgtgtgtgtgtgtgggtgtgtgtgtatgtgttttgagatccctccagatttcataaacttcagggctcacataacctggatttatccctttgtaccatcgcctttagatctgggcactcaggattcttgccttaggccctgcatgtgagagaactgtgtcacatcccttctccagctgctccgccttacataagatgcatttcctgaaagccaacagctcccaccactaggagactatgccttcaccactcactctgtccagaaatcgctgctcaaatggccctaggtcctaccctctggaggaccacataacgcacaacccatgggctgcggaggaacagtcaatcactggtagtggtggacagagcttagagggtcggtgggggcattcacctttctgactgccaggccttggtggaaaggcagccggctagatgttttgtcaactatgctgtattactggtaccttgtgaaaggactgattgccatcaatcttctgtatttttttttatcatctctattcaaccttttggaaagatatgagctcattattcgctggtttatatatattgaaaaaaactaaagaaggttttcaaacgtcaagaaccaatagattttaatatgaaaaataagaatgtttaaaaattcccagagaaactgctgcccttgattgacagtgttgttattttatctctctgctgtttattgctccttagtgagtcataatatttggtcccttgtgcagttaccctgtcaaggcaagaaatcctattgtaacgtttgcatctagtttgacaacccttctttgtacattgagcacacaaatgctatttttcagataagttgggacaacccgataatatgactgaagtgttttagctcaccagtgcagtacagttatcactgtactctttatagagtactataaatacagatttgtcagatcactgaaaaagattgcaggtgcatcaccattgttttgaaagtagctcttatgtgtgcagaaaaagcatggtgccaactttcaattccccgtgctaacctcatcccatgaaaaaaatcgatttgcaaatatataagatattttatttgaatgtgttctataatttaggttttagtataagtcttctagtaatactataaataaatgctatataatccaatattgattttctacttttccccttccaggggagactgactagcagaaaaagcagaaactttgaaatctgaaacatctcatctctatttggcagttagatgacatggagcaaggagcgggtactactgttattgaagtcaagtattcttatatatataataaagacaatagcacctgctttgtaaggtcattgtgaaagtattcaattttcaaagtaaagcaggtagaatcatgctgggcaccaagaggaagcacaataaaaattaccagatttaatatctcttgaatgaggaagttgggcataagaataagggattggatctctaagaatacataatgttctgtggcatttatgcttttagatatttcctcaaatttgcctattcacaatatgtgattatttgcccatttttaaaagaaagtattatcttttttttcctctggtatattaagcccttttacaacaaatgtttcctggttttttttttatcttctattttacttagaatagcaataactagtaggtactcaaaaaatacctgagaattggttaatttttatttacttttgaggtaaaacacattttcttttatttcgaaggtagaaccaaccatgatagttgtccaacattatcaaatttttaaaaattagatatgaatagagcatatttactgttaatattttaatattaacatatttaacatttgaataattaatattgaaaatatcacagggaattaaaacagcaattttgtcatcagtattgaaaagaaagatctgaaaacttgaagtctagaaacctgattgccagccctggaaaagtgctatgttttgctgcatgctaattctcttaactgtgaaacaaacattagcaacacagtgaaattctaatgagcaaaagtctgggaatgcctgttgtaaaatgtgaagtagcataccttacttctttgttttataggggtatctaaaataaacattcattaatatttttaattctttgagttaaagggttcccctgattgatggaaaaatcaaagtacttgtagacagattgattcctgtctgtttctataatatttgaacacctctattatagtactcattagacagaattacaattgcctatattcttcattctctctcactagatattaaagacaggtattttttgaaggacagatgtttctatcattttctttttgaaatattgtgtgtgtaggatgaaattttacattgtaagcataattacgtgttgaatatataaattagggttgtaaactattgtttaaatctagtctttaaaataataaattggtttattcagtaacacttaaatgtatttaatattaggcaccatactgtaatctaagctttgcaaacacgtatccatttaatcttcccaacaagattatatgttgttattatctgcaagctacaggtcagacaacaaaggcacatggagattaagtaacttgtccaggatgacaatttaaaaaaagaataaattgtactttctttctttcttttttttttttttttttatttttttggagatggagtcttgctgtgttgcccaggctggagttcagtggcgcaatctcggctcactgcaacctccacctcccaggttcaagcaattctcctgcctcagcctactgagtagctgggattataggcacgtgccaccacactcggctaatttttgtatttttagtatagacgaggtttcaccatgttagtcaggctggtcttgaactcctgacctcgtgatctgcctgcctcagcctcccaaagtgctaggattacaggtgtgagcccccacgcgggcctgtactttcttttaaattactttaattactaaatttagaatctgacacactgtgaaatcattcttttttttttcaaatgcagttctttttgtagtcttttgtaatctaaaaaatatgaatgtcattataagcaaataatgcttaagatgattagcatttataaatcaacataatataaaggaagaatataagtaacaaaattcttcactgatgattatcacaatcagtacctcttcatttatgtgtatgtttttctctcaaatgagccaggaggaaaactttttttcatgcttctgttctacttagtgtcattagtgtcattattcattttactagctatttctttttcgtctttttatactttaagttttagggtacatgtgcacaatgtgcaggtttgttacatatatacatgtgccatgttggtgtgctgcacccattaactcatcatttacattaggtatatctcctaatgctatccctccccgctccccccaccccacaacaggccctggtgagtaatgttccccttcctctgtccatgtgtactcattgatcaattcccacctataagtgagaatatgcggtgtttggttttttgtccttgcgatagtttgctgagaatgatggctgccagcttcatccatgtccctacaaaggacatgaactcatccttttttatggctgtatagtattctacggtgtatatgtgccacatttacttaatccagtctatcattgttggacatttgggttgggtccaagtctttgctattgtgaatagtgccgcaataaacatacgtgtgcatgtgtctttatagcagcatgatttataatcctttggatatatacccagtaatgggatggctgggtcaaatggtatttctagttccagatccctgaagaatcgccacaccaatttccacaattgttgaactagtttacagtcccaccaacagtgtcaaagtgttcctatttctccacatcctctccagcacctgttgtttcctgactttttaatgattgccattctaactggtgtgagatggtatctcattgtggttttgattgacatttctctgatggccagtgatgatgagcattttttcatgtgttttttggctgcataaatgtcttcttttaagaattgtctgttcatatccttcgaccactttttgatggggttgtttgtttttttcttgtaaatttgtttgagtttattgtagattctggatattagccctttgtcacataaataggttgcaaaaattttctcccattctgtaggttgcctgttcattctgacggtggtttcttttgctgtgcagaaactctttagcttaattagatcccatttgtcacttttggcttttgtttccattgcttttggtgttttagacatgaagtccttgcccatgcctacatcctgaatggtattgcctaggttttcttctagggtttttatggttttaggtctaacatttaagtctttcatccatcttgaattaatttttgtataaggtgtaaggaaggcatccactttcaactttctccatgtggcgaggcagttttcccagcaccatttattgaatagggaatcctttccccattgcttgtttttgtcaggtttgtcaaagatcagatggttgcatatgtgtgggattatttctgagggctctgttctgttctattggtctatatctctgttttggtaccagtaccatgctgttttggttactgtagccttgtagtatagtttgaagtcaggtagcatgatgcctccagctttgttcttttggcttaggattgacgtggcaatgcgggctcttttttggttccataggaactttaaagtagttttttccaattctgtgaagaaagtcagtggtagcttgatggggatggcattgaatctataaattagtttgggcagtatggccattttcacgatattgattcttcctatccatgagtatggaatgttcttccatttgtttgtgtcctcttttatttccttgagcagtggtttgaagttctcgttgaagaggtccttcacatcccttgtaagttggattcctaggtattttattctcattgaagcaattatgaatgggagttcactcatgatttggctctctgttattggtgcataagaatgcttgtgatttttgcacattgattttgtatcctgagactttgctgaagtttcttatcagcttatggagattttgggctgagacaatggggttttctagatatacaatcatgtcatctgcaaacagggacaatttgacttcctcttttcctaattgaataccctctatttccttctcctgcctgattgccctggccagaacttccaacactatgctgaataggagtggtaagagagggcatccttgtcttgtgccagttttcaaagggaatgcttccagtttttgtccattcagtatgatatggctgtgggtttgtcatagaaagcgcttattattttgagatatgtcccatcaatacttaatttattgagagtttttagcacgaagtgttgttgaattttgtcaaaagccttttctgcatctattgagataatcatgtggtttttgtcattggttctgtttatatgctggattacgtttattgattttcgtatgttgaagcagccttgcatcccagggatgaagcccacttgatcatggtggataagctttttgatgtgttgctggattcggtttgccagtattttattgaggatttttgcattaatgttcatcaaggatattggtctaaaattctcttttttttgttgcatctctgccaggctttggtatcaggatgatggttgcctcataaaacgagttagggaggattccctctttttctattgattggaatagtttcagaaggaatggtaccagctgctccttgtacctctggtagaattcggctgtgaatccatctggtcctggactttttttggttggtaagctattaattatagcctcaatttcaaagcctgttattagtctattcagagattcaacttcttcctggttgagatttgggagagtgtgtgtgttgagcaatttatccatttcttctagattttctagtttatttgtgtagaggtgtttctagtattctctgatggtagtttatatttctgtgggatcggtggtgatatcccctttttcattttttattgcatctatttgattcttctctcatttcttctttattagtcttgctagtggtctatcaattttgttgatcttttcaaaaaaccagctcctggattcattgattttttgaagggctttttgtgtctctatttccttcagttctgctctgatcttagttatttcttgccttctgctagcttttgaatgtgtttgctcttgcttctctagttgttttaattgtgatgttagggtgtcaattttagatctttcctgctttctcttgtgggcatttagtgctatacatttctctctacacactgctttgaatgtgtcccagagattctggtatgttgtgtctttgttcttgttggtttcaaagaacatctttatttctgccttcattttgttatgtacccagtagtcattcaggagcaggttgttcagtttccatgtagttgagcggttttgagtgagtttcttaatcctgagttctagtttgattgcactgtgatctgagagacagtttgttatactttctgttcttttacatttgctgaggagtgctttacttccaagtatgtggtcagttttggaacaggtgtggtgtggtgctgaaaagaatgtatattctgttgatttggggtggagagttctgtagatgtctattaggtctgcttggtgcagaactgacttcaattcctggatatccttgttaactttctgtttcattgatctgtctgatgttgacagtggggtgttaaagtctcccattactattgtgtgggagtctaagtcactttgtaggtcactaagtacttgctttatgaatctgagtgctcctgtattgggtgcatatatatttaggatagttagttcttcttgttgaattgatccctttaccattatgtaatggccttctttgtctctcttgatctttgttggtttaaagtctgttttatccgagactaggattgcaacccctgcctttttttgttttccgtttgcttggcagatcttcctccatccctttattttgagcctatgtgtgtctctgcacatgagatgggtctcctgaatacagcacactaatgggtcttgactctttatccaatttgccagtctgtgtcttttcattggagcatttagtccacatacatttaaggttagtattgtcatgtgtgaatttgatcctgtcattatgatgttacctgattgttttgcttgttagttgatgcagtttcttcctagccttgatggtctttacaatttagcatgtttttgcagtggctggtaccggttgttcctttccatgtttagtgcttccttcaggaggtctttcagggcaggcctggtggtgacagaatctctcagcatttgcttgtctgtaaagtattttatttctccttcacttatgaagcttagtttggctggatatgaaattctgagttgaaaattcttttctttaagaatgttgaatattggcccccactctcttctggcttgtagagtttctgctgagagatcagctgttagtgtgatgggcttccctttgtggataacccaacctttctctctggctgcccttaacattttttccttcatttcaacattggtgaatctgacaattatgtatcttggagttgctcttcttgtggagtatctttgtggcattctctgtattcactgaatgtgaatgttggcctgccttgctagattggggaagttgtcctggataatatcctgcagagtgttttccaacttggttccattctccccatcactttcaggtacaccaattagacgtagatttggtcttttcacatagtcacatatttcttggaggctttgttcgtttctttttattcttttttctctaaacttctcttcacgcttcatttcattcatttcatcttccatcactggtaccctttcttccagttgatcgcatcggttactgaggcttgtgcattcatcacgtagttctcgtgcgtggtttttggctccatgaggtcctttaaggacttctctgtgtttgttattctagttatccattcatctaattttttttcaaagtttttaacttatttgccattggttcgaacttcctcctttagctcggagtagtttgatcttctgaagccttgttctctcaactcatcaaagtcattctccatccagctttattccattgctggtgaggagctgtgttcctttggaggaggagaggtgctttgatttttagagtttctggtttttctgctctgttttttccccatctttgtggttttatctacttttggtctttgatgatggtgacatacagacgggtttttggtgtggatgtcctttctgtttgttagttttccttctaacagtcaggaccctcagctgcaggtctgttggagtttactggaggtccactccagaccctgtttgcctgggtatcagcagcggtggctgcagaacagtggatattggtgaaccgcaaatgctgctccctgatggttcctctggaagttttgtctcagaggagtacctggccggctgtgtgatatgtcaatctgcccctactggggggttcctcccagttaggctactcgggggttagggaccctcttgaggagacagtctgctcattctcagatctcaagctgtgtgctgggagaaccactactctcttgaaagctgtcagacagggacatttaagtctgcagaggttattgctgtcttttgtttgtctgtgcccagcccctagaggtggaggctatggggcaggcaggcctccttgagctgtggtgggctccatccagttcgagcttcccagccactttgtttacctgctctagcctgagcaatggcgggcgcccctcccccagccttgctgccaccttgcagtttgatctcagactgctgtgctagcaatgagcgaggctctgtgggcgtaggaccctctgagccagttgcgggatataatctcctggtgtgccctttgttaagcccgttggaagagcgcagtattagggtgggagtgacccaattttccaggtgctgtctgtcacccgtttctttgactaggaaagtgaattccctgacccgttgcacttcccaggtgagtcgatgcctcgctctgcttcggttcacgcacggtgcgctgcacccactgtcctgcacccactgtctggcactcccccgtgagatgaacctggtacctcacttggaaatgcagaaatcaactgtattctgtgtcactcacgctgggagctgcagactggagctgttcctattcggccatcttggctccaccccccccccccaatttaacttttatttaaagtttaggggtacatgtgcagttttgttatgtaggtaaacatataccatatacctatgtgtcatgggggtttgtgatacaggttatttcatcacccaggtattaagcctagtactcattagtgatttttcctgatcctttcctttcttccaccctccagtctctgataagccccagtgtgtgttgttcccctctatgtatccatgtgttcttatcatttagttcccacttgtaagggagaaaatacagtatgtggttttctgatcctctgttagtttgctaaggataattatctccagctccatgcacattcctgcaaaagacatgatgtttttattttttgttttgttttgtttttttaatggctacgtatatactggctaacttctattcatcttttgttttgaaaagtcacttcttcaactcagaggactctgtcatgtggtctacattctgcaaatttcttttaccttatttaccacagaaacaaatatggaacctaatcaacaattgtagatgttcacaaatcagaggtcctttattgtttcacttttccttgatagtcaaataaaacattcatgggctttgattccaagaactgtgttaagtacagtggtccccactcccacccctcaatctaggaaaattataatcaattcttttcctcctggttgcatcttttcccaatattctcttttgcttaaattcttgatctatctggactattttttaacctcttatgtataggttccatgacattattgtccttaagttccattaaagtcctgacatggactgcttctctcttgctataattttcctcagtcttctatcaggacccttcttcacttttctacatttaccccttgagtgcctcatagtcacttcaaagttgctacttgaaaacacattgtggcaagtagtggtggttgtctacacagttttcagctttcttgaagtaaatgctttctgttttgggatcagcaatgcacttgccacaggtgatgaatcatgtctggtctaaaacttcactagtcatgaaaacctcatttctactttctaggtttttgtcttcaggtgggtatctgagtcagttatggacaaagagacataataggaagtcagccaagggcttccaagaaatattttcctcttgatacatagataaaaactgctttttttgcctcgttctctcccttatgatttgggttttgtctatgaagactgtataattgggcctagagcaccaatcttgagactggaagactgcatgtattgaagtaaacagtaagctgaaaagaaagccagtccaacttttagctactagactttatgctagctaaataacaataaatgtctgtctttctctctatatatattttgagacaaagtcttgctctgttgcccaggctggagtgcaaaggcaggatctcggcttactgcaacccctgcctcctgggttcaagcaattctcctgcctcagccttctgagtagctgggattacaggggcccaccaccatgcccagctaatttttgtatttttagtagagatgaggtttcacaatgttggccaggctggtctcgaactcctgacctcaggtgatccacctgccttggccttccaaagtgctgggattacaggcgtgagccactggtcccggccgtctctattttttaatacctctttacaggatattctgttatgtaataatcaacacagccagaattcctgcttattttcttgaacagagcaacttaacttttgtttttagttgtctgacttagatcatgcacagaaggtcatctcattaagcaacagaatatatatgtcactttgagacaatcataagtgcacttccctgacaattttaatgtacagtagtcattttatctctctgtacataatattcctttctatcatatacttgtttgttcagtatttatcatataggttttcaaatttgatgaaagcagggattgttccccttatgcatgggtgcgtttgcaggtctttgcacaacaccagattctaaaagggcctcaataagcatgtatggaataaacagctgaaagaatgaatatttaatctagtgtttctttgtttgtttgtttgtttgacacgaagtcttgttctgtcactaggctggagtgcagtggcacaatctcggctcactgcaacctgcgcctctgggttcaagcgattctgcctcagcctctggagtagctgaaactacaggcacaagccactatgcccggctaatttttgtatttttagtagagatggagtttcaccatgttggccaggctgttctccatctcttgacctagtgatctgcccaccttggcttcccaaagtgctgtgattacaggcatgagccaccgcacctggcttaatctagtgttttaatgagttgcagtggagaagtcaacacttagtagattgtcttcttataaggattgccatttgaacagtcttgaatgttcagaatagttcataacccagaagaaatggggaaaattagaccttcagagatagcatgttccctgttcctgattcatcaattgtgaggaaatttaaaatgagtgtctggactacatgattgtttaagtcctctctatttttattttattttattttatttatttattttgagacggagtctcgctctgttgcccaggctggagtacagtggcgtgatctcagcacactgcaagctccgcctcggcctccatggttcacaccattctcctgcttcagcctcccgagtagctgggactacaggcacccaccaccacacccagctaatttttgtatttttagtagagatggggtttcaccatgttggccaggctgatttcaaactcctgacctcaggtgatccgccccactcggcctcccaaagtgctgagattacaagggtgagccactgcaccaggcgacgtcctctctattttaatatatttcaatcaagaaagcctcatacatctaaagataatatgtattaataaaagccctctaagtatgaatctagtaaatgtggagaccaaaattgcataagaaataatgagaaaaggtttaaatggtgggaaatgagacaacatgaaaataatttgtttagccttacattttacaaaacttagggtataattgcaatgtttgaaaggtacaaaatagaatgctcgctctgaacatatgacatctgtcacttcaattgtatataatgatgttaaagagggtaattttcataagattatacaaggatattgttgattttccctgaagtcttttagaaccatcaattaatgtaacaattatatttttaagcaccttgtgcagaggagagggataggcatgtcaggagaggtttgaggagggattaattttgtaggtagtcagttcactagtgaatattttattgtatggaaaattttacttctctacacagaatcataaatataacaacttggataatacataccagaataatgagactgccttgtactttactgagtttgggattaataattaatactatgggtagacagttttccaaattcatgattaagttttctctgataacaaaagccatttttcaacttttatttctttcaagaagcatacccttgattaatgtttcagtatatcctacagggtcattaacaccagtgtaccagaggaagatgaagagaaaatatttctgcatagagaaatggtatatgacctcaagtattaaaaatgaattctagtatcttagataccaatcttataagtgaaaatcctcttttgagctgcaaaagagaactagtgtgctattttaagatatacccctttaaaacagttttagggagtatataggactggggtaaagaacagagtcttgggagtcagcattcttatatcaattgagtttgctaatcttgggcaaagagggaaattattaataggtagtacgtcacttctaaattctttttttaatttttatttattatacttcaagtgctagggtacatgtgcacaatgtgcaggtttgttacatatgtatacatgcaccatgttggtgtgctgcacccattaactcgtcatttacattaggtatatttcctaacgatatccatcctccctccacccaaccccatgacaggccctagtgtgtgatgttccccttcctgtgtccaggtgttctcattgtttaattcccacctatgagtgagaacatgcggtgtttgtttttttgtccttgcgatagtttgctgagaatgatggtttccagcttcattcatgtccctacaaaggacatgaactcatccatttttatggctgcatagtattccatggtgtatatgtggcacattttcttaatccagtctatcattgttggacatttgggttggttccaagtctttgctattttgaatagtgccgcaataaacatacgtgtgcatgtgtctttatagcagcttgatttataatcctttgggtatatacccagtaattggattgctgggtcaaatggtatttctagttcgatatccctgaggaatcaccacactgtcttccacaatggttgaaccagtttacagtcccaccaacagtgtcaaagtgttcctatttctccacatcctctccagcacctgttgtttcctgactttttaatgattgccattctaactggtgtgagatggtatctcattatggttttgatttgcatatctctgatggtcggtgatgatgagcattttttcatgtgtcttttggctgcataaatgtcttcttttaagaagtgtctgttcatatccttcacccactttttgatggggttgtttgtttttttcttgtaaatttgtttgagttcattgtagattctggatattagccctttgtgagatgagtagattgcaaaaattttctcccattctgtaggttgcctgttcattctgatggtagtttcctttgctgtgcagaagctctttagtttaattagatcccatttgccaattttagcttttgttgccattgcttttggtgtttatacatgaagtccttgcccatgcctatgtcctgaatggtattgcctaggttttcttgtagggattttatggttttatgtctaacatgtaagtctttaatccatcttaaattaatttttatataaggtttaaggaagggatccagtttcagctttctacatatggctagctagttttcccagcaccattttttaaatagggaatcctttccctatttcttgtttttgtcaggtttgtcaaagatcagatggttgcagatgtgtggtattatttctgaggcctctgttctgttccattggtctatagctctgttttggtaccagtaccatgctgttttggttactatagccttgtagtatagtttgaagtgaggtagcataatgcctccagctttgttcttttggcttaggattgtcttggcaatgcgggccctttttggttccataggaactttaaagtagttttttccaattctgtgaagaaagtcattggtagcttgatgggaatgccattgaaactataaattaccttgggcagtatggccattttcacgatattgattcttcctatccatgagtatggaatgttcttccattttttgtgtcgtcttgtttccttgagcagtggtttgaagttctccttgaagaggtccttcacatccctcataagttggattcctaggtattttattctctttgaagcaattgtgaatgggagttcactcatgatttggctctctgttggtctgctattggtgtataagaatgcttgtgattttcgcacattgattttatatcctgagactgctgaatttgcttatcagcttaaggagattttggcctgagacgatggggttttctaaatatacaatcatgttgtctgcaaacagggacaatttgacttcctcttttcctaattgaataccctttatttctttctcctgcctgattgccctggccagaacttccaacactatgttgaataggagtggtgagagagggcatccctgtcttgtgccagttttcaaagggagtaggtccagtttttggccattcagtatgatattggctctgggtttgccataaatagctcttattattttgagagacgtcccaccaatacctaatttattgagcgtttttagcatgaagtgttgttgaattttgtcaaaggccttttctgcatctattgagataatcatgtggtttttgtctttggttctgtttatatgctggattaagtttattgatttgcatatgttgaaccagccttgcatcccagggatgaagcccacttgataatggttgataagctttttgatgtgctgctggatttggtttgccagtattttattgaggatttttgcatcgatgttcattagggatattggtctcaaattctctttttttgttgtgtctctgccaggctttggtatccggatgatgctggcctcataaaatgagttagggaggattccctctttttctagtgattggaatagtttcagaaggaatggtgccagctcctccttgtacctctggtagaatttgggtgtgaatctgtctggtcctggactttttttggttggtaggctgttaattattgcctcaatttcagagcctgttattggtctgttcagggattcaacttcttcctggtttagtcttgggagagtgtatgtgtccaggaatttatccattttttctagattttctagttggtttgcatagaggtgtttatagtattctctaatagtagtttgtatatctgtgggattggtggttatatcccctttagcatcttttattgcatccatttgattcttctctcttttcttctttattagtctggctaggagactatcaattttgttgatcttttcaaaaaaccagctcctggattcattgatttttttgaagggctttttgtgtctctatctccttcagttgtgctctgatcttagttatttcttgccttctgttagcttttgaatgtgtttactcttgcttctctagttgctttaattgtgatgttagggtgtcaattttagatctttcctgctttctcttgtgggcatttagtgctataagtttccctctacacactgctttaaatgtgtcccagagattctgatatgttgagtctttgttctcattggtttcaaagaacatctttatttctgccttcattttgttatgtacccagtagtcattcaggagcaggttgttcagtttccatgtagctgagcagttttgagtgagtttcttaatcctgagttctagttttattgcactgtgatctgagagatagtttgttaaagcttctattcttttacatttgctgaggagtgctttacttccaactaggcttcagaagatcaaacttctccgagctaaaggaggaagttcgaaccctttgaaaagaagataaaaaccttgaaaaaagattagacaaatggctaactggaataaccactgtagagaagtccttaaattacctgatggagctgaaaaacatggcacgagaactacgtgatgaatgcacaagcttcagtagccgattccatcaactggaagaaagggtatcagtgattgaagatcaagtgaatgaaatgaagtgagaagacaagtttagagaaaaaagagtaaaaagaaatgaacaaagcctccaagaaatatggaactatgtgaaaagaccaaatctacatctgattgttgtacctgaaagtgatggggagaatggaaccaagttggaaaactctctgcaggatattatacaggaaaacttccccagcctagaaaggcaggccaacattcaagttcaggaaatacagagatgccacaaagatactcctcgagaagagcaactccaatacacataatggtcagattcaccaaagttgaaatgaaggaaaaaatgttaagggcagccagagagaaaggtcgggttacccacaaagggaagcccatcagactaacagctgatctcttgctagaaactctacaagccagaagagagtgggatccaatattcaacattcttaaagaaaaaataattttccacccagaatttcatatccagccaaactaagcttcataagtgaaggagaaataaaatcctttacagacaagcaaatgctgagagattttgtcaccaccgctcctgccctaaaagagctcctgaaggaagcactaaacatggaaaggaacaaccggtaccagctactgcaaaaacatgctaaattgtaaagaccatcaaggctaggaagaaactgcctcagctaatgagcaaaataatccgctaacatcataatgacaggatcaaattcacacataacaataaattaaccttaaatgtaaatgggctaaatgctccaattaaaagacagactggcaattggataaagagtcaagacccatcagtgtgctgtattcaggagacccatctcatgtgcagagacacacataggctcaaaataaagggatggaggaagatctgccaagcaaacggaaaacaaaaaaaggcaggggttgcaatcctagtcttggataaaacagactttaaaccgacaaaggtcaaaagagacaaagaaggccattacataatggtaaagggatcaattccacaagaagagctaactatcctaaatatatatgcacccaatacaggagcacccagattcataaagcaagtacttagtgaccgacaaagagacttagactcccacacaataataatgggagactttaacatcccactgtcaacattagacagatccacgagacagaaagttagcgaggatatccaggaattgaagtcagctctgcaccaagcagacctaatagacatctacagaactctccaccccaaatcaacagaatatacattcttctcagcaccacatcacacttattccaaaactgactacatatttggaagtaaagcactcctaaattcttgttctatctcatgagagtttggtcacctttgaaatttgaacaaactacaaaatttctttgaatctcagggatttatccttttggaaatttatgcccagtttgtagacttcattagagggataaaaacaaatgtctgcaacgtatctggtatagttggtgctcagtaattttattgaagactacctattttttgcaaataaaagttaaaataaaattctattactaaatcaactccctataccctaacacctatggtcctaagtccaacatatacacttttacaacagttcacgccatagacaggaaatggatatcctggggtagattttttttttccttcaaaatactagtctttttcagctcctcgtacagctttgttgatgcctatatcccttgttttggttactgaccctgggtctccttgcctgggcacctgatttctgtagcttctgttcattcacattcatttcagatgctcttataatttctagttcctaatcttaatctagcttcaacattgccctgcttgcaaatttactaccttttaaaatgacttgaatcttctctattttcacagttcttgtctattttttccctgtaacagtttgtatgaacactaatgtggtgttcaaccctccctttcaattttagagaattggattctatattggaacgtcacttaaatttttgagtcctcaaaaccaaccttgttgaaatggttaataactttgtgaagcatgttgtgactagagaatagtgctttaaaagctataaggattagtgttgttatgaatttgacatgcattaacatgaccattgttaatggacagcttggtacttaatctcccaggttggttaatttatttagacttttgcctacttactttagaaatggatgtctagccatctgctaggcaattacagcttagctgcattgacatctgctttccttcattcttatagacgactgggtgcttgaaaaggcaaatatataaataacttctccaaaataaacagtactctaaaatataatacaattaattacatttgtgcttaaagatgcccactaatttttatatggatacttaaagaaattgcaagtaattataatagaaatgaacaatgatttatagattatatcataatgtcatttatttttagtgacagttctgtgaattatagcagagatcatcatcttccataaggagatattaaggatccaatacattaaataagaggcccacatttatacagtttggggttctagattataaatagatatttctataattatcaggcccctgcagcaatgcaatagaatggcagggaggaggaggaggaataatcaaaccactttgcttttaccacagaaagacagtcagacattaaaatgaattaaagtcaattcatgtttttatttagctcaggaaaagcattcatttaaatgacttttgcaaaaatctttttattatggttatttgctcagagtttaaaataaacagaaacctctcaaagaacaaacattacttatttaatagtgtaactttacccgtactggggaacataatttattaatagataacattggttctgagtgattcagcaaaaccacgatggatgccacttgaagtcacaacaattaaagaagcttaacagaatggcctcagtttctatggtgacagttacagaactattcagggatagcatgaaacacataaaatattgtgttcttttcagaaaatgatctgtgacagatttatttaaaaatagaaaatagaaaaaattatactcaaacttatttcactcaataacatctgtatttaggagttagaatttaatataaatacattcagtatggagatttgcctcagagattcacatggaattaaaaccaaaaagtttatcaccagatttcctacatttcactgtttataaaagacaagtaggttttattgtcttagaattgatttgtcctcataaactaggtgtgatttcaattttttcagatatttatggagtcttcaggttaacattgaatgaatgtattgtttattttagttaaacacctctcagtttaatcaactatgattcattcaatcaatattttcctttaaatagattgaaggtaactaaagaaaccttaaagaaaataaaagtcatcggccaggcacagtggctcacgcctgtaattccagcactttgggaggccaaggtgggaggatcatgaggtcaagagatcaagaccatcctggccaacatggtgaaaccccgtctctactaaaaatacaaaaattagctgggtgtggtggctcatgcctgttgtttcagctactcaggagtgctgaggcaggagaatcgcttgaacccaggaggcggaggttgcagtgaaccgagattgtgcctctgcactccagcctggcgatagagcgagactacaaaaaaaaaaaaaaaaaaaaaagaaagagaaagaaataaaggaaataatagtcatcaaatacatagaaggaaagagagaccaagataaatcattatttatttgttatgatttctaaggtaacaatgttgaaatgctaataatcaaagtaacattacaaagttatattttattaaacaacaaacttttaacaacagtactagtcatccacattttgcatggtaccttgttaactgaaaaccaggcatattggaaccatgtccttgctttgatttaattttagttacacagaaccatgcaaaatgagaacatagttctgatacatatgagtttcagttaacatggtactatacaaaaagaagcctgtttgtatttacctgttagataattcctatattatgctatgaagacaaagcaagccagaaccattcatcagtattaatatatatggggtgtatggagagtattttgttctttttttgttattacatcctcctcataactaagaataaaaacacatgtttacaatatattttagctacagaatttttatagtacatcttaaacaatttacttttacaaactatttaaacttgttgtttttaaccttgccagattccacaaaagagaagaagtagctcaatgcaaacatatgtaacgtgataataacctagaaattgaataaagaatatcaatataaagccaaagaagtacactaattactgtatttgttatgcttcactaacgttgcataacaaacagctacacatctcaatggtcactggtctttggaataactgtggttctgttttgcttgtctggattaagctaaagagatgtaacttggctttatctaaaggtgggattcaggtctagtatacctgtctcctaaatctggcatcagcagctattcagggaaggttcttctcatgagggagtgcaggaggacaagagggtgagatggaatcatgaacagtctcttttttttttttttgagatggagtttcgctctttttgcccaggctggagtgcaagttttgatatacttgctataattgagccttaatgtttattttggttctagtaatccccacttatccatgggggataaattccaagatccccagtggatgcctgaaaccattgttcatatcaaatcctatgtatgctatgtttttgcctatacatacatacatagatacttatgataaaatgtaatgtgtaaattaggcacagttggagattgacaacaataatgaataattaaatagaacaataataacaatttactgtaataaaagttatgtgaatatagtctctccctctctttcaaaatatcttattgtttgtaatattttcagactgtgatcgactgtgcagtctgaaactgtgattgactgcgcagaactgaaactgcagaaagcaaaacaaaagataagtgtagactactgtataatgacattaaaaataagctgaaacactgacatttacatagttcttattatgttcagaatattaacattttgataaagtttaagttgagagtatcctcatgaaatctgatacatacaatagacttgaagtataagttacaaagtcttaactgcctcattgtaaattataatggcatgattattccatcaacaattgtttggtttaatattatttcagtgaagacaggtgccatgcattttagatgataaaaattctaagtcttgtctgtgttttccctgaaatgaatcaagggattaatgttttccatgcctcatattctttaagtcttcatattcacatcacaaaaagaattaaatagaaaagaaattctttatatgtgttttaaatacttacaagtcttatattgttttagaggttacaggtattatagagaagtgccacttaacaatttaaatagaggcagaaatgaagacaaagattaaaattaggcatcattttctcataaaacgtgaacagactttttaaaactccacttataagttttaaaaaatctctctgcaattgatgagttgattatgtaataaatattgaagccctaattaattatttggaaatctttatcaataaataagccctatgtttctaaaaatagttatgaaatatatatgtgtgtgtatatgtatgtgtatatgtgtgtgtgtgtgtgtgcatatgtgtgtgtttgtgtgtatttgtatgtgacattttaaggctttattaccatatggctgaatcgatgccctaatttcaaattgttaatttggtactgtcttttaagtgcctactatatgcaaggtacatataccaaatgtatgtcttccaaattcccttgttaaaaatcacctgcctcttactcaggaactaccaagagatctatttcatgtctctatatatgaaatgctgcccttaccaatgctgaagtgtctcccattttctgcctatttaaatttctttgatttcttagcaaaaactgtgcatgtgtaatgaaatttgggacactagttaatggtgcttgaattaaactcttcatttttctttataagcttctcttggtttctggacatgccttgtgattaatatcaatatatatgaattactcaatggttttgtttttatttttttcacactatctatttgcctgagcttgtatgtcttcataaccagttatgaccaaacctgttgttcaaccctggttcataacaatctaaccaaaatggtatcataactccaggagcagaagaatttttgtcagatcttaatgacaattataagcaaggaaaaggataaatgaaattacatgatttctcatgttccatcatagcttgagcttttagggcaccctctaaaagaactatttggactattttgctatgaccaagccatcagttgtttctcctttggggttaattcagaaagcagctaggaataagtttatttcatggaaaaacacaaacatggagggaccaaattagtcatttatggggacaattagattttaaaattgcaattttatacactacataaaatcaaagaagagaaatttaaaagtactgcatctaatgttcctttcttattaatggtgttttctgttccagtcaccattttggctttcttcagagtttgtaatcaataaagaccctggcgtttgaagggcatattattctttttccctttttttcatgctagaaacatcatctctatgagttcatcatgtactcgattaattctcaacagctgctctttaatattattttgaagccccagatagttgatctgtgttttgaattacccacagtgttctaaaatgggcatctatatgtgatttttataatcaggaaaaaataagagtgagaaaaggtcatcatacttgatccacattttttttttttagacagttttgccctatcacccacgctggagtgtagtggtacaatcacagctcactgcaacttccatctcccaggatcaagtgactctggtgcctcagccccctgagtagctggaattacacacgtgtgccaccacgcccagctaatttttctattttaacagagtttggatctcactatgttggccaggctttttttgaactcctggcttcaagtgatctacccgccaactcctcctaaagtgctaggattaccggcgagaaccactgctcccggcccacatcttttgtttaaatcatatttatatcattttacctggaaatagcattacagcatagacttggaagagaagcagccaagaaaacaaacaagcaagaaaacaaacaaacaaataaattaatatttttattataaagtttgaagacctattctggtggcaatgtgctatgtgatttcgaaattatgcccaatataggaaattaacagtagccctgcattgcttcagagttttattatttttctaagtaaaatatatatgatgataataattgggaaacaaaggaaaataaaataaaattctgactaaaaacaaacaaaaaataagattgtttctgaaggagaatatggctctatatattctatataaagaatatatagagcaaacaagtatagtctaacttaatgaagtgttttcactcttgtcattttaattggaaaaaatttattctagaaagtaatatagaaagataataaaatgacatatcgatgaggaatttatccctttgtacctttgctgaccttcattacagattcatttttaaatcattttgttattgatggtaataaatatatttgatattcacaggaatttcacttgaaaaagataaaagatttcatagtagtaatagaatgttggctaagtagctaattattgcatacttaaatttccggtctttaaagtgacaaaaattctagatcttgcaattaacgatattaatatgtgttgacataaaatgagactgtgttgatctaggggtgataaacactgccatttttggaggattatgttttagcaagtaaattgtgtcctttgacttaataataattgcttctcgtttgtctccactcttttcgttttgcttcgactgtccacaacaaccagctttgtcctctagaagcattttaattttatctatgacagttcaactgttactctctatgctcacagtgggaaaatgtcagtggaaaaatatcagtataaatatgatttttgtaagatgcaaacattttgaaaatataatctatatgcccacttgtcatgtgtttctaagctgtactatgttgttgtggaaaacattggaaatttattttttaaagtcgcctagcagatgaaggaaacacaattaagatgatcttttcctaaatatactttggccctttatatgtagactgcagttatatttttatgtattgtataccttgttaattatccaaaattatttttttaaacttgatgttaaattgctttatagaaataaatttatcatcttttatcaacggttagctgtcataattgctgataggactaatgtaataattacatttttatcttaaagaattctgtaggtttgtttgaacaatccagacacaaaactctaccatatatatcaatcaaatattttacaacatataaaattatagagcaaaatatgacattttaaaagctgaacattagtaattttagattttctgaatacatcaattctcacactgctatcaagaactacctgagactgggtaatttataaagaaaagaggtttagttgactcacagtttcataggctgtacaggaatcatggctagggagacctcaggaaacttaccagcatggaggaagtgtgaaggggaagcaagcaggtcttcatgtggcagcaggagagagagaaagagagcacaaggggaagtgcaacacccttttaaacaatcagatctcttgagaattcactaactgtgaggagaagaacaaagaggaaatctgtccccatgatccaatcacctcccaccaggtccttcccttaacattggggatttcaattcaacatgagatttgtgtgggtgcacagagccaaactatatcactaaaagtttgtgttctctaagtagcacagcaaattgtacataagaggatctaagcaaatattctgctactattgtcagaagcggtggacaatgcctcaggtggatgttgagggtggcaagatgacagactatagaaataaattacttcactgggaaaaacaccactttttctcaaggaaaaaaaacaagatcgaagaagagaaaatgcataaaagcatttgagaaaaaatatacatatatgtatatatcttggatatttatttttaattaagctgacttttaaacacagagctcttttaaaaataatccttttaaatctctttataccagacagactatagccagaacaaatagctgaaacttctggcttttaagccatttttttttctttcctcaaaggtgttttctcaagtgaaaccaataagcatcactaaggttttctgacttaaccacagatgcacaagatgacttcggagagatgccaagcatctagaatcaccgctaaggtagctcagagaaaagaaaattcacgtcagaaaatcagaaactgtacatggagggaaaaagaataaataaatgcaaaagtcctacaagtgtcaaaccagaaaaaactgagtccctaagccaggaattgaaccctagccatcattatgaaagagcaaatctttagctactgagctgcagtatgagatgagtgttatattgttttttcccagaagaaggctagaacagtcatttttgagcttgcaaagggtacacctttacaagggaaaagaaactgatgtaaagctgagacgtcttaaaacagattttagaattaaaagtcagtatttcttgtggtcttactataagcgaaccaatacttaaataagaaaacttgttttaacacaggggaccaaaatttagaaagattattattttttctttttttaattatactttaagttttagggtacatgtgcacaacgtgcaggttagttacatatgtatacgtgtgccatgttggtgtgctgcacccatcagctcgtcatttaacattaggtatatctcctaatgctatccctccccactccctcaaccccataacaggccccagtgtgtgatgttccctttcctgtgtccatgtgttctcattgttcaattcccacctatgagtgagaacatgcggtttttggttttttctccttgcgatagtttgctgagaaggatggtttccagcttcatccatgtccctacaaaggacatgaactcatcattttttatggctgcatagtattccatggtgtattataaataaattttatttcagttatggctaatttaattatatataatttttaaaataagctccctttttataaaccttatcatgacttacatagatcatctatgacatgcttagactttttgacttatcgtatacttttttctttcctaaaaagtcattctactttaggacaagaatttaccacacatgatcctttctcatataacatttatttccttttacctttatcaccaaaaatacataattgtattcataacctttgcatttttctttcctactgattttttatctttttcacttatttctgatttcttcttaaatcgatattttaagacccacttttaagtaatgtccaattggccaattttttttcaataagatcatatcttctttggcatatttcatatacagaattatatacaaatttttattaatcctaaatttccatgaacttatcacatgaacttgaaaaatgcttggacttaacttatgaatggtcttttatttataagcctgtttggcactctgtagacacaatatataacataatgaaatgtacatacacataaacacatctagatatgtatacacacacataaacaaagatccaatagcttttatcttaggactctagccatgaaataataacacaaattcactgttttataaatgatagctggatccaaattctctctctaaaaaactgggacttttccacatggctaagcttgatttctaatttgaatttttctgattgcctaaaagactgcctagtgactagttcttcgggactggccattgtctccatgtctaataaggatctattagacaaaagtttttctaagtctagcaagagctcagttattttcctctcaaattctcacctcatatagcaaagtgtaaaataaagtgacaataagaaaaatggtaaaaatgtgtaaatttgtagaaatgctattacagaaaatgatgactttaggatagaaaacaagaaaagggaaaaccatgatgtccttagggtggactctaactcacaatcctagagagaatgccaattccaaacattgcagagcatccaggggcagccagtggtattaaatgccaaaaaacccagagtatccaaatatcaactaacaagggtccctgcaccaaatgccaaaaactgaaacatctttgggttgccaatagtgaaccccaaagacactaggcctaaaacaactggggccacagaacaacatgattttggcattgcaaggtcaacacaacaggagacatctcacaaccaagtgtcctgccttaaaccattgcccaaataggtaaagcaaagactacaaacacgataatgaaataaacataagcatgcattttggcactaagaacagaaaagtaaaattgccagttattagaaatgaacgagaaaaggtctgagagaaggggcaacagatgggctacaaaggacttggctggccagacgtgctcccatctggggcacccagacaatggcagactgcaactgggcttcaaagccagaagccttacggccacttccccatctgtccaaaataaagaatgtagggaaagacagaggaaccaaaatcaaagcggggcagggaaaagacagtaagttgaatctagactatgggagacccacccaccaattaggtctaagtgatgctgattgatcttaatttggggtcttgggggatgtctccattgtcacttcatcagtcatcagaaaagatgtcacagagtgagccctgagggctgctgctgattggctacttttatggtttttttgatcatgtgctaaacaaggcgtggattattcatgagttttggaaacggacagggcatttttgaaactgagagttcatctttctttcagaccatacagagtaacttctggatgttgccatggtatttgtaaactgccttggcactgatgggagtttcctttagtatgatagtatattataatttgcatataatgagcagtgaggacaaccagaggttgctttttttgccatcttggttttggcagattttcgccaacttctttaccgcatcctgttttatcagtatggtcttgtaaaacaatcctgctgaattcctaattcactcccattaaagtctcttagtcttatttaaccgtttgggtaaaatttctccccctctctccttccacagtactttgatcttatctctgtaatacacttacaactttgtcttgcgattctatttgcatgtctgtttagggacaaagggatgttttattcaacttctaccctctgtaccttcctcagacctagcacatgttgttgctcagaaaatgttgaattagtgtatgagcacaagaagcagagttttaaatattctagtcctctatgtaggttatctgtatattgaaggaaatttttcccaaagggataacattaagtaaagccaatgattattaaaattttttttcagaattttcatctagttaattttcttataatcagaaaaaaatgcagttcagaaaatattttttcatgtcatgagcaaaattctagtaaagaaccagaagtaaaatataaaatatgcatatgtttcttgtttgtgtttttgaaactgaagaactcttgtggttggcttgtatttcaactcacattttttaattcatccaaataaatgtttttcagcatttaaatattaactttaggccgggcatggtggctcacgcctgtaatcctagtgctttgagaggccaaggcaggtggattgcctgagctcaggagttcgagaccagcctaggcaacatgatgaaaccctgtctctactaaaaaatacaaaaaattagccaggcatggtagtgtgtgcctgtagtcccagctattcaggaggctgagtcaggagaatggcttgaacctgggaggcggaggtcacattgagccaaaattgtgccattgcactccaacctggatgacagagtgagactccgtgtccaaaaaaaaaaaaaataaataaataactttcaaaaataacaagaattgttaaacattgttaaactaaataataggttctatgctacattctatatttcactcacattgcttttcattttggacatcaggtattctttttaagcttgtatgccaataatttggttctgttcctaaaaaataaatgaatagatttggttgacgcactctcgtttcagttctcttgtctcaaataaaatctttaactagttattgcatacgtttactatcttttattcaaaattttgacaactaacaaggaaaactgaagaattaaatgaagcataaaggaatgtggttttgtacacagaaataaaatccaagcatgaaagaacacactagttttgttcttaacactgattgctatttgctaaaacagcagtgattacttctttcctgcatccgcaataaagtcataatggctcagaacaaagcttaaaaaaaaatagacatgttgaaagttgtgccattattccttactgcccttcctttgtccctgaaaaatgcaaaaaaaaaaacaataagaggcttgtaagagagaaaggagaaaataataaagaatgatagaggactttataccgtctaaacattatttgaaaaaaacatacaactattaaatttcaaactgtgacagttaatctctgtgatttttatagtttatttttcttacatgaaaaattgctacattctttctggacaagagaaattgagatagagatagaaatatatatatatgtatcatatatagaggtagaaaaagacaaaaatacaatcatttcatacattttatagtctataatggtcaatttaagctatacagcagttattcagtatggaatattggagagaaagagataaaggtatgattttatgtatatccattaccattcttttttaatcaaggtaggactgttcctcatctggccacttctcttcagggcctctaaattgtgaatgccaggagcaaatgtaaaggctaatttcgatgattactttgaattcttttttagttgtgctagctttcatttctacagaaaatctgcttttaaaagatgatttccattttctaacaaacatttgacaactcagtgagaagattcaattttattttatatagatattttatattttatatggatataatattagtaagcatgaacataaaagaactctgaaaatgaagaattttcataaatgtaaccgataatgtagtgtgcttatatagaaataccttagggctgaaatgttaattcatgtgtgaatctggtttcattgtgtggttttaggttaaatatatttaattgtttatcttttggttggatgactgggaaagtaatggatgcacaagaatttttaggattttggaaaaattgtactgaaaattgcctctcagaaaagcagttacgttgggtatacagtgagtataagaatgaagttgttcataaaatctaataaaggaggaataaaatttggttagtttggtctatttatctatacattcatttatctcaccttgaatgtccttcaacaatctggtttattaaaattaaagttgtcctttttctggattttttttcatttagacctcacagacttgttcagtttgtttctagatgaaacaaacttgttatcttgctcacatgaggtttcttccccgctacatttggaatcatttaaatttttctctacataggaatcctccaatctttctcagcgttatagcatttgggcctaacctccctcaagaaaggagcaaactctaagtgattccatatgtcctcctattgaaaatcattaattccgagctttagtatagtgatgagacatttagggaacatttgggtattgctgtcaagtaattttattgcctccttcatgaattagttccactacagtatcagatgtaatggagactgttgaagtttcattactggtaaccgggtgatctagcttaattatagtataattaatatcttttttatttaaaacataatgctgattttaacataattaagcacttaagctcattgacaatagaaataactttatcttaaaggttgattgtcttatctcaaatactataactaaatttggggtatctgatttcttgacatttgctaaacaaccttactaaaataggattagcatatattgttttaatatatttcttttttaggaaactttgaattttaagatattttgttaagctaatatgtgtgtgtaaataaataaatcacacacacccatttaataaattaaaagattcagtctcaggtggaaatcgcaatcatagaagagtttgggaattaatacgtttttgctattgtgtattttcacatatgtgtgtcaatgagtatgtggatgtgtttgtgtgcaaaaagagcgttttttatagcataaagtaggtaattgtttcatttaatatctaagcagaaggccaagttttacttcacacttcctttttagaaggtttagacatatgaagtgcaaggattcttctgttaaagaataatattccaggagactttgtctacagcacctgggaagtgtaataaaaaacaaagaataataagagtgatgcattgttccatatcctataaaagaactttctgaaatttgctaagtcgtttgccatctacatgtaagaataagacagttatactgattaaaacaaggaattgagtcatattttctaccactacaattgcaatcattttttttataactatgtgaaatgcaatttccttaagccaagtaccatctttaacctgaaagtgtaaacccttgacttagaacaattttagagattaaccttttcattctgccttcttcctgtcagctgatttctggatcattgtgcttgaacgttattatcacaattatttcctgattttttcccctcatttattagttccagttgcatcctgaattacagcagaatgatggttagatgtatattgggtttactcatgtcaccttcactgctcatagctgggtgggctagcacattgattagcatacttgaatatttaaaacgtgctttatagaactaaatatttgggttatgaatattaacatattcaatgaatatagaaacaattttatctaaccaattgttttgctatctcaaaaatcataactaaatttttatgggacatagtgattaaatctgtgtctaaaagcaattaatgccctatatctgtagtaatgtcagattttcatggtttattaatctcacagtgtgctagaactttaacatttctccttagatgtgctcattcacattggaacataagatatgatattgaaagaattcttaaaggacaaatgcaggcaaaaataaatgaaatggaataaatatatcctataatatgcagaaaaatattccattaccaataacgtcatgcattttaaaactctattcttttaggtatttattgctttttaaccttcgctgaaatgagactgagatcaataaaggtattaaatggtttctaaatagccaaaatacgcaagtatttttgttttctaaggtgaattctttagtgaactttttgaaatgtaataattggcattgtctttcaagttaccattacaaaaacaagtgagaattaaagtagaaactataacattaattttttttatgtcttatcttaaaaataaacccttggaacatacatttcaactggcttaatcacatatgagacaaagaaatgagaagttataactaggcaagtcctggacttcaacgttgtcttttccagcttttccatgacactattgcaatcaaatgttatctttctttcatgctttggaacattcctattgcaacaatgaggagaagaagatttggggaaatatagcagattaagagcttgagctgtgtgctgctgccatgagcagccataaacacctgctcactgatgacatctcatagctagtgttataattgaagttgtagtgatatctccagagagatcatagagcaaaggataggcccagcagtagaaaaagactctgggccttcgtggtgctcagtaagagttgatgatgagtcacagtagcagggtcctggcccagacctccgatgaccacatggacaaggaagttgatgcaggggaaggagtctgtgagccattgtggcccaatgagcacatcctaactcattctaatatgaaaagattagggagatgaggaaaaaccagcaaagagactggaagggagttgccaatgagatggaattggaaactgttagcaggaaagtgtttctaccacaagggagtaatcaaccaactcaaatgttactgagagatagagtaagatgaagctagaaatcagtctgggtgcagtggctcatgcctgtaatctcaccactttgggaggccacggcaagcagatcatgaggtcaagagattgagaccatcctggccaacatggtgaaaccccgtctctactaaaaatacaaaaactagccgggcgtggtggcacacacctgtagtcccagctactcgggaggctgaggcaggagaattgtgtgaacccgggaggtggaggttgcggtgagccgagattgcaccactgcactccaacctggtgatagagcaagactccatctcaaaaaaagaaagaagataaaaatccttggtaacttcaacacagctttacgttggtgaagattcaagtgctattcgaatgagttcagagacaatagactaaaaggagttagagttggtgcatataggaaaccctcaaccagttttgttgtaaagtggaatagataaatgaggcagtatcttgagagataattcaggttcaggaatttttctaaagataggtgatatagagctcctgtttggatgctctgcagataataaaagatgaaagatttatacaatctgaggagaaagcagagtatgtgcttcaagtaataacgtgtaaagagaacaaaatgatggtatgggaggcagaaagaaaataattgatgagagaggaatttctcaaataggtataaggggaggtaatctagttaacctttagaggggatggcttaaccacaaagaacccagacaaagaggtaagcaaatatatgataacatccttgtaggtatgaatatgtggtggtgggtttgagaaagttttgtttgttctattttctgtgaaacagaaagcaaggtcatcagctgagagtgaggatgagataagaggtactggaggtttgagaagagagaaaaaatgaatacccagtggtccaggacaaggtcggcaaactgggcaacatacatatttttccgtagatatgtggtcacagatcattttttaaagttcactttcaaaatcctcttcttcatgatgtcatctctaaaactgatctgcctgagaatggagatgcaatataggcttttctttcccacctctcctttcactgtctctactccataccccactccttttctgggttctactatggtgccttgtctctggttggtaaaatttcttgaattccaagcaaaaaaaaaaaagaaaaaaacagtatcaggaacaaatccttttgaaaatcaaatggtttataaattctttgattttatcaatactgaggaagggcttaatcaatataacatgtgttagataactaggtattacatttgatgatttattgttatgtgatttttggcattcttagtagttcaacagactgacagacatgcctataacaagactccttccattctcttctactttcttattcttatgtctgtaagatggataatgaggatagaaatgacatgaacctatgttaattttagcaataattcaaatgtgaatcagaaaaataactgaaaatatgtttgtatcttacactgtgatatattccaataaaatgatacctttgtacttgataattactaatccaatcacatttagaataattactgatctaatcatatttagaatatgtttatctattttgattaactgtaaactgctaataattgcaataagtcattatagtaggaaacaatacttaaagcttaatggtcacaaaaataatttgtgtaagtaaaacatgtcttcttctggacaaataacacatttatttatcagaaattaaatcatttataattattgaatttatggtaaaattcattgatttcatattaacaaatgttgaagttatagaattttttataattattttagaagattcacaagcaaagccgcttgtgggtaactggtagaggagtgtggcagaatgtgtggactagggacatgaagtaaacttgtaaacttgcccagcaaaacataagactcacttgaggttaaagggcatgaatgtaagggaagtctacttagcatggttttatgtttttcttccatcatgttcagttgcgtaggtacacacatggagtataaatagtactgcattttaacaggatggttaggccaaagaaattgaggatgtatgaataaagcggtatggtgatgtaccatggaatttatgctgtgcaaagagggaaggaagacaggtaataggtaagaaccactgaaacaactgatttcatcaatgaattgtagctctcttcaaggtagaaaaattattgcaatctggaacctctgataatgagcatgtcaacactggaatgtctgaaattgcagtatttgcatgagttgcagttatgaaaacaagatccaaattttactgatttcatagtattttgtctttttctctcgattagaatgcagaatatgttagggcaggtatttttgtccctcctccccatctgctgcattctcagtgcttgattgattcagagaagctgcacaatggatctttgctgaaatctttgttgaaagatgaatgaagagtgtatgactatgggaaataatggctgaaattgggtagatgaagagttcataattctaggagactgggcttaagaacgggggaggtatgagagagaatttgaataaatcaggaaacaaaatttttaaaaattgagaaggtgtgagggacatgatggacaactacaaagatgaggagcggttggtgtgatctgatgttacgagtttcaaagctgtgggtggattacagaggtaggaggcagaataatctgaaaaataaagaagcagcctgaagaaaatctatgctgcctacaagtgcaaggagaatagggggatcggagagaaaacagctgccatttgagagaatcgtgggagaagctgtgacttcaagcaggagccagatttcagctagagctcatggagaagaacatttacaaaggagaagttgagatattgcagataactgatctgaaatttcagaggagagaatgaaatggttttagaaattcagcaggaaattggggattcttagataatgaattctttcataactcttgaatttgacgagattaagctctggatgaatgattactaaaatgacctatatattttctaatacaattttataattattttcagtgattaaagataaattttatcagtgcattgcctttgatatttattttagatggaattaatcatacatcattttctgtggtgtatttctttaaataattatagactatagatgtaaaatgatatagttcataggacaattttaatagattatagctatagaatgctatgaagatacagtttagaaaacattttaggccagacacagtggctcacatctgtaaatctcagcactttgggaggccaaggtgggtggatcacctgaggttaggagtttgagaccagcctggccaacatagtgaaaccccatctctactaaaaatacaaaaattagctgggcatggtggcaggtgccggtaatctctgctgtttgggaggctgaggcaggagaatcacttgaacgcaggaggcggaggttacagtgagctgggatcgtgccactgtactccaacctgggtgacagaggagacgccgttgcaaaaataaaaaaaaagaaaatattttaaacctttataataatatatatgattacatataggtgtatgaatatataattcatagttaatctctatattacattattacatagttaattactttttttttttttgagatggagtcttgttcctggagtgcagtggcgtgctcttggttcactgcaacctctgcctctcaggttcaagcgattttcctgcttcagcctcctgagtagctgggactacaggcatgtgccatcatgcccggctgatttttgtattttttgtagagatggggtttcaccatgttggtcaggctggtctcgaactcctgaccttgtgatctgcctgccttggcctcccaaagtgctgggattacaggcctgagccaccgcaaccggccacatagttaatttccatgtatacaattaatagttatttctatatccacactacaaaagaggtaaatacaagtataaaattttaaaaatgtctgttctatgcaatgacatttaaaattcttgttgattatagtttttggtcttagtgcagtcagtttccacttcataaatactgtcttgcctagcttgtgatggttcacaagttttacatgccccacataatgaatcattgatattttcttagtacattgggcaacttttgaagcttttgcataacttttatttttatgtattatcagaaagagcaggttactggtttagtggtgccctagtgatattgaaattatttttatttaagcctttattctctccactgggaaatcttcttaaatttagttttgattgtgtcttcattgtcttctgtattgttcacatgacatgatagtaataatgataatacttacatagcacttattctaggcctgtaaatctaagcactatacagatgttaacttgttcaagtcacatatcaagtacatgtgataggttctattattatcttcccccacccttatataaatagaggagaaaactgagacatagagtgagtaacttggttaaggtcacaaattgttatatgtcagaactaggattcaaaccctagggtcacactgcagagactatacctttaactatactgtctctatagggtacatagctggtaaatattttgtagtaaatgatggtgaaagaaaggactcttattgatcttttctcttaataaatatttagcaggcacctacagtgtcaaatgctctgttttacatttaataaaacagaaatggcttcatgaagcctggaatcaagtgagagaaacagaaatataatttgcacgtgcaattgcaatattgtaagtactaagaacaaaaagaatgaggtattataacacgcccttctttggactgtgtgggtaggccctttttgaggaattggtatttaagacttgaacaatgatgagaaggaggcagccaggtcatgaataagagaagagttcctagcagaagaaatagtatttaagaagaacaggatttctggagcttatagaaagggtgcccttattttgtctttcacttgaatccaaacaggaaacagatgacataccaaaaagtaaaatattttatggggattcatttataaagaaagctggatacaggcattatttaagggatggtgtagaaacttggggtgagcgttagaagagctagtatgtactaccccagggcctgaaggagaagcaagttgttggagctgagaaggagagggttatagagggcagacttccttatgagagccttatgaatctcttcagttgagggtcacactcagctagagcaaatccaaataaagggaaacaggaaaatagattcctgaccctgctttaccttctgccctttcatctcctaatgaggctgatcatctattgcctaaacacaaagggaaagggtatgagagcccactgattaacccattcagttcagtctcccgggacggagtgtagagcgcaaggtcaaagaggttttggatatccattagaatttttggccgctgaacgatcatgctatgcctttagttcatgttatagaatcttttattttaggcaaaatggggaatctttgaagtggtgtgcttttggaacagggagattataatacttttatgaggtggattttgctttgaaaatggcacacattgtagaggcaattgcacaaatggagtggggagatacaaagttatttggtagtttatatggtggctttgattacagatgcttctcaacttacgatggggttacatcccataaagccaccataaattgaaagtatcctaattcgaaaatacatttaatccacctaacctgccaaacatcatagcttagcctagcctaccttaaatgtgctcagacacttatattagtttacagttagcaaaatcatctaacacgaagcctattttataataaagtttgagtatctcatgtaatttattgaatactgaactgaaattgaaaaacagaatgttgtataggtacttgaagtacgacttctactgagtgtgtattgtttttgctttatattatatagaaaaatcttaagtcaaaccatcgtaagtcggggaccatctgtagtgtggttgcaaatctgtttaaaaggtataaataacaggacttgattatagattttatgaatagcttggattgaaaggtcacagtgactctcgtgtatctgactcacataagtagataggtgttggtgccacaaactgccacagaaaaaaaattctatgaacagaatgagttaaggatgttgaccaataatttagttttacacatgaaatattcaagtggaagtgtcagcaggttgaatatacagatttaaactggtgtgatccagaggcatacatttgggagccctctgcaactagatttaaagttatgtaatcatgatatcatttaagctaagagtgcattgagggactagaaagaagaaacgactaaaccttgtaaaacttacacattcagagaaggctagttagagaagaagtcagcaaaggaatccaatgttaggactaagctcgcacttgtgttatcccacttagattataataattctgtgaggtgggtattataatattttgaatcaggatctgagaatcagattaatcatcctggctttgatttttgcctcactccaaaaccatgcatttttcatgacaccaggttgtctgttacaaattataaatacttgtggaagtcaacatcttcctagaatagtgatagaaagcaagcattaaaaaaaacataatatgaataagggaagtagttttaaacactgcttaatttgtaaattacttctgtgatgtataaattaaattataattgactatccttgttttccagagttagttggaatgatatggttttaaatcttttaaataggctaactcatgtaactaaaacaaattttaaaataaatttttccacagaggtgccaccaatttggttttacctcctaatggataaaagcttaatttcagccctgatctggatctatgaagagctttggtacttacttccaacagcttgttcctaagaactgagtgtgtaatttattaatagagactagagagtaggtgtttgaaatgtacagttgaaaacaagtcttgacatttaaacttcatcacataaaaatatgaaatccattattttctactaggatattaacaatagagttttaaacatcttttgtaatagcacagtttcataactagtccattaactacatgataactgtcatgaactcaaataagtgtccataatgatcagtgagtgcttccacttaagtgtccatatacttaggagggtgaagcacctttcagttggtaataatacagtgactataataagttctgagcagaaaatattaatgaatctgtggctttgtcttgatttgaggtattaggatagaaaatatcatctcaaacttttcaaagttggttacatttctagacattataatttgccatgtgaaaatcatctatgcattattaatatcttacttatattttaatcttataaaggctaaatatatatctttatataaggatatatagataggatagttatcctatagatatccatataaagatacatagataggactgtttctatttacacatttcatgatattagacttccagcatgtttgtgtagcagacagtatttgggctgaaaagagcaaatttgtttccaataaatactatatctttctacttaacataggatgataagtagaattattacatgaaatatttgcttggagtatggacagaatttgtactttaaatttgcattgaaagatttttatatattcatttgtaaatttagcattaattttttttggattgtagtttaactttcgccataacttctaaaatctccattcattcattcatttattcattcattcattcattctgccttctatgtgccagatattcttctacctctgaataatatagttttttattaaaaaacagctaaagcctcctctctcatgaagcttacagtaatgaagaatgagaaataatataagtaaataaattttaatgttgctattataaatgttttcccagaaaaaatgaaatgatacagttgagtgacaatttatattattctaataatttaagcttcttaaaatttgatctagctgatacagttgaaactcggcatttgttatgtatataagctgcatcccaaaaacaagtgttacatagggaagaataaaaacaatgagatgtttccaaagtattgtcagtttattaattaaatatttttgaattggtattaatacattatagtatgaactgcttattacaatttttttatttctaaaacagaggctgattttattaaataacattgagaaaaataatgtaactccactaatagtaattatgatgcttaatacttacttttggttttgccagaatagatttaaaatattgattgatggcacttttattaaattctaccagatactgaggagttgtaactcttggactaatactttggaagcaaaagatcatttacatttcattaacatttaattatctcagaacatctctgttctaccaatgactaacagattcagaaaaaaacttaaataatcttaactcttacactattcaaaaacacggttttctttgaagtgaaaactacattgattggtttaaaaatgtgtagtacagtggttacaacatgaactttgaaattatactctcttggatataaatttgtgtgccaccacatattaacaatttaagcctcccaaagctccatttacctaatatgtaagatgaatatatttaatagtacttatagattaaagtgatatcatatgaggtaacctatgataacagtgctggacaaaaaataagcttttaataaatggcagcttttatttctgtagttgtttttagtgtttgtatcataattattattctaatataattatatatgatatgaaatttataattgtatataacctgtgtatatatagcaattataatcattttataattttaattattatttgaaaaatactaagaaaatagatattctttttcataatggaatttgtatccataaattagttttaaattatatagggagcatggaatctgctgtcacctgaaaatggtttgtggatgttaatgtcatcagaacctcagttgactgattctttgttgcttttactaacattgtgtttaagcatgtagtttcagtttcttgttggctttcttcactaaattccaagttccttcaggactatgtcttgcttatggtggaattcacaatgtttagtagacttttttcttacatatgaatgaattaatcagatattcatcagcattattttaacattaaaagaaaaccttactacttaatggtggatcaaatgtgcaaagttcttttatgaaaggtacttgtatactatgtcttaaaaaaacaattgtgcgcaaaggaaggaagaaacatgtgatgcaaatttaggcaatgtttgttaaaatagatatgtgaaacctggagcagtggcatgtcccagggactcaggaggctggggcaggatggcaggaggatggcttgagcacaggaatttgaggtcagcctggacaacggagtgagaccccatcttgtagtaaataaataatagataagtgagtaaaatgtgtgtttaaatttttataataccttgcagtgggaagaggaatatgaaacatccaagctagatgtagcataattacttgtaatccttgacactttcattttaaaaaatctaatacgcattctaggagttgattctttttttattaaattgaggttgaaaaataaacactcaatttgctttctgattctctttgctttaagcagaatataattcttgtgcttctcttaagttcccaatctatactatcaatgcctaacatatatcaaatgtatgcatatgccaataacagacttaaaaatatcctttagtgaaaaaacccttaacctaaccaattagtaaggaaaaagtaaagaaggacaaaaggaccaattgtgatgaatgtggttatgacagtgcatttgtttgtcggaaagggtaggtagagtaagcattgagatttaagaatttacagaacaaatataatacaaaagggaatttggcacaattcatgtgatgaaagaatacacatttacctgcattttcacccttgtcattgaccacccacaagctttttaccctcaagaagagaataagtcctctgaaatataactgtccactggagagcgcaatgtatgaatggctcatagcaagaaaaagaaaatggtaactataaaattaaattgtagtcatgaaaagcaaatagatggaaactgattcctctcttcaggttagagatagaaacactgcaggatttttttttttagactgagcattcttttctttctttctttttgccccagaatatcataaataaaactactgacttattttctttatgttttctcctgcaagtaggatttttcttttcacatatgagttccaggcctttctgaaacaggggacattaatataagcctaagagaatactggtcaagatagccatttgaaatagaaaccactccctgtttcttgaaattttctcctgttcagaatgccaggccaaactggtcactcctgttcagttttcttcattgatctgttttctcatttcactctgtaaatgtttgttgtttgtaacagacgtcacatttgtctactctctaaccactctgcctggattacctggttattttaatttaaatgctctctagtgaaaactccaaaatctggtctgatttctgtcattgagtttcagaactttatatctgatgtcctgcatggacaaatctaaactgattttagactcaattccataaatttctgcttcctcctgtattctcatttgtggttaataatatcatcatctaatgaatctctgaagctaaaaatttcaatgtaatataggactcttattcccacacctcagtctgtaagtcactacattttgtaggttctgttatagaatatttctcttctaatcagagctgttatgtgtcacagctttaggtcacatatttatcattttcctcccacattgttgaacaatcttctaactgagctgtctggcacttctcttaacctttaggagtccatgatctatactggtatcagttatctactgaaatctggtttggctctgttattcttctgctaagatatctccacatggctccactgaccatcgcctcaacttcaagcccaagtttttccctctttaggaaatgggttctattctacatggccagtaaactctaagacccagcataaaatcatcacttctgttaagaattcttctgtgaagactttctgtgacttcatggtctcagaagactgtgacttccatgaagactttccttacactcctttcttttatgctccattacagaacttaacaggcatattataatttctgtttataaatattccttaataagaaaatattttttgttgaaattatgacttaaattctctatgcataacatagtacctgtttcatagttggcattgattaaatatgaattgaatgattttcttctattgacttaaattaagtctcttagagtggtttttctacaacctctatgatactattggctgctcattttaatgtactctgattttaaatcccataatcatttacccccctctttacccctgctcctacctctatggtcatcctgtcattagattagggacattaaaagaatcttcaggtaggaatatattggtttgaggttaagaatggcagaatcaaatgattattgactgttattttaagccaggttcagtattaaatgcattaagaatttactcaataattcttagaacagaaataatgaatatatttgttttactaattaagaaaaggagaaattgagtaaatggttcaagtttatatggtgatgatggacatagctggaaaccagacacatatcagtccagtgcccaaaatgtcagtataatagacaactcatcaccaatttaaatttgtttctatttgtattgtgacttcacacataattgaattaactgggctcttgctttcctctctggtaccagcctttattccatttcaaggtcatcctcatataattagaactgattacttggcaaataaaggataatattttcacagcttcttttacctgtactacataagcacaaatgtacagtgtttatatgatattaatataatcacaaatagcatgggatttgagaatacagttttgttatcatttttagtagtatttagaagtaaaatagaatatcaaagttctgtgatttaagaacttgaagttccacagttggttctactcatattagccatttaaccttgagcaggtcagtttcatcatctggaaagatgattttcatgatactccaaactataaatgatagtagacctgaaaagtacgaagatttcctaaaagtttgtggaagaattgagaagaaaggcatatctgaaaaaaatcactataaaatgccagtaataataattataggcatataaccatgaaattaattctgtatatagtattaagctaaagatgtcactatttgaatagcatatcctgtgtacatgaagttgaaaacctaggtgaagagatggaacatatttccatctctttccatatatgactaacaattctaaatatcatttgtagtgttcaaagtcataagagctcaacataaccaagtgaaaaaaaacatatatttatgagactaggggaagaacattccaggctgggacaaaattggggagaaattctgagaatgagttagaactgttttaatctttttgtctgaattccttaaagatgggactgttttcttactttataaagataccttaggagcttattaaaattaggcttagttgtcgggaacaacatattcttacactgataaggaaaacttcaggccttttttgcagggagataagacttaaatatcaccacagcaagctgccattttagcattcagtggttaagccaaggggcaaacagctggagcagagctagcagaaaaacagtgggatgtagtttccaaaccacaagtaccttgtgtctaattcttgcattcttcagcatgaagattgttttttttgttgttgttgtttgtttgtttttgagatggagtctgactctgttgccaggctggagtgcagtggtgtgatcttggctcactgcaacctcagcctcccaggtacaagcgattctcctgcctcaacctcccgagtagctgggactacgggcgcgtgccactacacccagctaatttttgtatttttagtagagacagggtttcaccatgttggccaggatggtctctatctgttgacctcatgatccgtctgcctcggcctcccaaagtgctgggattacagacatgagccaccttgcctggccaaatgtttttaatattacaaaaatcagacaaatgaaattcctcatttgtcctcgcatgctcttgttgttcctaaattccttcagttgtctaattatgtcacctttttttcaatcaatcaaattataattgccagtattaagtatctagttgtagtgacagaaaggagtgaaagcagtaaaagatatatgaaacttaatctcctcatttaaaatcatgcaaatgactgaacaatcttacaataagaccatttctatcagaaaagctaggaagtttatattaaaatactgtttttaagatttagattcattcttttatatgaagctaatacaagatagaataaatcattttttttaaaaaaaaagcaaatctcatcagaggcaaaaatcaatagtttcatattcaaataaaaacagtgcttaaaatcagtccattgtaagttgtttgctgttttctaattgtttagaacaacttccttttatctttcccaggtgttttaatgaaatagtgaccaatttctgaaaatgtttttctgtaatataaacgatagccaaatgccttggagaatattttcttttataatttctgtctttataaaaagttagtctttgtaaatttagattgcttaaagtctccaaagttcttagatgagaagaattgattttaacaattctgtatactattaatagtaatgcttcaggctcattataaaaactcaaaaggaaaatagttaacaaattgtaagttgaagtattattacctaataatattattattgctcaaataataatttgattattattgtactttcttctctcaattacccttattttgaatcttcatttctaaatttgccttcctactattattttcagactttttttgttccctctgtcttttaatgattaaatcatcatcaaaggctggagtgcagtggcagcatcactgctcacagcagtccgtaactgggctgaagcaatccttctacctcagcctccccagtagttgggatcacaggcacactccactgttcccagataatatattttattttttgtagagatggggtctcactatgttgccctggctggtctcgaactacaaggcacaagtgatcctcccgcctcagccttcataacttctggattacagacatgagccactgcacctagccaatatttagttttcttgtttgtagcatctatattattacatagcaatgtgttttagttaaaatatcaacttagttaaaaaaatattttgttagtttttctcaaaatagctatagtttcctaattctttaaaattatttaatatatgcctttgatataaatatacttcccttaaaaattgagaaggtatatgtaatataatttccattaacccaaagaggctaaaatgctgctttgaaccttctcagattctctctacttgtaacttacactctgttcttactgtcctgtatgtggtttgccaaaaatattgaccacctaaaccaatttcgctgtatttcaataaaacaaaaccaagttttcgaatcataactccaaagtttgaatcatagctctctcacttaacagctcatgatttaactgccatgagcctcagttttctcaattgtagctaacatcagaaggcttttttttttcttatactttaatttctgggatacatgtgcagaacatgcaggtttgttacataggtatacacgtgccatggtggtttgctgaacccatcaacccgtcatctacattagatatttcttctattgttaacctacccctagcccaccatcccccacctgtgtctatgtgttctcattgttcaattcccacttatgagtgagaacatgcagtgtttggttttcggttcctgtgttagttcgctgagaatgatggtttccaatttcatctgtgtcccttcaaaagacatgaactcatcattttttatggctgcatagtgttccatggtgtatatgtgccacattttctttatccagtctatcactgatgggcatttgggttggttccaagtcttcactattgtgaatagggcttcaataaacatacgtgtgcatgtgtctttataggagaatgatttatagtcctttgggtatatacccagtaatgggattgctgggtcaaatggtatttctggttctagatccttgaggaatctccacactgtcttccacaatggttgaactaatttacactcccaccaacagtgtaaaagcattcctatttctccacatcttgtccagcatctattgtttcctgactttttaatgatcacaccaaaagcaatggcaacaaaagccaaaactgacaaatgggatctaattaaactaaaaagcttctgcacagcaaaagaaactatcatcagagtgagcaggcaacctacagaatgggagaaaatttttgcaatctatccatctgacaaagggctaatatccagaatctacaaggaacttaaacaaattaatgagaaaaaaacaaccccatcaaaaaatgggcaaaggatatgaacagacgcttctcaaaagaagatatttatgtggccaacaaacatgtgagaaaaagctcatgatcactggtcattaaggaaatgcaaattaaaaccacaatgagatatcatctcatgccagttagaatagcgatcaaaaggcttttttatgagagataagtgggagaaataacacaaaaatatcatcccagtgcacctctgatataataattcttattacatgttagatgatgttattaattacaatatttgccaattttaacataagttgggacaatgttttaccagcacagttttttcccctgaagaaatcaaggctcattagacttttgctataatggaatttatattagctaaaataaaattacaattagactggtgaatatagtttccagaaagtatataatttaaattgctaacataaaagactgatttttcttaaagtcagatcttatttatatatttgttacatcttatatatcctgccttttatgaattttaaattttgtagctattatattttagtaaattgatggtattgtttaagtagaaatgaagaaaatatataatagtttttaaagctttacctaaaatatacaagtcttggcaggaatacatactattccccatttatttatttatcattgtattaaatctttttgctgacagcataggggaaattatgatgatttaaagagtgagtatcagtatttgacagagaaggaaaatgatgataacatacaagcagttatttataacaaaatttaactttaaagtggcaattgcttcatatttgatttatgcatttatcctaggtggtagaacagacttcccctgtccaaggagtgacctttaaaggtggctattgcaatatgaaaatatacattttgagagtacagtgattatggaaatgcagaagaaaaaatagttgtgtggcatgttttgcagattttttttctttttgcctcactaacttaaatggtggtttgtgattttcggtattgactttttgaattatcatttaaccttttcatattcagtaattggcaccaaccagtttttctttgctgccccatcttctaccagaaacagccacactacctaaagtctaaataaaacacaaataaatatgatccagaaacacagctaatagagaattctggactttgtgttccaatgctttggtggactcagtttgatttagaactttgtctttagcaatgcagttttagaaatttgattttattcagttactcatggatactctgggttataattcatttactccaaccaaactttaaagacttcataatattacttcatttgtgaaccataagtttacctaaagaaatgctgtttagttctttgtctataaaacacacgttccattaaccagtgacatttttttctagtcactggagaaagtaaatttgattaaaattttatctgtgcatctaaatgttgttaaatgcaacttactcattcccaatgggttgtagagaagttttaaaggtaatattaggtcaccttgtctgtttttaaattttattatatgttatcatcattttcaaccagtttccattgttgattgaatcatgccttatctcactggttaatggttgagcaaggatttttagagtctttttgtgttggaattttgttgtccatataatgatttgtatactggacagctaaacatcatagacagatgtctgcttttttttttctaaaacttatgataaactattcttgctgactaaatttatatttggtaagtattttgtataagtcactctcaggcttgatgagaaaacagaaataatacctataatcctctttcttccagattttatgttgtagtacatgtatatacacgttgtgtttctagggcaatttgactttgtaatcactattttttatttattttattttttatttttttgcgagtgagtctcactctgtcactggggctggagtgcagtggggagattttggctcactgcaaactccgactctcaggatcaagtaattctcattccacaacctctcatgcctcagcctcttgagtagctgcgactacagacgcatttcactatgcctggctaatttttgtatgtttaatggagatgaagtttcaccatgttggctaagctggtcttgaactcctggcctcaagtgatctgcctgccttggcctcccaaagtactgggattacaggcgtgagccaccatgcctggcttataatcactatcttttaatgacctactactgatatttcctaaaaacaactaatggtcccctgttttatctctaataatttaatcacttaagaatggtatacagaaactagttgtttttagagatgagtatgaatatgctgctttttttggccattagctgtttatcaacatttaacgaaatgtggatgttcaatttcttaaaataataacataaattttcattacttttcagctcctctattaagagttctgctctgatgctaggcaaaatattacaaactactacatgagggcccacctttcttttagggaacgttgctctattaagtaaagggaaatggtgttatccctcaaatcacttaggagtatacaacctcatagatcctttagcagcatattaaatagaatatatatatatatattttttttttctctaatggtagagaatatctgatctgttcttatgaacatttccctgctctttaatatgcatggggatatattctatgcattaggattaaaagcacaaatgaactacattgtgtaagtaaacttcagaaaaacaaatagacattcattgaacacctactaggtgacagacaactggacaagaaactggagatgccaagatgaataggggtatggtcccttaaagtatgaagctgaaggtacagtggagaaatatagaacacaatttaatcaagtcagtaatcatagttttttctgttattctacttaaaagattaacactcttatagttttcatagattattggtgtcaatgaaactgatattggtgggcaaggggaggccagtgggacctctaccccagctggtgaacaggctcttgacacagtcacaagaaggaattcaaggacaagtcagaaaatagtaaaagtacagagattgttgcaagggaaaaagtacacactcaagaaaagggagtgtgggcgtactcaagagagagagtcacgtgcaagggactttggggctgctatctttatgggtttctttagccaagggatggaatattcatggagattcctagaaaaagctggtgatttctcagaactgtggtgccacccatttttacatcaaatatgagtgctcctggaactgtcatggcgcttgtaggtatgttattgactatgttaatgagcatataggaagatcctaggtgaaacccaggacagatacagtgctatgttgagtccaccagatcttagccagcttggtccatgccctggttttcagggtcttatctgctcctggcttctgcagctatttcggcagtttccttttgctagtcacatgaaactgctgcctggaattttctattctcttgcaaccaccttgtgctactcctgcctcaaaactgtccccataaacttgctccttatcagaagaaaaattaaaatactgtcagaagcaaatattttacttaaatcagtaaaatgattgtccttaaaaacagatttgttgagttcaccttaattagtaattggctgacaatgagtacgaatttagttcatgtttgtttataagccatgtaacatctgtgaattagttttatatgaattgcaatcttttcagaaaagaaataatgtaggctttttctggtttggccttttgttttttttttaaccccccaaggagccacagtagaaaatgaaaaacatagatctgtaaaggaaatggcattttctaaatactcttttctccctgtataaacacattgattgttagtttttaaattgctttgacttataaagaccttaaaaatctcaaaaatgagtatttacttccctggagatttcttcattgagtttaataaaatccttagtgagattcatacactgcaggtttctttttttttttttttttaacttttctgcttttgaaattacaagctgttactcaccaggtgtatttttattagtttgtgtgattctgagcctgaatatttattttacaagtccatttagcaaactatgaagctttttaaatctgtaagaagaggggcaatactttcattgcaactttgaatgtcaaatgtttaaagggtaattacatgcttgaatcatattcggagtcaggatagtcaggacacacttgctgatttggaactgagaattagttacttcaaaatagagagttattttttacccaaatgtataatattgttaaatagcatcactgaaaattctgtgaaaaactggtctgacatacatacacgcatgcatacatacacatattttgccagttgagccttttcacaagactcagctacctagttttcttattaaattttgctcaaatggcaccaaataagaaatgtcagcatgacttgtataacaacatactttcaacagtttgtatcaaatgatttgcattacactagagtcttggttagattggaaaggtgtttacaataggtaacataaagctaaattcttagaatttgattttaagagtatatatatatataatgagaataaagaaaatatgtttgtaagatttgtcttagcaaattttataattaatagtaagtaatagtgcagcaagagaaagctatatagtatctttataaatcaaaagtatgattatttatcttatatgaccacatagcctactccagctattgccccatctctttgaaatactctaaagctaaactccttgagagagtgcacactttccattttctcacaccatttgcttcccaggcaagtgatttccgtatctctaaattcagcaggcacattttagtctgccttttacatggacctagcaaaactggaaacactcacatttgccatcttaaacacttctttttctttggcttctgtgattccatattttcctctctcttctgcttgttccgatgatttttctcaatctgcttttatacccactttctacccatctagccttgtctgcccagagtttaaaagttggagctttttacggtggtgttctaagtctgagaaggcaaaccttttggtaaagggacaaatagtaattatctcaggctttgcataacatatggtgcctggtgcacgtttgctgttgtagcatgaaaggagccgtatacaataggtaaataaatagctgaggtttctagatatgttattctgcttctcagtttctttatatcaaaataattttgtatggacttctaccaaaattcttttctatttcttacatttaaaggaaattagttttacatttccctaggatatttttgtagctttatatctctagaccgtcccactatgtacaaatagatcgacttgtactttgagtagcttcctcctctacttctcccaagtatctatcttggcttttttgtattctgttcttactgtttctgttcaggtcactttagattgtactccctcccaggagttactttctagtgtgggactttggctaaaaagagagctaggttttttagttttgagattttacagggttgagggtctcctattttctgactttactatggtccctttgcatttacccacaaatttgaatatgcaaaatttctgtgggtttttttttttttttttttttttttgagacggagtctccctctgtcgcccagactggagtgcagcagcgcgatctcggctcactgcaagctccgcctcccgggttcacgccattctcctgcctcaccctccctagtagctgggactacaggcgcctgccaccacgcctggcaacttttttttttgtatttttagtagagacggggtttcaccgtgttagccaggatggtctccatctcctgacctagtaacccgcccgccttggcctcccaaagtgctgggattacaggcgtgagccactgctcctggcctctctctgttttatctgctattctcagattgtctcactgtgcttcccataattctctgatcagatggactctaagggccatcagaagcctgaatgccttctgctctctttgcataattgcagataccttccagattttgtagctatcagtgatttttattcactcactggttttttagagctcataacgatttggagtttataactgatacttgtagaagcctagagatcttttggtttggctatcctgtttttagaggaatatttgggaagactcaaaactattccatttctgcattttccaataatcctgtcatagacgttacctagtatatttattttttaaggtggagaatgtaaatgccctagtattctatatcattgtatttttatttatttatttagccattcattcactgattgattcttttattcattcaaaaatgacattcatttattgagtatctattacattacaggtacttgacaaaatgtgattcagaaacagaatgttccagatatcatgtcaggtgctttaacaaagaatatcccatttacccttcagaataatacagtttcctgaaagtaattatgttgccaaagtttacagacagcttcagtaccaggtcttcgagttgattgtacaattgaatgaaatatgttgcttaagcagttgtttgatgtttacaattggtcactaggctaggcacttggaacagaaatatgtgccagctctttttgtttgtttgtttttgagacacagtctcgctctgttgcccaggctggagagcagtggctcaatctcggctcactgcaagctctgcctccagggttcacgccattctcctgcctcagcctcccgagtagctgggactacaggcgcccgccaccacgcctggctaattttgtgtatttttagtagagacggggtttcaccatgttagccagtatggtcttgatcttctgacctcgtgatccgcccgcctcggcctcccgaagtgctgggattacaggcgtgagccaccgagcccaggctgtgccagccttttgtgtgtgtgtgtgtgtgtgtgtgtgtgtgtgtgtgtgtgtgtgtgtgatgtttacctattctctatattaaaaactttactatggacgagccccactattacttttggcaggaattaaagcagatattgaaaggctaaagcaaatattaaatatttcacatgctcacacagagatacataaaaaaataggtgagatcattgctattgaaggcttaacattaatctttacttttaaacaatttaggataggaaatcaattcaggttgcactgcaaggaagaaatattaactggtctaccagttgagcattgtattgttattactatagagtatttttggattagatgtaattgctactgaagttaatcatttattatacacacacttagatttcttctcatcagcataccatctgcatttaagggtgctctaatgccatgctactcaaaatgtggtcaatggaccagcagcatccaaatcacttgagacctagaaatggagaatcttggatctactgaatcagaatctgtatttaacaaaatcaccaggttatcttatgcatctgaaatattgaggaacattgttctaatgtgtcagtgcttagattcatcaggaataggaagaaaataaataacattaactaccaaattctttttttttacttagctacactgagaataattaactgccacattttaaatacattattaatatattttaaaaatagatatctagaacctattaatatttgaatatttgtgtgaattttttatttagcattttaaaaattatatgcaatattttccacctagctcaatgttttggcagagctttgttagtataggcattagacatcatttgggctgagcacagtggttcacgcctgtaatcccagctcttggggaggtcaaagtgggaggatcatttgagcccaggaatttaagaccagaccggacaacatagtggaaccccattaatacaaaaaacaaaaaaacaacaaagaaaaaggaatcattttgtattactttaatagtagtaaaactcatttgatttaaagagaatttttttaaagaactatattgtttacacttagcacagacagccactaaataaggttgtgcagtgctcaaggaggggactatgggcagctttgtcacatctatacctacactggctcatagctagaatgtaagcactataagtacagggatctcttttctccatatacattaatgatagaatactgccaggcaaatagtagttcaataaatatcactgaaactttttttttctttgtatgtgaagagtcacagatgacattgtaaaatgatacaggaaggcagcacacattaaaaaaataaatcaatgggaatgatactttgcataacttatatttttaaaactcagatgctttgctttgacttgagcaaatcctattaatcacattaattacagtttcacagatgaggagatggagactgtagttaaatgacttgagtatcatatgtcttgactataatatgccttgattgtaacataacatacaaactagaatgtgttgacactaatatttctttttctttctttctgtttttttttttttttttttgagacggagtcttgctttgtcgcccaggctggagtgcagtggtgagatctcagctcactgcaacctttgcctcctgggttcaagcaattctcctgcctcagcctccagagtagctgggattataggtgcccgccaccacactgggctaattttttgtatttttagtagagatggggttttgccgtgttagccaggctggtcacgaactcctgacctcaggtgatgcgcccgcctcggcctcccaaaatgttgggattacaggcgtgagccaccgtggccagcctaatattccatttttatgaatactttacatcttctccctttagtgagagttgcgataattagcctatttgcaagatagcagggaggattaagtgtatatactgtaattgagaaaaacatactcatggctcatccatgttaatggcttgcccttgtttccatcatcttctgtctgattattgtactctagaggcaaccaggtattcaagtgtgtggcaactgtggccttcgatgtgtatttggagtcagtctgtaccttgaccttgattactctaaatgaggagaaagctatgacttaatggcaagtacattggcctgaaaattaaagacctgggtctaattaccctgataattgaagatctggcttacatcccagttctgttactgatgctgcattgaatttagtcttttcacttaatctttttcaccattgtttcttttttgatggaatgaggaaaattctagctaccttacatggttattgttattaaatttgaatgaaactcatttgaggtatattcttttaggaagactgatgaaaacagaatttccaaagtccctaggtgttgaaaacgcttttctttatcattgatatgtagtgaattttctcgtttgttctcttgcttcgtatattggttttgaaaagcctgctgctaatctgattatctcatcttagtaaattatttgccacttttgccgggaggccttgatgattttatctttaactttgaaatctaattgttttaataggatatgtttcagagtaattttctgagttaattttcctcaggtgaacctttttaagtttagattgttgtcttgttctttctctgaaaggcttccttaagctttacacttgtaaacattagctttgttgcattgttttatttttcttacatcaagttaatattttataatttaaatactagttctttttgcctgtcttccatttccattactttctctctgacccttttacttttttatatctttttcgtttttaggggcttctttcttgcctttcttcaatgaggctttgtgaattttcattcgagttttttctcatttggacattttataatgtattcttcatttcagtgataattttgtttttttcttctatttctttcctgaggtcaatcagctcttttccatttgtccgttttttccacttttgtttgtaaattttgaatttctgattcgatagtttttaaaaatatcatgtgtcttatttgcgtatatttaatcctgcattgtgttttaacttaattttcttctgctttgtggttgctttgtatgaaggaattatcagttggtatgtgtggaatttagcttcctacttttctgcaacagctgtgtaaggacttttcttcacttttatctactggggttttatacaacagtgctagtttagttgttccttcttctttcaatatagcaaatctaggtactttagaggatctttgttatggtagtggggaaaggattgttaaccctccagttttatgatttgcattttatcttgcaagaccctaaattttattttcttattgtctcttctttatcatccagtagcctgtacttctctcaccattttttctcttttctgttttctaagagctcatctttaaattgcatctactgtatctctttaaatcatgtctgccttgaaaattatgtttgtctctttaaaagggatgggaccttttaaattgtgcttacttagaaatttctttcccgttgtccctgctctgatctgcacagatatcttttcattcttttcagatataaggtggattttatttttctagttattgttgtaagtcactccttcttttgttttccccattgtttgcctgtgagtagggatggggctgggggttgcagcaggagacatgatgctctgggatttcctgattttcctcttttcactcatagttatgcagttttgatattctctatataagatatgcttgaataatttacatagaatttaacttttaatttaatttacatagtatttaattttcctagttttttcttaaatgtagaatttgattttctttctcttttttcttatttgcaggggatattatgggagataaatagttatattgttgccattgccctcagctatcctgaaagtatttttaaaaagtttttacttgaaaaacttggcttctgttgttttactgcttgacaactttgatttacattttctcagatttgtttctctcataaactttagattgagtgcacagtgtattattttgtagcatgatatactgtattttataacaaccttaacggctagctcatttaagataatattctagcatgtttataaaacaaaattaatccattgatggattatttgcttgttctgtaattgaaatatttgaaatatttaccttatgaaatctctagattgtctccacgagagttaatttttcttcagaaataatgaaatgctatcttaattataatgagaaatataatggtgaggactttgtgaactgaatcattcaagtataaaatattttaaattatttttccagtttttgcattatgtgaattactttggcatctgatatttttgtaaatattaataaaataaaaaaattatcttgcataaagttgctgacaaataatttctttgtatggatgtttctgcaagtgacaaaatccatgaaagaactgaaaatgcagtataatttctatcataacttttttcaatcaacttttcatatctaaataatttcagaaaattataaaggtacgtaaacttattatatcacaattttgttttaaatattttagatactgttttgcaatatagtggctttcttttataatcctaggtattttattttatgcatgcaaacacataattctaagaatgggtccataggttttacaaaactaacaaatgagtgtaggtcatgaaaatgtttaagaaccccttccctagaatatagtcctaaggaagacagggattcactgatgcagcctaagtgcctgaaacattctctggaatataggaggctctcagtgcatatattctagattaaactcagactttcctagcaaaatctttagtgacttttttatgtgataaaataccctgttgtaagctctcataagaccaaatactgctcatttttagctcttgtggcaattacacgtttacattcattgttattataatttgattgtgagccactggaatacagactctaattgggtagggatcttaccacttttgcatgcattttctgagccccacacagagtctggcaaataaatgtttgttgaatgaactataaattatattgagacacaaaataagtaagatttactttctgtctcaaagttttgtagggactgtgagaactgtaaaatattgtagcaaaaggtagtaccccagcaaacaatcatccaaccgactggctaaatgaataaataaaacttataagaaagtacaaatacattgttatgggaattgaaggtattaagtgatcactttttgtgtagaggtcagtgtgtggtttatataagtagtagtaatttacttgaatgtagaaggagaggttggatttctaacacatttatagagacccttctattctaagaaaggggaataaaagcaaaagcatggaaatggcaagaaacagggcaatttcagacactgaccataagttatctataaggaacggagcaaattagtttgtgcagttagattttgagtaatttcagtataaacctgggtgctaaggcaaggttttggactaagcttctttggtagctaatgctaccctgtttacagtttttgaaaagtgaaatattcaatgcaaactattagggagattcaacttaacatagaaaaataatactgtgaaatagatttttctagtaaaataagtataaaacacatatttcagattaataagagttcttaaattcaataacatattttgtgtttattaaaaacaccatagataaattttgtgtggatacagagaaataaaactagataaggcctattataaaaattttacctctaagaggtaagatctgcatttttacttatgtcatgtgtggataatgggattaatactcaatttatctccagaggaaggtcagcatgcctgttcaatagcattatatatttcaaaactgtaatagacaacagcagaacctttgcttgcaaattattttatttttatgtagttaatattttgatgacatgagagaaaatgcccatggagaagagaccaaagaaagccacttccacttaattgatatatttgtattaatttctagatttaaatctaggtgtgaggttacagagtaacatggcagagagcttaggaaatcatggactttcagccagacctgggtttcaacacctactgggttgcttcccagctcttgagtcttaggcaagttgcataactaataagagctttagtttccatatatgtaaagcaaaaacaacaaaaatgggaatcacatgacatgatgcatagtgcatagcacagtggttgtttagtaagcaatcaataaaattgttttatgattaaaatattatgatcatgcatgatagaggtccaaactatgaaatactcctctctttattttctaaaatcctacatttaaaattttcactaagttcactatttgaaattccaccatttattgattcattaggtaagaaaatttctttgctactgtaaccattagacagttgtagatactggctttacttctttcatcctggcctgatgctgtggctaggcaagtaaagaagaaaatgaagagggtaaaaagaaagtaattggaagaaaaggatgtagaaattgctgagtatcaaagcaagaagacagagaacgacatgagtaaaataaagacattgaagaaagtctgagaaaaaagccaaatgtaagagagaatgaatactctctctaccattcgctactgctcattaagattataataataacagtgttgataagttaaattttttgccttcaaagtcagcttttctctgccttgctacaagatactgagaaaatgtggagagccccgatttagctgttggccttcaaatcttatcccaaactctataaagtgactgatctggagcaagttacttaacaactatgaatgtgagtttaccaatttgtaacacggtgaaagttagcaaaggaattaaatccaggaatgacacatagcaaactataccactataccacacacaggaagtcttctttatatgttagctgctatgtataaatatatgtagtgttctctcctgttctctctcactctctctcaatatatgtatatagcagctaatatctgtatgcatatatatttgatttataaatgttatgatgttatgttatttataaatgttatgatgttatgtttgaaaatagtttgaaactgttttcaaaactggcacttttattttgtggatacaaataaatgtttttctgtcatcctactgccacaaattcttttcctgaaaatggtttaaaatgtattcaacaacagcattatatatctaatgaaacttgtcacttaatttcttcaagttcttcattccatattatttatttcttaaaaatttgagaatcagatacttatcaatttactttttagtttagtatgatttcataaaattgtaacatttataaattattatataatttgcttagtaatagtcatacgactcaatatttcaatcagattttataacaatttgtttgaaactttgaattgtgataaaagaacttttcagagataaattcagattaaaaagcaaaaaaatttaaaagccttttgatggggagtaccagttacttgtccaaattgagagaaaaagaaacagtcatcaaaatgaccaagagtaatatagcctcagatttctctttgttacctgatgacactatttaagatggactgtcagatcccattaggtttgcggataatattctgcagatgagatgaaaatggagttttcgctcagcaggaggaaagtgagaagtacacttattctagtcaggctcagagatgttattctttttctgttgttgctatgggataacattgcatcaataacaggaaagcgatccaactaagcttcatgcaccgcaatcaagttgttttgatgcaaataaggttcagtcacttagggtactcagttatgacaaactgtgctaacaaactataaatcaaacctgagctgaattgcaagtgtatatgctagataaaaaagaggaaaagcttttatcttttagtagacttaagagttattttgaataactataaagacctttacaatatttactgcaaaattaaagtataaatgttgttgttgataatttttaaaagtcaatttttattgtcccagaaatcctaatggagtttttattaaaacaatattatgagacaagtaagcctatgttatatttgggatagtatgtttttctagcatacataaacaaacctctgatcatagctctttttccctttcattttgaaattgtagttggtctggagaatgaggaaaaggaatttactaaaattatttgctctttaaaaagttatgcttatgtattatacatattcacatttaattcaaaatccttattttttaaaattttattcatagaaacattggcatttagggcccatatatttacctgactgacatttgctggtaatacatgtctgtcaaactaaagtattagaaactgaatagattttgaactaggagttcacatgcaattgcccatgtttcatactgttgtatcatttgttcacatttcctttagtggttgtggaatagaaattataatagccatatatagagagaccttacatggagccgaaagaatatatatcaacctaaaaacacactgagttactataagaatcttagccatgtgtatctaaattttcatttttcactgccaggtgcaatttgagaatgaatctttcctacataagaagacattgtaaatatgcaggtgggccctaaatcctgcatttgtagagcagtcatactgtgctagcttgtagtcataaatgtttctagatcagaattagatttggaaatttagcaaccaatgaaaataagcatttcaaaaccttgtgggtgattgttttttgtttgtttttaattaagtctgaagagagtgcacagaatgtcacacagtaaatagatgctgtcatctttcattaccaggcaccccatgacagagtccattgcagcagagctgaggaccttcatatcacaaaatgagtttgcttatcaggcatagagtgaaatgtttctgtatctcacaagaatgtctgatattatgcttctttaactgcacctgtaagcctgttcactgcaatttaaagacagtatcatatgtaacttgaagtcattttcaactggccatttgctcactcttagaatgagttttctaattaataaatatttttgaagacatggtgaataattggtcagatatagttaggattagtattaaaccctcggatctgaaattgtgatgaaagggtctgagatttcaccctgcatctcagctaatgagtgagcctgtcacagttttacagatattgacagaaagatatgaggcatctgtgtcagagacaagagtttcttccagtaaaagcagcagtcgaagtaacattgtaatgctgttccctgagccccaattcccaggggactaccggatgagggccaggtgatgcctgcacgtgtgaggggtatactacagaagaaccgtgagattagaagactgttttttatagaagctattggaatcctttgtcgtggagaaaaacgttatctttattaccctgtgcaaaattaggaaacagtccagaggatcatcctcacatttgagctcagttgtaagtccaggtgtcccccaaaccaccttaagtatttataattcactgcctggatgaatagaactcactgaaagctgttatatgcgtggttatgacttattatgtcaaaagaatacagattaaaatcagccaaaggaagagatgcatgtggcagagtctaggaaagttcctagcgtgaaacttctgattctcctctcccagtggagttacggacaacactgattttctctgcaaccctgcatgataatatggatggagtattgacaaaccccagaagctcatcaaagctttggtgtccagagtttctgtggaggctctgttatgtaatcatggtctactgcccgtatggctagtcttagtctacagcccctccagtgtgtgagctgaaattgtgactgaagaactccaccccaaatgacatctggtgtgacattttctaccctaattcctattgttagagtatctggtatgatccaagtccctcaggcaagcaaaggcactcccataagtgccttttatgaaattccaaaggcttagagacctagcaaaagccaaggaaaaagacaagacatgaatttgggcgatgttaaattatttattacaattcttagaatgtaagcagatctctctggggaggggaacaagatgtgtttatttttatcatctctgtctttccagagctttctgcttatacaaatatttctgaaaaaaatagtcctggagcaaattggctgttaatgtctagatgtgtagattcatggagaaaagcctgccaacaattagctagtgctttgcatttgataaaactcatcttttgagattccctctttcaaatttctggctctttgggtggactaaagagcacttcttttcaagctgtatttattaaacctagagaaagtgatcacactacttttagtagcttttatgttggtaacagaggaagtctttcgacattgggaaggttttttacttccctcatgcatacatatatgtgacttgaccaaatttagaaggtttttgaagggaacagaaatcacagattacctgcaagcaagcaatttcatgagatggcaccactgaaatttatttcaattttttccctcctaaaaacaaggcgattttcttcaatgactataaggttaacaaaacctaaccatgatttataatttaaatatataatttcatgtgtttcttaaaatgatattccattgctgagagtgacagtctcctctctgcctcgaaaccctaatagttggaaaggagaggacaggtactctgctttctaatcctcctgccttcaatcattactcctcattcctattaatacacttatatttttagccatgactattcctcaccctgcccctcccaaattcactttccctttagatactttcatggatccaaaaggaaaagcgatgcttctttttatccatttggttcaagcatgaatatctttccttgatatctcatagtaaacttcggaacatttaaaaagatttttgtaaaagctaggataactttttcaaactattttccctaaaacatagtttcctttaaaacaagaatttcactgtcaaatacatttggaaagtgttgtaaacaatattttcctctagggaaattcaaaatacacattatgcctaaaaggctgtaacaaaatcctgcagcaaaatttagacagaggaacaacaataggtaaaataaatacagagtacagcatgcaaccaacacagtttcttataagatatagtttgtcccttatggcatcagatgtgagtttcaagggctgccttttatgtgaaagagtcatttcttagccttcacacccagaagcattggctgaaatagtttgacagcttaaggtctagacctaagaaagtgaagctcattgaaagaggttatttcctctcctgcttacctaatacttttcttctaagttttttccttttctctgtggatactggtatgactaaatctacctgggaagagtaagtcctcaggctatggcttcgctctgtgaccacaaaggactgccaaattcagtgtaagacaatgacttaataattcttagataaaatgtggtaactagagcaaacaggaagtagtggagctaacagtgttatatttcattgtgtgcagttgatatttcataggtatagcttctgcatatcccagggatcagagatatgctctgccctgaataatggctgaattaattgtttattttcctagatatgacttagtatgtttgactatgcattagtatgctaatggtgtatgtatagaacaactaaagtcaaagtgaggcaatttagtagaaaataatttcaattccttatttatgacaaaatttaagtcacattttaactcagaaaatgagtgacttttaataaaaaaaatttcctataaaagatactgattttctttttactggaaacaatatttttcaacattgtgttctttcttcgagagcttagcatcccctaaatatgagaatcatctacttaaggaacttgaaattcctgagaagacacaaaacatgtatatataaatatactacaatacatcagcaaatagtcattctttttcaggtttaccttattttttattcattatcaaatctgcttttaactttttatcagaagcagaacactagatttaaaggctttccaaagcctaatgagtaagtccagtgttctctctgtgaatattgcatacttaaggctgtcatgttttgattaagcataagctttaatagatttgctggaataattattaaaatatttgaagacctacatttcatactggaaaggtcagaaagataaaacatacattagcggataaattcatatgagataagttttagaaaaattaatttcatggtatttatgactttttggagtgatagtttgttgatgcctattgttaatgccaatacaatgtgacacaattaaataaaataaaataaaaaaaagaaaaaaaaaggtgaagaatagttgtgtattttataaagatttttttaatctttatactcttgatttactcttttgaaactgtttctattagaaatgcctgatgccacatttttaaacaaagtgtctatttcttcacaatttgtatccaggaaaacatcatttctattaatatgccagtgccagagagaaacatattaatacactttcactttcatttttatactgacattttatttttagtcttgcagtctaatttttttttctacctgaactgtcttatggactaggtaaacttaaacacgtatcattcctgagaaaggagaaaaaaatgaaaacatactctatgtcttatcctttcaaaaactttaaaagttggaattctgaattcgagaaagcattcagaaaataacattctaaggaaaatatcctagttctttctctaaaatacacctctgctaaatattatcagatatattttcactgatcttaacttcgaaaatgatttcaaattaaggatgacttgctagacataagataatttggctctaatttttttgtacctttacaaattgacttcaattcagaggaaaatgatttgtgaaaagtctactttatgccatttgatttatataacagtggcaaaatatgcctaactggtatgtgagtaaaagatatatttgctaagttattatttgctaaacaaatctccaaataaatagggccatcttttagaaaacgtataattgatgttttagctaaaattttactcaaatgaggtaatgagcaaggctaagcctcacgttggtattgagtgtgtattcttacatctctgaaagtgaggaatggacaagggcaatcattctgggatgctatttgcattatagaccagaaaaaaaaaattataatgacttttaagagggccaagtctggatttgttagaaaacaaaactctggtagtgtgtaggactcttacgcagctaaaggaaaagtaaggtggattaatttattagcagtcacttgctccactccaggttcaggcttcaacagtacatcccaatcagccctttaaagtgccccttatctgtgcaccactcatccttcagccccacattcaatctttagggcctacttgtctgttgcacatgagcatacacacacatatcccagctggcacaagtaatgttatcttcactgacaatttcaaaggacgcaaggaaaggggagcctggcacctgggtagagcctctgggactcatgactccgagggtggctagagaacagatacaccaaacatcgtgaaggtgcctagaaactctaagactctaggtccttggattgtagggcttcagcctagtatgacgtgtctcctagtgagtggtaggacctgggaaactcctattggtatttgtgtcatgctaagcagaattgacttagaaaagttagttacaataacatcttataagcaaggtttatcatttaaagatatatatatatatatatatatacacacacacacagacatatatacacacacatacacacacatactagcatattctttatcaataagtgattactctgtactattttcaaacttcagaatatcaaagttcaaaagaatcgtttgaaagagtgagggtaagaggttttaatatgtagttttctgagccttgttcttagactctgaatcaagattgagttggtttgttctggaaaccaagaatttgctagccaaacaaacatccatgctggattgaataacaacagtcttaggaacacactttacaaagcatgaccccactgtaattgtacctatcaacatttattttgcagtatataatatgtgatgcccaaccacaatagtgtgagcatttttcactaatcatccactgctgtttccttcactgcattctttctgtaatgcttcatttaacaaatgttagttggccatgatttagcaaaacatgatgtctacccattaataacctgtatcataatatgagaacatttcattcacttaatgtttgctaagtgtctataatacagaaagatttacagtgaaactcctctttcaacaaactttatcaggaaaattgtcacatctagaaacactcacaagaaaatgaagaaagtaagaagtgccataagagaagtcacgataaaagtttttcccagaaggggattgctttaagcttagggtagtcatgaaaatagagtatttcaggtgatcattcatggcactgtttaaatatgagtcaggctgtgaaactcagggcaaggagagaagcagtggcagatgaagggaaggtttagggtatgcacagggaactgtgtaccatatgcgtatatagaacacatttggatatcacataggataagtgaatagcaataaggtaaatttggagcttggtaagagaaccttttgaatgccaaataaataaataaggactataagccttactgtgtagatgaggaaatgccagtaagggttggggtaccagggcagtatatcatgaagatgttccaggtaagtttgtgatgagttgaagtgaaggaaactgttctataggagaccacagagactagataagatgtaaaaatgcctgaatttaagtacataataaaaggaaaataatgtaaggaaaatttaaacaattatattgaataagtcttggtaactactggacatgggggaaaggaaagagtcaaaaaacaatgcccagaatttgaaagctgggcaactaagattattgtggtgacaagaacaaaaaaaaattcttttattattatcaaaaccttgcattagatcctttgtaaatatttaaattaatcttcctcccatcttagaatttggaaagcagggaagggggtcccaggggaagagtagccagtggacagttgaggagagcaaggggtagttataaagagattcttgatatgtcttcctgtatcacagggcgtgctaaactttctttttcaagggcggatgtgtgtgtgtttacagcatactcaaagtaatgtttacccttgaagcacattatttattgatatatttacatttattgaacatggaaattctctaagaggaaaataaataacttaggtacttgactttcatgaaatttattttctttatttacttagtaatcctattagttcctgttttgtttgagattctatagtattgtttcatttagccaaatatttcaagacaactttttggcagaagaacttttcatttatttgcatttctttcacaattttattttctaatccatttaaactatcacaaattaatatagaaaaatatattattgaggcaaacaagtttttgtgaaataaattgaaacccaaaaggatgaagaatgtcattgacataaaagtgtaattgttcttcaatgtaaccttacaagtatagatataatatatcataattgaaaaagaaggaagagggaaaactaacatccaaaccacttgaatgaagtaagtttttacacagcaaaaatatatacgacttttatttgtcaagtatactttaataatgctgggggtgggtggaattaattagcagtaagttggggggaaaagtagattacgtggtggccattgtagtagttgagagcccttcataaatgattgttaacatcgttctagttgcaaatattatctgaatatgaaattcatgctaccgtcattctgaatacttttattcttgagtttattttattaagacattaatattgttttcatgatcatcatcataagtgtgaccatctcccctctattctacctagcactatttttcttctaggaagtgcatgtggtgtttcagcatattttacattactttggttacaattaagtgaaattttatgtcataaatttatatagtttagaagcttagtttataagatcttgctatggctttctatttctgggaatgatgtttctgacaaaaatgtgtgatagaatgcatgatagttatccatttcattccctatggctcttagtgtaaagtccaaatctcttcacatgttttataaaagccagtaagatctggtacctgctttttactcatgcatagtttttctccctcatatttcatattttgccctccagttttactaaattttagtttgttccctgaaaatgactctggttcttgcttgcaggcctcagagcgcacttttctatcagccacagtactttcttctatgcccagccttccccttcccatcttttgcttggcacctaagcatttttcatgtctcaattggtcccctgtgcatcctttaggtttcactttctctggagaggcttatgaatagcccccaaatacaatgggtggacctcaactctatatccaaagaattttgtgcttctattttcatttcccatgaaaatatacaaaatacttcattaaaaaatataattctctctctctctctctctctctctctctatatatatatatatatatatgtaattacctgtattcttgtctcttatccccactagaccctaagccttgtaaggacagtctttgtctatcttattttccctttgtcttagtctgttcatgctgctgtgacaaaatatctgaagactgggtaacttttaaagagcagacattgattttctcatagctccagaggctggaagtgcaggaccaaagtgctggcaggtttggttgtctgctgagggctattctctgttttcaaagtggcaccttgatgttgcatcctctggagggaaggaaatctgtgtccccacatggagaaaggcagaagggaaagggagctggactcagcattaaagctcttttataaagaccttagccccattcacaagggaggagagctcatggcttaattgcttcttaaaggccccacgacttaatattaatactatcacattggccattaagtttcaacacctgaattttgtaggggacacattgaaatcatagcaccattgtatcctcagcatttaagcatagtggaggtacatgttagttgatgattgttgaatgaatcaattgatgattttcttttttatggttaaactaatgtggtatatactagactcatattccaacacaaacattcataaagattaaaatataaaaatattagattgtagaaatatgatataaatttgaataacatttttagaacaaattttcaacaagaactatgctttatactgtgctacacacttagcttttttagattttatttttatcttttttacccaggctggagtgcagaggcgcaatttcagctcactgcaacctccacttcccgggctcaagcgattctcccacctcagcctcccatgtagctgggaccataagcataacactacacctggctaattttttgtatttttgatggaaatgggtttttgccgtgttgcccaggctgatcttgaactcctgagctcaaacaatccacccaattcagcttcccaaagtgctgggattataggcatgagccactgcgcacagcccacaattaagcttttcaaagctttttgcgtactagtcttgtagaaattatttaacagctctgatttattgataatatcaaggtgtattgtaaggttaattctttattcttaatattgagataatgacctatgctcttaagtttgtatttaacttaaagagtaatctctgaaccagagtgttagctcttaacaattcataaatggtcactaaattaaccattttttttttttttgagacggagtctcgctctgtcatcaggctggagtgcagtggtacaatctcggctcactgcaacctccacctcccgggttcaagagattatcctacctcaggctgccagtagctgagactacaggcacacaccaccacgcctagctaatttttttcatatttttagtagagacggggtttcaccctgttggccaggatggtctcgatctaacctcgtgatctacctgccttggccccacaaagtgctgggattacaggcgtgagccattgcacctggccaacactttttttcaaatataactttaattaaatattggtggtgtgctaatggtttttaataaagtgttaattgaattgtgcttctcatcacaaaatatttgtaaacttcaaaggttcttatgaaactcatagtaactttaagaagaaagaagtaaaagcagaaaaactgataaattacttaatattatttcctgttacatgcattttctggttcttgtttttaataattagatacatattatggctttaatgcattagaactattaatcaggtatctcaaggtgatcacgcctgtgtcttgctagtcatgcactgcccacaagtgctcaataatatttactaactttaccaggttaactacaaatgtgggaaatagttaactcattcattttaattggttataaataatcttattttactttgttatctcaatatctttacttgacgcttactctgcacatttattaattgaatactctattaaagagaaagttattgtacagtgcagagttggatttgcagacaggagttcaactacttattaattcatttaaaccttctgaaatgcattttctcatgtgtaaaatgatttcaaagtgcaatgaaaaaagactgtctcaaggagatactgtttactcaccaacttatcaaatagaataacataatttaaagcattctaaaaccaaagaactctagacgtactaggtattattaccaaaatttgtatttcttttctacatatcacaatgttcaacacagaattaggggtaaaagcagaaaattggagagaacaccatataaataataaaggaactgggtgctgtggctcacacctataatcccagcactttggtaggcagaagtgggaggattattgagcccaggagtttgagaccagcctgggcaacatagaaagactctgcctttacaaaaaaaacacgaatgaatttgctgggcatggtggtatatgcatgttgtcctagctacttggacagctgaggtgggaagatggcttgagcctaggaggtcgaagcctcagggagccatggttttaccactgcactccagtccagcctcggcaacagggcaaagccctgtctcaaaagaaaaaaagaaaaagaagaaatgttcaaataaatgatgttacacccaaaatatgtgataatatgtgattcaatttacctttaaataccgaaaatatttcatgaaattaaaaacactatcataacaattgaggagtatcaattatatatgagtacatctggatgcctacattgttcctcaggttttgtgcatgaaggacagctcatatatgagattatattgctattatattgctacataccagccagctaaatgcaatcccccaaggacaggagctaaagtataacggagaatatccaaattttaaggaagtctttaaatgcatgccagtgtgtaagggaacttatctttctgtaagtgaatgctgttttacttttcttagcccagtagctaacagatttgacttctcatcatacctcgtttttaagggagatatctgagaagtaaaatgtaatgctgtttatgctactgatctttttagcacccaggagagtaaggagggcagcaccttcaagttagtgaagatgagaagagagccaactcttaatgaaatattttcttgaatctggcagtaacacgaaggatctaaaaactgataaacacttcggttacatcaaggacttttatattcccttctttattatgccagatgtgagctgccaacttaactaattaccatgttctcagtgggaagtttgctgtaatgcattttttgctcaaaaatatgttaaacataaaattcatttttttttcatttggggtcttcattttccaaaaagggaaataatatataaagctttgaaaagaaaactacatagtagcatttacataggaacgtttcttgataaaatacagatatacgacccaggaacaagcctggcaaaaaatttttcctgagggttttcaagttagaaaacccagtagtagaataaaattatccaaagacacatgttttggcaaacggtaacttacttctcttttatattctgttagaaaatattcagttgcttttgttggtatttaatattttgagaatatctaaatataataaaaagatccgctttcttcatttgcaaatgagaatgtaaagttcattattttgaccagcagtttttgctatttgtgattaaattcctataagaacttgtttgatatgagattgtgctcttctcaaataactctttaattttaattttacacctttgcaagtgtcagaatgatttgaatatgagagaaaagataaaggacacacagaataactgtgtgtaaatgatgtgcctttattattgttaaatactaaatagtaactattgtttaaagaaaattagtagtctttgaattcacaaattggagacctatttacacttcatttgataataattgctagcataagaaagacattatgttcaatacatatcaatatacataattaagaaggaaatgatttatattcaaggtcatgaacatcatacatcttagatttcataataaagaccaccagtaacacagcattttactagacacaggaagttattttgcgttacactaaaatttaaatattcaaatttatttcctaatattttaccaattggcatccataatgtagacagttcaagttgttattaaatgcacacatgcagttaaatataaataaggtataaacaacaaaaatctccatctactatgtcaggatgttaaacctttcttatggaggaaaaaaaagtgttttgctacactttgagctactcatctggaaaatcaggcttatccattaggcccatggatcaccattgaattactcatctgaatgtagccaaaaactcatactgggaaaacagtttaagaagctaattaaactgatagaaagaaaactttaattttaaagaaatatagaaagcagatgattatttataatttcaattaaacttcctaggctcatatatgaagaataaagtattaaacaaggagaacaagaccaatgcaaatatgaattgtggacatcaggtcttaggatatatatactaaaatacctaggcttattcagtcaaaaaaatgtaacagttgacccttggacagtgtggagtggccgaacgcttgtgcagtcaaaaatccacagataacttttggctccacaaaaactttaactacttacagcctattgttgactggaagacttactgataacataaacaattgattaacatatattttgtatgttatatatattatatactgtatactgtattttcacaataaagtaagctagagaaaagaaaatattatgaaaataataaggaagagaaatatatttattcattacgtggaagtggatcatcataaaggttttcttgtggtttataggctgaggaagaggaagaagaggagggtttggtcttgctgtctcaggggtggcagagacatataagtggacttgctcaattcaaacttacactgttcaaggaacaactgtatatctatatgtgtatatatatatatatatggacatataaatgtatatacatttaagaatttcagtgaattaatcagaagagactcccttctttattagcaaacataaataaaaatagatacaggtaccaacattcaataacaacttgtttttttgatatataatttatttatatctacttattgaaaagtatgcaatatatgctctgtttattttctttcttctctcactatattaattgtatcccttcccacccccttgaaataatctagatttataacttccagtgtttcatagagatatactaaaagttttatgagattattctggagttaccatctgtaattttcaaaagtaaactaaaattgctcagcggataatacctgtattccatttggaatatcattatttgtgcatagttgcttattaatcattatcttggaatcagaataattgatcgatacagcaaagatttttgtaaatatcagcagtctttggagaatggagagttaggaaatttgaagattccaaataagtcatattaacagatgattatgttcctactaataattgtattactagtagaacaaattggcctcattcatctttatttttgttagctgtttaggagcattagactggtgggtacacttttgtctttactagtactaactagcaaaaggctgttttcaatctttttaaataaatatctattttagtgaatactgtaggtatatatatcatcagaagcaactactttgcaataaataccactactgactttgtagacattttcttaaggcattgtacctcagtttgaacaatagaatttcatttaatacaaaatgtttatcattatttcccttcttggaaggacagtctagcaaactctgaaggtgtttctcagtaaggacttctacgaatgtggcaagattgttaacatgatatcacttggcaaagtttctcatattacatgtggacattttaaacgtatttagtaccatagccttaatgtgtttttattgtataaacaagttgtattttgattcagatatacttagtttttaaaaagtagatgttgaaatacttttagtttggtaaatatttcttttcaagaataattccaattgtgatcctcttccatattacaatggtaatatagggtttatttgctgctaggtaacagataaaattgctgttaggtaacaaataaaatatgcaactaagaaggtttgtaacttctgttttatttctatcactggtatgtgcttgaattaatgaaaagcgtctgagactactgattatttcaggaaaaaatttgccagcaattcagagtagttgctactacatggtagcagtgtgtttctttctctagcatagctgggttgcaattaaaaagaaaacagacatttggaaatattctttataaaaacaattattcttgaaacttgaatttcagtgaacacattataaactaaataaaattaacatatagaaataattgtaaaaacattttatgtttcaaaatcattgtaaaaatgttttctcttttaaatatgaggtttactctttaattcttcaaaaattccagtaaatcgcctcacttttggtctcatctgcttgctacctaacctatattggttcattggtcctttcagtgatacttgtttttgtattctagactatagataagtccatagacttctgtcatctttccctctagctaatgacagcagcactatcatcataaatattataggagcttctggtaactgagtacctactgcatacctggaactgtgataggtgtttcaaagataatcagtatctttgtctgaaaggtaggtagtattacccttgtataacttaaattgcagaagaattggctaaataaaataaatgatgaaaatagctgtaagacaagaaatgtgggaatgagtatattttttagggaagggggacacctgccttttaggtacaatgattgtttttaagtgagctaagcatgaacagatttcaggttttcaagagaatctgaatctgtgaattatgatgtgaaatagccttagagttgagatggccaattgaattatctttctaactacatggtgggtgaagcaaaaacaaatgtagacaaggtctgctgtaagcaattttataggctacttggtgtcacacaggtactaagtgataaagcaggatcccagcccaggtctgccagggtccattgcactccttttcctctaatccacactgctttgtgagctacaggcctgtataaatgccactatctgatttgtatattctatttctaggcagttgaacattttgaggcaaaatcatgaaattaaattgagtgttgtccaaatttagctgccccccttttattaattgctccctactttttttataggttctaattcctgagatagtaaatggcacataggaaatttcttaggagtaatttggggatcaccatctgtggtgtagaaggggaaaaggcaggattaagcagagggagaagttgagctgcaaagcacatccaacaaaggccttcagcagaccccatggggagctctaggacaacccaaggtaaggtgggggacttggcctttatacacttgcattgagatttgatgaaatctggctgccttgaggagaggaagtcccttcggctgactctgaaaagggctgagaggcaggacatagtggctcacacctgtagtcccagcactttgggaggccaaggtgggaggattgcttgagcccaggagtttgaggccagcctgggcaatatggcaaaaccctgtttctacataaaatacaaaagaaatagccggccattgtagtcccagctactcgggagactgaggcaggagaatggcgtgaacctgggaggcggagcttgcagtgcgccgagatcgcgccactgcactccagcctgggagacagaccgagactccgtctcaaaaaaaaaaaaaaaaaaaaaaaaaatagccgggcatagtagtgcatacctgtagtcctacctacttaggaggctgaggtgggagaattactttagtccaggcagttcccccagcctgggtgaaagagcaagaacctttctcaaaaaaaaaaaggaaaaactacaacaacaacaacaaaaacaaaaggactgacagctgaagcttttctagcagcagcactctctttcacagttacgataatagcctgcaataacttatcctggcataaaaagaatttgcatatcatataattggtgattttcttgaccttcattctcaaacagaggctagttatgttttatatcttctgtgggagagaggagaggaaatcagaggggaaataataggctatcctctttcggaaaaccaagcggccaagggggtatcccttggtgcacttttagagaatatccaaatattctctaagcccaaagctctaaacatcctagatcagattaaggaaatgtagaaccaaaaatcagaaatttctggaactgtagccactcttttgaaagtgccaggcagacacaggactcagaattgtcctgtcaatactcagtctggactgtataattttaccggttggctccaaaatgcccagtccagaaagggataaaccttgatgggctgcctgcaaaatgtattaatgtttttatattgttttccaggaatttttattcatgttttactacccattataaagacaatgtggttggtcttcatcagtgtcatgttcaggggcccttaatagcactttgttgggattttaatctgttaattaaattaataattaaaaattactcatctattattcatactccttattatattaagtgcctttctcatataatgttaagttgtttaacacctttactttgagcaacattaataataatattctaaattgttggctactttttcaaaatacctgatactcttttcatggagtagttttttaaaaatagcttgtttagataaagactgaaaatgttgctaatctggtttaattctggatgtttgaaattatttccagttgtttaaaaagctttatgaaaaataaaacaaagcttccctcaaatcatctggcaggtgactttacaagtaaccaggaattggtcagttttcaatatcatttaatcataatacgttaattgagttattgctaatatattctcacagggtatttgttctaatttactaccttatcacactgctataaaaatagcagaagatgtgttccgaaagccactgccatggacgttcataagataatacacagttaatctgttatgcctcaccttcatagatctgtccagaaacagaaagcacctctcattttccattgatccttttctatctcctgcctcaacaccaccaaatatttttattccacacaactctgtggccttccaaaattattaatttaagagattctaaccaagactctgtccaagaatgaaatagcttatttatggatccattcattggtttatggatccagggtgccctggagaacaccacaaatcttcgtgacatcccaagtgttaactttaatgtttatatctttaatttagctgaaagatgtgtaaaatctcatatagtcaaatagctccctcttgactgaacatataaaattgggattaaagcatgctgttccaatagatatcaatcataacttatgctcaataatttatttttgaatctacattttaagatcgcacaatgttaaggagcaattgatttttttctcccatgcggcttatttgtggccaaatcctagttgtacagagattgccttgaatatccagacttcctctgggcttccctgttatatgcaatagtgtaaccattaaaataaggtcagtaagtaacctcttggcatcacaaatagcagcaggacagtagtaagtatatgtctgtctctacatatagtattttcctatttatccagctcattacataactatttttactttattatttcaaaattggaaaatgatataactaataataatcaccatacataggaagggatttgactgtaaagataaatttaggccgggagtggtagctcacacctgtaatcccagcactttgggaggctgaagcgggaaggatcacctgaggtcaggagtttgagaccagcctggccaacatggtgaaaccccgtctctactaaatataccaaatgttagccgggcatagtggcgagtgcctgtaataccagctactcaggaggctgagacaggagaatctcttgaacctgggaggcagaagttgcagtgagcccagattatgccattgcactccagcctgggcaacaagagtgaaactccatctcaaaaaaaaaaaaaaaaaaaagataaattcaaagtcacactgtgtttcacatgtagcatactgtgtactctccagtgtttctgcaaaagccgttcttcagcatgttagtcattagtagactctgacacattctatatttgtcactcatcaggttagtttaatatccactctttccaataaacgtctgattctgaatattccatatgtagagcagattaaaaataaaagggaaaacacatagtgaatcatgttttaatgttcttaactccattaaaaatgcattatatgcttcacctacttgcaaaaaaatgagtgaaattgaaataagacacagatacattttattttttatttatttatttatttgtgacagagtctcactctgtcacccaggctggagtgcagtggggcagtctcagctcacggcagccttgacttcccagaatcaaacgattcttctgccccagcctcccaagtagctgggactacaggtgtgtgccaccacacccagctaatttttgtatttttagtagagataaggtttcaccatgttccccacgctcgtctcaaactcttggactcaagcagtcctcctgccttggcttcccaaagtgctaggattataggcttgagccatcatgcccagcctccctttttttttttaaaaaaaaaaaaaaagacctaaagatatcttttaaagtttgaatggatattgataaatttactccaaatctgaggcaaagataatttcttataatatttaaagtatacttgtatttagcttagtattataaaactaatattgaatttcatgcccttctgaatttctgtgaaaatttaccatttctaaaaattattcataacccttggcattttataattttatttcattattttattttatttttaatttcatttaacaaatttttatttatttttttgagacgaagtcttgctctgtagccaggctggagtgcagtggcacgatatcggctcactgcaacctccgcctcccgggttgaagcaattttcctgccccagcctcccaagtagctgggattacaggtgcccgccaccatgcccagctaatttttgtatttttaatagagacagggtttcaccatgttagccaggatggtctcgatctcttgaccttgtgatttgcccgcctcaggctcccaaagtgctgggattacagttgtgcaccattgcgccctgccccaaattttatatcttttgaccaacgtcttctcccccatccctccaaccactcctgcccttgataaccaccatttccctttctacttttatgtcagcaatttttttctatcagtgagattatgtggtatttatctttctgtgcctgactcatttcatttaacttagtgtcttccaggttcatctatgctgtcctacatgacaggatttcattcttttttgagggtagttactattttattgtgtatatatattacattttctttattcattcatgtattgatggacacttagattgattccacgtctggctgttttgattactgctacagtaaacgtgtgatgcaaatatctgttcaacatattggtttcattttctttggaattatacccagtagagaaattgctggatcatgtgctagtttcatttttaattttttgaggagattccatactgttttctataatggctatactaagttacattcctaccaacagtgtgctagcgttgccttttctctacatctttaccaactccttttagcctttgccattttggtaacagccattctgacaagagtgagggatatctcattgtggttttgatttgcctttccctgatgattaatggtgttgagcattttctcacatacctattgatttgtatgtcctcttttgagaaatatctaatcatgtattttacctgtgtttttattttgtaatttattttttattaattatttatactcatttatttatttaagacaagatcttgctctgttgtccaggctggagtgcagttgtgtaatcacagcttattgtgatttcatagagatgggggtctcactatgttgctcaggctggtcttgaactctgggcctcaagtgatcctccgccttgccctcctaaagtgctagggttgcaggcatgagccaccacacccagtccattgtttaaaattgagttatttgtcttattattgagttgtttgagttttgcatatattctggatattaaccatttatcagatatatagtttacaactattttcttccattctgtatcctgtctctttgctcttttgattgtttcctttactgggcagaagttttgtcatttgattaattccatttgtctatttttgctttaattgcctgtgctttttgaggtcatatccaaagagccattgcccactctaatgtcttggagctttccctctattttttcttccagtagttttatggcttcaggtcttatatttaaatatttaattcattttgtttttttttttaatatggtgtgagataagagtctaattcattcttcttcatgtggatacccaattttcccaaaactattcattgaagacactgttctttccctcttgagtattctggctcctttgttgaaaatcagtttgctctaaatgtgtggatgtgttttggggctccctattctgttccattggactatgtgtcttttaatgccagtgccacactctttcgtaacttactatagctttttagaatgttttgaagccaggtagtataatgtctctaacctcattctttttgctcaagattgctttggtgatttggggttttctgtgctcctatacaaagttcagattttttttttttttctgtgaagattgtcattggtatattgataggtattgtgttaaatctgtaggttactttgggtagtgtggatgctttaataatattaatattaatgctttcaattcatgaacatgtgagatcttttcatttatgtcttcaattttttttcattaatattttaaattttaagtgtacagatattttacctctttggttaattttactcctgagtatttttttgtaggtattataaatgagattgttttcttattttcagatattttgctgttagtgcataaaaatagtactgatttttgtatgttgattttgtatcctgaaacttaatgaacttttttattattaatagttctaaccatattgagtaatgtctttagagttttctacatatataattatgttttctgcacacagagagaacttaacttctttctttccaatttagatgatttttatttccttctcttgcttacttgatctggctagagtttccagtactatattgaatggaagtagcgcaccaggcatcctgccttgttctaatgtcagtggaaaagtctttagctgttccctgttaattatgttagctgtgcgtttgtcatatatgatttttattatgttgaggtacattccttccgtacctaacttgttgagagtttttatggtgaaaatattttgaattttatcaaatgctttttctgcacttattgaaatgattgtgtggtttttgtctgtcattctgttaatatgatgtgtcatatttatttatttacatatgttgaactatcctttcatcactaggatgaatccctcttgattttttttttttttttgagacagtcttgctctatcacccagggtggagtgcagaagcgcaatcttggctcactgcagcctctgcctcccgggttcaagtgattctcctgcctcatccctagtagctgggactacaggcacatgccaccacggccagctaatttttgtatttttttttttttttttagtggaccatgttagtcaagttggtctcaaactcctgacctcaaatgatccacctgcctcgacctcccaaagtgctgggattacaggcatcagccaccacaccaagccacaaatgatctttttaatgtgctgttaaatttagtttgctagtattttctttaggatttttgcatctctgtccatcagagatattggtctgtagttttattaatagtgtctttgcctggctttggtattagagtgagactggctttttattataggtttggaaatattctttcctcttctgttttttggatgagtttaagaagaattggtatttaattattctttaaatgtttaatatgattaagcagttagtatcttgatctcctctgtaaattaaaaaaaaaaagtagctaagccatcagttcctgggcttttctgtgatgggatagttttcatcactgatttgatctccttactagttactgtatcttactgtatgcatcaagggctttattcatttcttccaggttattcattttgttggtgtagaattgttcacaattacctttttttttttttttttaagacggagtctcgctctgtcgcccaggctggagtgcagtggcgcaatctcggctcactgcaaggtccgcctccagggttcacgccattctcctgcctcagcctcccgaatagctgggactacagacgcccgccaccacgcccagctaattttgtgtatttttagtagagacggggtttcaccgtgttagccaggatgttctcaatctcctgacctcgtgatccgcccatctcggcctcccaaagtgctgggattacaggcatgagccacagcgcccggccaccttttattctttgtattttacttgtatcaattgtaacgtctcctttcatttatttgagtcttctgtcttttctgttagcttagctaaaggtttattggttttgcttacttaaaaaaaaaaacaaaaacaaaaacaaaaaaacctcttggtttcctttaattttttctattggctttctactttccatttcattagtttctgcttagatatttattattttcctttttctactaactttgggcttagtcttttcttgtttttctagtatcctgattttcaacattttgtgatctttctcattttttgatgtcggtgtttcttctataaacttccccttttgaactgctgttgctgtttcccataggttttgatatgttatgtttccattttcttttgtctctggattttttttttttttttgacggagcccaggctggagcgcagtggcgccatctcggctcactgcaacctccgccttccaggttcaagcgattctcctgcctcagccttccgagtagctgggtttacagacatgcaccactacgctttcctaattttgtattcttagtagagacggggtttctccatgttggtcaggctggtctcaaactcccgacctcaggtgatctgcctgcctcggcctcccaaagtgctgggatgacaggcatgagccattgcacccagccagaaattttttttttaatgattttttttttttttttgacaaggtcttactctgtcacccaggctctagggcagtggtatgatcacagctcactgcagcctcagccttcatgggcataggtgatcctcccacctcagcctcccaaagagctgggactgcaggcacacaccaccatgtgtagctaatttttgtattttatatagagacagagttttactatgctgcctaagcttgtcttgaactcctgggctcaagtgatctgcccgcttcagcctcccaaagtgctggaatcataggcatgagccattattccccccaacctgatgaaatttttaattttacttttaatttcttcattgatccattggttgttcatgagcatgttgtttaatttccatgtatttgtgaattttttgaagtttcttccgttatttctaattttataccgtgtcatcagaaaatatatttgatacaatttcaatcttattaaagttgttaaaatttgttttgtggcctaacatgatctgtcctggagaatgttccaggtgcagttgagaataatatgtattcttcagctgttaattagatttagttgatctagattatattttaagtcggatgtttccttattggttttctgtctggatgatctgtttattgctgaaagtgggctgttgaagtctattactatttctgtattgtagtccatctctcccttcaaatctgttaacattcgctttatatgtttaattgctatgctgttgggtgcatatatataattcttatattctcttgctgaattgacccctttatcatgatataatgatgttcttgtctctttttacactttttgacacattgtgtattttatctgatttaagtttggttatttctactctcttttggtttccactgcaggaatatattttttcactcattcacttaaagcccatgtgtgtctctacaagtaaagtgagtctctttaggcagcatatagatggctcttgtactttaatccattcagccactcagtcttttgattagaaaatttaatccatttacattctagataattattgataggtaagtacaaactaccaccattttgtccattttgttaggtttttttagttgtttcatagatcttttgcttttttacttcctctcttgcttttttttttttttttcctttttgagacagtctcactctgtcgcccaggctgcaatgcagtggcaccgtgccgtgtcggctcactgcaacctctgtctcctgggatcaagcaattctcctgcctcagcctccaaagtagctgggattacaggcgcccaccaccacgctcggctaatttttatatttgtagtagagacaggatttcaccatgttggtcaggctgatctccaactcctgacctcaggtgatcccaaagtgctgggattacaggcatgagccaccatgcctggcctcttgctttcttttttgtggctgattttatgtagttgtatgttttacttttttgctttttattttttgtgtatctactataggattttgctttgtagttaacatgaggcttacaaaaacatataactggttatgtaaagctgataacaatataactttatttcaaaaacaatacaaaataagaaaaaaaaaacataactctggttgctcatggataagcagaacccagaacagactggtgcaagagagaagggaacccagctccacatttgtggcctgaagctctggactgattggcaaaaattttaaagctgacaatactggaagagaacctttgatcaaaaacactagaaattgatagagacgtgatacagacaccatgatcaaaaagagaggaagctcggatgtctgctcaaagtagttgggcaacaggactggcccctggactcaaaacagacataaggaagtgatgagtgaaggaaccttgggcaccacatgcccactgtggacctctgagatcctagctacaggagttcttatgacctccatagacctttaaactggcaggaagagctgcccaaagaacagacagaggcacaatttgtacctatgtggagccagaaggttttgctgcattgcgttgtttcagcaaaacgttaccatagatgtccatctctcaaggctctccatcttgtgctgagtggctacagctcctgctgtctgctggtccaggagagagcagggccaccactgctgcaggactgaggtgcatctgatccatccacccccttgcctgttgacctcttccaagaccacctgcctggctgctcccacaggagagtgcctacagcacagattccaccgcccccatctgagtgctttgctgttggcttggaggcagtttgcccctcagaatagccagtgcaataactgaggggccagtggacaaacccacgggtatggtcccagttcctcaggactggaaagcacttctgagggatatagaactgagatctatggcctgagcatgaacaaggacgatgacctcccctctccccagctctaagaatacagaggactgtgtcatggctttgtgtgccagtatgggagctgggcatccctcccttcataagaccagcccaggaaggagatgtcatgataaatgtcttcttccttgggagtcctgtggtctagaatgtctggaatgactctgcgatctaggcttggaagaagcctagttggtcaggcctgctcccatggcagagattggagggagatccattgggttgggggactgcaagttgaactggcctcactgcattggctgggctgaaaaccctgggctgtgggcactacactagttacaaacccatggtgccactaccctgcctaaggatgctctgcccttgaacccactgcatcaccagaccacctgcagacataccatgcaatctgctttgactccggcaagcacaggggactgatggtcccctgggagttgcatgcctcctggtgacctccttcaacatggactatccctaagagagggggtgaatgcagcctactaaaatcttcctttaggacaaaggaaatgggtgcagcaccagcagttaaaggggacaacaccaaggtctaggaatggacatggaaagggagtcatcttttgcctccggtctccacactggagcactgctgcagacccactgaaatactgaaggtatgagcatggcagagtaagagcctactgagccttacccttaaatgccatctactggactgacacttgaattataccaccaaacaaaaatatattgtgtttacgcccaaggcctgtaaaacccaccacaggaacctgtctacagcaaaggaacccttacagagtcttggccctctgaaaaaaaacatacaagcagctaacaaacatatgaaaaaatgctcaacatcactaatcagagaaatgcaaatcaaaaccacaatgagataccatctcacaccagtcagaatggctattattaaaaagtaaaaaataacagaagttggccaatctgcagagaaaagggaatgcttataactgttggtggggatgtaaattagtccagtccccgtggaaaacagtttggagatttctcaaagaactaaaaatagaacaaccattcaacccagctatctcattactgggtatatacccaaaggaaaataaattgttctaccaaaaagacaccttcactcatatgtttattgcaacactattcacaatagtaaagggatggaagcaacctagatgcccatcagtggtggatttgataaagaacatgtggcacagatacaccatggaaagctgtgcagccataaaaaagaatgaaatcacgtcaatcatgttccatgtaacaacatggatgtggctggaggtcattgtcattatcctaagaagattaatgcagaaacagaaaaccaaataccacatattcttatgtataagtgggacttaaaccttaggaacacatggacataaagatgggacaatagacaacagagactccaaaatgagggagggaggaacgggggcaagtgctgaaaaactaacttttgggtcctattttcactgtcttggtgacaggatcaatagaagcctgaatcttggtttcatgtaatatacccttataacaaactggtacatgtaccacctgaatttaaaattaaaataaataacacaaaaaatgcagttttcttccactagtctcatcatattttgaattttgatgttaccatttgcatattttatattgcacatctcttaaattattgtaactattatttttaatggttttgtgttttatatcttatatttaagatataaataacttatgcagcactattagagtattagttaatctgaatttgtgtacttacttgtaccagtattttatactttctgaatattttcatattactcattggcattttctttcatcttgaataattacctttagcagtttttgtaagacaggtctcatggtgatgaagtcactcagcttttgtttgtacttcatttctgaagtacagacttgcttagtacagcattcttggtattcagggtatttttccttctaggctttgaatatgtcatctcagtatctcttggcttgtaaggtttcagctaagaagtgtgctgcttgtagtattggaactcccttatatgttgtctcttttatctttctgctttcagaatactctctttgtctttgatatttgacaatttgggcagtcttattttggctaaatctgcttggagaacatttaacttcttgtacctggatctttacatctttattcaggtttggaaattacctactactatcttgttaaagaaattttctatcctattatgtttctcttctttttctttaacacctatgacatgaaagtttgtttagatattcttctttaaatctcataagttttttcatttcttttcattttttctcctctgcatttgtttaaataacatatctttgagcgcacgttattattattattattattatcttgttggatcaattctgctcttgatgctttctactgcatttttttcatttattgtagttttcttctctgggatttctgtttggttttttaaaagtatatgttcattaaatttctcattccgttcacatgtttttcttattttactggattgtttctctggatcctcttgaagtcctctgagctttcttaaaacagtttgaattttgtcaggcagtttatacatcctcatttatttaggtttagccattgataccatattttgtctgtttggtaatgtcttgtttttctaattattcttcatccttgtgattgagcattgatgtctgctcatttgaagaagtaagacctattccagtcctcatggactggctttgtctgggaaagccctgaggtatatgtggcactagggtgcattagaaacctgggacaattgtggtcagcacagcactgccagaaccctggggactacaacagcaggtgtgactcctggggtggactgcaaactcagtgcgcctgtagtgggcatggcattgccagatgctcagggaagctgtggccaatatggcacatgcaggtgactggggcttgctacagcaggcacagtgctgggatgtgcctgaagcacagtgcagctgcatccagtgcaatgctgccagaagccgtggcctgttacagcaggcatctttctggggcagggcagaagcttggttcagttgcagctgggtcaggtctgatgactcagttcatggatactgtcctggaatatgggactatagggatatccctagtgctgggttttattgtggtaggcccagtggtagagtccacggcaaaatcttgtgcttgcttcccttcatttccacaaagtggatattatctctctctatgctgcactgtcttgtgttggggaatgggtaacatggatgatgtaaaacagtcttttctaatttcttcaatgagtgttttcttattattttcctacaaccacatactttgatctctaagttggtttctgttgctcttgtgaatgtagttttcttgggtgtatagttactcaaattggtatttctgcagagagaaagttgctggagggtcctacttcacccctccccctcatatttttaattttaaaagatattccttcatatgtattttgctattgtattttttaaagtccatattgttcatttatttacagtagccaattgacaaataaagcacctgcttctatgtgagcaccaaaaatattttagatccatcaattcatagtttataaaacactaaatttcatgtcatttttgcttgtttcccaaatttcttagaaattacctaattaaaaatctttctttataagtatcttcttttttgctgacattctgtgtacgacacagtatgttatactatggagtgaatgaaggatattgttttttttttaattaaaaaaatacattttacctgagcaaaatcttatagaatttgatggtttctctctttgcctcagcactgatatattttaaaacaaattggttagtttttcttatgaaatagtatttcttgtttttttttaaatgaaccttgcagttatttagcttgtttacattggcattataaatattatttaatgtagtgccatatagcttgtagaaacacattaattttttttttttttttttttttttttttgagacggagtctcgctctgtcgcacaggctggactgcggactgcagtggcgcaatctcggctcactgcaagctccgcttcccgggttcacgccattctcctgcctcagcctcccaagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcctggcccgaaacacattaatttttaaactaaatttgtagggtgttatcagcattgtgaggaccggaataacatctgctttcttccctactgtgtaccagaactcagcacaattctcggtgcataaaaggcactcagtaaatatcttcaaattataaataataataataatttaaataaaatagaatatcataatgacattttggtgttttttttgtgttatattaaccaaatcatttccagcaaacgacagctacataaataaaactttaatataataatttctccctccaaacatcacaaacttttaatgtctgatgaatgtttttctcccttatcatgcaggaatctacagggaggagccgaaagtatttaatagagacttgtgagaaatttgctcatttagaatttcaagttcttgttttttactattttctctcaaattgttatctactgcctttaagtttttgtctctttatacaccactccctggttcatcactttctccttattccttttgcttttgttcactcgctttttaaatttcatccacgattcaatttagtcatcagttgtcagtgatgtcctcgatgacttagttaattttatgttgctataacaaaattctgcagactgagtaatttataatgaatggaaatttatttgacttaaatttctgaaggctgtgaagtccaagagcatgtcacagggacctggtaggggctttgattctgtgtcattccatagtggaaggtggaaaggcataagagtgtgagggcgagagtaagagatagaaaggaagggaggctaaactcatgcttcatgaggatgcttctcttgagatgacaaacccagtcccttcctcaaaatggggacagaaccctcctgacctcatcacttcttaaaggtcccacttctcacactgttgcattggggattaaatttccaacacaggaacttgagagtacacatttaaaccatagcaccagtcatgctgttagcatgtggaattacatcactgtaataaatacctgaaccaaactttaaatgtaccgtcaatgttacacaagcctctatgtatcatcatttttctctcttttgctttatagaataaaacaaatatttactttcctcaaatttttttttctatttctggttttactcttaattctattcttgtgtgtttgtaaatgccttcattctactttcacatttaataaatgttttggcagaaaatatttttcttaagaattttgaaatctttgttactgtcaagaagcctgataacattctgattccctttcctttgtttatacacttctgtcttcactctcattctctggaggctctgctgtgagtatatttgctttaagcatatctggattttttttcagtgtattggacattagggtaagcccttttactctggaaatgcagttttcatatctccgaaattttgttgtattgtttctcagatatgttccctctctgttttcccttttctttgtttctagttcttggggttgtcttcgttttgcttactagattgatagtttgttttgttcatgactatatttcatttgtttgctttttttctactttctaagagatttgattgacttttcaatatttactaatggctttttaaaaacagattttattttttatattagatttaggttcacagcaaaattgaaagatggtacaaaaatttcccataagcacctctgttcccacctaccacagactctcccactaccaacatctggcaccagaatgactcattttttaactgataaacttacgttgacacatcattgtcacccaaagtacatagtttacattacagttcattcatgttcattctatgggttttgataaatgcataatacatgtatctaccattgtactaacacacagagtaatttcacttcaactatgaatcttctttgttctacttatttatccctccctccactcaccccctaacaaccactgatgctttttcttttccatagtttcgctttttccagaatatcatataattggcattctacagtttgtagccttttcagtttacctctttcgcttcataatatgtatttaagtctcctccatgtatttacattctttggtagctcatttctacttagcactgaatacaattttattgtctagatatactacagttgatttatcaattcacctacgagaattaggttgctttgttgcttccaagtttggcaattataaataacgtttctataaatacctgtgtgaaggtttttgcatgaacctaggttttcaactttggggtggtaaatactaagtagtgcaattgctagatcatatagtaagtaagagtagatttagtttagtaagaaactgacaaactatcttccaaaatggctgtaccattttgcattcccactagcaatgaatgggagttcctattgttccatatcctaaccagcatgttgtgttattaatgttctgcattttggctattttagtaagtacctagtggtatctcattttaatttgtagtttcttaatgacatatggtgttgagcatctttttatatgcttatttcttgtctgtatatctttttgttgacgtatctgtttaggtctttttcccagttttacattaggttaaaaatggggttacttttcttctcttctgctagaagtaggaggcgatttttttccaatatttactctgagaacttggtagagttcctaaggtaaaactcataaaaatgtgaagaacctcttatgagtgagtgtccctggattttttaactctcataattgtccacactgattacctaagaatttgtcagttttagttgagggattttttgttttgctttttgccacagtagtagttcctacagaggtttctgctggtggatttctccttcaataagttgttactccctaattttgtatgtctatctctccactttttagggcattggtttgccctttgacctaacttcgctgatagttctaaaaagagttgtttatttttttagtttgttcagcttttaaattgttggtaggatgaagtgatgacttctaaactttttacatgctggcctggaatccaaaagttccaatattacttattttttaaaatttttgtatcatatttttaagagttcctctgaacccccaaatgctaatagatggagatcattgtctgagttaacaatatttctgtagggaataattatttattttgacaaataatttttattttatttcatgccggtgcagcagagatttcatgatgtttatggcatataatgatctaccagttgctctatttaatgttattacttttaataactaaagatattaatatttattgccttgtgaagcttcatattttcaaaacattttaatatttaatccgattgggaagtactgtgatacagtagaaactgaactgatttagagtatgtcaaacgtgggttagactcgtgctgctatttacagatgacagtatctaagactaaataccctttcatacaacttgggaataaaataaaatgattactttgaggatttttaagaagtaaaagtatgtgtagattattatattagctttatacttcttctgtaataaattaccactgatttaatgggttaaaacaatgcaaatttattttctttttcttttataggtcagaattttaacatgggtttaaactgggccaaaatcaagaagtcagcaagaccacttttctttctgcaagctttaggggacaacttattccttacctttttgagcttgtagaggccacctatattccttgactcatggcccctttctgccatctcgaaagccagcaaaaccaggctgagtttttgtcatatcatggcactctgaccctaccttttgcctattctctaagaattttttcagagttaccacaaagaatacttttaagagttataattctcttagagaataggcaaaaaataggttcaaagtgatatatttaaggactcatgtgattacattggacctctccaatatccagaatattctcccatctcaacttcagctgattgccaacgttaattgtatctgcaatcttaattcccttttgctatgtggcagcatatttacgagttccaagtattaggacatggccatatttgggggggccattgttctgcctgtaaaagtatctaggaaaatcctgatatagactatcaataaatggatacttgctattcattcaataaaatatttattaagtaattaattttatagattgtatctacttcagaggaaccttgaggtagacatgacaggtactactctagctttccatctatttcatctattttaaagcattggtactaatgatacaagaatgcaaatcataatctacatatttttagtgcttataaagtatataaatattatgttgtctattaaaaaaagcttgactttttttaatcaataaaataaataatatcctagctacttaaaatgatttatatttttaaattataaaactaagaaaaaagggtaatacttgtttttaatatcaggtcacacagaagaatatttttttcgcatgctatattacaggtgtgtcattgttcaaatcatctttttttgtacagaatctgaaatactccaactaatattttcaagggctttgtttgattgtgtataatgcaggtctagcagctctactaggattcttgtaatcaacacagtcattttgaacaatttgaggtgacgactttactaagtgttctctaatctgactttgttttccctatgggagcaattattctacaaaatgacaaagcagcaagggcaaaaatctagctaccaatgacataaaatcactgctttatttcagagttgggattcttgatctcattaatggcctggaattgcatgacaagcttttccatttagacaattaacatattaatccacttcatgtagtatccatctgcttatatataatttttcagaaatattttccatacctccttgcactcatggactgtagctattttcaaaagcaatataatcactagatggtgtaaaacactaatataaagtacctgggggcaattactggccttcagaaatgaaaaattacagtcaaatcattttataaatctttgaaactcagatattgaggaatagtattggggtaattcattttcccactcagttaattccgtggttggccttttgtgcagtttgacaaatcaagacttcttgtggagactggagagtaatttcattcatagctgagaaggatttttttttaaagatggctaaagtcatttatagttctataaactgaattattatgtagctattctcttatcttttttggcagtctggagcaaaatccatacttaatagtaagtgaaaataaaaaaggagaaaaaagaaaaaggccacatcttagcggttcttagaaaaactaattattgttttttagcaaatgaaatcaactttgctttgccttacctagatttcctgatgaatgataaacaggagaggctgagctatattacttttcaaaatacatgcatagggatatatataaatatacacacatatataattatgccagtgaatattgtaaatgatattatctgtggaattaacaaattatttccaaagctgaaataccacaggtcaatgccaggttctcctccttactaattatgtgacttcaggaaagtcattttgcctttctataccttgatttcctcatgtataaaatgcaaagtgttggcaaccagagaaacttacctcactcttagtgttcagggtttttatggggagtcatgtacttaagtatgcagcgtctgtgtgactgacctcagctactctgctgctttgaactcccctaccctcaagagcaaaaataagcattcactgtaaatcatattgttagtgtaaactatctgatcaaaccagtattgtggcttaaggcctcagacctatagaaatactcttaccaggcagaatattccaagggctcagagctcatttcctaggagctggcccagggccagtgctgcagacagccttttcctgggaatatgcagggtctgagcaactttggtctgttgagttaacctttatgttgcaaattatatctcaaaatagtcaagaacaaaagcataaatatttgttacaaactctttacatttcttgttcttctatgataacactattgtagcctctgtcagtgaaaggagccaaagaatatttctttaatttgataaagcatttcatttaaattaagagttaagatttaaaacaggatactttgcttaacagaatccatggggaaattgagttttgattaattgtgtgttttattttaaaagggttaactagaaagacctttttacttatacttcctcattgaaaataattccaaaatattttagttattttcttacctgaaaaactgcttgaatttctaatgcaataaattgaataatatttttcatccagaaattttaattcaaatggcaacaaataagaaacaaagatgggttaataaatatatagtaggataaatattttaatctataatactaaattatagattgtaatatctcaaaattaccccattagcaattattacaatactatatgtgaatgaatcagcactaacatccaaaaacagtgattgaagaaatccctttaaacaatttagctatgagcacatgtaaaagatgaattataatatttcatgcaagaaaaaaagacttttagtagaccagtttaataatttatttttcttcaggacattcagtaggaagatagaatgatgaaatgatcactgtgagacggaaaggaaggaagacttggttaagatctgtttgattacgttctacttaatgcaagtttatacatagttaaggggtatgtgtgtgtgtttgtgtgtgtatctgtgtgaaatatatatattgcacagttcttattaattaattatttaattagcacctaaattgtcaagaattattttgggggaaatccctttaatggaaataacttaggttttgaaaacaaaaaatatgggttctatgtctgcctcctgctctccgtgtgactctgatcaaagtgtttacctccatttgacaaagtattttgtaccctcagtttactcatctgtattttgagtttttgcatggggactattttgttctttgaaagagaacttgttgtaaatgaagatggatttagacaaaaaaatagcttcatatcagtacagagccttgatttttagaggaaaggaatgactttttttttttgtgattttttcacaagagtggtagcaacgtaccatgtgtagattactttgataggaccaagcaggatagatattatcaaaggaggaccaattgatgaatttcattagctgagtgatttttttcttattgttttagtgtataggaatcccatttctgcatttcttggtgggacaagaattgataaaacatgggttacatctgaataatattactactgacctcagctgttgctttcagctctcccacccccaagagcaaaaataagcactctctgtaaatcatattgttagcgtaaactatctgatcaaacttgtattgtggctcaaggcagaatatttcgaggattcagagctcattccctagtagctggcaaagggccagttctgaagacaggcttttcctgggaatgtgcagggtttgagtaactcaggtctgttgaatgaacctttatgttgcaaattatatctcaaaatagtcaagaacaaaggcatagatattagttaggaactctttaaatttctttacctactattatattaataacactttagtgttaaaacatgggtgacatgtagtattgctactccacatgattagtacaaagcaaattaaataatgactataaaagcactttataaacccttaaatgctaaatacatgttaaaataatcattgtttatcaatcagttaacaccaatatacagtcaaacacaggttcttaagaagaacttttttatcattatgtgtgaggtgaactcctttgacagggttttctctcattctgttctcttagctatggaccacttgatcagtaagtaattcaaatgcaataatctgtaggagacatggatatttaaagtaacccttttcaggtatccctatgttgatgattaccttcacactttaaaacatcgagagtgaagtagaaaattgatccaattacctgactaattcatgcttgagaaaaaatatagttttttgtttggcctatgaaaaattgactaatattataaatacactacttttaatttgcaaaattacttgtattgatatactgatctgtaatctgaagaagaatcattactaataccatttttcagttcttaaatacattcagtttgttatgtctgtgttgaatttatttttcactggggttaatatttcttgttttcttttattttacctcaaattaaccacacctactacaccaccttctactcaatggttttgtgagtccgttaattatattacattatttcacattttaaaaatttgtggatatgttttttgttttttaagacggagtctcgctctgtcgcccaggctggagtgcaatagcactatctaggctcactgcaaactccgcctccctggttcaagctattctcatgtctcagcctcctcagtagctgggattagggtgcccgccactacgcctggctaatttttgtatttttagtagagatggggtttcaccatgttggtcaggttggcctcgaactcctgacctcaggtgatccacccgcttcagcctcccaaagtgctggggttacaggcatgagccaccgcgcctggctggatatgttttttaaattgaggtatacttctgtgaattctgtataagaattcactttagaaatacatttttatagatattaaaaaaaggaaaaatatgctttctgccaaacatgctaaaatgttaacctatatcttggtgacgaccgaaactttaatttttttgcagggaagtatccttagtattgatttgcagccaagcttgtctctatctcaaaggtcacaattttcaaacgagaatacctttttatgtggtgtttcagcacatctatttttagtttcagctaaaaacaagaggttaaaaatcaaccatggatgaaaatattcaaggaaaaaaactgatttttttttcaaatatgaaaggagagtcttgtaaatgtcaaatacaattattttagggataaaatgtaattcatgttatctttgaaatatgcagcaatttaattttaattggaatatattatttttcttattaatgtccaataatataaaaggtacaatttaaaagaaaaaagttgtatcaagattataattgtgcatattaattcaaatgtcacggtggtatgcagaactctaagctgagcaccaagatctccattccctggtgtacataccctatgtaattccctaggactgtgaaataggatggctttcactctctgcagctgggttatgttataaagctacagggattatgcatgtttaattaatgtctcaaatcattgatctcaacataaggagattatctagttttgcttgatctactcataaaagcctgtaagtctgggcctagaggtcagacaaagataaagtcagagattccaagcatgaagatttgatgtagctttgctagcttgaagaagagaaaccacacggcaaagaatgaaggtggcttctagttgctaagagccagcaaggaaaagagaacctcagttacaggaacttcaaggaagcgtaactctgacagcaacagaaaaagcttgggggtgaatttctctttagaaactccagaagagaagcccatccagattctttgatttgggccttgtgatactttgagtagagagcccaaccactgtatgccagacttctgattacaaaattgttagctaaaaatttgggtattgttttaaagcactaacttgtgataatttgttttgcagtgatagaagactaatacgcttcctataaatttagccaggaaaatatgccatgtaacacagtgcttactagcacacttttaatatagaaactaaatataatccaattaattggaagtatagctcaaataatatatcagactatgaagtacgtatttaaccatgttttagttcaatttttaaatttaaactctcaagcagattataaacagatttgacaaaatcttttttttaaaaaaagcacaatgatttaatggaattttttgatattaaaaacttttggtctttgaaagacaccattaagaaaactaaaatgaaagccacataatgaaagaagatattcacaatacatttatcttgcaatgggcttgtatcccgagagtgctcaaagaatgcttataatttaataagaaatcaaacaattcaattgagaatgaacaaaggaattgagcagacccttaaccaaaaatgatatctgattgaccaataaacacatgaaagatactttacaacatttgtcatcaaggatataaaaattaaagccacaatgaaatattactatgaagccattaaaatagttaatgttgaaaaaactggtaatagttaagtgctggtgagaatgtgaaacaggtatcctggctggcgaaaacgtaaaatggtactaacaacttggaaaactattggagttctcaaaatttatatatttttgacaaaatcctttatgtacagtaaaactcccatgattcattccacatgatagttaaatcttgattaaactataacctgcattggtgtaaaaaataataatgaaagtgacaataacaggaaaggcttttaagatctgtttgtttctttaattgcttgcatgaaaacaaatgattcaatatactctaaaatgctttcttattcttataaacctagctaattaatattatatgaagagttacctttactttgcctataactagaatttgtgaaagtatctttaaatatacattattaatatagaattttgttactaggttgaatgacttttttttcatttaatgctggctgatgaagcataaacatgttccaaaaaagtaacatacgggtgtgtgactaaaaatgttaatgacaaagtactgatttctcagccctgatatttctatactgatatccatcccagtagcatgttaattcccactgaaattctgattattgatactactgataaaaataattatcctctatgtacggtctcttatgtgtcagacactgtgctatgtgacattatcgcatttgtatctcatagtaacatcaagaaatttattttctattattatcctaacttacaactgaaaaataggtgaaattcattaataatgatgtctacttagatgtcccagaagtatctgaaatgtaattatctagaacaggggtccccaatccctgatatcagtctgtggactgttaggaaccgggctgcacagcaggaggtgagtggtgggtgagcgagcattactgcctgagctccacctcctgtcagattagcgctggcattagattcatgagagcacgaattctattgtgtgctgcacatgcgagggacctaggttgcgtgctccttgtgagactccattatacccccccaccccagtttttttccaatttgtccgtggaaaaattgtcttcacaaaactgacccctggtgccaaaagattggggactgcggatttagaagataagtgttgctaaaaaataagtttaacacagatctattataatttgctaaaatataactgtcaaagagttgaaaacatgaccctcataaatataaatgaaccaagtcagtgattttattcaactaattaattaatgcgagaatcagaagatgccaaaactggttcaaaggattattaaaagtactgagattaatatagtcagtcagagaacattaagaataatttactaatagatgcataattgcttaatatcctacagggctatgaactataacatttgagattgttgcctctagcagctagaaataaatcatatctatactggacaacatttctttagattactttaaataaaaatcattttcattgcttttataaaagaatcaattgcattattataagtgcaagttaatttcacaagttgtttatgagtaaattttatagaataaggaagttttccagaaaccttatcagcaatgctgatatgatgctgtagtaggcagaataatggcctttcaaagatgtctcttctctaactgtgaatatgttaccatccatggcaaaagagattttgcagatgcgattaatttaaagatcttcagatagggtgattatcccggattaccttcgtgggcctaccataatcacagggttccttaaaagtgaaacggggggaggcagaagaaaagttaaggccagagtgctgtaatgtgataaggactcaatcaccattatactggctttgcaaatggatcaaggtcatgagccaagaaatgtgcggagcatcgagaagttcaaaaaggcaaggaaatggataatctcaaaaagaaaaatagtcttgcaggcaccttgattttagaccagtgagacctctgtcagacttctgctctacagaactgtaagataatatatatgtgttattttaaaccactaaatttgtagaactctattatagcaaccataggaaattaataaaaatgcctggccggatgcagtgatcacgcctgtaattccagcactttgggaggccgaggtgggcagatcacgaggtcaagagatcgagtccaatcaggtcaacctggtgaaaccccatctctactaaaaatacaaaaattagccaggcatggtggcaggtgcctgtagtcccagctacttgggaggctgaagcaggagaatcgcttgaacccgggaggtggaggttgatacagtacatgattattaataatttgttgactggatgaattatttagggttcaataaatgtaactcgtttaggacatatagttaataaactggatcctagattaagcctctgtgcctgtccctacaacctgtacttttaccacttaagttgctttatttcttgtgtagtcaaaaataatatcctttaaatcatttccttagattattttgcctagattctccacattcattctgataaggaaatgatttatagttgataatgtttattatttagttttaataaactggaaaaaatcaatttcaggcatatgttaaagatattgcaggttcagttccagaccaccataatcaagtgaatatcacagtaaaataaatgtcatacaaattgtttgggtttcccagttcttataaaagttatgcttatactataccacagtctattaaatgtgcgatagcattatgtctaaaaaagtccatactttaattaaatataccttattgcttaaaaatgctaacagtcatccaaatcattatcttttggctattggagggcctgatctcgatgttgctggccactgactaatcagcgtggtggccactgaagcttgggtagctgtaccagtttcttaacacaagcatcaagtttccaccctgattcactcacaagagatttttctgtattatgttatcatttgatagcatttaaccgacacttgaacttctttcaaaattggagtcagtcctcttaaaccctgctcctgctttatcaattgtttaggtaatattctaaattctttgttgtcatttcaacaatgttcactgcatctttacatggagtagatttaatctcaagaaaacattttccttcttcatttataagaagcaacttctcaagcattcaaattttgttatgagtttgcagcaattcagttacttctttaggctccacttctaattctagccctcttaatatttctacaacacctgcagttatttgcttcccttaagtgttgaaattttcaaagcccctcaccttccttctgcagcttcctgacctctttcatccttcacagaatctcatcttgaattgtagctcccctaattcccatatgttgtgggagggacccagtgggagataatggaatcatggggtcggtttcccccatactgttctcatagtagtgaataagtctcaagagctgatggttttataagaggtttccccttttgcttggctctcatttctgtcttgcctgccgctatgtaagccatgccttttagcttccaccatgatggtgagctctcccaagccacatggaactgtgagtccattcaacctctttttctttataaattacccagtctcaggtatgtctttatcagcagcatgagaatggactcataaaactggtatgcaaataagcagactctacatcatagtattccagtgtagttgaactattattataatggagtccctatccataaaattgattacaatctaatatggatttgtgcaataaggcaaatataccagtaactaaaatacagggaaagtatgctacagatgaattaatttatacaaatatatgagtcaaagggagaaattattcaattaggtaaaggaggaaagcatttattaaaattagagagggtgtctgggtgagagccaagtctgaaggatttttttgggtaatggtttctttactctattttctatcacatgttgaaaattttaacacattgctgtcatcagaaggtgtttataatttttttgtttatagggtttataatttttttgttttttaatttatagatttatttgattaaaaaagagtttcatgtaccagagatgggttattgaaaataggcattgtttaaaatatgataaatattttatttgaaaacttggatttttatgatttacaaaaatctggagaaaaaacagggcaaaaataacagaaaatgaacatatatttaaattccccaaatattcaaatatatcattatattatgatgaagacttacatattactattttgtaatatgacaaagatctattcttacatttattatgataaaatgttgctataatatgagttcattatatgaagctctgacatgttcctctcattcttcatctaatatctaataatgactacctgcaaggagaaataatcactcaagttgtttacttttgcagaaggtgcagtctctttcagagaattctaaaaaaaaatcacattctatttaaactagaaactttctattaaaataagtgaaatgtagttaacaaaggatatttatttttatgtattttgttagttactattttccttattttgaaaaacttcagatcactggaatatctacattacaaagtggccagattgtatggtgtctgtaatctcattaccttgtggtaaaaacacttaattttaggctggacacaatggctcatgcctgtaatcccaatattttgggaggctgaggttggtggatcaccttaggtcaggagttccagacaagcctggccaacctggagaaaccctgtctctaccaaaattataaaaattagccaggcatggtggcacatgcctgtagtcccagctactggagaggctgaggcaagagagttgcttgaaaccaggagaaagaggttgcactgggccaagatcatgccactgcactccagtctgggagcctgggtgacagagtgagactctgtctcaaaaataaagaagattggccaggtacggtgtctcatgcctgtaatcccagcactttgggaggccaaggtgggcagatcacctgaggtcaggagttcaagaccagcctcaccaacatggtgaaaccccattgctactaaaagtacaaaaattagctgggtgtggtggcgtgcacctgtaatctcagctactcgggaggctgaagcaggagaatcacttgaactcaggaggcagaggttgcaaagagccgagatcgcgctattgcacaccatcctgggcaaaaagagtgaaacttggtctcaaaaaaaaaaaaagatcagatggctgtagatgtgtggtgttatttctgaggcctctgttctgttccataagcctatatgtctgttttggtaccagtaccatgctgttttggttactgtagccttgtagtatagtttgaagtcgcgtagcatgatgcctccagctttgttccttttgcttagaattgtcttggttatatgggctccattttggttccaaatgaaatttaaagtagttttttctagttctttgaataaagtcaatggtagcttgctgggaatagcattgagtctataaattactttgggcagtatggccattttcatgatattggttcttcctatccatcagcgtggaactattttccatttgtttgtgtcctctcttatttctttgaacaatagtttgtagttctccttgaagaggtccttcacgtcccttgtaagttgtattcctaggtattttattctctttgtagcaattgtgaatgggagttcactcatgatttggctctctgcttgtctaatattggtgtataggaatgcttgtgatttttgtacattgctgttgtagcctgaaactttgctgaagcttaaggagtatttgggctgagaaaatggggttttctaaatatccaatcatgtcatctgcaaacagagaaaatttgacttcctctcttcctatttgaatacaatttccttcgtttgcctgattgccttggccagaacttctaatactatgttgaataggggtggtgacagagggcatccttgttttgtgctgactttcaaggagaatatgaacagacacttctcaaaagaagacattgatgcggccagcaaacatatgaaaaaaagctcaccatcactggtcattagagaaatgcatatcaaaacaacaatgagataccatctcatgccagttagaatggcaatcattaaaagttaagaaacaacagatgctggcgaggctgtggagaaatagaagcacttttactctattgatgggagtctaaattagttcaaccattgtggaagatggtgtagcgattcctcaaggatctagaatcagaaataccatttgactccgcaatcccattactgggtatacacccaaagggttataaatcattctactataaagacacatgaacgtgtatgtttattggaacactattaacaatatcaaagacttggaaccaacccaaatccccatcagtgatagaccggataaagaaaatgtggcacatatacaccacggaatgccacgctgccataaaaaagaatgagttcatgtcctttgcatggacatggatgaagctggacaccatcatcctcagcacattaacacaggaagaggaaaccaaacaccacatgttctcactcataagtgggagttgaacaatgagaacacatgggcacagggagggaaacattacacacgggggtctgtcgcaggatgggagcaaggggacggagagtgttaggacaaatacctaatgcacgcagggcttaaaacctagatgacctgttgataggtgcaggaaaccaccatggcacatgtatggctgcataaaaaacctgcacgttctgcacatatatcccagtatttaaagtaagataaaactatatataaaaataaaaaaagaaaaagaaaacactgatttttaactgacagattatgtccccctaattgcaggcattagaataatttaccattgtgataatgcttgaaagttggattatattacagacctgtaagacggcattagactttgagtcaaaagtattcattcattttttttgtgtatttttgtgttaaattaacagctttaaaaatgtttatagggatacatagtaaaatagctatatgttcatgtgtgaggattggataagcatgtgaaatactccacagaatttgtgctcaattttgggacttcacctgccttgctatgaataaagtatgtattcttaggatacataaacttgtatattattttaatcttaatatttctaatcatctcttacgcacagcctacttctttctctataactgatggtgattaattgcctaattacttgccccatatgcttctcattattttgtgttgtattagctttcttttttttcatctattgaattagagtaggggaatttaaagttcccagacagtacgttatggttctttgtatcctctgaagtccctaatacagcactctctccatactgggctatgtgatacatttggaaaagcatgaggtttgaagttcagacttcaaattctggctgtatgtgttaactcagtacacttgagaaaatctcactcttgttaaactcttctataacatcaggctggtgtggtaagatcagtagcagtctatgagaatcaagtgagaaccatttgcacaaaataattgtataaattccagatagctataatatatactgtagaattcttcattagataaaatgatcatactaaagagtataataacttaaaaaatatagacagctattattaatgcttgcaaaaattactatttcaatggaacttactttggatttattcatttttttaatcacatcataggaaaactaaacagattctaactcatttagttgttccaatttaactttaaaaggaaatagaaaaagcaaaggagcaaacaaaaaaaatcctgtgattctaatgccaccagttaaatcatagtgttactggtggagggggtacaggttcttgacgtcttgaacaaagaattagatgaaaatgcacaaagcacggaaagaatgaagcaacaaaagcagagactaattgaaaatgaaagcacactccacagtgtgggagcaggcccgaggatagagactcaagagccctgttacagaatttttgggggtttaaatatcctctagagatttccactggtaactttgtgtatgccctatgtaaatgaagaggatatttcctgtcataactgaagtgtttccatttgatttagttctaggaagtccttaggtttccagcctccaggttctattctcctgcctcgatagaggctctttaaattcacgaaaatcattagcccttttgcactgtatatattattgttgtatattttccctgggtgttatattcatattgccttcctttacacccgaattctgcttggatgcgtctcctctgtgttcttaaaacaagacaggtaattcctattatgttgcatattataatttcttcttattgtactttccttaactttttattctacaggactaagagctctgtgagtgaagggaccatgtctaccttgcacactaatatattcaaaatgactaattatgttcagctcatagtaggatctcagtaaatattggtcaattatataactgcagatgtacagcataattaaatatatatgcaggcccattgtaaagtggttttattttagaagcaggaaaatctttacaatccaaatttaaatttaacctttggaagttatgctatggggatgtggctattggcattcactaggcaaattcacctaggattctttttttccccagaaaaggaaaaaaaaaacaagctcaaaccaacttaagaaaaagatgttttattttctcttttaactgataagtaaaggatactatgtggtttaaatgaagtaatcatggctcagactcccatctccccacgtgttctctcaggttctcaagtaggctttcttcacttagcactgtgtcttgccttaaggccaaactttgcttcttgccactcataatttagtaagaaacatggctttctcccccatgatatgtatataaatatgtagggaagaatttaactagccctgtgtgattctagtgcccatatcttgaccaattgctgtacccaacataagtatggacagggttaatatgcttagatacctttctaccactatagtaaacagtctcacagaactcaatagattggggaagcagtgattttggatggaaggcatgagaaacaggtaaaaagcatttcttcactatattatgtctctttaggttttgcctttatgtggcaaagaaatagaaaagtctccactaaacgtttcatttagaccatccttgtgaacaacatgtagagttctaccagcagaatagtaaattgtgaactctttcatttaagaaatatatcaaagaattgaggtgctttttagccccaaacattgaaaatacatgagacaagtgaccatgtcagagttaaaacttggttttagataggtactagctaacaaccacaacacctagtattagatgcttggaaagcaacaaaaactctttcctcagggaagcattgaggatttagatgaattcagtgttatttataaagtgcttattatatgttctttttattttaatatcataagtaatatatttttatactttaagtgactaattatttgatttcatcgatctattaacaagtgttttgagttacttatcagagaattcatcataaaacacatacattaaacatctattttactactataaattcttaaacttgatttcatccagtagttcttatcatgtaatttcgaatgcaatgtaatgtagtcagaaacgtgtagaatatcttcatttaaatttgtcaggcatcacatgaagttaaaactcatagtggtctataagaaaaagcaaagaaaatactgttgcctcaaacagttattttaacagctgagatttttatattgaaataaactaataagaacgtttagtgtttgaaaattatggtaggcacttgaaatatttatatgttaatagttaaatcactcaggcaaaattgaacatatttataaaaaatttattctaaacatatggaaggaattctggattaaccttcataatatatttgaaatacgatatgttggaaattaactgggcttagcttgtattcctagtttgggctctgagacacgattgaaataattaatttcaacaaagaatatagaaagtatgaacatgtgttggctttcaaaatgtgaacaacgtggtgaaattattagatccttgggtggttctggtcttaattcatagcttaaaatattatgtagtgagagacttatatgctttagttttttagtatcaataacgcccttgaaacctttctttgtactcctcaaccagacctaggtgttttctccttaaactgaaacattcattttcacaaaaaataaaataaaataataaagaatagtcaagaacttgacattattttttgattagacttgttgggcagaacatatcttttatagaatggtatgttgtaattgatttaatatggaaagagagaaaaacctcttatataaagacaggtgctttgcaaatttcagtgttcatacaaataacctggagagtttgataaagtactaactgattcttggattccacttccagaggtcctgattcagtaagtggtgcctgagtgcttgcatttctattatattctcagatgatgctgatgctaatggtctgtggagcacattttgaatatcgcttaggtagaactactttggaaacaaaactatttcctcctttaaaaattaaactacaagaattaaaagaacgcacactaaaaacatgtgttaaactaaaaacaaattgtaaaaaatttaaatgaaaatattaaaatcaagtcaaattatttatgatcatttatgttaattatataatagaaaaattctcatttattcaattaaagttatttaatgctttttcatggtctgttcatatctgattttcattatggtgaagtaaaaataaaggatataggtgttaaatatactgatttaaagtataggacatgtactaacaatgatataattttttaaatttggcatttaagcttatttctatattgactatatatagctataaaacacatccctgtcatgagtcaacttgatttttttctaggacaatttaaagtatcagttcaataaactagcttaggtacatagtttactgctttggaacttcaaagtgacagtcaggtacaatcaatatgaggaaataaaagaaggattcaattctcttgttactgataagttcaagaatatctctgtaaaagtaattgctaaaccagatatttttttaccaaaaaaaagacaaacttaaaagcccaaataataatttatatgtaatttaaatgattaaaatcagtcataagttctttccaaaggaaataacaatttcagaaaagaccatgatttttaaaaatttcaagtgtactgtaataatacaatctatgatgaatgacagactgaaatagtgaatcatggagcttggatattatcaagaaaagacaataaaaaataagtaatttcttatggacatttaaaaacttacagctaaagagttttcagtgtttttatgactttttaaaaattattctcagtcatgattagttagtgctaattcaatctattaagttacaatttcaaaaaggcattttataaaatgtaacgtatatttctacagaaatttaaattctatcttctgatggtttgcttatcaagtaagcccatggactttgtaaaattgaaatcaaggtttacatcactctgaataagctggaaaaataccgtaacctgcagtaggaaaatcaaagatgaatgaatcaaatacttattctgcttaattcatgcctctgatcattttaaacttaactaattggtattatgagttcccaactgaacatgtgttattatataactgcattcagtatgtattttgtcttattagaggttacatattgctttttatttacatagctttattaagatgtgattggcatacaataaactgcatgtttttaaaatatactatttaagttttgacatatagacccatgaaaccattaccaagattgagatagtgatcgtaacacctcccataattttctttaattttttttaaaaaatacatttgactgtgtatatttgaggtttacaacatgttatgagatacatatagatagtaaaatggttacaatagtgaatcaaattacagtatctgtcatctggtatacttatgtttttgtaacaagaacagttaaaatcttatttaacgaaaattcctaacacaaaacaatgttatcaactatagccctcatgttgtacattagatatctaggcttgttaattttatatcttttgacctaaatctcctcattttctccctgccccacctgccatggtagccactttttaattctctgtctctatagggttgaccttcacttttttagattccacatataaatgcaatattattctttctgtgtctggtttatttcacttaacgtaatgtctttccagtccatccatgttgtgtcaaatggcaggatctgattttttttttaaacgctgagtaatattttgttgtatatatatcacattttctttctccatttgtctgttgatcgacacttaggttgtttccatatcttgacaattgtgaatgacactgcaataaacatgacagtgtagctatctttagggagtggtgatttcatatcttttgagtctattcccagaggaaagattgctgaatcatacgctagttctatttttaatttacataggacctttgttctgtttttcctaatggctgcaccaatttatttttttattattatttctttattttttattttttaaatatactttaagttttagggtacatgtgcacaacgtgcaggtttgttacgtatgtatacatgtgccatgttggtgtgctgcacccattaacttgtcatttaacattaggtatatctcctcatgctgcaccaatttaaattcccaccaacagcatgctatagtttccttttctccacaccttcaacaatatttgttatctcttacctttttgataatagccatcctaacatgtgtgaggtaatgcttcacagtggttatttgtatttgcctgatgattactgatgtagagcactttattatatatttgttggccatttttatgtcttcttcagagaaatgtgtattcaggtcctttgtccattttttaattggatttttaaaatttttctgctgttgaattttaagagacactccaattcaggagattgggggtggagtggatcatagaggggtggtgtggtgggacactgggttggctcaggtgtctacctcactgggcctaggttcaagtagtcaggggacagggtagacattagaatggggagatgagcctctgaggcaccttgttcccagagtagggagctatagcttggctagggaatgttgcagtatcatgtgtgagagcatggtgcaatgatggcaaaacctccgggatgaaggaatgcagtggctactggccattagaacataatgcactctagcagtggctctgggttcagaacgtgatagtgcagtggcagcttgggtcatggggttcagggcacaatgtgggctccttctctagagtagtacagccatgtgaatcccaggcaattccctaagctgtgctcaggaactgtaaagactgcaggatcctccagtagcaaaaattgcaggtatccgtggtggttgatatggtttgactgtgtgtccccacccaaatctcatctcaggtggtgatcctacatgttgagggatagacctggtgggaggtgactggatcatggggtggtttttcccattatgttttgttgatagtgagggagttctcacgagagctgatggttttaaaagtgtttggcaatccccttttcattatttttctctctcctctcgccatgtaagacgtgccttgcttccccttcaccttctgctatgattgtaagtttcctgaggcctctccagccatgtgtaactgtgactcaataaaaactcttttctttataaattacccagtcttaggtagtatctccatagcagtgttaaaatggactaatacagtggtgatgagggccactgagggtctcttacttgcctttctctatctggagaagccccttgtgatccagacttggggatgggatggcagaggcaatgtgttttcttctcttcttatgtgaccatcctgagtttctgtgctccacagggtttacctcactcctttgctgcactctggcactcctctttagttactcaggtcaaaatgcagctgcttattcattagtttggttcctgattgttggagagtgataagtgttaggcacacctctagtcagccatcttgctgatttctgtctcagaattttcttgtgccctttgtaaatcttctttcatccctcctgctgtggctccacacagccactgcttagttttctgtcactaaacactaattagcatttcttagaactttatataaatggaaacatatgtagtttttgttgtctggcacttttcacttaacataattattttgatgttcttatgtactgcagtgtgtatcagtaggctatttattctaattgtggagtagtattctattgtatagataacacacactgtatccattgacctgctaatggatatttggattgtttacagtttgaggttactgaaaataaggcttctatgaacatgagtgtaaatagggacgtaggtatttatttctcttgagtaaatacttaggactgaaatgatatggtcaggacaggtttaaatatttaggagacttccaaactgttttcaaacaggttgtagtatttcacatttctaccaggagcatatgagatttcctacccaaaacttggtacagtcagactttttagttttagccttttagatttgtgtgtagtcatttttctttgtggttttaatttgcatttccctattgttgagcatctttttctgagcttatttgctatctgtatatcttctttaatgaagtatcttttcatatctttttcctatttgaaaaatatgtgttaattgagattttagaactctctctatattttggatacatgtcaattattagatatatgctgtgaaagattttcttccagactctggctaatcattttattctctgaatggtgtcttgaaattaagtagcactagtccttcaaatctatgattttttttcaaagacatctagctactttatgtcctttaaattttttttaaattttagaatcaattgatcaatgtctctcaaaaatcctgctaggattttgattgaaatacatgtaattatagatgaatttgagaaaaatttttatcttggcaatatttagtcttagtgtccatgaacataatatatctgtttaggtctttatataagcaatattttttagttttctttcatatttctgtcagatttctatgtattttgtatttttgattttattgttagtgatattattttatttcaaatctatttttttcattgctaatgtattgaatacaatggagttttgaatattgatcttgtacaaactcgttaaataacttattagttctagtaatttcagattttctaacacaatcatgtcatttgcaaataaatacagttttatttctttctttctgaactagattatttttatgttttattcttgccttatttcataggctagagtcttcagtacaatgttgagcagcagtggaaacagcagacatccctgtttttttctttaatcttcaggtgaagcatttagtctttcactattaagtatgctgttagctctgtgtatgtatgtgtgtgtgtgtgtgtttaatatatatttagatatcctttatcaggttgtaaatttcctttctgtttctattttgttgaaagtttttatcaggaatgaatattggaaaaaaaggcaagtacattttcttcacttttctctccctcccctccgtgcctctttcccaactaaaagtttatcaatttgattaatcctctctgagaggcaaccaaatgaagccaaaagttacatttactttctttacttgtatgctattttatttagttccattctcatctatgctatttctcacattaggtttcatttgctctttttgtttacaggttcttcagctgaaagctggatggcttttttttttttgagaccttattttttatttatctctaatatgggtgtttagtgctccaactttctccctaagtattgctttcacagcatccaacaaattgtatatgctgtatattattttaatttggtataaaatactttttatgttctacttttatttttatttgacccttgaattattttataatgttattttttcccagcagttggagattattcagggatttttctatcactaatctttattttaattttatttggtcagagaacctactttgtatgacttgaattcttttaaatgtagtaagatttgttttttggtcctgaatatgatctctcagtaaatggtctctgtgaactttagaggaatgtattgaactgtttttggatggagtggtctataaatttctggtaggtgttgttctagtcttctacattcttatagaatttatgtctacttgttcaaccagcattgtgaggtagttttggaagctctgactataatggggcattttcagtctatcagttttgcttcatgtattttgaagctctgttattagctgcaaagcacatttaagatttttctgttcctttgaactaacaaccccctttttcaatatggaataaatttctttatacctggtaatattccttgaatgtattttggctattattaatataacctcctctttttatgtagttaatgtttgtattatatatcacctttcattattttatttttaatctatgactttatatttgcatttctctataggcaatatatagttaggtctttcggcttgatcagatttgacaaatgagacattgtgccttcaagatgggctgtctcattcacccaatatccatcttagtatatttattaattttaatgtgtgcatggtattctgttatattatcaactggccaagtagtttctaagcaacaagcaactgccaggctacatttccacattttcatggatttgaccaataaagaataagcccaagtggatttagacagtttattacccatgacaaagcaaacaatatgatcttcatgttcacatttctacccctgcttaccctccgcaagtctcatggggacaatatagaagagtgcaggtgaatactatgcacataggattatttatcactgagaaggaacaagtgtaatcttataaggagactgataacaaaccttcccaacctttgctacacaggggaatttctcctttattaccccgatcaggaaacaaatctgtcctctctcctagaggtagacactacctttgttattccgaagtgcttctagggaggagagagagactttagccttagtaccatggaaagtaagcagatctgttccttgacctggagaagctttgacaaagctgtcaatgccctttcttcagaggttgtgtagaaatgtcagacttacagggaattttctcccaacatatttagaagtatcggttacttctttcagaaaaaatgaagctactcagtattttaaggaaaagtttagtagaagaaaatagaagcgtatgcagtggctggaggagtagggctagcaaatgttaggcccattatttgctatcaggttatctggacgtgcagacagagccaggtaagctgatgctgcagatctgtactgctggtggcataaaagtgtttaattatcaggaggatgcctgaaagctattgggaaaactccaggtcttcagcctgctgtctgccaatgcccttgtgcctgtcctcagccctgccagagaataatggcttttcttactcttccacatcccaaatctcattcaagtgatatttattggcacaatctagtggcattctggaatttgggtaggatacctctcaagctcttcccttgtattttaggaaagtatatagatgaaggagagtgatgttgaaattgaaaacaatctgtggaagcctttattaatgtaattctaacatcttttctcttaccacaatactttagtaaataaccttgtacatctcccttttggcacatgtgggaggatttccactggatagatgcctagaaacgtaatggctcacagtgcgtgcctatcatacattttgatagatgataccaaattactctccaaaagcagttgctttccagggagtaactgtaggagaagggaggagaaaaaccctgtttgtagatgatttagaagcacaagttagtactcaagtctccttcatggacactgactcagtgcctttgggtggtgactctgtgaggcaatgggagggaagaagaaagtgcaatgaccccacgataccttattataagacctaacatctagcatcaatctttgaaccatcgagaaagaaagaagaaatacaggattgaatgtcttgtctcaggtcttatgccagcagcttgtacatggattttccaatttaattgtcaatgtaagtctatgaaatatattattctccccatctttcctggtgaactattgaggggtagatgccaagtagcttgttagagatcatgcatttaacaaatggtagggataagattcaaaaccagctgggaaaaattacaaaatctgtattttttttctatatctcacagaaatcttcccttcttggtaaacatccttgagcctcctattattcttttatggctagtttactgtcttcaaggctgcccatgtgtaccggagagaatacagactctggagatgtaaagacttgaatttgaattaaaggttgagtcccatgttcaccatttattatctgtgttacttttgagcaattcaattcagctctttaaatttagtctcaacatctataaaactgctataatgaaacatgcttggcaagtttgttgtgagcattagagataatatatgcaatgtgcttagcatattgttacagcattaattatgtatacttatgtatacattgcaggcgagctgcccgcttccgggatccactaggcaaagccagctgggctcctgagtcaggtggggtcttggagaacttttatgtctagctaaaggtttgtaaatgcaccaatcagcacttcgtgtctagctcaaggtttgtaaatgcgccaatcagtgctgtgtgtctagctcatctagtggggacttggagaacttttatgtctagctggaggattgtaaatgcaccagtcagcactgtgtgtccagctcaaggtttgtaaacacaccaatcagcaccctgtcaaaatgggccaatcagctctctgtaaagtgggccaatcagctctctgtaaaatggaccaatcagcaggatgtggatggggtcagataagggaataaaagcaggctgccccagccagcagcggcaactgagtgagctccgcttccacgtgtgggaggtttgttctttggctgttggcagtaaatgttgctgctgctgactctttgggtttgagccgcctttatgagctgtaatgttcaccatgatggtctgcagcttctctcttgaagccagctagaccacgaaccccccagaaggaagaaactcccgatacgttggaacattagaagtaacaaactccggacatagcatctttaagaacggtaacagtcaccacgagggtctgcagcttcattcttgaagtcagccagaccaagaaaccaccaattgtggacacatcgggattggcacatgttgaatgctgtgagactagatgccaaagtatgcatgtgttgtgaattatgtttacaagatgttataaatatgggccgataaagttgatatttataattccttaaagtcacgtattaaatctgatatattttatctcttcacaagtcaaaataaacttagaaagttttgagaaacaaaaatatagactagaatattatatgcatgtaagactgtacaaatccagtctaaaatgtaattaatgtatcattgtttcctccttgggaaaattatccagtagtactccaacattatgtctttttctgtctagtcctaatgcagaggagacaggaaatcagaaacagcttaaaacccttggtgatgtactagtgacagttgaattagaataaaatatgtgtcttttgactgcttgctaaaaatgtaaatgattttttataattttttttgacttcttagtgccagtgtgtttacattgaccaaatattttggtgaaagttttgtatattttttttcaaaatgttaagacaataaaaatatttgagttcaacaatgtattcttagaaatatatttctagttttatagtgcttaagtttattagaatatgacaataacatatgccaaatcaatgcttaaattgatactttttataattttcttgatcttgagaagtcttaaaaagaggtactatatttttcattataatatataaagatacctattgattataatttcatttggcttaggaatttccctttgaaagaaagtatcattttggatgaatgtagaatgtatttaaaaattttaaacaccgaagagataagtttatacacttggactctgttattaataagttatggccattatctcttccttgccatggggagagtcctagttgttattatactgtcatgtgtcacttaaagatgcagatacagtctgaaaaatatgtcattaggctgtttcatcattgtgcaaacagagtgtacttacacaaacctagatgatatagactactacacacctacattataacgcagttgtaatacaatggtaaaatatttgtgtacctaaacatccctagacatagaaaagataatgcattgtgccaagacattaatgttagctatgacatcacgaggcagctcgtttataatcttatgggatcattgttgtatatgcggtccattattgaccaaaatgtcattacatggtacagtcccacacttgacgtgatatagagttcatatgtcactttttcattgttactgattttgatcaaccaagttttaaatatgtactgtgaaaaatttattttcacctttattttgaagtactgtgcatcatttcatagcaaatctatggcatggatatgcaggaaaaagtggataaaattatattttgacaacttcctaaattattatgtctctcagagataataatgatcagtggtatatatactgttctactctgagatagcccaggggcatcccaaactatgagggtttctgtgacactcatacagataaactaggtccataatgtataaatattaatgttggcattcacactgaggctgggcttttgcatttccacaccaaatagttatcttttaaaaacataacattacagatacattttggcctgaaggtattttcataagttccctatttatatgttgttgatgaaattaaggattccagtaaatcataataatcattgctagtggaggagaacacagtaagattaattccaattttgtggggaagaaatattttacatatggttttagttatgtatttagttatggatgactctgatgttctgaaaatgtattgcattttaaccaaaagcgtcagaatataatacattagttagtacctcagtatttgaaaggcagtgaaaaccgttggctgtttttagacatttgtgtatattttgatatatatgtcaatatttaatagaataaatcttatgtgttaaaatgttctcattcctgaacacactaaatataaaaactttaaggaaggagcatttattagtttgctaaggctgccataccaaattatcacaaactgggtggcttaaaccaatagaaatttattgtctcacagttttagaggctataagtctcatatcaagatattgacagagctggttccttctgagggctgcctctcccctagttcttgtggttttctggcaatctttggctttccttggctcatagaagcatcaccctgatttccgccttaattttcacatggtgttctccctgtgttttgtgtttatccaaattttccctttctgtaataccagttatgttcgaataggggcccatcgttctctgtgttgaccttatcttaactgattacatctgcaatgactcttttcccaaataaggtcacattctgaagttttaggagctaggacttcaaaatataaattttggggagacacaattcaacccatacagagggtaatggatacttataactaccttcttaaacatggatcttgaaattcaacttgccttttcccttcctctcaactaaattttttttcaaaacctgaatttgaaagaaagactccacttaaccgtttttaaattttaaggcagaaataacacataagcatactggagtaaaagtgtgtattctatatcctgtgtgcactccacaactatatttagtaatgttgactcctcacatttcctaagttcttttaaaactgtacaaaatatttatttttacattgctttctgaaagctgatatgttatttagggatcttaataaataagaacaaggctagattaattcaaagaaatttaaggtatttagattaaggtttacactttctgtggataaggagtttgagcagggattagttgggtcctctattagggtcccacaaggctacagtagtggtgttggccaggccacggtgttatctgaggttcgtcacccaaactcatgtgatcattgacagaattcatttcctggtatctgcagaactcatggaggcttcaatttcaagctcaaaaggaccatacctttctgatgctttaccttctcctaaagggtcctctgattggggactgggtcagaataagttatttctaaaagattattaactcaaagacaaccaattatcaagctaagcacacgatatcccattaaattcacagtttctgtccacagctcaaagggaggagaatatacaaggcatatacaccagggagtggaatcttagaggccctcttagaattctgcctcttatagtaacaaatatatacattatcattaagaggtagataactaatagatactattaataaaaatgattcatgcataatgtaaaattacacaaatattaatgtttccattaaactcctaatatgtataatattctgatctagaaaataatatattctcacttcttattttgcctttccaatttatttcttcttattttatttcatttgattcctgattgtcctgcttctgtagaaaggtttcaaatgtggccattctatgtagtctattgtttagaatttttaatctgttttataataaagaaaataccttgctttttaggcttatttctctatacataaatcttcaccttatgattttgttgattttttctctatgggattctctccccatttcagctcatttgttctgatagcatcatattaaaatgcagttcttgcatcaaatagtaccgcctccaagatagaatcctggattcctgtagttatctataataactgtattttagtatgtttactgcaattgaccataatagaagtgtgattaattttattcatatttttatatatttatacttagacgtttgtttccattgcatcccttactagataataaaaatgttgtgaatagaaatcagacatagtgtgatcatgtcattttcttcaggcttagtaagagttaaattgtttcacttttcactgtagttgatattaattggtttatatatttgttttgtgagttaacgcatataattaggccaagttaaaaggaatcatatgtcagttgtattcatatttaaatatgctgtgaaattttctagcctgtcagaaaaagattataccagtattactatatcaataatacacaaaaaagtctatatagttttccttttgatagaacaaaacttattctgaaagaataaataaaatgttcaatctaaagatattatcccaaccttcaaacttcagtgggaatacatgacacaactattttagaaggaaaactatagagcattgtatcagtatgtggtatcttatatgccttatagcacacaaatgttacccaattgagatattcattaggcattagatacctgtctctaaatctagctatcatagagatgtttcgcatggagggacactcagaaaacatttatgaataagagtagattcggctactgaatttagataaatgcaacccagttggatgtgtactttagtaatcagtggcatattagagtcattgaccttaaaatactgaactcatgttttaaattattttactccttacttgggtgacataggattcatattgattactgtaatttggattacagaagaaaaagtgctatttattcacatagaatatcaattttaaaatgtgaggccaggcgcggtggctcatgcctgtaatcccagcactttgggaggccaaggccggtggatcacgaggtcaggagatttgagaccatcctggctaacacggtgaaaccccgtctccactaaaaatacaaaaaattagccgggcgtggtggcgggcacctgtagtcccagctactcgggaggctgaggcaggagaatggtgtgaacccaggaggcggagcttgcagtgagccaagattgcgccactgcactccagactgggcgacagaacaagactccatctcaaataaataaataaataaataaataaataaataaataaataaataaataaaatgtgatttcagtaagctgtaattacaaaagatcgcaaggaatctgccattctgagtcaaaaattttactgcccttctcgagtcatgcccaatcttcttgtcttaaacatgtgagaagaatatttgtgaacaactatcagctactacttcatggtgattgcttaaacgtattcatacacgtataaatagatacatatgatataaatattttagctctttttgctttctaaggctgacatctgacagtgaggccattgatcttcagttgctagaaaagaaaaattttaggctagtctaccacttgagtgatttgcttttaaaactatgagaatacatagaagtcaaatcaataattaagcagtacaacaataaacttcatgttagtattatgatgaacatcatatttttatgtgaaaagctacacacataacaatgaaggcaaatattatcaaatttattaatatgcattgaatagcgctagagtgtacagaaggcagatcgacctttatctcattacattaatgagatgagaaaaatttgaaactcagaagattgccatcagttgatattctttttttgttgttgtttctttgagaccaagttttgctcttgttgcccaggctggagtgcaatagcgtgatcttggctcactgcaacctccccttccaggttcaagcaattctcctgcctcagcctcctgagtagctgggtttacaggcgcccgccaccatgcctggctaattttcttttcttttcttttttttttttttttttttgtagagatagagttttaccatgttgatcaggctggtctcgaactcctgacctcaggtgatccactcgcctcagcctcccaaattgctggaattacaggcgtgagccaccgcgcccagcccagttcatattcttaacaagcaaatgaaaaaagctgtcaaatgacaaaattactgaaaaaaatgaagctctgttgcctttatttaatgattgggctatttggttgcaaacactttattctactctctttcttgtgatatatgactgctaacatgtaaattcagtagatctttttagtatgtgaaccagaggttgaaggcacagtgctttagtcctttgaagccttgatatccttataagatcagttggatttattcaaatctcagttggttgctttgagagaataaaatgatcccaggggtagaagatatccatttgctaatgtctaggctacctggtatttaaaaactgaaacacatttttttttttctaaaatgtaagttcttatatgattggtatattttatttttgtgtgtattaattaataagccaaacctcttaaggatatttctataataccatttcatatgaagaaagttatttcctgttcattcactaaatacatatatggatgaacaggatataatatataattatatatattatatatttaaaataatactttaatatatgtagaaacaggctttatatatattatatatttaaaattatatatacagcttatttctgttatcctcaaaataaaaccactcacgtggcatgaaaaggagtcttaatatcttaaagggagatatacttggcctcttaaatatgattagcacatttattatagaaactttctcacagatatcagatactcaaatttttcctgactttttacactctttcttaatatatctcttttatttaccttattttcactttgattttcttttaaatgatagctgtagacatgccaataacaaatattttaattgcgtgttcaataaaatgtaatttaaaattgctgagtttatttacaaataaaataccttaagacttaaaacaacaacaaaaaaataaactatttagttccacatgaagtttttgtttatctcaaggtaaaattttagtttatagaaaagttttagagagaaactattgggaacattggtggaatactaaaaagatcattattattttttaatggtggaaagcataatctaaatttcttgttgataattcagtaggacagggtatttggagaacggggtatatttcatcacttaaaagacaagataatcacagaaagcagccatcagttttagcctttctcatgaacaaagacagaaaatgagtaaacattaatgtgttggaactaccaatgaaaagaaacttaggcagtataagataaacttattagatttatgacatatgcaactccatttttaaagcagagaaattccacattaaaacaaaattcttataattttctgttgcttccctccaagccacttcattctccctagtgtaaaaaggtcagtcttagaatagcttatgtatttttgcttccaaatgcaacagaaacttgtagacagaatatatggctccctatatagtagtatttgagaaaccaaataccataaaaaggctatcttttgcagacataatccccttaatgtttgtgtgtggagttattccttttggataatacgtactctgttaaaataaaatgttataccagtctcttatcagacaccagcatattagctggattaattacctaagaagggtcagagtggtgagggccagggcatagcattggtgtattttgacagggaagttaaaaaaagtcactggcctctgacttagaattaaatgaaatacagcaacccaataatgaattctgagtatccagggaacaataatactctaaagcaaactcagagatcacaaaggggcatgacaggaatacacccaacggtacacaggcactggaagaaccttgtactacatttatactttagtcttaggtgtgcccaaaagtataacatacagttctttgatacaagtcccagaaacctacttttgctcacttcatgaaaaaaagaaaaaaaactggttattggaaggatatgaagaggcacacagaaatgaaaagctaaacagcactcaagtcaggcaaaagatgggaatcttagagaactgagatagaagcagggctagcctcataattgaagggtccagtgcaaaatgaaaatgtagtactacttgttcagaaatcactgaaaatttcaagatggtgacagaagaatatattaccaaatgtagtatcctttcaagaggtgggcatctcacaagttcatgaatctgaccatgggtggcaggaattaatggataagctccatagtataaatcagctactatggttttctgtcttcgtcctttgttgctactaaagattcacacttctgggaaccataatctagggatttagaatggtgaattctttccagaaggttttcagtttactttgcctaaattcatcagaagaatcactatctatggcagctatagccacaggggaagagagcatgggaccctgtttagcaagactgcatgcaatcatggagaagagtaaggagtttctcgaaggaacataaaggaactgttaacaaaggacgtgatttcttcctgtgcaggaaaaaacaaacagacattcacatggaaataaaaaaataaaaatcctttcttacactcctgtgaccagcttctaagaagttggctctaagaacatgaatagtttatttaacagtgctcctgtaacatctccattggatcacagatactcaggtttaaatactggcatatctcattttattgcaccttgctttacacagtgcttcccacatactacattttttacaaattgaaggtttttggtaatcgtctgtcaagcaagtccatcggtgctagttttccaacaacctgtgctcactgtgtctctgtgccacaatttggtattcacacaagatttcaaactttttcattattatattagttatggtgatctatgatcagcaatctttgatgttactattgtaattgttttgaggtgccatggactgtgcccatatagaaatcaaactcagtggataaatgtgtgtgttctgactggctattcccctatatctctccctgtcctcaggcctccctattccctaagacacaacaatattgaaattagatcaattctacaatgccctgtagatgttcaagtgaagagtcacatttctctaaatttacgtgaaaagctgtaaatgattaagcttggtgagcaaaacatgtcaaaagctaggcatcttttgacaaacagccacgttgtggatgcaaaggaaaagttcttgaaagatattaaaagtgctacttcagtgagcacaggaattataagaaaataaaacagccttgttgctgatatggagaaagttttagtggtctggataaatcaaatcagtcattacagtcccttatgccaaagcctaatccagagaaaagccctaactctctttgattttatgaaggctgagagaggtgaaaaagctgctgaagaaaagctggaaactagcaggggttggttcatgagatttaaggagagaagctatctccataaaataaaagtgtaaggtaaagcagcaagcactaatgtagaagcacagaaagttatccagaaaatctcactgagaccattgatgaaggtggctacactggcaaacagattttcaaggtagacaaaacagacagaagatgccatctgggactttcatagctagagagaagtcaatgcctgacttcaaagcttccaaggacaggctgactctcttgatagggactaaagcagctcttgactttaagttgaagccaagttttatttcccattctgaaaattgtagggcccttaagaattatgtctgtgctcaattaatgaagcaacgaagcatagatgacaacacatctgattacaacatggaacactgaatattttaagcccactgttgaaacctactgctcagaaaaaaacaagatttctttaaaaatattactggtcattgacaatgcacctggtcaaccaagcattctgatggagaggtatgaggagattaaagttgttttcatgccgtctaacagaacatccattctgtagctcatggatcgttgaggaattttgatgctcaagtcttcatatttaagaaatacacgttgtaaggctagagttgccagagagagtggttcttctgtttgatctgggtaaaatacattaaaaatcttctggaaagaaccattctagataccattaagaacatttgtaattcatgggaggaggacaaaatatcaacatcaacacaaatttggaagaagttgattccagccctcatggatgacttcaaggggttcaagactacaaagaccagtgtaggaagtaacttcagatgtggtggaaacaccaagagaactagaattagaagtggaccctgaatatgtaactgaattgctgtaatcccataacggttgcttcttgtagatgagcacagaaagtgttgttttttttttttctttttttgagatagattctactcttagtgaatatgctgtgaatattgttgaaattacaacaaaaaatttagaatattacctaaacttagtggataaagctggggcagggtttgagaggattgatacgaagtttgaaagaagtttaactctgggtaaaatgctaccaaatggaattgcatgctacagagaaatcttttgtgaaagggagtgactagatgcagcaaacttcattgttgccctatttcaggaaattgccacagccactccacccttcagcaaccaccaccctgatcagtcagcagtcataaatatggaggtaagacctctcactagcaaaagattaggactcattgaaagctcaggtgattgttagaattttttagcaataaattatttttaaattaaggcgtgtacattgttttttagacataatgctattgcacgcttaataaaatacagtatagtatacacaaacttttatatgtgctaggaaagcaaaaaaattgtgtgacttcctttattgaaatatttgcttattgcagtggcatggaacctaacccatgatatctctgaggtatgcctgtataccaaaattattaatttcaatgattctaggaaacttttttttaataaagtagtttttggttaaaatttccagtatgttacactcttctaacaaactgtcgaagaataagagaaaaaatgttttagactgggtgtagtggctcacacctgtaatcctagcactttgaaaggccaaggtgggaggatcacttgatgtcaggggagttcaagaccagcctggccaacagagtgaaactccatctctaccaaaaatataaaaaaattagtcgggtgtggtagcacacgcctctaatcccagatacttgggaggctgagtcaggagaattgcttgaacctgggaggcggaggttgcagtgagccaagaacaggccactgaactccagcctgggccacagagtgtggctctgtctcacacacacacacacacacacacacacacacacacacacacacacacacacacacaaataaaataaaataaaagggagagagagaaaaaatgttttaggttaaatacaaataaaagagcttataggaattactctgaggtgaaactagcttatatcctctaatcagtatgtattcatggcttttagagtttggcttaagaagcttatcgaggatttcgccaagtggctgtctctgaagggagtggaaatgttaggactcacactctggagccagactctgggtttaaagttctgttttgctgtgtgtatcctgttcagtctctacacctaggaaaatgttaatataagaattgattattaaaatatctctaaaggtgacataatttaaaatacaattattacacataaaacaatttattcttttcagaacagtttattcttttcagacatatgtttcatatgtatgaaacaatacatataaaacaacgtagtacgattatttggtggaggtatgtcttaggaatggaacttgattttattggggggaattatttttttttctgttatcctttctaaatgggcagttatctctgaagaggaaagagcaaaatggagcttttattctctcacctcttctttggttgtattaagaagagggctgagtttttattctcatctctgtttcaaagacaattcaatgttgataccaatctgtgtttctgctgcttgtgtaaaagaaaaaccatcctatgccaccagcaaccactgttatctggttttaaatgtcaagtatacttcagcatagaaataaagaaactgagataacagtcaaagaaaaatatattgaagcacaaagataagagtccaaccatcttagtgtctgtgtctttgagaaaggagttaggaaaagattcatcaacagaaacctaaaacattttgcagcttctaacttatctaaccttatgatttatagccatgtatcatgtttatacatatgattgtagtatttgtctatgttggtgctatactgatgaataatggaaagtaattcagctactttaaactgaatcgtttaaattagttcagcgatgacattctgtcttcatgttatcccttctgaggtctagcctgagattttcttactaatctcaaggatttttttgtttgttccttgcaacagatgttcatactttgacagttctattgtatataattatgtataaaccatattatgtttttcattccttatttgaaagtaatctagatgatttttgtgtgtgtggctgtgagtgggtatgtcaaggcattttggaatccttgacttggtgtaatatggaaaatctgtttctagttgaaattgaatacatatatcacaagtccttttgttacttttagaatggaatgtatgaaatctgattgggaagattaatgtaggttttattaatctttctcaaattgataaagttctgtcaccctaaagatttattcaaagttgtaatctcaaagtcataagcaccaagtctttacctttgaaaagtattggaagctttagtttcctagccactatggattatgccaatacttttaggtattacctttatgccaaattacaggacaacaattttctttttagaaacattattttctagactataattttttggctaacacttatagctcttagattgccacatcttgaatattataacacaaattatcagaagcaaatatacatacagtaatatttttaataatgtttttcataaatcatatctaaattcccattttgtgcattcttcaaatggctataaaaattttgcatactagctcttaaagcaataatattaggttctaactattttatgtgataatgaaataggctcgattttattttagtagtttggtcctgtaagattaatcaaatttattacatgatatggatgtgaagtaagcaaggcactggtatttttgtggctcattattctgatattaaagggaagggaagaaggtaggtaacaagtggcatttaaaataaatgtattttcataataaatgatgattctcatcttattctgttacactgcaagtataaaactcttattgttgataagaagttcataataagtaaatcactttagacctggagtttgtgacttaaaaaaagcctttatttcaaaaagcaaaaataaaatgaataatgaattatcttatatatttcttccactaaacatatttcaaatgaaatatagtatgtaagttaaaaagccaaaaatacttaacccataactgtaagatctacattataggtaactacaaaataaaaatactcattatctataatatatttataaaatgttgttttcaaccaaatgttaaatagaatatttaatatagtaaaaattatttccctttttagaggtttttcatctttataaatgtatttgacagtaaatatagtaaaaactacaatggaactgaacttctagcaaattttgaaagctcttcagtatcatcgtgaaataattattcctcagatgagattttgttaaactcattactcttcttctgtaatttaaaatttcccaaataaaattactcttccatatagtggtgaatgagagggtgggaaaatattcctgatccccgcaagagaaaaatgtgcagtttggaaaatgtataaaataaaagtgttccaacacagcagatgatttatgttgtttatatgatgaattgcatgaagggctaaggagaaataattttagattaaaaaaaatttgtttgatacctcttagacataggaagacccgccaacctgtgatattttgtaagttacgaacaacttctataaatattagggggcagtaaataagagtttgatttatttccatctatatgaaatgtctttgatgattttgtgctctcaactttctgtcagttttagtgctctgggaaagaaacccaatgtattattacttcaataatagcatgattacaggcatacaatacctccaattaaataattaattagaaaatgagaaatatgtatgtgtgtgtaaacagatttggtgtgtatctttatgtgtatagaatttttaaacaataatttggattttttttgttcaacctgattgtactttcatctctacattcattaattctgattcttttcataagtgaaatgctccttaacctggatctcaagtcacatgtgaatatgaaagtagaaaatgggagagaaaaatactcatgacattaatggcatggagaaaaggtactgaacatacacagtcacgtcaaccttctctttttaagactaagccagaacttgcggagtttgtatgatcagttttatgctcataggatactttctctaaaattttggacaaagttaaaaataagcaccaaaataggtgtaaaaataaaattaataaaattttggacaaggaaactaattttagtgaatagtgggagtcgttactatttaatctaattccctaagactgtaacttaataatatttcactattctagcttcagtgaaaatagaatagataaatacaagtgtatttaaaaatgtaaccctattaagagatgatacaatatggtaaaagaacactggactagaagtcaggaaaccagaatttcacagtctctgtgtgacagttagaaaattaatttaggcttgagctttcctatatattaaatggagatattatacatgatggactattattctttttctatactaaatttgattagtctatttatatgagtattacatagaattgtgcaaggttttgtggatacattgatgaacaagaaacacaagtactgtccctgttacctccttgaatcatcgtagtttcaaatatagaaataaatagttacacagttaattatgatatttcacccttacttctagatttaatgtctttcttactggaatatatcctttagccattatcccagttagaatgccttccccttcaagtaaaagacaaacctaacacaaagattattaaacagtaaaaacaaaaaacccaaaaacataatcttgtctaacaagaagaggtagggaatccccaagttggttagttacaagaaacaatgacctcttttcttttctttctttcttttattttttttaaacggagtctcacacactctgttgcccaggctggagtgcagtggcgcgatctcagctcactgcaacctccacctcctgggttcaagccattctcctgcctcagcctcctgagtatctgacattatggtcgtgcatcaacactgctggctaattttgtatttttatttttagtagggagggggtttcaccatgttgtccaggctggtcttgaacgtctgacctcaagtgatctgcccacctcggcctccgaaactgtcaagagtacaggtgtgagccaccctgcccggccaccagtgttttttacagctgactctcctctcttttgtgggatacaccaatcattccaggcaatatatcaagacaaaacaacatccaaaggaaaatagctataatttttctgtgttttttttcttttttgccagggaggaaatgttttcctgaagccctcctacctcactctttgtcttatttatctgagtcataggagaaccagcctttaaacaaattaagaagttttgtttttgaaagaagcaggaaggaggtataaaatgaatagtgggtaggcagccaacaatgtctgcacataatatttttttcctttcagaaatgttatcaattggtttccaagtttctgggttttttttttttcatctttataatgtccttttctctgctgagacttgccatttgtttttttgttattaccatttttaatagaccttgaacatatttataatgctgattaaaattcttgtcagctaatttcaatatatgggtcatctcatttttagtgtctgtctgtaaattgtttttctgcttctttgcatgcctacttattggaatatttgacacacatgaatggatgacatgtttttcagagtctgtattttattgtcttcctttagagaaagtatagaattattccagcaggtagttaatttactagtaggatcaagtgaatttttgagcctttttaaagtttggaactctatgtctatcagcactacgagtctcctttgtctgtggcagatcttctcctttatctgcataggcgtaaaaattgctgcagcctctgtttttagaaacctcatgcaagttcaataccctgacactaccacagtggcaatttgtataattatttctattttgctttctttcatatggcacctggaagttcatctggcttttccttttgtactgtaatatgttttaaaataaatgtggttgtaagttatttagcatttctttgtatttggaacatgaggtggagtgtagatcagctcattcaaatgtgttcttagaggtcccctcaaattagttttttaaaatgcatctgtgataagcattaaaaatgaagtcttaccatataaaagaggtacctgtgtattttttaagagtggggtactagctgcagaggtttctctggcgacctgatgtttgtttgtttgttttagttatactttaagttctagggtacatgtgcacaacgtgcaggtttgttacatatgtatacatgtgccatgttggtgtgctgcacccattaactccttatttacattaggtatatctcctaatactatcccttcccctgccccaacccctcgacaggccccggtgcgtgatgttccctttcctgtgtccaagtgttctcattattcaattcccacctatgagtgagaacatgcggtgtttgtttttttgtccttgcgatagtttgctgaaaatgatggtttccagcttcatccatgtcactacaaaggacatgaactgtcctttgtatggctgcatagtattccatggtgtatatgtgccacattttcttaatccagtctatcgttgatggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgtccctatttctccacatcctctccagcacctgttgtttcctgactttttaatgatcaccattctaactggtgtgagatggtattttgctgatgttttataagggaagatctgaagatgggtaaaggattttttttttttttttttttttgagacggagcctccctctttcgcccaggccagagtgcagtggcgcaatctcggcttactgcaagcttcgccccccaggttcacgccattctcctgcctcagcctccagagtagctgggactacaggcacccgccaccactcccggctaattattttttttttgtatttttagtagagacagggtttcagcgtgttaacctggatggtctcgatctcctgacctcatgatcccccaacctcggcctcccaaagtgctgggattacaggcgtgagccactgtgcccggccaggatggcaggattttttttttatggagatagaacatcatatgcaaaggccctgaggcaggatggaacttggcacatttcagcgcctgaatgaaggccaatgtgtttggaactcaaagagcaaagaggcagctgttaagagatgaggttttgtgagagagacagtttctagaccatgaaacaaccttgttggctatgttaagatatttgaattctatcttgcttttccccatatcacaggtagtggtgaaataacttgtcacatgtagatttttatctaaatgtaaattttatctaaatgtactgttaagttcttataaccactacacttactatagagggaaatgctgattgcatctcttctggaaatacgatgaaacattcagttacagaataatttgagatacaagtgttttcctaaaataacactctcagacagacaatatatttggaaaggaaaaatgaaaaatataagttattcataatcaacagcctttttgtaggtaggtccttaaacagatagtttctgttaggttctgggaatgctagttcattaatatagatttatgtcattgtgctggtcttagaattattcaagctaggattaaactcaccgtaaataacctgaacctttttaaaatgaagttgaaacaacagtaagtatcctaagctaaggtttttaaaagttattattttctgcagctctacttaatgaagctttggaaggcagttgtgtgcatatgcttatttattatgccaggtaaataggggttacttacttttctgttctttggaaatttggttcagaaatcacagttacattataaagtgtaaatcattgagatgcttttggccatagacattccctataatgaaagatgtcattgcactaaataaggaaaggttcctatgacagataatgggatcaatgctatgcaactgacatgatcttgtattttgatagtcatttgggccattttattaagaagttttcaaatgatttgaagagcacttgtgggcagaggaaattctaactacccaatgatactacttagttatagctaagtgagaaaaaaaatcataaaaatattcttactttctctctcaggtaaggaaaacctttcagtttccctgtagtttgtgtcaagatatatgttttcccattaaacttgtctgccatactgacgagagaattacagcagaacttttgaactagtttgataagaaattcctttcacacaaaggatcccagggagaaaagtgcaaagccagttcaccatcgtagtttaacttaaatgtgttaagtatcagttgaaagtctcaaatcctctactcattcgaaaatccacttaatataacatttatgggatttgctattaatcttatccaaaacctgtgttattttggtacttatggacttagaaaagtctgtatgtctcaaactttaaatgttactaaatcttaaattataaaaacttggttagcactcataagcaacgaggcatgtgtaaatattactaacaatttcactgaagattcatgaagttgacacagagaggatgaactgtatataaatgtgttcagcggagattacattgtctttgttttttgtttggagtagttatggtgattaatgaaccactgtatccagcttcagtatcatactctttctttttttgccaagttaaaggactatctttggtgatataaagcacatttgttcaatttcttgaaactataataattcagagttggcagacagagttatatatccccaagtgaacgaattgtattatccagtgaaccctgctaaatgcaagaacagaagagcacctgaatctttttctcccctcaccagccttaatatgttgtctgtgctagaggaaaatatggcttcgtattagagatttttcttcattttcttgtcaaccacaaggataattttaggtgaatttacccagagacacttgggtatttttctgcccaataatggctattgatcaaaacattaatattcaatacattgaacaactgtaaaccatgggcaccaaccaatcagaaagacaatggcaatcagcataaaacaggatggctgtgccggcctttgcagctgagtggcaaccccatttaacagatctttcactaactgtttcaacctaattaagaatggttttgattaccatagccttgtagcagatctattttttcatgtagagataaaatgttttgagataaattgatttgtttctcatatgtgaaagaatattagttttttttggtatcaactactaaaaagttaataattgtggtgaacctcttaaagtcagtgacagaatcctattaatctctgcaacttcagccatcactgctctgctggacacaatgtggatgttttcaataattttggaaaaaaatgccatcatcttttccttttgggattaaaaatatattcaaattattgaagtatgaaaaaatgactaattttattttcaaaatgcatttctgtacatggctcatcttagctatttgaaaatggcaaagatattcaaatttgtgaatgttaaattataatctccagagcctcagtaaattccctgaaatacagtgttagaacttcacacgaatatgattcctgaaagttgtgtcagtcctcatgggtgtttagatccatgactgaccaaataattttaaagagccagcacgctaactaacaggaattatagaaatataatttaaattttattgtaattgtggcaggaaacttagagccatggacaggagccccgcaattcataacaattcacaatacagaaaaatttttctgtatgagttgtatgcgtcgatgattacaacaaattgtgttttatttattcacccattattgtatttatctattcaatttcaattatacaactatttactgagtcagcctaatatatgccaaatagcaggcaagttcacaacttaaaaatgatacacttcaaaaattcgattataactaaagtactactctaatttaatatatacctaccgtgacttctaatttttatacttgattttattcttattggtcttagagaaaatagccatagaaagcattaacactaaacggaaggctttaagaatgactgtatagttcgttgcaattagacataatataattaaattgaatcaatcgtatcagataaaatatacactttaaagtgaaaatgttaatgattcttagtataactgtaagtatactgttttgttcatttgcatgcttgttttccacacaaaatgcagcactgttgtggtttagagctaagtatgtattgccagcattcaaacctcagcaatgtcttttgttagctgtgtgaccatcagcaagttacttaacctctcttgactcaaatcaccccactgggaaatggatattataatagtactaaccttaaagaattgttgtgagaattaaatgatttaacacctataaggacattacatgactgcctgaggttcaataagaactatataaatattagctattattatatgcatgcacattatgtagttagtagggggcaaaatcctaggttatttcattttacatccatttctcactaactctttaactccaagaaaagttacttatctgtactttatttcatctacctcttgaagttgttcaaagtttgaatgaattaacacacatggagtggttagcacagtacttggccaatagtcaaccctcaaaaaatgttagccataattttttattccttatttcattatagatataaaatggaggtagtaattattatcttatcccttcacaggacaattgaaccactgaacatatctgtgaagataagtaaacagttgaatattattcaaaaatgtgtttactaattatctagtaatttataaattcagttattctgtttgtgaataatgagatgtgaataaaattaattaaaatatattttcttatctgtattattgcctgaccttggtggcaagcgccagagcatctgtttgttttttctctatttaggttgctaaagtatcttgtcatataattcagaaaattatatgatataaaaatatattatgtaagaaaataatataattcagaaatatatgtatagtattgaaattaagcagaagccctaaactgtttttataaatattctgaagtatgttacaatattaattatcattattggataggtcttttggttttaaaaatggaaacaatttttttaatggaaagattatatcctaaaacagtaattttcattgaatcttaccactaaatgtatatttgaaccatttcataatttctactggaatgtgtgaaaattttaaaaaactactatcatgaggatggaagcagtggtgcacgcctgtaatcccagcactttgagaggccaaggcaggcggatcacgaggtcaggagattgagaccatcctggctaacatagtgaaaccccatctctactaagaatacaagatcacgccactgcactccagcctgggggacagagtgagactccatctcaaaaaataaataaataaataaactaatatcatgaaatgaggacacaagaaatactttctaggatactagaaacattgattaacaacttgggaaatactgctctaagcatgctgcactgtaatttttgttctttttttttttcttgttaggaatctttccctgaaattaacaaaggacgttgatcaagaagccaggtgttcccacatcagccgaatgcccaacagtccatctgcggattggcctctacaaggtgtggaagaaaacggaggcatagattctctgccattcagactgatgttacaggactgcacggcagtcaagacgttattattaaagatgaagagagttcttcaagaggtaatggtttcctctaagattaatgtccttcagtgctggtagacaatgaagtctgcagacgtggttagaccctgctctgtcagtaattaactacatgacattgggcaggggtcaggtttcctcttggagcttagctattttcatatgtcaaatgagtgttttgaagttctggtttataaggtactctttagccttaaaattgtaagagtttacgaaatacttaaaaaagaataaattgatcccaagcatccccctatttgtcaggtaaggagaaatgagtatcagctatatagttatggttacatgctattataaagctattgagaaatctattaaatgtatttcacatcaatgatactgggtctttgtttatatgataccataaaagtagtttatttagtcatttttgttccaataatcagaattcagtaaaattgaattacagtaaaattcaatctgaaggtctgaatgattttgcctaaggaatgtagttgccctccccacagcttgggcctagttactgaaacagtgagctagtcaggaaaatgcataatgagattcttttacccttgtgcccagaaatcagccattctttaggactcaagtttgctttggtttgatttttataattacaacagttgttttatttgagggatttctatacaaagtatacccgtgattattattacttcatagacatgtgaagtgagagttagaaattttaaattatttttctcaagtaagtgtaatttcagggcaacagcctgaaatttgtgtctttgtattacatcctattatatttaagtagatttatctttattgattggagatattaataaagaattgagaaaaatattattatttagaattaatggtccctatgttataatgattgctaatatttgctttttgaacactttgataataatgctagcagctaccactggaggctagaattgaatcaggaagaaaaaaggcagtataaaagaaatgaatgccatagactattggggcttccagtaatgtgttctcatcagctgttataaactgtattagtctgttcttacactgctaataaagacatacctgaggctaggtaatttataaaggaaagagatttagttgactcacagttccatatggctggggaggcctgacaatcacagcagaaggcgatgaaggagcaaagtcacgtcttacacggcggcaggcaagagagcttgtgcagggaaactcttatttatgaaaccatcagatctcatgagacttattcactaccatgagaactgtatgtggggaactgcccccatgattcagttatctccacctgcctcccccacccttgacacatagggattattatgattaaagctgagatttgggtggggacacagccaaaccatatcataaacaaaagctggaagataccttctctgtgtcccatacaggttatatctctagggcagcctttgtttctggatattctggatcctataatgtgttgtgctgtagcggtatgcttatacttgattactcttagaatttcagaaattatatgagctggcagttcagcaaaggcatcaaaataaattatatgaacttaaatcaattactttcaaaaagggtaatcagtattcaaaatgtgttttctatttgttttactattatctacacttgtgagattatttacatcttttagaatcacatggtggaagtactatataattctgactgtacagatttccaacatgtagattcatttatgtcattttggtagcttgaaatcagccatgtgggagtatttatgcctcagaaattggcaaacactgcaaattagggcctcttatttttggcaagcctgttgttaaatattgactagcacattactatgtgtataactgtatgattctatactgacaacataaatatttgcctgcaaatgaatagataagtttgaatttcttccacctttggcttaacatgcaacctgatcctctttgaacaagacaaacttagtaacagctgttatattagaagatactagtctcaactattcagctttttacctctgtttggtctgaattttaataacaaatcagttaaagcaaaagataagtagaaagagctgacagaaggtgtcaagaggctttcttagagtacttaattttataattttaaaatattcagtgatattcactataaagtcaatattcagaatatatttagatggtttctatactgccacctggttttctttattaaggggtattcgaagaagctgaagagaattgattttttaaagctgatgtagagtgaacaatacttaatatatgtttgtgcagcccattcagtgagcagagggtctttattatcaacagggaaaagcaatagtattatatgattagcatagacaacagttctactaagaagatattcataatagaggcctctaaagaaaattgttttttgaaatgttccctaagccaggaagttttaaacttccattcccatttcattactaaattggagtttaatatcaatattcatttagattaacaatatattttaatataaaaaattcattcctattttgagctgatttttatgatgcacaatcgttcaatctttgttcacagattattattattattattattattattattattattattatttgagatggagtctcgctctgtcacccaggctggagtgcagtggcgcgatctcagctcactgcaagctccgcctcccgggttcacgccattctcctgcctcagcctcccgagtagctgggacaacaggcacctgccaccatgcccggctaattttatgtatttttagtagagacggggtttcactgcgttggccaggatggtcttgatctcatgacctcgtgatccgcccgcctaggcctcccaaagtgctgggactacaggcatgagccgccgcacctggccaagttcacagattattttttaatggcaggaggtacctatttgattttaaggtaaaataattacttaatttttacatgtcatattagaatatgcttttatttgagatttttggtttgttacatgagtattgcatttgtatattttttctcattgatctctttgaaacctatgacttagtggaaatgcaatgcattcatgatatttttacacttttgctaataaaggtacacctttcttgtgagcaaatcaagttatcctttgttgtttttgagggaacatcttctacaaatagcatttgaaaatatccagagatagtaatagtgagatcacagaaaatttttggcttaatctgtttaagattgctctagggttgtggttaatgactagcggctagaaggatgcctcgacagagtgttaatagatgactttcctaaagtttctagaactgtttcagggttgtggagtaataaaaataattccttggaaagttctacacagcaggctaaataaatatacaggtcgagcatccctaatctgaaaatccaaaatccaaaatgctccaaaatttaaagctttttgagcactgacgtgacaccacaagtggaaaattccacatataagtactttaaaccacttgttttatacataaaattattaaaaatattgtataaaattacctttgggctatgtctataaagtatatatgaaacataaatgactttcatgtttagagttgggtcccgttcccaagacatctcataaggtatatgcaaatattctaaagtctgaaaaaattcaaaaaacacttctggtcccaagccttttagagaaggggtactcgacctgtactctatctttcaagtactcttatctatatagtccatattacttatggcattttaatgaatataagcattaacgctgagatctacttgtaatattttaaagctacctataaaatttacttctttctaaatttttttgtgaggtatcacatgtttaatattattttgcaatttttattactggctaaacaaccttagattgctattaaaatgttaaatcccattagctcattccagatttttttaaaagttattttgtcattaactgtaattgcattacttattattctacctactttgggtttaataaaaattttcatcaagtaattcatttggcacttagtaattcttccattttgtgccatcaccataacaacataaatcatattaatctaatccaggtttggggattatatatgttatgctattttataatatataatatatactttcaataaaatataattttgaaagtgaatacacctgcaaaagtgaatctaacattgtgtttgtatctgaatcatcttgggtaggaaccagagatggagatgagtaatgggtaggcattgctctaaatattctgcttcagtaaacctgtctttggcccaagcatgtgaatggtgaggactttctcagtgtctcttccaagtatactggaaaagcactgggttaggatattgtgttttagactgttggtattaaacatcctgaaaccttcctctacttaggagattcttgctcctgaatacttttcagatctgcttatatgcatctcttcttccaactgctcctacatcaatgatggtccattttactgaagttacttcacaactggtcttacttctagtcttcccacctatcaaatcaatttactcattgctgtcaggctaaaatgattatgtgatcaagtcagtccctgtatatctttaaatgtttcctaattgcccttacaagttcttctacaggttgtataacagtctatatttcctctatcattggagcacttatgtctcctcattttaattgctaatcttccttttcccagtgatattctaagatgcaggaaaatgatcttgtgaacttgtaccttgttatatcttctcaacctggaaggtatttgctgcttaataagtgtttattaataaataaatgaaaggaaatggatttcattctgtttccaggctaccattaaaataactgttggcagaaaacaaatgataaacttgagtgcttgatggaatgaggatcaaagtaagtatgtagtaaatttctcctctttaaaagaagtgtacaatatgtttttttctcagaatatgaaataaagacacatcacaaaaattactagatttaatttaatcaagacccatttgtatgcccaagtctatcaatggtagatataatttcctgaagctttttcagatctttctatgcagtagatggctatggtattccttaactgtatttttaaaattatctgctaaatcttccagattagaagaaaggcctagaggtttagagactggttatttccatatgtactcactcttttcacacagagaaaattttgttttcactgaacatcattgcaatttcagaggaaaaggataactataaatcattataaaaccacaaatcagttaatctaataaacataaaattattggtataaagccattattacttcttatttgtttggctgagcttaccgttttcctagtgatggtctgtcgacctcctagattttaattttgaggtgagctaagaattaataatctgaatggagtatcacactccaaattctgtcatccttttttaaagatcagtttctttttattaaaatgcacattcatattcccagcaacttcaaatttcaactcctttatttttagaaaaatgaccgatgttgggcctttagaaattctattgttgtcactttattctctagtattagtgggaaaagacatgactgtagtaagggaagagaactctatcatttttttcttctttttcttaaatttttaaaaaattttatgatctataaaagaaaatgtttaatatctacagaggtgggttttgttttaatgcttccttttagtttgctctattctctttatcaaacaaatatattttgatataataagctgtatctattctaacaaaatagccagataagtaaaaatcaaggaactacttatttgaaaatttatataatttacaggcccatatagttgatgcaaatattggggctgtgaaacatttgcaaaagacccgccattgattaaagagctggaatctatttttctttttcttttctctactacctaatagttcaaacattaatttcattttacctaaaaggaataataatttaagactttcaaggataatattcaatgcaaaatttttggttttttttcagcgtaatttgcaattacattataaaatttacagtgttttctacttcatcatttgtcactgtttggtgggaatttttaaagagtttatttttactgcatttcagtaattgattcaaagggcattaataaggattttataactaaatgacattttcctatcagcacatcttgagatggaaagaaaagtctatagggtaggaacttcagcaatggataattagagaaggaaatggccacagtggagagtcataaagtaaagaaatatccaaatcaagcaattaccatggaaatatagacagcagtctaataatcagaattctctttatacttatcatttgaaaataacaaaattacaagtttttgctaccttctttatgtttatttatttatttttgctggtccagaaatatgtttaaggaaaattagaaaaacaagtttcatgaaaacatcaaatggcagaaagttagagtgactatactagtatcagagtagatctaaatatatgacatttcaccacagtcagaaagccatacttcataatggtaaaagtcagttctttaggaagacacagcaatcaaacatgtggatggcttgtttcaccaatacacaatgcaaaaactgacagaactaagtgaagaaataaacaaattaacaatcacagttgaagaatttaaaacatttctttctgtaattgataaagcaactaaatgaaaaaatcagaaaatttctagaagacttgaacaatattatcaatatttttaacccaattgacatttatagaatactacaattaataaaataattatatattattttcaaatgcgagtggaacatcgtcaagacacactatatactgggtcacacaataagtcccattaaatttaaaaggtagacatctatggggtacattttttgagaaaaatggaatgaaactaggaatcaaaaataataaaataactataaaagcatcaaatatttggaaattaaattacaaacttctatataacccacagacgaatttagaaagctgaaaggaaatttttaaatgtttccaatgagatgatgataataatatcacaaatcaaaattttctggatatagttaaaactataattacagggaaatttgtgactttaaatgtttatattcaaataaagagtgcgataattcgtaacctttaactttcttccttgaaatgttggttaatggatacaaaaaaacagttgaatagaaaaaagttctagtattaaatagtacaattgggaaattatagtttataataatttgttatatttcaaaatagctagaagatttgtaatgttcccaacacaaagaaaagatacatgtttgaggtgatgtatatagcaattaccctgatttaatcactccacattgtatacacacattcagagatcacatgcacccaaaaatatgtgcaactatgaaatatcaataaaaaaggtagctaataaaagaagggcaaattaaatccaaacgaagcatgtagaaagacataataaagaacaaaactctataaaattaaaaacaaataataagcccaaattgattctttgaaaaagttcaaaaaaaggctgataaaaaaagattatagaaaaattaagaaacataaatactagtgccagcaatgaatctagggaggaataatcactacaaatcctgcagacatcaacatgataataagacatggttacaaagaacattatggcaaaaaattaacataaatgacaaaaacaatttttttgaaaaatacagctttccaaagtgacataagaaattgcaaatctgaatagcctaacttgtactaaattaatgtattttattatttaaaaaagaaatacatatgacagatattatgtaaaaattttcaggaaatagagacacattatgcttctcatcttgttttatgtggccaacatatgcctattaaaaaaaattggcaaaaatccttataggaaaaaggaaattacagaatttttttataaatatagatgcaaaagtcacttaaaaattagtaaatacgtgtagcaatatgtaaataatgacctatttgctttcattccagtttttttagcatccaaaaaccaagcaatacaatttactatattaaaatattaaaaagagaaaagcacaagactgtattaatagatgaaaaaagtacctttgaaaaattgaaaaccaatttatggctcaaataaaaatataaacctcagtttactggtagtacaagggaacttctatagctaatattcatacttgatggtaaaacactgaaacttctcctcctaatattatcagcaaggtaagaatatccactcaccacgtttgctgtacgtgtgctagaggtcctagctaggaatgaggcaagaaaaagtgtaacaggcataaatatttgaaagaaaaggtaaaactgcatgtatgagcagatatgtttgtttatacagataacctaagaaatctacaaaaaagttaataataaaatgacagaattagcagtaaatttaatagcattgaagaatataaagttgtcataaaattatatattgctgtgtagcaaatcagctgtaaaatctagtagactaaatcaatatttgttatttcaaagtttctatggttaggagtttgagagtagttacctatgggttatggctgaaggcgtctcattagtttgcactcaggatgtcaacaatggctgtagtcatgaattcttggctaaacttgaagatctactgcctagttcactcacttgctgtggcaggaggactcagttcttcactgctggtgctcaagaggcctcagttccttaccatgtagccttttcgctggtcaacatggcagttggcttccccctgactacacaatctgagagagagaagacaaaatgcacaatgtcttttgtaacctagtctcagaagtaatataccatcacttttgtcaaatttattggtcacaaagatcaaacttgatttagcatggaagaacaatatgtaaagtatgaataccaggaggtagggaacattgtggtccattttggaggctgtctaccagtcaatggtgtattcctctcatatgcaaagtacactcagcccctcccaaggccattcaaagtatcattcaattacagcatcaattcaaagtgcagaatctcaaaatctaaagtgtgtatagccgtagatgaggtttaaacacagcaactcaagtatagttttccattttaacctgtaaactaatacacatgttagtagttttttggttaggattcaaggcctactaaaaattcttgctctttgttctgccctctatgttctttgttctaacctctgggcaattctttcttataaaggtagcacatgttttgcagcagaatagtttcttcatccttatttgtagttgtagacattggtatccaaaggcccttttcattttactctttgtcccttaaagaccaaacttggaaagtgtttctgtgaatataactctcttaaattccttttggggttgcctgtgaaccttattcgggaatcacttccttagacaaaatacgtacccacaaatcgcttcaagataagccctactctaacttgaaataggtgcgggataactcctttaagcttttgaaattttaattgtttgactgtgaagttcgatgggccataccttaaaaccttaaacaaaaggcatcttctgtgtgagtgaactaggtactctgcagcaccacattttatcttttaggacagctctacattgattaaataaattttaagataataattttttttaatctcaaatcatgtggttgttgcacaggtttccatgtttatcaaaactcatcaaattacacattttggatggcaacacatgaaatatcattacacaactgttaagtgccagtgtcagtgctcccatttgtggagtttttagttttcccttgtgagacctgtaaaacaacaatgaccatttatcatacagactaacttagtattgtcagttcttataaattattacaagttattttccctcattgttagaataacataggttaaaaaaatttacaaggtaacatagtcttcatatacacatatggatcccattgtatactccctggagaaacctctggtttagataatgacatctcttagactgatagatttttagtaacagtattctgcctacataaataaggcctggttatgctgctgtacaacttggtcttgaaaatagatgaggagaggaggaaagtataattccatgactcttgctttgtaaacaaccctaattttcaacagtcctcttggagagattagagaaggtggagaaaaagtctttcctaaccccaaccccatttcactcacaaaattccactggaggaagtatattgcagtggtaaagattacagttgttttgaatcgtagagatctaggtgtgaatctcacttctgccattgtatagctactgtaagttgattaatgttttcttaagtttctgtttcatcatatgtaatattaataactacctcataggattatttggacaattaagcaataaaatgtgtacagaacatcacagtgtgagtttggggtaggcactcatgaacatgagccactgcagtgatcttacttgtgtgataattgccaactatgtcaagccacgtgtgaaatatttgagatttcttaaacacttaaaaatataacaattaaaaaagcatatatatattctttatatatatatacacatatatatcagtaaatgcttcttaatagcataatgtgttgtattcattgaatcaatatcaatcaatattgaatcaatatcaataaaattatcaataatttttaataaaattaaaataatttaccaataatttttaataaaagccatactatctaaaactaaaactagaaggattattgccatttatgcttttctggacatactcaattatggcagcacatttgacttgacaccactccacaaaagtactacaacatgtcaattgaatttcctgtttagagtcaacatatactgtggttgttccaggtgagaactcagggtgacagaccagaatgaaagaaattgagatagaagggaagagatgtgtagtgtttttttgaagtcttgtcaatagtacctgcttgtgaactggaatagagtggtgacagatagagaaaaatcaagcattactctgaaagttgtcacttgagttacaggcagattatattgccattttatgagccttggaagactagaagaggagtaacctgtgcaagacagaaggaaacaagagttctattttgatcaggtgaaggttgaaattcttatttcaacatgcaaatgtatgtgtcaagcagaaatttgaattaatgtgtctgtacatccagcaagatcatggctagaaatgtagattgattattcatgatcatatagattctatttaaagttatggaagagagaatttgtatttaaaaccagattaggatgtgccaatatttaatgattggaaaatcaagagaaagagtgtccagggagctaggaagaacactaagagcatagtgtctttcaaaaagccaagagaaaatattgcttcaagaaggtcagcttggggaggtgctgaaaagtaagtaggataagaaaagataagcaatcgatttggcaatcctttgaagttaattccaaaagcatagtaataagctttaggaatttcaatatataaaacaacctattctaagtgttaacttggatagtcaaagcctagaatagaaataaccatttccatctagttctcagttgttaaattgtttgttaattcctttatggcattggtctatgaatgtgaaagacatgaaaattaataatagatgtcctgagttttaaaaatagcttttaaagtaagacatgtcttagttttggaaggaaactatagattttattaggttaatcaagaatgataaacaaaaattcattttatagagtattctccatgttgaggtatcatttttcttttaaaaagtattatttatattacttaatgttattacttaatactgcagaataaatctagcatagtgatcacaggatacagttatgatatgattaggctttacgtccccacccaaatctcatcttgaattgtaatctccattatccccataatccccagatgtcaagggagagaccatgtggaggtaattgaatcatggggatgatttctcccatgctgttcttgtgatagtgagtgagttctcaggagacgtgatagtttaataagggactttttcccctttcgctctgcacttctccttcctgccaccttgtgaagaaggtgccttgcttccctttcatcttccaccatgactgtaagttttctgaggcctccccagccatgctgaattatgagtcaaacatctttcttttttaaattacccagtcctgggcagttctttatagcagtatgaaaacagactaatgcaaggtactagaacaaactgctcagatttgaatttcagctctcacaattactaggtgcatatgattttgggcagggtgcctaatctctccgtggaaatctggtctcttccaaaagtgtaatggtgcatgttcaaaactactagataattttaagttttccctggtgtttttattacattactctcccaatgaggtataatatattaatctaaaatatattttatgttaattgtattcttatgcccacaaaaaatattttgagtacaaaaatcaagtcacaggtaaatcctcatacagaatatggagttaaaaatatgcaaacttaaataatatgttgttaagtaatagatatgtatatagtaagaccataagaaaaaagatttaaagagtaagaagatgctaaacaccgtattcagggtaagattatctgttagaggtagtgggggaaggcatgtgcagttacgaaggggcacacagaggtctttctaggtattattatttacaatatattttcttacattttttcaaaataattatgtatacatgttttcttatgtatgtgaaatcttatattaaaaaactcactttccaagtgtatgtaatccgagtggttccctgtacagcaacattactccccacaaccctttttcttgtgtatccctatgcctgtaaaaatggcagaaatattttgcctactcctatgctgtcaatgtatcttctgatatttatatgatgtcaaaatgcaagtggagcaggatcaaggtgaacaaatgtatacccatatgccagagatttcttttctggtatgtgtacttatattatctgctagtcatgcataatatttgattgcttataagaaaacgaactgcaacccacagttttaacaataatgccaccttcattgtacctaactggtgtggtaatctatttgtgttattatcatattcaataattaatcaaataaccactaatgtggttttattatgcatgtctaactttcagttttcttcatgaatccagcattaatgtttcacttgtaaaacaactcacatacttttgtgtgattcgatgggctaaatccgacattaagaatttcaagctgcaacataacaggtatacagcagacggcaccctgcagaatctccaaggaatacttgagtcgtcagcgcttctgatgggttttggaaaaagacagtgagcagagaatcacttaagcaaagtggaaaagccgtaattgtgttcctctgagacacatttttactgaaattatgttttgtttttgtttgaaaatcagaatcaaaggcatatttaactacagttaaaatagctgtttttaatgagtgattctatcaaatatgatgttacaactttagataacataatgcaatttcttaaaagtagtatgaatctaataatattcacatgtttacagatgagcaaaagtgtttcagaatctagtgactcgtttagctggaatgcacttattccttaactgtatcattttaaccttgataaaattgaaaacttgtggaaattgatggactttattttagtttagatttaccagtagatagacatttactatttcaaatattgtcattttaaatatgttattttctggagaggcacagtggctcatgcctgtaatcccagcacttcagatagcctaggcaggaggattgcttgagctcaggagttcgagacaagcctgggcaacatagagatctcatctttactaaaaataaaattgttaggtggatgtagaggcacacacttgtagtctcagctacgcctgtagtcccagctactctggaggctgacatgggaggatggcttgagcccaggagtttgaggctgcaataaggtgtgattgtgccattgcaccccagcctgggcaacaaagcaagaccctgtctcaaaaataaatacatacatacatacatgcattattttctgttttttttttttttaaagtaaaagtgctcaagatatatagaggactagctattgataaaatagaaatgagtcaatttatatttaagataaatacgtgtgaacataagtagacccatttgttttgttctctttgattaaatggacttttgagcagactatgaagagtggagtgtttaaaaaaaataatgatttctcatgaaatattcacttcacttctcttgaaaacatgaatattgttttgttatgcatgatctacattaggagtcagcaaactttttctgtcaaggctagttagtaaatattttaggtttttctgactgtatattttctgtatttcaactcctcaactaagttgtagtgtgaaagcagctacattaaatgaatgaatgtgtgttgctagttcccataacactttgtttaaggaaacaggcagctgtccagattcaggatttgtcctgggcctgtcatcctatactacttcagagagaggagattaaactgtcatgggaggcattgggtccgtgacattggagcattagttttaggagcaagaatatacagtctaaatcttattccattactagttaaatgttcttaggcaggttgtttaaattctttgcctcagtaggttggggataacagtcacatatcacttaggtttgtagagaatattaaatgtgttaatatacttcaaatgcatggaacagtgttggacacatagcaaatgctcaatacgtattagatattattttatgattttcacaaagtctgagggccactagtgaaacaaagaaactggatttgccattagacaagcctgaattcaaatcttagatctacaaaaatttaagaatgtaatttaattcagttttgtttaatttctttagcagtcataggtttctttgggtgtaataaggggattaaaaaaatcatataaatgttgttgtaaaggttagatttcatttgtgtctggcaatggaaggatctaaataaatgttacttctctttcccccttaaaaagttttttttaattttagtattaattctaaatttgttgcccaggttggttttgattgctggcttgatagtacatttatgattatagttttctctagaactggtccttgattttagtatcctatttctttcatgtgccagagctgaagtttgggccttgagcctcacgtttgttgcagagattcttttgctagttcacaggatttctaaacacaggtttaatatcccttatccaaaacacttaggatcagaagtgtttcagatttcagagtttttggattttggaatatttgcgtatatgtaatgagatatcttgggaatgggacacaagtctaaacacaaaattcatttgtgtttcatatacatcctaagcacacaacctaacgataattttatacaatatttttaatagttttgttcatgaagtaaacttgtgttatgtgttcatgtgtggaatttttcacttgtggcaccatgttggcactcaaaaagttgtagattttagagaatttttgatttttggattagggttgctcaatctgtattttttttatttaatttaatttaattttacattccaggatatatgtgcagaacattcaggtttgttacatagataaacgtgtgccatggtggtttactgcatctatagacccatcacctaggtattaagctccacgtgcattggctatttatcctgatgctctccctccccaacccccaacaggccccagtgcgtgttgttcccctccctctgtccatgtgttctcattattcagctcccacttataagcgagaagacgtagtgtttgattttctgtgcctgcataagtttgctgaggataatggcttccagctccatctatgtcccttcaaaggacatgatcttggccaggtgcggtggctcacacctataatcccagcactttgggaggccgaggcaggcagatcacctgtggtcaggagttcaagaccagcctgaccaatatgatgaaaccccatctccaccgagagtacaaaaattagctggatgtcgtggcacacacctgtaatcccagatactcgggaggctaagacaagagaatcacttgaacccaggaggtggaggttgcagtgagccgagatcatgccgttgcactccagcctgggcaacaagagtaaaactccgtctaaaaaaaaaaaaaaagaaaaaaagacacgatctcattcttttgcggcatagtattccattcaacctgtacttcttatccacctttctaagtctctgatcaagttacattgtttcatagcaaattttggataggatatcagtgaattataagcatgtccaaatagatacctacgtttacctaggttttaaaatctttccaaaattttgttttgtttttaagaaatattcaaaaatgttcgatgaaacagagatgtgttgtaagtgcttttcttgcaaggaattctgtgttatagtaatgatattcgtagcttctatttgaagccaaacaattttaattcatctatatcttcttctaaacaatttcctttatatctatacttatagtcttcaaggtgacattttatctagatatgtagggatttactgtttacaacttaaaacattattttaattgcgtattctcagatggaacaatcctaatttgctgttgtttaaattgtattatttatttcctattcagggctttggaaaggctcacaatcatcatatttttgtttaacttaactcttggtttatggttttgacacatggtcataaaaacatgctttgataaggtgtgatctaatttagtacctactgaaattctatgtcccaatatgcccttactgctttttaaacctaaggctgttttgaaccaaaagccaattttctaatactggaaggctcatttgctccacattattgagaaacatatctattttatttaagtactttagaaatatccttgctagggctgtgtcaaatttaaataccaccggaaagataattgaaaacgctaaataatcttgaattgtttcttctgaatatttctctttacttggttaacatccaagactatgtatcttactgacaaattgtttaatatctgtcaaagttatatttcttttttctagaaaccctcagaagaggaaacaatttttttttggtaatgaattgtggtaaaagagcagtaaatattgccatggatacatataattctctggaccacaggccaaaaaactgctggcgttgattttggggaaaaaaatcagcagataacatctaaatctctgtgcatatagcaaaaataggaattttgggggaaaaataatcatactatatagtaatttgtgtttggatttgagaatattataatagtagagaatgaaagtgataccaggatgcctgaagtgtgtgtatgtgtgtgtgcaggaacatacatgagtgcaagtacacaagtgcctatatgttcattgggtttgagtgtgtgtatttgtatacactggggtttaggaggtagagttggaagggatcttaaaaatagacctaaaaaacaaacaccttaaatgcatagatgacatctattgcttcctctctgtcaggttaaatttgacctcattgaaatttctacccaaccttgcaaaaaaataccaggatgcataaaccaggaagtatgtctgcattcaaacattgcttctgagccatttcttggtatccttattgtcaggtctatcctgcttttcttcactatgttaactgaacttactatttctgtctacttttaggctctgactttgacctttcctgtgtgtgaatttaatttctccctcttagcagtaaagcaatgcatagattacttttaatgacccaccctttcctttcatttgcattagccctatgatattctatatcttcttactttcctagggtagtagaagtcttggcttgttttgccagacagagcaaaagtgtcctgggatccacctaaatctcgtaaaatatttccttacacagaacgcaaaattgcttagtactctctacaaataccctcatccccccaccccaacacacatccttttcattttaaatgatagcccaggataaatggtgtgtttccatcagtgcttcagattgccatgttctttcagctcattatgcgcccacccaaattgaatttctgtccctagcatgataagcaagcatttaggtttaattgagaattctccttatcttattataatgagaatttttaacaccaccatttctgtaaccattatggtagtttaactgctgttttctgattatcaacttttgtgagacttttaccatgtgcagagtgagccagtttggccactgccacaagcgctgtggtattgttcctttataatttttgagagtaagacatggacagagtaaattgtgtttaaggaggggtttttgttgttgttgttgtttctcaggtagacacatatgagcacgttaaccgcttttacagggctttctagatttcaaaaagctattggtcaatttagcaaatgttagtattttcaaacttcttagaaatgttctttatactctgccatgaaaattaaaacataaaactagaaatttgaaagatcatagcttttctccccaaaagcatgctatgtatttgtaaggtaagtaaaatgagtgaaataggatgaatattcagtgattttaaaaattgtgaaaaataaaaactatttttgacaattaaaaaaatagtagtgtactctccactttatacaaaatatatactttaaaataacattgattgtagagtcgggtgtaggagaacaaaaagcaaattccaaaaatagtttattttacatttgtttatgataagtttaaatggacttaagtcatttgtcctaagagtttaggaagtgaagaaatttcaagatagtaagaaatccagatgaaaatgaaactaatcaatccataagtaataacaattggtatttggcttatacgttatgtgaaaaacagcaacaacaaaaaatattcatgcctgtgcttaacatctcagtggggagaaataggcagaggaaaacatgtttaaaataagataatttatacgatattttaattgtgcctccatttcttaagggaactttttttcattcactatctgcttgagctttatgtttaccttttaggttcaatattagagtattaggtgcaattattttataggctccttaccgtagttatagaattcagtttagacatagactcacagttttttgttcagtttatcaacaaattttcattgtatgtcagtctctgagtctacaaaaaggaaagacaaaatgagaggaataaaggaaaaaaagaagaaagaaagagagagagaaagaaaggaaagaaagaaagaaagaaagaaagaaagaaagaaagaaagaaagaaagaaagaaagagagttgccctcaagaaagaagtatacaagttcctggtattcaaaaaattaagtcatacttaaagcctgaaatttctgtggttgtagggcatactataagagagagtttctaagaaaaccagttgttatggaatgaattgtatgtccccaaaattaatatgttaaagccctaaccaccaatgtgactgtatttggagataaggcctttaactaaggttaaatgaggttataagagtagggccctaattcaatatgattgttgtctttataagaagacaaagaaacagtaaaagccaagtgaggacagagagagaatgcaccatctgcaagccaagaagagaagctgtaggagaaaccaaacttgctgacatcttgatcttggacttctagctccaggactttgaaaaaataaatttctgttcttttagccacccaatctgtggtattttgttatggcagccctagaaaagtaatataccagtcaatatcccaaatacagtagaaagaacaaagccaagattagattttatatggggaaccttaggactttgtgtgttgtactaatatagggaagacaaccaagagagtaacacggtcttataatattagtgacagagcagaagttagctgctgcttcttacacattcatctatgtgcatggcgataaggcttgacagctttgcactgataagaaaacaggggcaatgctccttgaatggtttcactattaaaatggccaagaggttaagtgaattttaagaaatttttcatacagaagcatgttgtgaaaataacaatcctgtccagaaattaatttgtgggttaatatgcaggacatattagaataaagtttattgggagaaatgaagatcaactttgattcaggtttgaaatagtaagaatatggagtgtggcagtggcaatgggaagctaagaagagagaggctgaagattatataaaaattggaaatgaagagattaattactattataaacagtatgcttgtgccctctcaatattcacatgttgaaagactaaccttcaatgtgactatgcttagagacagggcttgtgaggatgtaataaaggttaaatgaggtcacaatcgtggggccctgaatcagtagggtgggtgcacttagaggaagagacaccaaagttttctgtctctaccatgtgaggacacagtgagaaggcagctatttgcaagccaggaagagagccatcaccaagaactgaatctgccagccccttcatcttggatttcccagcctccaaaactgtgagaaatatattatctgttgtttaagccatcagtttatagtattttgttatagcagcccaaacatattaagacaaagtggttgggtactttgaaactaatattttaactaaagcactctgagctttagaaatcatatttataataactataatacatttccaaagaaagtataatttagtgaaaataaagggtcaaggggctgggtgtggtggctcacacctgtaatcccaggcctttgggaggcagaggtgggtggatcacgaggtcgggagtttgagaccagcctggccaaaatggcgaaaccccatctctgctaaacaaaaattagcctgtaatcccagcactttgggaggccaagacgggcagatcatgaggtcaggagtttaagaccagcttggccaacatagtgaaaccccgtgtctactaaaaacacaaaaaaattagccgggcatggtggcaggcacctgtaatcccagctactcgggaggctgaggcaggagagttgcttgaacctgggagggagaggttgcagtgagccgaggttgcaccactgcactccagcctgggcgactgagcaagactccgtctcaaaaacaaacaaacaaacaaacaaacagaaagaaaagaaagggtcaagaaagtgaaaacgaggaagaatctttttgagcaaaaaggaagaaggttgccatgttttctgtaaaataagaataatgaaaaaaaagaaagcttgtgggattcaattgcaaaggaagttcttaattaaggaaaggaacatgttaagatagtaacaggatagtttggacaccagacttgtaaagactttggataaaacttatgatgaaaaaaggaatgtgatgaatagaaacaagtcattctgaaacaacctgcttgtgcaataaaagaaagggagataatcagtgaatgaaagggaataccatatcaggtccaacctcttcaacagctaatatctactctttaatatgttaccccactttacactcagcatgcttataaatagtgcttcttggtatcaattttgcctttccctaaatacctacatattttttacaccatcattttactgaataccaataattaaaacccaggctctactttaacacagttttatgctaagccaatgtgtcactaagtccttttctttctgtaaaatcttttcttcctacctcaacttttcttctccatttctataaccaatgctctagtctaaaattgctttaaatatgtgaaatcttgtaatagtctcataactaagaagcagtattgcaaaatgtttaagaacataaactatgaagtcgaactaacttgggatagaatcttgtctctgacgtttgcatactaagtgcctttggggaagttatttaatgtcttcaattctgtttcttcatttgtagaataaagacttgaataatagtagatgagaaaggctaattactacagatagagagaaagagaaattttctcctttctcttcattaatccactcatatctatttcatcatgttattttctcaaaaaattttagcagatttctatttcatggaaaataaagccaaattcattctttattctactataaagatacatgcacacgtatgtttattgtggcactattcacaatagcaaagacttggaaccagcccaaatgtccatcagtgatagactagataaagaaaatgtggcacatatacactatggaatactatgcagccataaaaaagggtaagttcatgtcctttgccagggatatggatgaagctggaaaccatcattctcagcaaactaacacaggaacagaaaaccaaacaccacacgttctcactcataagtaggagttgaacaatgagaacacatggacacagggatgggaacatcacacaccggggtctgtcaggtggtgggggataggggagggatagcattaggagaaatagctaatgtaggtgacaggtcgatgggtgcaacaaaccaccatggcacgtgtatacctacgtaacaaaactgcacgttctctgcatgcatcccagaacttaaagtataattaaaaaaaaaaaagtttgtaaagcaaataacttggaagacagagatagcgttccccctctaggacagagagcaaatttgaaagctaatgtctccttccaagacaagttttggcaggtttgctagcaacacatttaaaagattgttgttcctaagcttgagattatttagctgtggcacaaacacaatgtgtgtatcccttccacctggattgcttcatatagtgtccattaaacttgggggatgagaaatagcatggacaactggagtcaatggaaaaattaagttcatgctacctgctatatcctgaataataaatttcctgtatatttaacccagaaagtctcaagtgttctgctagcatttatgaaactggggcatactaattgatttatatttattgagtaaaatatcagacccctcacagttattttcaaatttaatatgcaaaattttttcctgtagcaatttaatttataagtaaattttaaaattgtaggtgtataaacaaatttacttcctaaatatttaaatgtaataaaaacacttaggaatataatttttgtatttcaggatgattaaacatgcagtaaaataatgaagtcacatgttgctactggaatcaaaagttcctagtttttgtgatgtcttttataataatgttgtatatgattgtagaaataatactaaaatactacattatcagattttcagcacttttcttctgaaaataatgggctgttacttttgagtcagagaatcagtggtctgtttgcatgtgttggagctgagaaactgatatcccaaaatatggcattttgacatgctgaactgaagaagccttagggtgtctctgactatctttcccaaaggaaaagatctagacccaataaggagaacaatattctttttcttctcttccctgttatcttattatctattgcaaaaaagaagaccaagatgagatcatacctcagtggacctttttatgagtataataacttacaagcataatgacaaggaccatttaaattccaaagaaaactatttacaagttaatctctattccccattcaatcatttttgctagcaattatttattgcccttcaacagaattcctcttcccctttttcccataacctgtcttactagaagaatccaaggccccattgtttctctgtatcctcaaaattaagtttctgtaactcattgggaaggtttggtcttcattctgaaggcttccgtgtatgcatgttaaataaatttgtctgctgttcctcctattaattaatatgcctcatgcctgtgatttttcagaaaacttttagggggccaagcctatggctcccacaaatgcatttcaagtcgtttaactgccatctttcttaccagacaacctacttgtctttataaaatagatttatttggtaataagagttcctatttaaaaaaaaaacttgctttgaatttccagctgtcagagctgtgtaattttatgtgtgcttgtttttatttgagagattatatcctcttaaaaggaaaacaagtaacagagtaatgaagataaaataatctcatttttataaaaagtgtattttatatgtttgcatatttgtatatgagaaacactgcgcagtggtatcatgtgttacctaagaaagaatagaggagtagagggaaatagttgactttccttcatatatctgtgccaatgttattttttcttttggttttgtgctagaaatacaaattgaaaaaaaaattttaatgaaacgtaagtattgaagaaccaatgagataaattaattaaaattatgatagacaccatgatagagtcagtatttatattaataatattttaatacaacagggtgtacattcgtaagtgtgaataacattttgaaatatcttattttttaacataatttttatatttccagtaaattcagccaccaccatacctatttcctattttatataacttgaggcaccttgatgcttcatttttcacaaattgtttccttattgagtgatatgcttttatatttatttaaaactatgcacgtctacaaaaacgcattagttaatttaaatcttgaaaggttgtaggatcatgtatttgtccattttcacactgctataaagaactacctgagactgggtaatttatgaagaaaagatatttaattgactcagttccacagacttaacaggaagcatgactgggaggcctcaggaaacttacaatcatggtagaaggcaaagaggaagcaagaaccttctttacatggtggcaggagagagagagcaaagtgggaagtgctacatacttttaaaccatcagatctcatgagaattcactcattatcacaggaacagcaagggggaaatttgcccccatgatccagtcacctcccaccacgcccctccttcaattcaacatgagatttgggtggggacataaatccagaccatatcagatcccttatgttttgtttctgttatagtataaaattgaaatccgattatgtgaattcgttgggatgctttatttaacaacacttaattatttttcaagggctaatattaagattttgttatccaatggaataacatatactttataatttttcatcagctgtattacaaaaaaaggaatccttattactttaatttacttgacacttgaatttgtattttcttccttttatactttatatttcattttacatactaaattctaattcttatagttttaattttttcttatatatgcaacatatttttgaataaatgttaaacatacattttaaattaacccattttccattctaaatgtacattgctcatttctctcttctgttacatagcattgcgattttttaaaaatctgctcatatcttctctttcatagaagctagcttccatgacaaagttttcccattcatttattcattcattcaaaaccacttatttagccctttattgtacgcctaaccctctctcagtttcttgggctatattatttatatctctgtaagtgaaagaataacacacaacttaaacttctttggaggcctattgccccacagtagtataagtataagaatgagtgtgatgtttttgccagaaaagaagtatagaagagatgctggctatataataaatttttattttataggtggggttagaaaggaggaaaagaaataagattgaggttgattattgtcatcagaaattttaatttcagtaaagaaaacagtgcagttatttataatgaaatattatcaaaatattattttgcatatttaaatttagattattctagcaattgtttatattttgaaatgacttacatttcatgcatactgttctgtacctatagatggcattaatatcactatattaaaaaagtatacttgatatttggcctggtggtttttgacagtgtaattataggaattttagttatttgtttctcatgtcaaatctagcagattcaataaaaaatacaatgattctctgtttatctgagttatatataatcataataaagttttataataggatccctcatatcagctgctctctttaaattatcctcctggtttgatgaagtaaaagatagatttttattaaaaaatttctgtagcacattttgtggtgtgttttgtgagatgacagtaacagtctagtgttttcatggcttttgatagttatttattgcatggtaaaagagaactttgggaagttttaaattatcttttctttcagattgaaacaaaacactattttctaacctgttatctctcatttccacctatgaaggcaacactttctggctctcttactcactggctcttgctctctttctctctcttacatttggagtcaaaactctgagaatgagtaagatctttttgatacagatctggtctgacctagatctttccttatagttttcaatttattgttttcacatgtcctagtttgggtagtattgagaggatccctaaaattttgatggatgcaaaaatatagctttagtaaacatgtatgtgtgcatttactcagaatttaaatgaaaatggagaatagaaaggattaaatactcgggtccaaatagagatattgttaatcttatattatctgacaaacttaaacaatttttaaaatagtatgccctaaattcatgaaaatcaaaggtataggagagtaaaaatcctcagaatacgtgtggcaagatattctaagaggctttgcacagttataatattcttggctttttcttttactaacatgctgcttctccaagtagagaataatttaatttctttcattctcttctacccttacattgttttgatcacctcttcacttcatctttcagagaaagaaaaagatattcatttgtttgacaggttgacattaaaaatctctttttaaaagtttttaaaaattgttgttaacaattaatatttttgaaacccattggacagtctaaatgctctcaataaaagatctttatttccatgttttctcctttgtgtcctgcaagtttctgaggaaggtgtgttaaaaccttcgaatatgactatgaatttttctatttatctattatgactatgaatttttctatttatctcttttattctgtcaattttttaatatatcttgaaaatatattattggatgtattagcccttttataattatgattttttatttttaataaatattctggtgttaatcctacatagtctaatattagtattgcttgtgctagtttctgttggttagtatttgtgcgatatctattttccattcttttatttttgtttttctgcatttgctcatttttatatgtctctagtgacagcatatagttggcttttatggtaaaattcagatttaaaaatcctttttatcttttaattggagtctggatcatatttgtatttaatgtaactactgatatatttgaatttaaatgtatgtttttaattttgttttctatttgtccctcttgttctatgttcctttttgtatctccttgaaataattattttctaattattctatttcctcttattactttgttagttatgcaatttaaataaactattcttttagtggttatgatagagatatcaatgtatatctttgacctggagaaagcctaatttaaatgaacacatgtaattttctgtgtaatgttaggacattaaaatactttatttatctctcatttacatcttcagttatgtatttaattcaacagatatgtgatcatatgcatcatgacctcaatatttattaagatttacctaaatatatgccattttatttgaactttatacatttctacatacagtcatctatctgggattattgtcttaatttctgaagaacttccttaatatttattttagtatgggtgtgctgatgatgaattccctctctctctgtctccctttcattcttttttccttaaaaagccacctatatcagtttcatcttaaaacatattttaactaaataaaaaaatctgtttgcagttatttttattttcaatgctttcattttctggctttattcaaaagagattttgttttttggaagctgatgtgtcttttctctggcgtcttttaacctttttctttggctttttgtagtttgagctacctttacatagaattttatttgtttgctgtttatgttatttacatctgtggctagtttttaaacaatctgatccagtatcttttcaaatgttgcttctgcatagttcttctgttttttacttctgggactccaattgcatatattttgatgttacaccgtataccgtgtcattaagctttttcctgtatttttgttgttttttgtttccatgtttcaatcagagaattttatctgaccttcattatgcttcactaattttctcttcatctgtattaaatgcactgttaaagccatctaataagatttaaatttcaattatcatatgttttagtccatttgattttacatcacagttttcaattctctgctgaaatttttcatcttgtcatgtaatttcttgaacacattaattacaattatgttaagactatgttataactctatatgtggagccagtcacagtggctcacacctgtaatcccagcactttgggaggcccaggagggtggattgcttgaggccagaagttcaagaccaaccttgccaacatggcaaaccccatctctactaaaattacaaaagttagctgggcatggtggtgcatacttgtaatctcagctatgtcaggagactgaggcatgagaattgcttgaacccaggaggcggaggttgcaatgagctgaggtcataccacggcactccagcttgggtgacagagtgagactctgtctcgaaaataaaaacaacaaacaacaaaaaaactctctatgtagatctcctttggttctgtttatattttctggctttttcctttttatttatgtatttatttgattccatctccttgtacacctgataatgtttaattaaataataggagtaatttgaggctctaacattattaactttctgcagaaaggatttacttttgcaggcaattaagttctaaacattacatcttaatccaatcaggaattaaagtgattccaagatggacgtcagtcattgggaacctagtgggattaccaatggaaagaaaaccaggagtttccccaggaactcctctccctgggagacctgaattccaatgtcttcttctcaactcagttacactagtgacggccctgcttaagacctgtcattctcaaccactgctttctgctcaacttctcagattttgctgtcaatttgacaaatgaccccaaggataaaagtgacaccaaatgttacatttgcctttgtgggtttccccctgaaatcatgacgttttaggtctttgacttttcagagtaaaccatacttatgcatgtaattctctattactcccctctaggaataacttaaaaagatatagtaactcagattacagctgtgcgtgtaaagaatcaataaacatttaaatatattcacaatggatgttttctttatgaagaatgtaatttagtatgggaccattgaatttgcttttccaaagcatttcacaaactaaatatcttagaatatgtggtgacatctgtagttatatagtttaagtaacttgaaaccaaatagccatattaaagagatctcagtgtatgtactgtatacacacacatgtgatattttcttcccgttttcttgcctctctaggtagttttagaaataacaaaaagtggtgtgtgcagttcatccttgtaaatttgattttcacaacaaccaatgatatgagagggctttttttttttttttgagaactgcccttaataatgaagatctactcctaaattaatgttacaatgggactcgttgactcacatcagttttctaaattgattccaaggtaaaaatttctgggagatcattctcttgattctgctaccctctgaagaaagcaacaaataattaggcaattaacaagttgctttcatgcttgccctagtgttttgttaagagctccagttctggataggctctttgaatatgaattatacttctagcacctagcagtttggtaacccagaaaaagtgacttttccctcttagtggataagaattgtacttcataaatttagaggatttaatgagaaataaatgtaaagagcagattagtcatccccccaaaattgtattattattttttcatcatcatgatcatcattacaaccaccaccaacatcaccactgctaccatacttccaaaccatgtattgtgggctccaaaagttattattataacatttttatcattgtgactatgagtctgatttcaatagctagctatatttttaaccaacattgcataatgaatattacctagatagccttcttttcttagtaattgcatttccattatcactctatatagcatttaaacttttaaaaagctgcctgtgtttttataagttaaatatataatattaactatttagttgtgctatcctgaagagttaaaaagtatttgcttgggattctgactggtgtaagatatcccattgtggctttaatttacatttatctcatgaatgatgaacattttttcatatgctagattgccacatgtatgttttcttttgaaaaatgcttatttgtgtcatttgcacactttttagtgaggttttttgttgttgttgagttctttgagttccttagtcttcaaaagtaaaaaaaaaaaaccttaaatagatgttaatgaagattcagaaaaaggggaacacttatacactgttggtggaaatgttcagttagtacaatctctataggaaacagtatggcaatttctcaaagaaataagtatataactaccatttgatctaaccatttcacactgggtatctacccaaaggaaaagaaatcattatatcaaaaagatacctgcactcacatctttatcacagcactattcactatagtaaagatatgaaatcaacctaagtgtccatcgtcgatggacaaatgtgtaaagaaaatgatatctatgcatcatggaatactacatagccataaaaagaaggaaatcatgtattttgcagcaacatggatggaactagaagccattatccttaatgaaacaacttagtaacagaaagtcaaatactgcatcttaaaatttttgggaatattaatgaaaatgtgtcataacatttcaaattgatatatgatattcttcaagttatgtcttatctaatatttatatagccatataattcataaaagctgtgtaagccataaaatcatatatgccaattttgttggttctgttaaacaggaaaataagggcaacattattatgttttgatttaaatttgcaggatttatgataagaaaaattattgtttgttattgctaacctttttctaaaatagatattaaatacattttaaaatagagtcacaaagctttgaaccaaagtagaaatggtggaggaaccttgtactttacagatgggctgccagctaattgcaccttttgcgtaatggctatatatttgatggatttcgcaatcttagaatgcttccaatttttatttgcaaagtagcatattaataattgccttgcaattttgagatgaagagtaaataatataaatttttataagacacttggcacatagtgctcaataaaggtaaaaggtgttattgttgctatagtttcctggaataaataactgctgtacagtgtttctcatggtgcttgcaataaaggaagcaacattcgcttggttgtctggattctgaaatactgcatctctgaaattcattcatattatgcaaatagtgtgataaacatttttattcctctattcctgcctttctcaaactccaaattataacttacctacagaatcccctgtattgaggttggtttttaactgtgcttttaatttattctgtagtttttaaaactgctttagtatttacaatagttggcagtcatgaaggtagtaaattatgacctttattcgttatcataagaaccccagtttgaacagagattgcacatgactttattgtccttctgtgcttcaggagtgtgcagttgcttttctgaaactccaagggagaatttgtgagtgtatttatatatatgctactagaaaagtaattgaagaatagaatagaagaagcaatgtaaaggcttcttagaaaacattaaactagtagagattattcagcctgaagaatagaaggctgaagcgcaatatgcagcgaaatgtttaactatagtgtgagatgatttatgttaactataaaggagaacctccctgggctgaatgatagttattagaccatggtacagattagagaaagagtttatggaataactccaaaatttcctaaaatatcagagtgtcctacttaaatcgtatgctattggtcttactgaaaactataaaaatgcagagattttatacactgtttttgttctttaaaaaaacccagtgtttagtaacatgaaattaaagaaataatggaacacaattccacaagtatcagaaaatgtgctaccttgttgagtaaattgaaaaaggcaggcattacttccattctgcttaagaaaaaaaaaaaatttattttaggtctgctgtgtgatagttgacaagcagtaaggactggcttgtttgtcctataccactctttgtttctttctttcttttttttttttttttgagacttagtctcactctttcacccaggctggagtgcagcagcacagtcttggctcattgcaacctccgcctcccaggttcacgtgattctcctgcctcagcctcccaagtagctgggactacaggcgctcgccaccatgcccagctaattttttgtatttttagtacaaatgggtttcaccgtgttagccagggtggtctccatctcctgacctcgtgatccgcccacctggggctcccaaagtgctgggattacaggcctgagccaccatgcctggccgtcctatactactcttttatgggaaaaagtagctcaactgggtgtgaaaacattaatgttctgatatagggtctgctacttatactatattatatggaataatatactatattatatggaataagtcattttaattttctgcatctttttttactcactatgctaattgatctctaaaattttcaaattataatgttctgtgagtaaataaaataatgaaaagtaaatgttttttagtctcatatactaaggcacatttaatgcacctcccagtctttaacatgcattctgattggattatttattcatttggggaaatcttatacattgtacaatatcttaactaaatttgatttgcattttcatgtagctaggatatgtaatttaggaaacaatataaattataaataattaaaacctatttttgataaagagggtgttaatgtaagctagtgatcctagtaagttttttcattacgctcttgtcttttgtttctggtactctacaaatttcaagtcatacattaaagtgggatctctgtatctgattcaggtcctgctatgtcataatccaatgatgtctcttaaatcatattttctttccttggcagttttattattatcactgcttagaaatactgaggcaacaaaatcatatttctaatatcttaaaggatggaatattatttcataaagtgagattacctaattgcttgttatgtttttgttctctataatgagagaggaaattaagataatcaccttgagttgattttctgatttttatcaggaagataaaataacttccctgtgctttttcatatgcaatattttgatagtaaaataatggtttactgtttgaaacctagaggaaagagaaaagaaaataataataaattgtgttaatccacacttggaaattttctataccttgtaaacatttatttcttacaattttctattaaagtagatattaacatcttcacttttttgatgaaaaaactgagattcaatcaggtttattagtttgtctaagaacccagtcaacaagtgaaacctggatgcctgctcagttccaaagctcggagtgtttctagtacaccagatattctggctacacacaagaaacaaatgggaaccttaaaaataccaatgaattcaatgttcaagatcaattgagaaccactaaagtatatcgtttatgttcttgagacaaggtcttgcttgctttgtcacccagctagaatgcagtggcacaatcatagctcactgcaagcttaaaccctgggttcaagcaatactgtgggcctcccaaagtgctgggattacaggtgcgactaccacacccagcctatactttattattcttcacaattttttcaaatatttattttacaatattttagtgaaaaataagtcaaatctaaaacatatgtttgccagttatgttatttcccattgcaatattgtagatgaacagatggttagctattagttccatctgtatgaccaaaatagagagtaattgtgtgttattgttacttataggttcacttgtcaaggatgagtgtttccaattctacaaataaaaattgtattattttctagttgtatgaaagtgaagctaatgcttaagaatgtaagttacctgtttgctactaccatttaaaagataaaaattggtttttcagtttggagatacttttaaaaaaatctctatttagttaataagaaattctatacaaaaaaaatctctacttagtttacaagatattttatacaaataactgttttggcacattcatgtatgagaccggcttttaagagtcaaaggattaatttgaaatattgatggtatgagtatgatagaaatttcataatagaaatattacaaaatggataaaatgttttctatgtgcttcgttatttactaatacattgacttctcatttcattacacatttccagctagatggcaagcaattcaaaatgggacttaatgtaatgatataattttgtgatttgtgtgtctcctttaaactttcaatcatagattaaattttaatttgttaatgtgttctcacaggataaacaaggcacaaattcctactatatactaacggaaaagggagttttttttgtcaaaagcattaaagcaatttgttaatagaattcatcagcattgtatttttctaccttaacatactaccttgtggttcacattaatagttataataattataaaataatttcataaatttagatacttgggtaattgacaaatatctatttacaaagctggtttagaaatagaaactaattggccaggcacggtagctcacgcctgtaatcccagcactttgtgaggccaaggcgggtggatcacctgaggtcaggagttccagaccagcctgaccaacatggagaaaccccatctctactaaaaacacaaaattagcctggaatggtggcacatgcctgtaatcccagtgactcgggaggctgaggcaggagaattgcttgaagccaggaggcagagattgtggtgagccgagatcacaccattgcactccagcctgggcaataagaatgaaactctgtctcaaataattaagaaaataaataaatgaaaccaaaataaatttttggcgtaaagtagacgcttttattgaattttagttctgtggaaaagtagatgtttgcgaagattactatattaaacatttaatcctgaaaaattcaagtccttgtttagtgaacttatttttccattacttttggctttctattacattattatccagtacaattttagtgagtatctagtaagtttaaggattatattaggtggtaggatatagtatatctatagtaggggtccttgctataacagaagagcagggaagaaaaacattaaacaaatacttataagtgttgtatgtcatgtattttctgcgctttgtgacatatggctgtaatttcgaggtagggagaggttctaaggactgaaacatatgctgagatttttttttcttttttttttttgagacggagtcttgctgtcgcccaggctggagtgcagtggcgtgatctcggctcactgcaggctccgcccccagagttcacgccattctcctgcctcagcctcctgagtagctgggactacaggcacccgccacctcgcccggctaattttttgtatttttagtagagatgaggtttcactgtgttagccaggatggtctcgatctcctgacctcgtgatccacccgcctcggcctcccaaagtgctgggattacaggtataagccagcgcctccggccatatgctgagatttgaggggtaaaggaagtatatttccagctgagggaaatgctaatctgaaggcactgaggcaagagtttacaaagcagtggggtattagtttgttattgctgctgtaacaaattaccacaaacccagaaactgaaaataacacaaacttattatctcacagttaaatagatctgaagtttagatgtgggaggtttctctggtgcaaatctcaaagggcagtcttcaaggtgttggcagtttgggctcttatgtggaccttctgacagtgggaggtgtgggaaaagggactctgtttccatgctcattcaggttgttggcataattcatttccttgttgctgttggctgacttccccatttccttacaggcctggagcctctgtcatattcttaaggtcttctgcattccttgtcacatgcccccctcaatcttcaaaccggcagttgtgcatggagtctttttcacctatcatatctgcctgacatcccccctctgccacatcacttctgactctccttttcatacgttagatgcaaaaaaaactttgctcttcaaagtttatatgattatattaagtctacacaggggattctggataatctattttaaagttaactgattagtaatttgaattactaatttaaatcttgattactaagtcctttttgccatgttatgttacatagtcacaggcttgacaccatgggcataaattatggggctaaaattctgcctaccatggtggttgaattttactgcacatgaagaggtcagtgaactgagtggctaacttgctttttagcctgtatattttggcattaatcagccaaaaatggttgtggtgaagagataaactaaagtcaatgacatatctctagcaatacctaaaggttggcaattagtagacacaggatgagtagaggatgataccagcatgagcctcacagattgggggaatactgcaggctatggagtggtgataattaggaaaatgcaccagattgccctatcacgtgctgaagaaaaagctatcttcaactgacagaactcagtggaatcctggcactttggagagagccaattttcaccaagtcaaaaattgaactgagtagtcattcaaagagttcatactgttgagaagtttgttaaaaattttccaagagtaaagtagaaaattttgtgggggagaggaggaatcagggaaatgtatcaggagaaacaacacaaagaacattatgggcatgggagcgtcagacagagatggcagagagtggtgaaaggcaaagtgaattgagtatggatttacaaagaaaataataactctaataatctcttggaaatggatatatttctttcactagttatcaagaggtctgcaaagaaagtcaagttgttgaaaactgcatggtctttggaagagagtggtagagttaacaccgaatcgacttcaggttctgtgaagtctggagcatgtaaggtccaagtcagccatttgtttctgagagtcagtacaccatagtggttaggaatacagcctgtggcacaagggctcatgggttccaatcctgtccttctgactttgaacaattcatttaaactttctgtgcttcagattcctcagctgcacagtggaaataatgacattagtggccatttcattgtgtcattgtgaagattaaatgagtacatggctcattgttaagtgttagctactattattattattatactttaagttctgggatacatgtgcagaacattcaggtttgttacctaggtatacctgtgccatggcggtttgctgcacccatcaacccatcatatacattagacatttcttctaatgctatccctccccagccccccactccctgacaggccccggtgggtgatgttcccctccctgtgtccatgtgttctcattgttcaactcccacttacgagtgagagcatgaagtgtttggttttctgttcctgtgttagtttgctgagaatgatggtttccagcttcatccatgtccctgcaaagaacatgaacccatactctttcatggttgcatagtatcccatggtgtatatgtgccacgttttctttatccagtctatcattgatgggcatttaggttggttccaagtctttggtgttgtgaattattaataatattgtgttagctattattattaatggtcattgctatgattttttacctacttaccaaagatttcaatattacactctatgcaagacaaataaacagtttttagactgaaaatctatgctaaacttaataattttgtgtatgtcatttggttcaataatgctacttaagaaacacagtattaacctcatagagttaggtattattgcttgtgtgtgatggtggagctgtgtcaaaatagttgttgggaaaataggttatggtttaagtgattttggtagatctaaagatgccaatcctggtaatgtaaacttgcctgttggattactttttctttaataaaaacagccataatcttctagaagcagtgttcttgagaaatgtatctgtcgctaaaaacagaggaggtcaaatgatttttctaggtatagtagtcacagtaaatatctactgtcacatgtagggaagcagcagaaatatactgtggcttctgttattggaaaactgtctgtatcttttctagctgtctcctccaagcatccttcaatggggaattaaccttgtacaattaaatttgcagcagagtaaaaactttttaagaaaaagagccatcttttaaaatattagcctgttgccatttagttcaaattacgcgattgataattcaaaaccacttacatgctcatttttatgctatgtgaattgaatgtcataaaattcatttattatgaacaaaatattcaaaatgcatcagagtattatatgctgagctttgataagagaaaaaagaatgatttgacaaggatatgaaaaatcatataccaggtatatgaggttaaatgtattttcaaatgcttcttgattacaatagttaaatattccttgagagattttactatatgaatttatttcagatttcaagtagtcatttggaaattgttattttgggaattttttagatcaactttttctaatcacaactagaaaattaatactatcactttggcataatttgattgggactgctggttatttaaaacaattgatgtgtataagaaacttttaaaattattttaggaaatgtaaaaaagtatttgatttagtttctgcctccaggtactaatacagtaaggggatgaatcatgtacacatataattattgcacaaggtataatataataagggccataagagaaatgcaaagcaaatgaagtccaagaagagagagattaccagaagcttggcaatcaaaactctgttttcatatttcagatagacaatggaaatattaagtggaaaagtagggtatggaatatataatatagtgaactccaataatgaatattttagaaacacacagatacaaatagaaaatattggaaggaaatgactaaaggtataatgagtggtcatctccttctttctcttctgcttcttttgaatttctcaaattttctacaataattgcatttttctcttaaaataaaaacttattaaaatatatggtctcatattaatctaaaatctagagctatgagacaagagaagaaaatgaggaaatttctaagaatatgttcaagtgtaaattttaaaacctgtttataggaaagaagacaaacaccatagtaggtctataaggatggttggactgctttaatactctatagaatccctcctgtagtttatagagagtctctgtaaagaaagttatctatttgctattttaaagtaaacattatttagagaatatataccacattatgcttgataagtttggttatgttataacttggtagaggaaggtatcgtttaggggagggaataaaagcaactaacaattgagtcgaacttttgataagttttaggagtcgttgactaaaggttggtgtgaatgaatcatgtcaccttcatttgagttctctcttcaacctttttagtagaagaaaaaaatgtgaaggagaggaaatatgcttgtagatataagttatattaagtattaatactcatgcacttacatgcttttaatataagttcaatgagaaaaaagagctctaaaatatttgtcaaactttttttaaatgaggatctttgcttattgttgcagattaataatatggcttttttgaaggatatttgccaaaatgtctaaaatgcttttagattggattatcttagagcatgtaaacaaatacagtgatacagtaatagggctatgagaaaaatcattcatgaatgaacctattccacaattatgatctctagcttgcacatgataacattttcatgtcatgtcttaatttaagaagattctcattgtttatgcaaaagcagctagtagagttcttttaatgagatggaatctattaaagtctcgaattgaatactaaagatgccaagtttaagaaaatgttcacattattgcttactgttctttgtgaattttctcactcatacgttgtatctcaggttgggatccctagaagcagacgttgagacaggatttcagttgcccatatttattgacggtattttctcaagataaagggagtgagggaagtgagaaagttcaggggaattcactaaagcaagaaggtggttttcactgcagtctagattcagccatatctcatggggataagaaggagcatgacttttaccatataattgtccccaccttgaggcaaaggggctggcattttgtacctccatgtattctttatcgatgttggaaaagcaggttagcaatctgttaggggaaagaacttctggtaggcaaagggaaattctccaaagaagggggcaactatgaactatcagcagccaacactcacagcagctggatcaaataaagagagtgtggccagaacacttaaactgttcagtagatattattggttaatcaagaccatagacatatttaatttaatttcacaatgttcaatcattaaactgtcactgagtacctgttagctactgaaaagtaatagtgaactattattaatatatttaaaaaaaatacatgccctcctcctttatccaggaagaggtcaaaatctctgggggcaagagtcaagtataccaatacagtcataccttagagatactgagaatttggttccagatgccacagcaaagcaaatatcttaataaagtgagttacacacaatgtttggtttcccagtacatgtaaaaattatgtttatagtatgctgcagcctattaagtctgttataaaattatgtctaagaaaccatgtacatatcttaattaaaaatactttattgctaaagagttctaatggtcacctgagcctaaacagagtcataatctttttactgatggagagtcttgccttgatgttgatggctgctgataagggtgatggctactgaaggttgcgatggctgtgacaatttcttaaaataggataatgaagtgtgccacattaattgactcttccattcataaaagatttctctgtagcacgtgatgctgtttggtagcattttacccagagtagaactttgaaaattagagtccatcctctcaaactctgctgctgctttatcaactaagtttatgtcatattccaaaacttttcttgtcctttcaacagtgttcacagcatcttcagcagaagtagatttcctcccaaggaaacactttttctgctcatctgtaagaagcaactcctcatctattcaagttttatcatgatattacagaaattcagtcacatctaattctggttcttttgttatatttccatcacatctgctgttacttcctctcctgaagtctttgaagtcttgaacctttcaaagtcatttatgagggttggaatccaaactcctgttaatgttgatattttgacttcctcccatgaattaagaatgttcttagtggcatctaaaatgctgaatcctttccagaaggtttttaatttattttgcctagattcatcagaggaatcactatctatgagagctatggccttaggaaatgtatttttaaaataataactcttgaaaatcaaaattccttcttgatccatgggctgcagaagatatgttgtattagaagacataaaaacaacattaatctgcttgtccatctccatcagagagtcttagataactagatgcattgttcaacacgtagtaatattttgaaaggaatcttattttctaaggagtaggtctcaacagtgggcttaaagaatattcagtgagccatgtcattaaacagatatgttgttatccatgctttgttgtttcattaattgagcatgggcagagtagatttagcataattcttaaggaccctagaactttaagaagggtaaatgagcattggcttcaacttaaaatcctcagctgtgttagcctccaagagagtcagcctgtccttggaagctttgaagccagcccttgacttctcctccagaaaatctgttatttagcatagccacctttatcaattatcttagctagatcttctggataacttgctgcagcatcttcatcaacacttactgcttcacctttcacttttatgttatggcttctttccttaaacatcatgaatcaacctttgctagcttccagtttttcttctgcagtttcctcacttcttttagccttcatagaattgaagagattaagggccttgttgtggattaggccttggtttaagggaatgttatggctggtttgatcttctattgagatcacaactttttctgcaccagcaataaggctgtttcactttcttattatttatgcattcactagagtagtacttttaatttccttcaggaatgttttctttgctttcacaacttggctattttgtgcaagagacctagcttttggcttgtctcagttttagacatgacttcctcactgagctaaatcatttgtagcatttaatttagggtgagagaaattgtaactcttcctttcacttgaacacttagacgccattgtagcatgattaattggcataatttaaatattgttgtgtttcaggaaatagggagatccaacgagatggtcagagactagagaatgaccaatcagtggaggaatcagacacacacaatatttatcaattaagtttgccattttatgtggctgtggtgtgtggtacaccaaaaaaattacagtagtaaagtaacatcaaagatcactgaccacgtatcatcgtaacagatataataataattttaaaactttgaaatattatgagaattaccaaaatgtgacacagaaacacaaaagtgagcataagttattggaaaaatggccccaatagatttgctggaaacagggttgccacaaaccttcaatttgtaaaaagcacaataaagtgatgcaaataaaatgaggtacaattgtatttatgtacaatgagttatgtactaaaacaatattcaatattcaactattatggaacagagaaaggctcaactattagtgccattatttatatatatcttaaggtatgctatttgagcttgaaaattatgtttaaacttaaacttttaagtgtcccttctctgggaaattcacctgtatagaatatcttacttctatggaatgctgtataaactttgtgtactcacatacctgtgcatataaagcacatcccatttgttgggcggccacttatccccaaacttaaaataagtaaaacataatgtggatcaatagtatttgaaaacaataaaataactcctgccagtcacaatgaagggcagaaaatactgtgccagttgaggcacatggatccttctgctaggtaaatataattaaaaacaaaatactctcccaacctagaaatcctctccacaaaggtagcaggtaaagaacacatctgtattattgagtaagagttaaaccagaatgtggtgaacatcataggcaaatctcttcactaaaagattgcaaaaacagcaactttgctcttttatgtagtcaagcagatacaacccattatacatacgtttttaagatacataacatctagtcctcaaataaaaaggacttagtaccacttgtcaggcatagttcattataaatttagccagtaattggggtgaccatctatgttaactaattggtgttatccagaggagaaacaaacttcttatatccttatgacagaaggcagtttttgagttaggtcctaccttcccacagaagctgggagatatggatgctaactctcttgatgttgacatttcaaggagatgatgtgcaagcccttaagacattcctaggtcataagactgacaaaaggcctatttagctttgtaaaggatttatatatgttttaaaggaggagaaagtacttagtattacaagctttctaagaaaatggagaggagggaaatctgtttttttcaatagagagaattatgcttcatattttaaatttttctttgtccttgcactacttatgatgggattctttaggccccagaggaatcatttactcttatttctgacccagttatatagtttgaaatcccacagcagattgtaccttatctgagagcaggcatcttattggagacagagatgctgactctagcatgatgaagggacagttgtcaagtctgacactgagagaagcgacaatacttacaaaaagcagatggagaagtgtaaaagaggggaggagagagagtaggatgaaatggacagtcattcggcttttctaatgggaagaaacaatcctgccacttaggtgactcctgacggcattgttttattaccaaacaaaaattaaaattgacctttaaaaatatatatacatatatatttatgttcactaaaaaattatttaatacattcaatccacagatagtctctaggttgtttgaggtcacattcctgttatgtttaaggatcttcactgatgccctttgacaatgtctctttcaggcttctctcctttttttatagcatgtaagaaaatgtgcacattttctgcacatgagtggtactggtttttataagtattacaggaggggaacacattgttgagttcattggtgatttcacccccaagaaacaaagaccctcctgacccaggaggaaagtagagcagttgcattttataatgaaaatattattgtgtcacattattatgactatttttcagtgggtgattcagtaaatgcagcatatgcttagtaaatatggatgcacagtgtctgaaaccagactgccagggttcaaatcacagcatggccatttactatcatcattgtgaccttgaacaagttacctcatcctttctcatttcattttcgtcattgatgaatagtgattattaatagtgctttacctcataagactgtgacgaggataaaaggagttttcagagagacagaaaaagtgaaagagaagatctgtcaaaatagtcaataaatatcaactattatttataaacaattacttacagttgcaaggcttatttcaatctagaaataatatgtgctttaagagaaaatgcatgtttttttaatcacatgtagagagtgtgctttgtaaggatgcaagaaaaaaatattctatattactatatgtctagtaaatgtgtattgtacagctagttatagctgagtttattttgtggattcacaaaatattagtttgaaatcaaattggtattttttgtattttaagtatgttgaactcaattttatgatttctaatgttagtgtatatcttatgggtagaccaatttttttttgcctgtactgacatattttgatgttgatgtatttgaaaactttgttaacacacatgatctaaaatttatatagtatgtgtgtttttatcttttttttttttttttttttttttggcttgggttggtggtttttttttttttttttttatgtgtttttttttttttttttttttttttttttttattatactctaagttttagggtacatgtgcacattgtgcaggttagttacatatgtatacatgtgccatgcttgtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcaatttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgacttcttaatgattgccattctaaccggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcaaaaattttctcccatgttgtaggttgcctgttcactctgatggtagtttcttttgctgtgcagaagctctttagtttaattagatcccatttgtcaattttgtcttttgttgccattgcttttggtgttttggacatgaagtgcttgcccacgcctatgtcctgaatggtaatgcctaggttttcttctagggtttttatggttttaggtttaacatttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgtttttgtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttatttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtcgattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtgactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttgtcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatttcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggagtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctccgagccaggtgtgggatatagtctcgtggtgcgccgtttcttaagccggtctgaaaagcgcaatattcgggtgggagtgacccgattttccaggtgcgtccgtcacccctttctttgactcgaaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcaccgtcttctgcgtcgctcacgctgggagctgtagaccggagctgttcctattcggccatcttggctcctccctcgtgtttttatcttataccatgtggtaacacatgtttatttgtggactgatttaagaattgataattatacagtcttcacagaactcagaaaaatggtaaatttttacattcatattgggtgtttaccaccttgggaaatataacaaaaggaagaaatatctaatgtttttgattttctagtattgccgtaagaaaacaaaaataattctctacttgtccactatttctggtcccagactgaaagaaaaaaaaataacttttttttttatgtttctatattttgctaaactacaagtgcttgctgttgagcaagtgtgaagcaagctttctcctaccacttttgatgtcctaaattatgtctttactctgatttggcaaacatggtgtaggtaaatcatcttggagagttcttcctagaatgagtttacaaacaaatccactttatacttataaattataataattccgcttatattgattcatcatgaattgtgctcataccctattaaaaaaaaagaaaaaaaaagacactcattagacttaaaatttattagtggcttaattagatccttttcagatcatttttaaaattttgtgtaaaatgataagaaggcactttttaccagatatagtatatcatggcctggtgaatgctttccttttccccatgtcttaatattttatagatttatttctccaaaggacctgtattagttaagttcaggtggattatgtcaataacatattaacacaaaatctcagtggtttcatataacaaaagtttacttaccttttatttttttttctaaaatatcaattatggagccagggctctgttccgtaaagtcattcagggtctcataactccactaaccaaggataatgggaaaacaatctttcctgtgccttgacagaaaaaagaagtgcttcttgttgtgcactaataatatctaccaagatccatgtggctcttttgtccttgaacatatataatagtttgtgtaaattctcagaatttggtgaatacatgggtgttactgtataaactcagatttattaatcactaaatagctctaaatttgtaaataaatttaattcttaaattttaaaagaattttaattaatgtttttacattgacagaaaaagataatctttctcaggttatttttggacatgaaatggcaataaatgactgcattgcctactggcaatgggtgaaaaacatgattgaaagcctaaagaacaagtgccatttttatcctgtgaacagccatgcaaccaaactgcagcaagcaacatactgatatttctgaagagtctcctggaaatttgccaggaagaaaagatgagagattaagaagcagagtacgaagatgaaataattatttattctatttattaaatgtaaaaactttccctttaagttgcaataagaaataaaataagctacttgagaaagaagaatcttactgtattgactttagacatagagagaatcttaaagtgcttctatgaaaaaatacactcatatctaagatatgtagaaagaaattatgcccctttctcttctagtcattgtaaatatcctgtcttaaagagctcaagctattttgctactaacagcaatcatattactcttaagttaatccatcttatataccctctataaatcataatctagttaaatacatagcaaaaatggtgaattggctctccttaacctgagtcattttaagttgtacttttaaaaaatcttaccaattgctaaaaagcttaattatgaaaagaacttgcaaaagaaattaatgactttgtaaaacgaaaatggctttaaaatagacaagctctaattaaattgatttggacccaacatctttttattcaacaaacatatgtatttaaaacaattttctgctgtaatgattaattataattttatttttaaactgacaaaaagaaaatagcatacctatttaaatcaagaaaaggtagtttttctttaaaatggagatttttagttttgctaaatttaaaaaaaaagataatgtctcaagtagtaaactaatgagggattgtatgtctgacaatagtctaaaattgtcttttgagccatgtttccttgactgaaagaggaatggaacaaaataattatcttttttttcaatcttctcctctaacatatttctaagccttcagaggttaatagcaattatacaaaagatgccttcccatggcttcaagcctgtcatgttttgttttgtttgtactctagagaatgctctgaggttgattgagttgtgttttgaattaacggcctcacatcacctttcaaaatttgaaacattcttatgacattgtcaaaattagaaaagttgttatcatagttacagttttatgcaataacagattgtgtctattttgtttcactttattttgggatatactaatttgcttcaaaaaattgtatctaggaaataatgagcaatagaatcagagagaattaggtttgaaatataagttttatttaacttctttgagatgtaattatcttatttctaaaatgagattataaatatccatatcttctgaggatcaaatggcataactagtatagtgtctgccatattatatccaattaaaaaataacatgctattcattatttttgtccttactgtttaagccttgtgtttaagtttatgagtacttagaaggaatttttaaatgcctatgatttatttacactttatgctttaaattatgcttgtgaattatttatagaatttttctacaaatactgagccaggaagcatataacattttaatggaaacatagaaagcaataaaaaggttagagttattcattaatataattagttgtataagagtaataagcatatggttgttgatatggtttggctgtgtccccacctaaatctcaccttgaattcccacctgttgtgggaaggacctggtgggggataattgaatcatgggggcagatatttcccacactgttctcgtgatagtgagtaagtttcacaagatcgatggttattataagcggtggggcgggggtggactcttgcacaagctgtctctttgccaggtgccatccatgttaggcgtgacttgctcctccttgccttccgccatgattgtgaggcctttccagccacatggaactgtaagtccattaatccctttttcctgtataaattacccagtctcgggtatgtctttatcagcagtgtgaaaatggactaaatatttgaaatttggacacaattccactcactaataatctactatatagcataggatgttttgatctgcaagtcacagaaaacctcaacttctagggtagtcctgagttagaatgagcttcaggcatataacaatctgtggctagtcatatcatctagaactcaggctctttccaatattctgccttctgtttgctggtgatcacatcaacttcaggctagaacaagatggcagcagtgtttccaagcaacacttccagactcagccatatcaaagaaaaagaggaactgccactctgttttcttcttggaatcaaggaaattttcctgtgaccctggtagatttttcagaattatccaattcctacaaaatatactagaaagcaaaaattattactaatttaaggatgtaatggatattattagagtgccaatcaaagacaccatataggtcacacttttaggtacccagcatataaacacacattctttccacccataggcatttaaaaaatgtccatgctcactaaatacacattctccagaatgggaaaacacagacatatgtaagaccctcagctcaagtttagggtctctgtgttcggtgaagtcctttccatcaatttagacagtaactgtttattgtctggtgaagaagtgtttcactctctgcccaacttttggtaattggaaaacaggaaagacaacttacatgaacactcttactcaaaacattggaaaatcaaaccgcgatactgatttatagcacattttctattttgctggaaacgtgaatacttttggtttgatagtcaactaaatcccttattctgcaaatctgacagttgtatttgatgaaagctgagatggtaacaactttcttgcccatatcgaaattcagggaatggggatgtggaaaaatgcctcactttgagattgcacatttttaacaggccccttcctattgagtgggtttggtgagctggtttaattatttaattggtttaattatgggatcttactcttggtgaggcttacagttaccttgatattgtagttcccttaagaatttatttggcttctagctcactggagttcagctccacggactggtaacctaggcagagagcttatccagcaagttatttattctgggaagtctagttttagccacaggcctcagagcttcatccacccctctctctcgaccctgtcatcattatcatttaatgacctctgccatgaacggaatcaaaagaatagcctgaagtcagaagacacatatattatgtgttccttctaactgcatttttaaaacaagattgtctcctttactagatgaataatgcctaactggaggtgtttgctagaaatctggggttgtaggatttctttttactttaatcaaatattctgcccagtatccattatcccatctctgcttgctttatctatggcttgagtagaaaatttggcttttccagtcccccaaatttccaaattattgaactttaaagcaatttagattatagcccaaaacctcttcaggcagaattgtattttattctttctctgccttctgatagatcagctttagcctaagcataactctttcttgaaatacctaactgaaagctgcaagaagtagccaaaacaccaatgttctgaaaattttctgtcagtttcccaaatgggcaagcatttagccaagtgcttcagaaccacacacgaaaaagggtaattaaccactaagatttgaagaatagagcaaattgtctttatccttgctttatctcctctcctctgccaatttagtgttttaaagtctgttacttgtggcagcatatttccggtgacatattcggcatcaggatgcttctgtcaacaagtaacagaagacattaactaaaccaccttacaaaacaatggaaattataccatttaactaatgtagtgggggtccccaagtgccatgcatgaaggttcagccccactgtaattttcttacctatcgtctttctctaggactggtagcaaaataccttcagctccttaagataagatatttacaatgactagaagaaaaagagaaataatttatttccaggtatcttagaacaagtatatttttcacagaagcacttcagaattattctctcaatgtctaaagtcacttatgtaaaattctttttttcaagtagcttactttattttttattgcaactcaaagagaaagctttttacatttaatagatagaacaaataatactttatcttcttactctgcatctcatttgctcatcttttgtttctggaaaattttcaggagacccttcagaaatagcatgttgcttgctgaggtttggttgcatggctatttacaggaaaaaaaaatagacacttgttctttaggatttcaaccattttttttttcacccaatgaaaattgctgggtcatctgtgacagcctcttttggaaacctgcagttgtcctcagctggggtgagaagttcatattctcccaggcctgccttgagataaagtaaagcactacactttagaagtgcttccttttcatcctaaccaggagtttgaattaggaatagaaacattcctggagcccttcgtctctgccagagtggagagtggcccccttgggagccctccttccttccacccacaacctcagacagcattcaaaccatacaacagccaccccaaacgagctaggtagactgaaaggaaggaagagaaggaaggactaatataaaatgccttagaacatatacttcataattgatgggtcaccaacaagaagtgattacttcacactgcagggaaatacttttctggaaaacaagagacaaaaataattttcggatacctgcgcgctgactctgatctaactctgtagcctgtcctcatcccagtcacctttgttaaggtgtctttgttgagcctgagttctgtacagaaaccagaaaagctcgatattcataaacatttctttaaatgcagaaacatagaatgttaatgtgcatttttctgagatggtgttataagtccaagtatcaaaaagcagtagcaaatattagtttgtgttttcaactctggagtctacctaggccacgtgttaaggacatctgtatacttcattagggaatgagaagccaggaacaattaccttagaatttttgcatctgctgtcactgtcaatacccatttcatacccttatgcattctgtatcctttgctaaataatttctgaatcttaaagtgtgtgtgtgcacgtgcatgtgtgtgtgcatgcatgtatgcatggtgttttcctgaaaactcataaaacacaaaacactgtacactaaatttctgtaaaacaatttaataatatataccaccttatgttacaaatattcttttaaataatttttctacctaggctactctttaaatggttgtcactatattatatacttgttaccatatcaaaactcagtactctaattaatatatactgaattttaaaattgcagtaaattttatcttctcagtgtagtaaaaagacccactaatttttcaagtaaataatcttgttaattccttgctggatgatgttttatgatggtggttatgtgtctcctgtgagcctgttcccacattcaaattattttatgtatatactgagacaaataaaaaatataataaacacacttaactgatacatctgtggaatttttaaatactttaagtgaaatacctactttgtacaagaaaaggttataatattaccatttgaaaaatcaatggtgctttcagattccgaggcatctcagtataaatacatattattatttttactcaaatgcatatctgaaaatattttcatactgtcatgctagaaaagcactaaaattgcttgagaagatagctgatatacatatatctgggctaagaaagcaaacttgagtacaagtgtttgagttaaaacagtcttatgcatactaaatggactctggcaacatcacacatttacctaagcatttagagatggcagttcttcttaatttgttcttaattctgttttcagagtattgtgatattttaatctttggaatgctgatgatttatgagttcaaacttgaagacattttctctgtcagtcttttagtattcaaatcaatgcagggaacacagaattagatctggagaggggaagcaggattcatcctctctggggataactaagcaaattatttggaactctggatgctcttgggcattcagtaggtcaaagtctaagtcctcaaagtaaacagtgatgggtcaaattgctgagagctccatgtgtgtaaaaaacaattctttatagtgcccaacatatctggttagaatatattaattggtggttaaaaatagaatatttattttaaaacagctcgttgatatagataaaattgaactaagatttctaatatttaatgtaaatattattcacttatcattcatgcagcacttgctctatgccagggacaggctttggttcagtgatctcaaaaataattagtagtgttacccaaattcaagcagtggcgtagattggatactccaattagtggaccctgatcttaagatttagatgtaagtgacttattaagtaagtgctcccaggaagatgtgataagggagtggagaaaacaggaaatgaacgacaaagaaccaggccaatggagagaattcagtggaagtttcagacatagcctgattctgtgggaagctctggagggtaaattacaggtcagaggttgtcctgaccctagacaaagaagtaaggcttttatactcctgttagccaggatgggaggcagtgaggttttggatgtgtggttagtgctgtctaggcacgtccagcaactcctgcaggggagaggacatcagtatgcagggcattcctctgaagggtgagttctaaaggtgtaagcctttcaaagcaaacaagaataaacttgggccaggtatgcacagagctggccaaattgtggtagtcactgctggtgctccacacaagaatatgcaatgttaatcataggaatatgtttggggcaccagaagtgagtcctgtcagaaattcatgttctggaaggggtgctaagccttaaaaatatgagtgtgatacgtgcaataatatattgatattgaaggcacaatactcagaaagggggttggataactccctggatggtaagcatgggaggtcaaagaacacttgagtagaaaaatgaagagacattttaaatgctaatctgcttgctaccataaactaagtattaaaagtgtatgtctggtttgattatcattttttctttaagggagaattaatatttcactcaccgcttagagaaaggtttctcttactcagtgtcttgtgtttgcttttcaagtcctacattgtcccactgaaagaattaattattgtcctgtaaaacctattaaaattctgtcttaggaaaacctattgtcctgcatgtcaaatatttctacagttttataagttccttttggcttctgcttctcctagcctaatttcctcatcttttcttccaaagtgtatttctcttacccggtcaatgagaccatattctttcctcatgcataagtggtactcccataatcattccatcctcttccagcagcaaggagccaccttattgcctccttaattttttttatgtctctctttaagttagtatgtgtgatttaattccctagaatgaccatttgggattgaattcctgactacctgataaaattacatcacatagaccatgaacccagaatacaaagttgtatgcttttatctgggcctttctatgttctatttcaagacatctgactcaaacaatgaagtgagacatctaatttcatttctgctgcttactcaatgtcacttttaacaatatattaacctctccaagtcttaattccccaatttagaaaagataggtaatagttcatgtgtaagatggttgctgtgagagttataaatgctcagtgcagtgtctgagacatgataggtctttagtagatgacaacaactattaataagaacaataaaaataataatatagtggccttacctcaagtttattaataaggtagaaacacaactcttttaattttactattaaatctttacagagggtttatacatacaaacatacataaaacctctaagttttacttaaagatatacctgtctctgatagatacatatggattctagagtttaaatagtcttgattattttattcctaaagctaacacagcttagaccagtatttctcaaaccaccttaaaaaaactcatatatatgtgtgtatcccataatcccatacatatgtgtatgtataaactcatatatatgtatatcccataatcacatatatacacacatgtattatatatcacatgtatataaacgtgtgtatatattacatgtgtacatatcacacgtataatacatgtgtacatatcacatgtgtgtatatcacatgtataatgcatgtgaatatatcacatgtgtatatatcacatgtatatatgtgtatgtatatatatcacatgtatatatacacacatgcatatgtacgtgtgtatctatgtgtatatatatacacacatatatgttattttattttacattcaggagtacatatgcaggtttgttatataggtaaattgcatgtcacaggggtttggcatacggattatttcatcacccaggtaataaacatagtactcgatcagtagttttcaatcctcacccccattctaccttccaccctcacataggttcccgtgtctgttgttcccttctttgtgtccatatgtactcaatagaaacacttatattaagtgacatgttaatgtatgttctggaagaacacaccaaaaaataactaaattaaattttttaaaattttgcaattaaatattcttttacaattcaatgtgtgtatatatatatatatatatatatatatatatatatgataaataccagacacatttatagagctcttatgatcataaaatctcttatttatgaaggtatttctcattcacaaatctcattataaagttaaagataaattacttgaaatattaagcaagtatatttaacttcttttatttatagacagtttgtcccgttcaatagctggtctgtgttatgtgacttaatttataattttatatggctttgtcatgtcattaaatgcttttattaaatatgaaaagaaaaatgctgctcatttctaacttcaaataaatttttggcatctgctttaatccaagagcccgtttcacctcatggtttcctgattgtgttccattgttgcattataattagaaaaattatacatgggcaactaaatttaaacaccttggattaaaagggaaaaattaagaagagattgtgttataggcataatgacggcagtaacattaagggacacttgaccgaaaggcaataattcaagctacagtactagcattcaataagatgttggttaaatacagtaccttgttaattttgacgtatgaattctacttcatgaacgaccattttattaaccatttcaattagctaacataattagaataattcaataccatgaacacattaatcaaaataggttcttcaataaacatgtctagactttaatacgtcaaccataaattacaatattattttattttagtcctctaacaccaaagggccatattaaataaaagagtatcaaattaaacttaaaagatgtattttattttgctcatttatcattcagatataatagatgggcttttggctttcaaaattatccttcacgtttttctcattttaaatgcatgtccttttttctttataaagatgtttgtctctttatttgtggaaagagctaaagaaactattactataccagaaagacacacacagttccacaatgtcagagtcagggttaaaactcagtaaagtgtcacttgtgcggatgaggttaagggtaaggatggactcactaaatcttactctattcagagtggctgagtcttcaaattctctcttcaggtaactaaattttattgcatgcttgttaagtggcagttattgttctaatagaaggccttttacgtatatgtacttaatcttcactaaaatctcatgagatagaaactctaaaactttaaaattattatttccattaacagatgtgaaattattatttccattaacagatgtgaaaattgtttatagtaatggtttaaaacaattcttaccacaaattcacattttcttttactcttcccagctacaagttagagttggattatctacattacgaagagaggaaagtgattgtaaaactagactttatttcattcagcaaaggaaattcattggcagggtgagactagtcgagtgagtatttcattgaggtggttaagaaaagaaaaaggtgtgaacaaatgataaaaggtggaataagcttgatgaccttggaaaggtgtcctattgattgttcaggtgacaaatcaggtcatgtattatgtggtagtcacagattatataatttggttcttgtcaattctgtaaataattcattgtgtaacctatgaaaaactctccaagcctcagtttcttataaaataagatatagatatggctttaaatttttttcaattctctaatttttgttatatctgaagttaggctatcaaagataaaccacagccaatcactttcttaagtgtctaatgcatattttgcacaatgctatgaggaggaaaagaagaaagagagaaagaaagaagaaagagaaagaaagaagaaagaggaggagagagagaggggaaagaagaagtggggaggaaaaatcatattcttcagtttataatttagttgtcagaacaagagcaaacacatgtttaaaattttgtgaacaattccttcatggcaacaaaaaagacatggtgattttaaaatttatatttgttctaatagtcttaaccaggataaatgaccagaaagagagtaatggctattgcagtatgtaaagaagactagagtaggagttggaagatttggaacaaatcccaattttgttgtatcatccttatttagtgaaaatgttaataattattaagcatctgtcatgaattaggtaccttgctaactaactactttatatattttaataatccacaattgtagtgtgccagagttggagccttcaagttttagtgattaattgaaaagcacaacttatttcttcttgtgctatggactttttaatgagtcctcatattcagaaagccgtagaagtcaagtgggtagttacttaatgttggctaggcagttgatttactgagtctgcaatagatgctaactttccctggttgattgggagaaaaagtcaatggaaagtaacaaagaaagcttcattacatttctttgctattcatacaagctttcagtgctagtgaatgttttgtgcaattgctcaaagtattatattatttgggagcatggaaaatgttttcgtgtttacttgttgttttcctcaagaaaatttccagagctaggtataactcacaaaatcttttttcagtcttataaagaatgagaacacttgttaaatgtgccaacctccctttagcagaaacagctccattaagccagtatatttggcactttctcaatgcacgatgtgtgtgtggggtgtgtgtgtgtgtgtgtgtgtgtgtgtgttttagtttatgaaaccaatttaaatgctgcattcctaaaaagctggctatgatcctcaattttacagagaagaaaagacgttttgaaatcgtttaatataccaccaaatctgaatgccaatgagctacaatttaccagtaacatacattctttattaatattaccttcttttgctttcagaaggcatgtagggagaaggccataattagaatatatgtatatatatttatttatatttatatatatatgtatatatatttgccaatctagaatttctaatctccatacactttggcaactattggggaactaaaagatgtatcatggaaaaacaaattaaaatgttaaattcaaggacacagtgctttgaataaaagcctcagataatgtgaacttgataagctcatcagatataaatgaaagatctggcataaatgatagatttcgtgacttgggggactaaagaagttttaaaatgcatctaatactaagcactcttttggagaattaatgtaaaaactaaatcattgacctgtagaaattaggtaataacacttactattattgcacattatcaatttatgagatgttacattgtagtcctaaacattgaggctgaaacaaatcttaaaagccctcattattactttactctttgggtagatattattactggaagtatcatagaatgtcagacctagaaaggagtaaggaatggaactaatcctcttatttacataggaggaacatgtaaaggcaatacagttgtgattgtctgaggtcatgtgatttttgtctgtgtacatgggacttttacttgctcctttaaaggaatctcaatagcttataaatgtcaaaaggaaaaaccaatcatctctttacattagcacattttatttcatttactgatattattaagccaaatatttatattttaataccctagtaatgatatttatattttttcaaggaatttttttacattgttgcataagattttcatcatactttatgagtgcaagcacttttactattatatgtgagtcttattaatgttaattatttagaaatagagatgacacaaagagctaggtaacaaaacaataaataaattcaacagtaaaacattttgaaatgcaaatattttaaataaaaatttttaatgaataaaagtatgcatgttcttgaaataaatacttttattaaaaactcatcggttacatttccaaaatataaatctgataccaactatcaattttagtttataggcagtgaacattaaagctggattaacatcatgctgattttgtttttcattttctttttaattgaaaataaagtgtgccaccagtcaaggtgaataatgtctatagatttttcacctgtgttttgtggctgaatttatttacacccacattaactgattagctcctgccatgcagttccatattcatcaattatttatgaaaatgcctcattgtatttgtcatatatgtatcagtttgaatgacaagatggctcttctaatatgctggtattttactatagttaaaataatgagaaactggtaatttttttttaatgccatgaagataaaggtgtttaagtcctgttaagcagaattaaccaaaataagagctttcccaggtaaacacttggttttgtattttacctaattatctaaattcaactgtatgacacgtcctaattgaataacgatggtaatttctgtgatagagatgaaaagcacataaacttgttctgaagttcgcttaccatcatagcatatagacacgtaaacaaataatttcgatatagcttgataatcattaaaacctaacacttcttatttagcactttgtgtgccaactctgtttttaatagtttttcctaatttactccttccaacaacctttaagagtgggttctattactctccatttcacagaggagaaaacagcagcacagaaagcatatataacttgcctaaggtcacataattagatacctgtggagctgatatttgaaatcaaacagcctgagactcagaacaaaacagcagagtgttcagttgtagcagagggatggtgctgaattacagctgggaaaaaaatgaataagaatgtgctagttaagggctgcacagtggtggaaggaaacagggcaggcatgagaggaaggatgagaacagatacagagcattctgggatgagataagagacttagtgagggcaaagagctatgagactgtggctgcgtgtaaggaactaagcaggttcttcttacctcagccatatttctcaaagtgagtctccagactgtctgaagaaataagtgcttggatacattttgaaaatacagattcctagactgtgatagacctactgagacagaatctctgcagtgaattcccaaatgagaattttaatagagcacgtcagattatttattatacatcaaaagtttcagaagcctgcgcaagattgtaaagttcaagatgagaagtgtcagaagatgcctttgacttgtcttctttctgattatgttatttcacataacataaaaaaccaatatttcaaaatacatactaaatgtaaacaaagattaaaagcacctgagtaaaataagcaatctaacagacaaaaataaaccattctttgtccagatccttacttcatttatcctgtaaggaaattatttaaaaaaaaacaattcttacctacttttattgagacactacatttcccccgcccacaatcatttcagttcactatttttgctatccgcataaacctttagtgagtctttcaaaagatatgaccaagtccaaccctcattcatttaacataatgattctgaatcctattggcaaatagtgacctgagatactttttaataaaaggcgtatgaaaggagaacaattgatttgcaggtatttttccctgtatctactatgcaaaagtcttttcaccctatactctcaggaatacatgtataagaagtgtaatatccatagggagcttgaaatccagaaaggatataagacaggcccacacacacaaaatgtaataaagttaaaccattgtaagagcttcaaagaggtgcagataatgcataggagttcagcaaaatgcaattattacttaactgttgaaatcattagggaagttttcatggaggattgggcatttgaacttggttgtaaatgatggatggacttgtgatattaaggttaccaaacaagagcattttcaaatgcttaggtggagagatcattatgaatgaaagctagaaagctttcatagtaattgtggttaaagggattcttggaaaacagattacagttttttatcttgagagggacttaagtaggggtgataagaattaaaagagaagttgttctcactctgaggatactgaatgcaagcctacagagtaaggaatgtagtcagtgctctgtgtgtgacattgaactcctttagcaaaggaggaaaatgaataaccaagtttcagagagaactgacatctaggtgtgaaaagaactagagaggagagagactgagttacaggaactcttaagataaaatcgagcagacaaggaatatgatgtttcaaatccaatctgtagtgcaatatagagatgggaacctgggaatgatagagttggcaaagcattccccatttacaaattgatcttttccatgcatttcgtcattctttctttctctagaaagtgaattgttaactttgtcaatttctatgatataaatgatccaactatggtcaattttaaactaccaatgtaatgtattgaacctgaatttgggacatgttggcaggaagttttcctctgttaactgaggtctgacttgttagaggcttgtgaattaaccgacaatagacaggttaataggaggaaagtttattacacatgaaaaactagccagtagtgaggaactagaggttacggtttgtaaaccaactcaacaagagttgattggataatttgactcatgcctgtaattccagcactttgggaggctgaagtgggaggatggcttgagactaggagtttgagaacagcctgggcaacatagtgggactccatctctacaaataaaaaaattaaccagggtggtggtgtgcacctgtagtcccagctactcaggagactgaggtgggaggatcgcttgagctcaagaggttgagggtgcagtgagccatgatcccaccactgcactccagccggggcgaaagactgagaccctatctcaaaacaacaacaataacaacatccaagaaggaaggaaagaaagggcagcttagacttcaatgcaaaagtgtggaaggtccttgctgggtaccttggctcatgtctgtaatcctagcacttcaggaagtcgaggcaggtgagtcacttgaggccaggagttcaagaccaggctggcgaacatggcaaaatcccgtctctactaaaaatataaaacattactccagcgtggtggtacacgcctgtaatcccagctactcagaaggtcggggcatgagaatctcttgaacctgggaggtgaaggttacagtgagtcaggatcaagcaatgttaatgggcagttgaatcaattgaatttatacttccctgtgctagggttagacttcccccaaacagaaagttctctcaagacaaggtccatggcagctatattgtgggggaggttctgcttaagtttagaaaatgtctctctgtcgttgctgactattcagaagttttcagtttaaagtaatttttgtaccactttggtaggctgttaatcccttcaggaaaaaatgtacaaagtacactcaaagagcactggcaaagcagcttctgccttctgctgtatgaatctgccataatctgtatgtttgtatccgttcaaaattcatacattgaaatctaatcatcaatgtgatgatggtaggatgtgggacctttgaggggtgattcagttatgaggttggagccctaataaattagattagtgcccttataaataaaccctacagagctgcttatttccttccaccatgtgagcgcatagctagcaggcaccgtctatgagccagaaaatgggcccttaccagatattgaatctgccagtgcaatctgcttatgtctcaatcttttttttttttaattatactttaagttctagggtacatgtgtacgacatgcaggtttgttacatatgtatacatgtgccatgttggtgtgctgcacccattaactcgtcatttacattaggtatatctcctaatgctatccctccccactcccctcaccccacaacaggccccggtgtgtaatgttccccttcctgtgtccaagtgttctcattgctcaattcccacctatgagtgagaacatgtggtgtgtttggttttttgtccttgtgacatttgctgagaatgatggtttccagcttcatccgtgtccctacaaaggacatgaactcatccttttttatggctgcatagtattccatggtatatatgtgccacattttcttaattcagtctatcattgatggacatttgggttggttccaagtctttgctattgtgaatagtgccgcaataaacatacgtgtgcatgtgtctttatagcagcatgatttataatcctttgggtatatacccagtaatggaatggctgggtcaaatggtgtttctagttctcgatccttgaggaattgccacactgtcttccacaatggttgaactagtttacagtcccaccaacagtgtaaaagtgttcctatttctccacatcctctccagcacctgttgtttcctgactttttaatgattgccattctaactggtgtgagatggtatctcactgtgattttgatttgcatttctctgatgaccagtgatgatgagcatttgttcatgtgtctgttggctgcataaatgtctgcttttgagacgtgactgttcatatccttgcccaatttttgatggggttgtttttttcttttaatttgtttgagttctttgtatattctggttattagccctttgtcagatgagtagactgcaaaaattttctcccattctgtaggttgcctgttcactctgatggtagtttcttttgctgtgcagaagctctttagtttagttagatcccatttgtcaattttggcttttgttgccattgcttttggtgttttagacatgaagtccttgcccatgcctatgtcctgaatggtattgcctaggttttcttctagggtttttatggttttaggtttaacattgaagtctttaatccatcttgaattaatttttgtagaaggtataaggaaatgatccagtttcaggtttctacatatggctagccagttttcccagcaccatttattaaacagggaatcctttccccatttcttgtttttgtcaggtttgtcaaagatcagatggttgtagatgtgtggtattatttctgagggctctgttctgttccattagtctggatctctgttgtggtatcagtaccatgttgttttgcttactgtagccttatagtatagtttgatatcaggtagcgtgatgcctccagctttgttcttttggcttaggattgtcttggcaatgtgggctctttttttggttccgtatgaactttaaattagttttttccaattctgtgaggaaagtcatttgtagcttgatggggatggcattgaatctataaattaccttgggcagtatggccattttcacgatattgattcttcctacccatgagcatggaatgttcttccgtttgtttatgtcctcttttacttcattgagaagtggtttgtagttttccttcacatcctttgtaagttggattcctaggtattttattctctttgaagcaattgtgaatgggagttcactcatgatttggctctctgtttgtctgttattggtgtgtaagaacgcttatgatttttgcacattgattttgtatcctgagactttgctgaagttgcttatcagcttaaggagattttgggttgagacgatggggttttctaaatatacaatcatgtcatctgtaaacagggacaatttgacttcttcttttcctaattgaatatgctttatttctttctcctgcttgattgccctggccagaacttccaacgctacattgaataggagcggtgagagagggcacacctgccttgtgccagttttcaaagggaatgcttccagtttttgcccattcagtatgatattggctgtgggtttgtcataaatagctcttattattttgagatatgtcccatcaatatctattttattgggagtttttagcatgaagggctgttgaattttgtcaaaggtcttttctgcatccattgagataatcgtggtttttgtctttggttctgtttatatgctggattacgtttattggttttcatatgtttaaccagccttgcatcccagggatgaagcccacttgatcatggtggataagctttttgatgtgctgctggattcagtttgccagtattttattgaggattttttcatcgatgttcatcagggatattggtctaaaattctctttttttgttttgtccctgccaggctttggtatcaggatgatgctggcctcagaaaatgagttagggaggattccctccttttctattgattggaatcatttcagaaggaatggtaccagctcctccttgtaccactgctagaattcggctgtgaatctgtctggtcccgtactttttttgattggtaggttattaattattgactcaatttcagagcctgttattagtctattaacggattcaacttattcctggtttagtcttgggagggtgtatgtgtccagtaatttatccatttcttctagattttctagttcatttgtgtagaggtgtttatagtattctctgatggtagtttgtatttctgtgggatcattggcaatatcacctttatcattttttattgcgtctatttgattcttctctcttttcttctttattagtcttgctagcagtctatcaattttgttgatcttttcaaaaaaccagctcctggattcattaattttttgaagggttttttatgcctctatcgccttcagttctgctctgatcttagttatttcttgccttctgctagcttttgaatgtgtttgctcttgcttctctagttgttttaattgtgatgttagggtgtcaattttagatctttcctgctttctcttatgggcatttagtgctataaatttccctctacacacagcttttagtgtgtcccacatattctattatgctgtgtctttgttctcattggtttcaaagaacaactttatttctgccttcatttcgttatgtacccagtagttgttcaggagcagattgttcagtttccatgtagttgagaagttttgagtgactttcttaatcctgagttctagttttattgcactgtgttctgagagacagtttgttataatttctgttcttttccatttgctgaggagtgctttacttccaactatgtggtcaattttggaataagtgcagtgtgtggctgagaataatgtatattctgttgatttggggtggagagttctgtagatgtctattaggtccgcttgatgtagagctgagttcaattcctggatatccttgttaactttctgtctcgttgatctgtctaatgttgacagtggggtgttaaagtctcccattattattgtgtgggagtctaagtctctttgtaggtctctaaggacttcctttatgaatctgggtgctcctgtattgggttcatatgtatttaggatagttagctcttcttgttgaattaatccctttaccattgtgtaatgtccttctttgtctcttttgatctttgttggtttaaagtctgttttatcagagactaggattgcaacccccacttttttttgttttccatttgcttggtagatattcctccatccctttattttgagtctatgtgtgtctctgcatgtgagatgggtctcctgaatacagcacactgatgggtctttactctttatccaatttgccattctgtgtctttcaattggagcatttagcccatttccatttaaggttagtattgttatgtgtgaatttgatcctgtctttatgatgttaggtgtttattttgctcatcagttgatgcagtttcttccaagcatcgatggtctttaccatttggcatgtttttgcagtggctggtaccggttgttcctttccatatttagtgcttccttcaggagctcttttagggcaggcctggtgatgacaaaatctctcagcatttgcttgtgtgtaaaggattttatttctccttcacttatgaagcttagtttggctggatatgaaattctgggttgaaaattcttttcttttagaatgttgaatattggcccctactctcttctggcatgtagagtttctgccgagatatcagctgttagtctgttgggcttccctttgtgggtaacccgacctttctctctggctgcccttaacattttttccttcatttcaactttggtgaatctgacaattatgtggcttgaagttgctcttctcgaggagtatctttgtggcgttctctgcatttcctgaatttgaatgttggcctgccttgctaggttggggaagttctcttggataatatcctgcagagtgttttccaagttggttccattctccccatcactttcaggtataccaatcagacctagatttggtcttttcacatagtcccatatttcttggaggctttgttcatttctttttgctctttattctttgaacttctcttctcacttcatttcattcatttgatctttaatcactgataccatttcttccagttgattgaattcgctactgaagcttgtgcatttgtcacgtagttctcatggcatggttttcagctccatcaggtcatataaggacttctctacactggttattcttgttagccattcatctaatcttttttcaaggtttttagcttcttttaatgggttcgaacttccttctgtagcttggagaagtttgatcatcttaagccttcttttctcaactcgtcaaagtcattctccatccagctttgttccactgctggtgaggagctgtgttcctttggagggagagaggtgctttgatttttagaattttcagcttttttgctctgttttttccccatctttgtggttttatctagctttggtctttgatgatcatgacataaagatggggttttggtgtggatgtccttgctgtttgttagttttccttctaacagtcaggaccctcagctgcaggtctgttggagtttgctggaagtccactccagaccctgtttgcctgggtatcagcaacagaggctgcagaacagcaaatattgctgaacagcaaatgttgctgtctgattgttcctgtggaagcttcatctcagagaggtacccggccatgtgagttgtcagtctccccctactgggggttgcctcccagttaggctattcgggggtcagggacccacttgaggaggcagtctgtccattctcagatctcaaattccatgctgggagaactactactctcttcaaaggtgtcagacagggacatttatgtctgcagaggtttctgctgccttttgtttggctatgcccggcccccagaggtggagtctacagaggcaggcaggcttccttgagctgtggtggtctccacccagtttgagcttcctggctgctttgtttacctactcaagcctcagcaatggtgggcgcccctcccccagtctcactgcctcctttgcagttggatctcaggctgctgtgctagcaatgagcgaggctccatggtcgtgggaccctccgagccaggctcagaatataatctcctggtgtgctgtttgctaagaccattggaaaatcacagtattagggtgggagtgacacaattttccaggtgccgtctgtcacagcttccctttgctaggaaagggaattccctgaccccttgcacttccggggtcaggcgatgccttgccctgcttcagcttacgcttgttggactgcacccactgtcctgcacccactgtctgacaagccccagtgagatgaacctggtacctcagttggaaatgcagaaatcgcccatcttctgggtcgctcatgttgggagctgtagactggagctgttcctattcagccatcttggaaccactccctatgtctcaatcttaaacttcccagcctccacaactgtgagaaataaatttccgttgtttaaaagttacctagtttatggtatcttgttgtaacaaccctaatggactaagactgaaaaccacctaaaaattgccctttcacatggtgaattaaattatttaaaaacaaacaaagtggcctggcatggtggctcacacctgtaatcccagcacttttggaggttaaggcgggaggatctcttaagccccaaagttgaagtctgcagtgagctgtgattgtgctgctgcactccagcctaggtgacagtgagaccctgtctctaaaaagtcaattaattaattaaaattaagattaaaacaaataaaaccacaacaaaagttaaagataatcttaatagcagagatttttgcaaaataggagagaggatgccttcagtaattaggattcagctgttagggctagagagattctggtgaatactacaggttttcttgagagcttgagagaatttggacaaggaaaaattacagaaaatgaagtaaaccgttgattatccccctaaagtttagaacatatgctatacagcaaaacaaaatttgcacattgtgtgtaaagttgaagtatattctttctgtttattctgctcattcccttatgtagtttttattgtaaattgattagcttgtcctgggtatgtttgccacaggatatgctaaaccatttgtcctttttgagagggtttgtgaaagaatgagtttgatgaagtcatgacttccaagtagcataagctcaatagtggatttttaaaagccatacccatcatgttatgaagcttagagaagaggcaggtgtccatcttattcctccttataatttcctaaccactgtcttttcctgctcccctcataatttttggcaggaagcccatgccatcagactgtatcacttgctacccctcttcattgtagtcttcatcccaaccccagcacactcttgtctattctttgaagattatagtcctcactcatgttcattatttccaatgttgcttctaaaatagtccatgtttagacacatagcttatctttgtctcaccttggattttagctccttgaactgttttttttttcaataatcttgttctcaatcctatctccgccagtgtagtcattcacagtgcacctctactgtgatgtccatttggaatttcaaacttaacttgaacaagctgaattactggactttacacttcaaatgtgtacatgtgtaccttttgccatcttccctatcccattaaattcctacagaatctgtttacccagacaacaccttggaaatcattctgccttctcttttctctcatagcccatatccaaactatgaggaaattctgtcatttctaccttaaaaaaaaaatatatatatatatatataatattcaaacagtttttactacttccactgctaaaaactttgtccaaacatccattatctctcaaactgttataatcactttggagtggtctttcagcttccacactcacccttctacagtgtctttgtaatggtgcatttgccatattttattcatcacaagtgcactgtgaaatccagcccacactcaaggatgacatgagagtgcaaatacaaggaggtagggatcatttgtgaacatgctagaagccacctacctcaggcagcacagctagttgtaacgagtaggcctcactctcagaatttaaagctggaagcatcctagcactctgtagcagatgcagaacacagctttcggtttacaagctgccaatattatcctacctactgaacttaaaaagccccagaatggaaagatactctttcctttcatttcagtgctctatcagccaaatctgtcaatgaaaaatggatctgtgtagttcaaggtcaaccagcagcagtttgcacctcctgaggctctgtgttttagctaaagctacctgtggtctttgtcttttctgatgttgttggacccagaggctttgctgagacacattcatctcacaagccatcatttcagtctcacaagactatataaaaatagcgtcatgcctgagggaaaagcctccataagcttcagacaaccttccaggttaaaccttcttatgatctgaggcttaatgttctcgctcagaccttagcagtaaaaagccaactgtacaactgctgagcagaacacacgttctctgcatgtgatcctgctagcaaaagaggaataagcagaaccaaaaacactgagttcattcaccccaaatttattagcaagaaaagtaatatttctttgctagggagaaaggctgggagtgtaacactagtagagcttctggtaccgggaatgaggaatgaggaataagtgttcctacccatcctcagaacttccaaatattttctttgttttataattttatgatgttttctttaatatgtaaaaaaatcaacatagtcacttaggtcagtctttgtctttattatttatttatgtttatgttcagagaagccctccttgttctattgtaactgaaaggtaatttttacttacattttcttcaagtggttcttgtgggctgatttatatttagtattttaatccagttatagtttactataatgcaatttaaggatctgattttttcccctaaaagttaacgaattggtaaatcacaacctattaaatatcctgatcaatttctctttgccagttgaagatatgatacatttagaaccctcaaactcctcaagtggtagtaaaaattaaggcattagctttggagggaaattgataatatatgtgaagctattcaattgtgtgcatagcctttaactgagactttataactctacaagtgcatttaaagaaatattcacatatctgtcttaagaatgtcatcacaacattatacagaaaaaatggaaatacaaaatatctaatgacaggattaatgaagttatttttatatgatggaaatttattcattccatataatgtaaacttaagaaaaatatttgatgtaagaaaaatcctgagaatatagctaggtgcaaagtttagatagaaattattatatacattaatgatgcattaatgattatattatgttttaaaatttttatctatttctcttcaacttttactttgagttcaggggtacatgtgcagggtgtgcaggtttgttataggtaaatgtgtgccatggtggtttgttgcacagagcatcccatcacctaggtattaagcccaggatccattagctattcttcctgatactctcttcccgctcaaaccccctccaacaggtcccagtgtgtgttgttttcccctatatgtccatgtgttctcatcatttaggtcccacttaaaagtgagaatatacagtatttggttttctgttccttcactagtttgctgaggataatggctttcaactccatccatgtccatgtaaagggcatgatcccgttcttttttatggctgcatagtatattatggtgtatatgtatcacattttctttattcagtctatcattgatgggcatttaggttgattccatgtctttgctattgtgaatagtgctgcagtgaacatatgcatgcatgtatctttataatagaatgatttatatttctttgggtatatacccagtaatgggattgctggttcaaattatatttctgcctctaggtctttgaggaattaccacattgtcttccacaatggtagaactaatttacacttccaccaacagtgtaaaaacattcctttttctctgcaaccttgccagcatctgttttttttttttttttgactttttaataaccattctgactggtgtgagatggtatctcatagtggttttgatttgcatttctctagtgatcagtgatgttgagcttttttgtttgtttgttggctgcatgtatgtcttcttttgagaagtgtctatgcaagtcctttgcctgctttttaatgggattgtttgttttcttcttgtaaatttgtttaagttccttctagactctggatattagacctttgtccctttgtcagatggatagattgcaaaaagtttctcccattctctaggttgtcacttcattctagtgatagttttttgttgttgttgttgttttttgttttgttttgttttttgctgtgcagcagttctttagtttaattacatctcattggtcaatttttgcttttgctgaaattgcttttggtatttttatcatgaaatctttgctcatgcctatgtcctgaatggtattgaccagattttcttctagagcttttatagttttgggttttatatgtaagtctttaattcctctggagttaatttttgtatatggtgtaaggaagaggtacagtttcaattttctgcatatggctagccagttctcccagcaccatttattaagtagggagtcctttccccattacttgtttttgtcagctttgttgaagatcagatagttgtacatgtgtgatcttatttttgagttctctcttctgcttcattggtctatgtgtctgttcttgtatcagtaccatgctgatttgattacttaagccttgtagtatgatttaaagtcaggtagcatgatgccttcagctttgttctttttgcttaggattgtcttggctatttatgctcttttttggttccattggaattataaactgtttttttcttgttctgcaaggaatgtcaacatggtttaatgggaatagcattgaatgtataaactacttttgggaagtatggtcattcagatgatactgattcttcttatccgtgagcatgaaaggtttatctatttctttgtgtcctctctgatttctttgagcagtgatttgtagttctccttgaagatatccttcacttcccttgttagctgtattcctaggaattttattctttttgtagcaattgtaaatgtgaattcattcatgatttggctccctgcttgcctgttgttagtatataggaatgctagtgatttttacacattgattttgtatcctgagactttgctgaaattgtgtattagcttaagaagctttagtgctgatatggttgggttttctagatatagtgtcatgttatctgtaagcaaagataatttgacttcctataatcctacttgaatatgctttatatctttctcttgcctgattgtcctggccagaacttccaatactgtgttgaataggagctgtgagagagggtatctttgtcttgtgccagttttcaagaggaatgcttccagcttttgcccatttagtatgatattggctgtggatttgtcatatgtggcttttattattttgaggtatgttcattcaatacttagtttattaagagtttttaaacatgaagagatgttgaattttattgaaggccttttctgcacctattgagataatcatgcggctttcacttttgttctgtttatgtgtcaaatgagaattactgatttgcttattttgaaccaaccatgcatcccagggatgcagccacttgatcatggtggataaacgttttgatgtcctgctggatttttttttttttgtcagtattttattgaggatctttgcattgatgtccatcaaggatactggcctgaagtttttttgttgttgtatctctgccaggtttggggatgatgctggcctcatagaatgaactagggagaagtagtcccttctttttaatttcttggtatagtttcaatagaaatggtaaaagcttttctttgtacctctggtagaattcagctgtgaatctgtctggtcatgggctttttttgtatttctgttgggtcagtggtaatatccccattgtttctgactgtggatatttgaatcttacttcttttctttattagtctagctagtggtctatctatgctattaatttttttcaaaaaagtagctcttggatttgttgatttttttgaagtgtttgtcacagtctgcttcagtgcagctctgattttggttatttcttgtcttccgctagttttgatatttatttgctcttggttctctagttcttttacttgtgatattaggtttttaacttgagatatttataactttttgatgtggacatttagggttacaaatttccttcttaacactgccttagctatgtcccagagattctggtatgttgtatccttgttctcattcatttcaaaggacttcttgatttcttccttaattttattatttacccgaaagtcattcaggagcaagtttctgaattttgatgtaattgtatagttttgagtgaatttcttagttttgatttctagtttgggctgtggttcaatagtttttttatgatttaaaatcttttgcatttgctgaggcgtgttttacttctaattttgtgatcaattttagagtatgtgtcatgtgacaatgagaagaatgtatacactgttgttttggggtggagagttctgtagatatccgtcaggtccacttaatccagagctgagttcaggtcctgaatatttttgttaattttctatctcggtgatctgcctaatattgttattggggcattaaagtctcccattattattgtgtgagagttgaagtctttttgtaggtctctaggaacttgctttatgaatctgggtgctcctgtattgagtgtatatatatttaggatagttagcacttcttgtcgaattgaactctttaccattatataatgtccttcgtctcttttttttttttttaatcattgttggtttaaattctgttttgtcagatagtaggattgcaacccctgcttttttcttttttccatttccttggtaaattttcctccatcccttaattttgagcctatgtttgtctttgcacatgagatggatcttttcaagaagcacaccgatgggtcttttttctttatctagcttgccattctgtgtcttttaattggggcatttagcccattgacattcaaggttaataccgttatgtgtgaatttgatcccgtcataatgatgctagctggttattttgcagacttgtttaggtggtagcttcttagtgtcactggtgtgtgtacttcagtgtgtttttgtagtggctggtaacagtttttcccttccctatcacgtgcttccttcaggagctcttgcaaggcaggcctggtagtgatgaattccctaagcatttgtttgtttgaaaatgatcttatttctctttcacttatgaaccttagtttggccagatataaaattctatgttggaaatttttttccttaaggatgctgaatattggcccccactctcttctggcttgtaggctttccactgagaggtccacttttagtctgatgggcttccctttctaggtgaactggcctttctctctggctgcccttaacctatttttttttatttcaatcttagagagtctgatggctatgtgtcttggggttaaacttcttgtgaagtatcttactggggttctctgcattttctgaatttgaatgttggcctgtcttgcttggttggggaagttcttctggatgatatcctggagtatgttttccagcttcattccattctccccatctttttcaggtgccccaatcagtcgtaggttcagtctctacataatcccatatttcttggaggttttgttcatttattttcattcttttttctttattcttgtcttcctgtcttatttcaaaaagatagtgttcaagctctgaaattctttcctatgcttgatctattctgctacctgtgattgaattgtgaagttcttgtgttgtgtttttcagctccatcagacatttctctctaagtccttctaagtctctttcagtcccagtatgagaacctggaaatttcagttgaaaacgttgaattcattcgccccttttcattcctctctgtgagtgccatggaccgcagctgcttctattcggccatcttggatcttttcctttcaaatctttaaatatctacttttaaatatctaaaaatatatattttatttgtgattgtctttgaatagttggaattttgttcctttttctatctatttattcgtttattcctttttctagtttgtacttttaatacttgcttgtctcccctaatgaacttaaggtaattggaggcaaagattttttcttattaagcacacattatagtatcttgttcattataggttctcaagactgtcagttaaatgtcgttaataaaactagaaaacaattctgactggttggacactgctgaacataccaagaatatttaataagataaatgaactgagggatatgaagattcaagtcatagaccaaaacataaagaggccttgccacaattggttcagatccccctacatagataaggggtcagagacagaatttctttccctgggaaaaattgtgggttaaaatagggactcagcctccaagtatctatatagcaccttgggggaatgctacaaggacttaaaggttcaaataaatatatgaactcctagaattttgacataaagttagaaactgcagttttctaaaatcgaagcaaacaagagcaagataaaaccaataagcttagttattgttgcagtaaccaataccactatcaataaaaataagctggttttaaaaatattactaataaaattaggtatttatcttctcaattacactgcagtgtatctggcatgaaatagttgtattttctatagtagatttttttgtaaataaatgagctagtatgaatggtagtcattgtggtgatgctctaacactgttcaaatgagaaagtgccctgattctgaatgatttatatttatttatatatttaccataacttgatgttagcatcttttgagaggatccagttattgcttcctacctttatatgaaacaaagaacctttaggtctgtagtgtggtttctgagtgattctgttcaccaaaagcaaagaactttataaatagattaccaataattcttatgctaagtttagtttccattattagttaatatgttggccagtatctgacaaagtacagttcattattcagttaattttgaatcatccccacaaaacctactcgtccctatgtgaattgatgtagtttaatttctgaaccttccaaactaaggaccaatttctgatttcttctgtgagattcactctgaagggatgagctgggttattgccttgccatagcctagtaatttgggttattctagggtttggtcacagctttgatttagctttcagttagtgactaaacactaaagcaagagattagtaattggaattgtatcacaagatcagagtagagctaagagcaaagctaagtcaacactgagacaatcatctcttgggatattatatctcccagctgtcttagattattgataccaggaggaaagaggatttaaaaagctgctttctgtcctctctgtgatttcaggagggtgaaccagagcttttgtttaccttcggatctgtactaaaagccttttcaagtagagaatatatggtgaggcagtgggaaaatactcactcttaagccttatgtggatgtgtatactggtagaatctctatgcaggacaattttgtaatattattcaaaattacatttgaatgtatctttcagcccagtaatttcacatctcaaaatatatcttataggtaaatttgcagaaaatataagattattcacttcagctctgtttgtaatgcaaaagagaatataacactagttaactacattataatatacccataaaatgtaatactatatagtattgatatacagtcataacaaatagtaggggaacccattatacataaatatatggtaaaacagcaagtttaataataatatatatattaccctatatgtataaaaataaataactgtatataaatatttgtgtatatttttctatttttaaccatataacatctgtagaaggttatataatacattgctaaaattggtggcctctggatggctggtcactagtggtaaaagaaagacattatttctggaaaaatatgttgtactttttgaattttggactatgtgaatatgttatccaaattaaaaatatgtacaaaaatttttaaaaagtagtaaatacttttatatccaggcatttttgtgataaagtcttatgatgttcccaattcaaaaatatataacctaagctccaaaaatgtagaaagtaataaactaacttgctattatataaatattgttaactttccagcctagaataaagtggtatcatggctgtctacttttgttagccaattctaaattttagattttataacttgaaacttctcaatcatagtgcttattcccatacagttatgtgctgtataattataatactgtatttttactataacttttctatgtttagatatggttggatacacaaataccattgtgtttcagttgcctacaatattcagtacagtaacatgctgtacagacttgtagcctgagagcaatacgctaaaccatattgcctagatgtgtagtagactaagctatctaggtttgtatacgtacactctgtaatgtttgcacagtgacaaaagcacctaacgatgcatttcttagaatttctcttcatcattaagcaacacatgtctatatgagacataatgcttacatattagacacactgttttgtgaaaattatttgtccatgtagagctggattatcaatataccaaagattcccttggaacttagtgtatttcttgccatttcctagattgactcagtgttggatttgctcctaaggatgttccatctacttggtgacttcagtcaattcagacagaaacacgttcttatgacctctggtgtgttagctgaatgagagcatctacttttcaaaattccaccacaattcccagatttgagctttgtttaaataatgcggcttctgtgccattttgtgactggcaggaaatgttgattaggccttgattatatgctcacatctattttaagggttttggaccagcagtattcaaagcaaatggattgaaagtttaggagaactcactccccaatggaaaaccagaatgttaacaagtgaaatgaactggatgctaggaaggcaaaaacagcagctataaactctaagaatatattataaagaaaaaagcttgcattttcacttggaggaaacaagaccagtaaaagatgtgaccggaatggaaaaggttgttgaaccagactaaagtacaaggggtagtccagatttagagattaaactcaatttcctatcgctcttgttttggtttactgctaaaacaacaaacactgaggcatggaatatgcaccacttagagaatgaagtagtggaatcagccttgttcctctgagaggagtgcctgtaattcagaagtcagcaccctggattggaggagtccaggcctcttggcttcttgccttttgcaggtataactagtgaaggacacacattagacactgaaaatctacccactaatatgtatgtgtgtttatatatatatatacacatatatatatatacacacatatatagtgtatatatatgtgtgtatatatatatatgtgtatatatatgagagatgtttttctgtgtcacaattaggtattctgtattccctttcttactaagttcttgggccaacagcaagcttaaccaggtcttaccaatgggaacaatcatggcaaaacttaaagtctaagagcagggaagtttaatgtgtactcaatactttttgaatggctgaataaatgactgaattttcacagaaagttgacacgtctaaaaaaagaaatatatttttaagaaaaataacccatttatactatagaaatcaaaattatcttatgtgctttatcagtgataacaccattattaaagcagcagtatactaaaccatgtgtatatattttctgtgtaattttacaactatgagaatacatcctaaaattagttaacacatttaaaagggggaaatttaattttattaggtctagaggatcattatagaatttaccctaatggcttaaaaaagttaaaatatttcacctacacttaaatctttttgtgtactcagaagatttcagcccaattgatcatgtttcacttcaagaaatccttataaataaactttaatcccataggacagatccattaattatgctttcaggggaggcataattaatggatctgtactatggaattatagcattcagtaaatattaataatgaaaactcattctaccaagcaccttaatagtacccaaacaaatagatcattttatatggctgaagctttccttcagcattcccatatggaacatgaaagtatgcaaaacaatttaacatcagcttttctgggagaacttaatagattaaagattctctgatggagagattttgcatctcaataaaatgatctgtcaaaatttactttgatgaaagttttaaaagctctgataaaaactcagaggctatgagtaaataactattatgtattataacaataaatagcctggttatattgctaatgaagaatttttaaaataaacttttaattggggaatagttttatatttacagaaaatatgcagagacagtacagacgagtcccataaactcctgagtttctcctactgttatcatccaacctcagcagagtacatttctcacaacttaaaaaaccatcattggtgcattactattaactcaactggtcaatgtatttggattttaacagttttccttaatgtcctttttgttattcccgagtcacattcaggatactttattacagggctcctcaacttcctggccacggaccactggtccgtggcctgttggaactgagccacactgcaggaggtgagcggagggcgagtgagctaagcttcagctgtgcttacagctgctccgcatcattgccattaccaactgagctccacctgcctttcagatcagctgcggcattagagacccttaggagcgctaaccctagtgtgaactgcgcatgcgaggtttgaatgctccttatgagattctaatgcctgatgctgtgtcacattctcccatccctcccaagatgggacatctagttgcaggaaaacaggatcagggctcctactgattccacattatggtgagttgtataattatttgattatatgttacaatgtagtaataatagaaataacgtgcacaataaatgtacttgaatcatccctaaatcatccccctcccactttgtggaaaaattgttttccatgaaaacggtccctcatgccaaaaaggttgaagaccattgctttattattgttgttcgccatgctttctcagtgaaagtttctcacacttttcttgttaagcactgattaggtttttgcagaacattcctcagtttagatttgtctgatatttttctcatgattagactgtggccattggtttgagggtagaagaccatagatgtgaaggatccctctcttcacattatacaacgttcatgctgtctacataatgctacccttgatcacttggttgaggtagtgtgtgctgggtttctccactgtaaagttacattttccttttttcatacattacactttggaagaaagtcattcagtgtagcctgagggtgggaatagggtgttaagtttcatctcttgaagagaactagctaaatgaattatttggaattcttctgaaaaaggatttgtctcgtctatttatttgttgatttggaatttttctgaaaaaaatgggtctcttctcccgatttatttgctcattcttttaatactttgagttatactctgtagtatgttttttatgttgttgttcgaattgttccagctttggcatttgggagttctttcgtgttgagttctttgttctttgtctctttggcatacccctgttcttttgttttttgagtacttccttgctttatggtaccacaggatgctccagaatcatcttgtgcctcttgtaaatttcttgtcccattctggacttggaattagccatttctcctaggagccctggtttgttttttagaaaaaaaaaattaaaaaaaaacacaagacctaggcactgggtgttagtaaggatattttatttaataaaattaccacattttccacagaatcagaagaaaaacataagacttatacaataaaatatttataatacttgtaaaagattctttcattttcatggattaaaaattaactccctaacttatgaatcagttaactgtatttcaaaaataaatttaaattttaaattttatattttgtttgtttgtttttgcatttgcaagatttaatagagtgaaaacggagctcccatacaaagggaggggatccaaagagggtaacctaaattttatattgttagatacacacggctgacttggaaattgtatatacagaacattgacagtactaagtgacaaatagtttgtgaatcaattgagagttcttcctttcttcatatcaaaatgaagaagataatactatgtttcccaatgctattaaaatgagtacatgtttgtatttatcaataataaatataatagtagcagttatgagaagatgtaacactcaaaatatcaactttattttctgattattaatagtgcctcttattcttcaatttctctgcttttttagtgacagaatattgagtgaggaatgaaatcgcttgtcaattaaggaaattgtcttctaaaaacaacagcaataaagaaatgaaagagttttttaataattaggcaagtagaaaggattctagagagcaatattcataaaaagaaggtgatattaaccagaatatttataatatgctcagtaaattcttgtctagattttattattgaacctaaggatgacacttaggagaaaaatgaaagagaacatagtctacattaaatagaaatagaaagggagaggtgaccaatttgtgcaaaataacattttaatggtaggtaaaatgttaggttcatattatttatctgtgctagtgtttgaaagaagcagtttgtctgttggacttacaaccaaaaaccaggttaagaacacttgttagaataggcttcttatgacaggaatgtctattgtgtctccaatggattaaaaaaaaattcatgagaattaaggagatttattctgttgagatatttgctgcttttagaaaatagctcttctatgttcccataggattcactttcacattattatgaaccaatcacttgtaaaatctctgaaatatatcaaaagcagatgaagccataattctgacagaacattttatgaagaaagttgtggattaacaaaaaccattagcttttaaaaacatcaaatgtaacttaagtattttatttagatattaaattgtatcagtattgctattgttgaatgaaagagtaaatggattaaaatatgaaatatggataagacttatcttcaaaaggtttacgatactatttgatctaaaagaataagcaaattggaatgatacctaaattacagatcactgaaaagcaaatgggaaaacaataggataaacatgaaaatatgtatttctcaacttgataactaagtacagtttatcagctgttgtcatacgagattgatttgtttttttaaaatatttatctcaatatttcctcagaacagtaaaattaaggtgtcacactttaagattgatttgaaaattatagctagaacacaattttctcttagaatgacattcaaagaatcagtgttacataatgtaaaatttggagtctgctttttactaccctttgatttatatgttaatttctggaaagttgtgggagacctcaatctttaaagtttaccatgaaccttgactttgcactcctcatgttcttataaaaattaaaccttcattggaaagactgtgatccaggcttttcaatttttacaaatgaatgtcatctatgtctcctaaatatatagtttttgagggtatgatactttaataagctatgcaggctgtccatactacaggtaaatatcgaataattcaactatgaacgaactgtgttctgtcacttgcttaaattcttgtgagaaatccaactttaagagatttagctcaagagtctttttttctgtgtttttcagcataaagcttcattcatgtcttacgttaacatcctgaggtaaattagttagcaataccagccttgtttctctattatgtcatataatcagagagcgagagtcagcaattcataatatttcctggattgatcaaataaatggcatagaactccggataaattttgaaattaaagtcaataactaactcacttcaattatctggtgcatgtattttcctacttcctttagtagattattgttcaatttttacctaatttccttctttagatatttttactcaatgcactgccttatatcaatttccaaaataggtgtggtatgtgttaaattaacattatgctgaatatcttggttcctgtgtttatagttcttatccttggtttctggactagggagtcataagtagtcccaacttaatggatatttaaaatatgtccagtttattgtacatttgaatacagtgaattgaaaataatccttgaatagaaagtctctaagaataagtagcggttgtagcacctatgctttgaatgcgttcttttgttgaaacttaagtgagtcaaacttgcctacttatatccttatctcacttgaggtgaattcattctttggttttaatcttcactgcaaaatttctgtgtgtttgcacatatatttagaaaccaagctgaaaatgtaggtatatattcttttcaatgttttcttttgttttatttgcatatgggagaatccctctgagagactgtgttaagaatataataaaatgacttctgttgctacctactattagtatatttttcttgcttttagaaaagtaaattaatgatgaacttctaactgatatatctttcttaggctaatctctcattaaagacgttttaattgattttatttttaaaagactagataaacagccattagcaacattccaggcattctcttacatttgtgtaaatcttttatccttaaatttttgtttagcagaataaaagaaaggtaaaatgtcaggggctatgaatttaggaatttaaaaaatttaatattttttcagtttgtaattgtatattatggcagattggtttacataatgaaaaaaatggttgcaatgatttaaatctttatagaagaaaaactgtaatacacgtttgaaaatcagtctgaaatacattgaaatagcaacataatgaattattacagatacagtttaatttaaaaaaggtaaaatataaattaagcaatgatgataataaataccaccctaacacaaaaaatggccattatatttgataaaatgcacttaaaatatacatggagagtgataatttgactaatttcccagataatcatttctgtataaggaatgatttattatataattatgattaaatctacgttaaatctgattttttacattcatattttacttattatttgtttattttaatgatttatttatttttctaaattatgaatagtcaaaatgactacaaaacaatcctaattaaattcaatttcactgtccttgcagagtgcagacatgagtccagcaagcagtaccacgtcacttcctgttagtcctcttactgaagagccagtgcctttcaaggtaaaaaacaaacaagaaagcattatttataaaaatattaggatagttaataaatagtttaaaatagtttatgtgtagatggtgaagtgaactgctttaatcttcaagggtctgatttcaaatcttaaaatcgtttttttgtgtgttccattgtcattctattgctaactaaaggtaaaggtttgaatgataattaatactttatgggacaattgtttgtcttacatgtaaatggtggagttttattgtaataggttgattcacatgaattagaggttttaaatattttgtttatagtaattatattaatataagtcataggggaaaaaggaaacattcagccctcatctagtggttaaattttcattagcaatgctaggttaccaataattaatgatgtaatccttttaaaataagagtcaaaatcaagagttgaaatatggaatcattccaccaaacatattgtatttaataaatattggagtaaatatgcaaataagtatgtggtatgactggtggcatttttttcactttgggaagctatatacataacaaatacgaagtcttgttttgccacttaagattagatgtttctatttaagccaaagcttgtagatcaactattttatgtttgtactggggtatttagatattattaggattattataaataaaaacaattcttaagagcctgaggaaaaaaacttaaaacgttgggatgatgtacttaagtgcactgatttcagtatagtttggtttaaagacgtgcacattttaagattatcacttttatgactgcaatattttaacatacaattattatgagagttttttatttttcatataaggaatgtatcttattcaattttatattgcttatacctagtacagttgctggcatggattttcatatattcaatattgctgtcttgttgaaatgataattatagaaggctatgaattcaaatgagagtatttagttttctaattatggacacttttttgcttaatgagagtcaaatatttgttagaaggccctttctatacctgctaattgttaaatactgaatgatattctgattacattatttattgaaacattttctttattattatacagataaatgagaaaataatactaatgctacaaagtttgatgttaccgttttatggtatatggaacaaatttactgaagaagcatatctttaacaagattttaattgaattctcaaaacttcgccagaaaccattttttctttttaatattttgacaatgattacagtctttgaaaattaatgtattttttaacagaggttaaaaaaggttagacatatttcagaatctgctgacataaagctaatataaatataattagtttctctaactggttctgagagatcaatagttttggggtaaatgtaaatggttctataagaaattaaaactttcaagtgcttataatatttagtattgtcttttgatggccaacatagttatagtgacttttaatttactccttttgtgaaaggaatattgcctatatcttttcaaaatatttaatcacctataaaattatcccactagtgtttataagtatctaaacttaaaaatcaaaattatgaaataaaactttatctgcttctttcatttttagcttataaattgtcattgtgtaaatgagtaatataatacttaatgttacataaacacaaaatatacagaactattttgaacagaatcttaacagtataaagcattgtaattccaaggatatgttgagaattatataacaaatagaagacatttaagttttcttataaccacattctgaaaaagtctaatattataattcagatgtataaaactttgattaaaattatgatatctgaatagctaggtaactagaaaataaaaggttgtctttttcacctattccccatgaatgtgacatgatatttcatgttagtattagattaatcctcttaacctcttagcttacttttctaagatacagtgatttcagcactcaaccccatcacaatccaccctaacattagaagagcaaagcttcttctaatattggtgggtgattgagggatttgattttcctttttcttctgggaagtaattagattactagaagaaatgtatttactccactttcttagtcagttttggaagcactcagaacagttggaggaagataccttgttttggctggtatgtttatcaaggtgcatacttttttttaagcattacctttagaatgacattcagattaagttgaattcaaccacatcatttgaaataaagacaaatggtaaattatttttataaaaaataaatacaaatactttcccactaatacccatgcctttattcttgaatgttagataagaaattggctattgttaggaatgtaccatagtaagatatattaaattaagtatggaaaaaaagatggcatcctagggactatcccaaggtaggttaaactttagagatacatgaatttaaaatggcagttcagtcttgtttgggatcaaatgtttattttttccaatatggcagcatttttcaactttgttagtattggagcccattctttcaattaattaaaaacgatctgccctgaaagatagtctaagccccacatacatactcacttctctattcccccacactatggttcagttcctgctaatctcaaatttactgtttaaaaaccattgctagagtggtttgattggtgtagctagcctttcaaaactgaggacatttcacacaaaaattcatccaactttgtcttaaacaattgaaaaatctggaaactttgtggatctcgttgtaagtagaactacttgataagagatgagaaggctttctccatctagacagggtacataaactccaggtcaccacagtcatcaccattcctactatattcatgccaggtgatgaatgcatttgactgtattctttcatagaagatagtgtataattcacaatcttccacatatactacacataataaactccagatttcctgggcagcctcttgatactgaggagtttctaggatgcttggttcaaaaagtttcttttataagaactgtcagattcttttacctttataaactattgttatgggcatctatttggaaacaaaaggcaaatgtataacctctagtttttgttgttttttaatagaatattcagcattatatcaactgtacacacatatggtctgacacatgccactgcatcattatagaagagccaaaggataaccaattttgcataggtaggaacaaaatgttatcaaacatcaacaacagaatcataaaagttcaagatcattaaagtgaaacattgctctgataaaagacagtggattgcttagccattaagttttttatagttttctgaggactaaacctgaacaaaattgatgttgttaattttaatgtgctcattctatccttttctatcttttccctctggcattctccctgatttcttgcaaacatctaatcacttcctatctcatctgcctgacatctccctttgttagccttggtaaaatgctccacactgaagatggcttcaagccactacatttcactgttctttagtaggatgaccctttcaatgttttgtacatatgcagttattagcagcctcagtccattcctggaactaacactcttgaagctaaagctggctcgttgctcctgaccctccataaaagtacaatttatcatgagccatgttctttttgctagtaatgttcatcagttttaaaatttatttgtacttcaatgaagcatgatggctacattttagtctcttttcctacttaagtaatattttttgattagatatgttaggaaatcatattatcctactgtactgtattatatttatcctgtgataaattcagcaggaaaaaaaaacttctattctattgttctttgaacttctgaagacttttgtagcttcaaaagtacacaaaggcattgaggaataccctccattcaccaatccttgatcaaaatttaaaacaaacctaattcattgcatttcttggcccattgactactgcttccctgggatgtttgcattcctggaatgcctagagggattgtcacagtacctggaatgcacaatggcaccaccctctccaaggtatggccacattcccaaggaactgacagtgtggcatttggttctttcctaggtctcttcttcttatgaaatccaaggttctctgacttcttttcctcatccctagttatttctctttagtctaaagaaactccaagcttctctcagagatgtttcttctctccttaaatcagccagggcactgataaaacaatatcaagaataagaacaagaaaaaactctttgatgtactttttaggaatagaattgtgtctgaagattcttctgccgtgacatgaacttaactttaatatgcacagagccactttgcttaagcaggggatagaagggaggaagtagataaataaattgtttcaaaaaatttttttgtaggctgggtgtagtggctcacccctctaattccagcactttgggaagctgaggcaggaggttcgcttgagctcaggaatttgagcccaaccttagcaatatagggagaccccctccctattatttaaaaacatatattctaccatgaaatactggtatgttaagcaataaaaatgatgcttaactttacgtgaccatagagcctggattcaggaattagtaatgtgtagtaacacacagtttgctccctattgtataaaatgaagtgtgtagaaaaaaagatgcagtaaatatagaattatcaatcttcaactctggggatggatcacactattttaagaaaaattttctgtagtttctataatgaccacttatttctatttttaaaacaatgtttatttttaataaagcagaaaagagaattgggggcattagaagcaatgcagtctaattaggaggctgtctgggaggatcaaaccccagttttgccactctctagctatgtgagaccttgagccagttattttgtgtccaaatatcttatttataaaatgacaacagcaactacttcttcattaggttcttataaggttaaacaagttaataaatgaaaagtgtctacaatagcacatagtaacccatatgtaactgttgattattatttttatagatgcaagatctccaagttcaatgcaagaaagtcttataaatactgtagggcagaaattttgccactgaactcctactactttattttcaaatatgaaagaaatatattttaaacataaattatttactttgatgaagattcaagtttaacatttattcctacaagtcatgctatttattttatacgcttgagtattcagttgagctcatatatcagattcctcttatgaaaaatgattaatggaaatgtttattaattttgagaaggagtaaatataatgaatttgtcttgagggaaaactggtaaatataatgaaacactacttggaaaaaatacataatagtttctgtaacaataagaacatatatatattggccgggcgcagtggctcacgcctgtaatcccagcactttgggaggctgaggcggttggatcacaaggtcaggggatcgagaccattctggctaacagggtgaaatcccgtctctactaaaaatacaaaaaaattagcctggcgtggttgtgggctcctgtagtcccagctactggggaggctgaggcaggagaatggcgtgaacccaggaggtggagcttgcagtgagcggagatagcaccactgcactccagcctgggctacagaccgagactccatctcaaaaaataaataaaaataaaataaaataaaataacaaaagaacatatagtatctttttatcaggcatacaccatagcaactttttcttttgttatccaaaccaccacagtaacgtaacctggtaacctcctaaaagcataccttccagtgaaggaatattatttaaccactttagaatactggggaaacacccattgtgaacaaagtgctgctgctgttttacttgtttatatattataacatcaacatagtgagtagtttcgatttatttcatctaaatatatcattatgtaaaagaatacatttggaaactctgaaagacagaagccaaattgtggcatgaccttcacaacatcatctgttgtgtatcctgcatagactcatttttgtgtgtgtatgagagagtttttattgttccttttcatttattgaatgtaatggtctctcttagtattagaaatcgcttttttaatgtatccctggaagagcccattatggtatatttctgcatttctggtcattttttactaagccatctatgcattcaaggatttgttgatgaatcaatttgtcaagtacctaccatgttcttagtaatattctaaggcattggtatgtcgatgtcaacaacacgaactaaatccctgcattaatggtgtttgggttcttgggagaagaaatagacaaccagcaaataaatatataaaatgtcaggtagggtgataaatgttatgatgaaaagtaaagcgcaatatgaaggatagaaagtggcactggagtgtgttggtgtttcaaaaaggatggctaaggaagaccactttgattatggaacattttagtagagaccataatgaagaaagggagaaagccactcatgtttttatgggaagaaacctgagaataacaactgcaaaagcaagagaatactcggtcttatcaggaatggcaaaacattgtgtttggagtagaatgaatgatgagacaagtaatacaagtttaggtcacagagaaatcttatcataaaaggtctagtatgtcatgataaagacttaagatcttatttcacatatgatgaaaagccattagagtgtttgttgaaaaaaagaatgacataatcagactattgttaaactattgctttggtttctgtgtagatataggcattactgagtcaaggctcctatagttgaaagattatgatggcttaaactggagtggtaaaagttgaggggataacaattgattgaatattgagtacattttgaatgtggggtcagcaggatttgttaatatattgtatgtagaatatcctaaaagaacaaaatcaaagatagtttctgatactaattttttaatgttttcctatttttaccctttaggtaactttctgatgttacaaatagatagcatgatacggagattagtaaaatcttatttgtttggttggcttaattgtgttagtagtgaggcagtaattgtgaaatggcagacgatgttggttttgcaggggataatattcaatcctacaagtaatactaatttctggtaatatattttatctgccagataactgaaagcacataggtaaaactaaacataatttgtggtggatgctgataaatcaataattatggtttagaaatatgattcattaatacataggtgaagaaataagcaggtaaaaataaaattctttgagggatagctgatgaattttgaatataaaccatacaataggtatatatttgaggaaccaatgtattttataaaaatcattttaaataaacatggcatcattgtggttctctaatgggaataaattttaagagggttctattatttatactatgtatatttaaagcaattatttttgattgatgtaatacaaaatgatagtttcactcatataattccaagtaataaaccatctcaaaacctgtcagtctaaaataataatttattattgatgtttatgattctgtaggtcgactagactcatctgggcagttcttgtgtgaggttttaaagtgggtacagtcagactgaggttgagaatggggtcatctgaaggctcaggtgaggtagactcccaggataattcctttattcacaagtctggtgttgcactgaaaacactgtacctattgggatttctctctctctctctctctctctctctctctctcactgctctattctacttctgcctccctctttctctcctcagcctctccatggactagcttgagctttctcacaacatgctggttttggataattagacttgttatatgatagttggcttcccctagggtgaatgttccacaggaaaagaaagggaaacatgtcagtctaattaggactagaccagaaatacacagcttcacctccacattgttctattgatttagcagttccagagtgtgtcgacagtccctaagactacccctacattcagagatttgtaagaagacacagaattcaacagagatcacactcgcctctaccagcaatgtgaacagaggacatgtatgtgatatttctgcccagtaaaggccagtagcaactcagcaccaaaggattttactgggggcttatcatgtaggaaccctgtacctagtgtatatccatattctaaactcccagaagaaatcaggtatttaacataaacattattgtacaaatattgtttgtacaaactacttagggacagtgagccaatcttatcatttatggaaatctttatatgtatgtaggactctggttaccagtcagtcaagttcttagataccaaccagtggctaatcttgcaagtgggcctttctaagcactatatattaatttgttctctatctccatcagtttaattattgtaatatttagctcccataaataagaacatgtgtaattttcttactttccttggcatatttcacttaccataatgacttccagctccatccctgttgttacaaatgatagcatctaattcttttttatggctgaatagtgttcattgtgtatatgtatcacattttcttaatccattcatctgttgatagtcacttggattatttgcaaatcttgactgctacgaatagtgctacagtaaacatgggagtgcagatatctcttcaatacactaatttcccttcttttgggaatatatctagcagtgggattgctggatcaaatggtacatctatttttagtttcgtgaggaacctccaagttgtactgcatagtaattgtacaaatttacattcccaccaacattgtatgaaggttcccttctcttcacatcctccaaagcatttgttattttgcctgccttttggataaacatcattttaacaaggatgagatgatatctctttgtagttttgatttgcatttctctgatgattagtgatgttgagcaccttttgatatatgtgtttcccatttgtatatattctttagataaatgtctattcagatgttttggccatttttaaattgcattgttaattttttgtcctatagagttgtttgagctccttatatattcttatgttaatcccttgttcagtgggtggttttcaaacattttctcccgttctgtgagtttctcttcactttattgtttcctttgttgtgcaaaagctttttaacttgatatgatcccatctatccaattttgctttggttgactgtggtttagggatattaagaaatccttgtctactccatggtcctggagagtttccctagtgttttcttttagtaatttgatagttacgtcttatatttaagtctctaatccattttgacttgatattttgtatatgatcagagataggggtctagtttcattcttctgcatatggatatctaggttttctggcatcatttattaaagagattttcctttccccgatgcatgtctaggcacttttgtcaaaaatgagttttctgtatatgtatagatttgtttctgggttctctattctgtcccattggtctgtgtgtctgtttttatgctagtaccctgctgtcttgtgtactatagctctgtaatatgatttcaagtcaggtaatgtgattcctccaattttgttctttttgctcaggatagctttggctattctgggtcttttgtgattccaaatttataaattttaggattgtttttaatatttttgtgaaaaacgtcaatttaatctatagattgctatttttatttttatttttattaatttaatttaattaattaatttatttattttgagatggaatctcgctttgtcgcccaggctggagtgaagtggtgcaatctccggtcactgcaagctctgcctcctgggttcttgccattctcctgcctctgcctctcaagtagctgggactacaggctcccaccaccacgcccggctaattttttgtatttttagtagagacggggtttcactgcgttagccaggatggtctcgatctcctgacctcgtgatctgcccgccttggcctccctaatctgtagatttctttggatagtatggacattttaacaatattgattcttccaatttatgaatctagaatatcttttcatttttgtatcctcttcaatttattttatcagtgttttatggttttcattgtagagagctttcatttatttggttaactcctaggtatttatttttgtttatagctattgtaaattggattactttcttgatattgcaattttcacaattttcaaatagattccgttgggatatagaaatgttaatgatttttgtatgttgatattgtatcctgcaactttactgaatttgtttttcaattctaataatttttttggtggagtctttaggtttttccacatataaggtcatatgacctgcaaacaagtataatgtggtttcttcctttccagtttggatggcttttatttctttcccttttctgattgctctagctaggacttccagcactatattgaataacagtggtgaaagggcatccttgttttgttccaaatcttagacgaaagactttcagattttccccatttagcataagctgtgggtctgtcatatatggcttatatggcttttattgttttgaggtatgtttcttctatactcagttttttagggtttttatcatgaaagagtgtggaattttatcaaatgctttttcagcatctattaaaataattatatgtttattgcccttcattctgttgacatggcatgtcatattaattgatttttgtatgttaaaccaggcttgtatctgtagaatgaattctacctggtcatgacgaatgatctttttaatgggttgttgaatgcagtttgctagtgtgttgttgagtatatttgcatcaatgttcatgagggatattgtcctgtagttttctgttttggatgggtctttgtttagttttggtatcaaggtaatattggcctcatagaatgactttggaagtattttctcctcttccacttttcagaatagcttgaggaggattgatactagttcttcaaatgtttgctaaaattcagcagtgaagccactgggtcctgggcttttctttgcttggagatgttttattacagcttcaacttcattacttattattggtctgttcagattttacatttcttcatggttcagtcttgatagattttatgtgtctcaaaatttatccatttcttctacattttctaatttattggcacatagttgctcatggtaactttaaatttatgtagtatcagttataatgtctcctttttcatctctgattttattggtatgggctttctctctgttttcttagtctggctaaaggtttattgatctgtattatttattttactaattttggttttgattgttcttttctagttctttaaaatgcattgttaggttgtttatttgaagtgtttctacttttttgaaataggtgcttataactataaatttccctcttagaaatgctttcactatagctcataggtttgggtatgttgtgttttcatgttcattggtttcaagcaatttttaaatttttttcttattttaatcattgagccactgatcactcagaagcatattgtttaattccatgaatttgtacagtttccaaaattcattgtgttgttgatttttcattttattctattgtggtcaaagaagataattgatataatctcatttaaacaaaattgtaagacttgttctgtggcctaacatatggtctatccttgagagttattcatgtgctgaggagaataatgtgtattctgaagcctttggatgaaaaatgttctgtaaatatctgttaggtccatttggcctgttgtccagattaagtccaatgtttctttgttgattttctgtctggatgatctgtccaatgctgaatgtggggtgttgaagtccccaagtattattgtattggagtcaatctctctctttagctctaataatatttactttataaatctgggtgctcttgtgttgggtgtgtatatatttacaatattgtatcctcttgctgaattgacctctttatcattatataatgaccttctttgtgtctttctatattttttgtcttgaaatctaccttttctgatataagtatagctagtcctgctcttgtttccatttgcaaggaatatctttttccatccctttattttcagtctatatttgtttttacaggtgaaatgtgtttcttgtaggaaacagattattaggtcattttttttatccattcagccactctatgactttcaattggagagtttatttcatttacattcaatgatattattaataagtaaggacttactcctacttactcctattttgttttctggttgttttttccttctttcctcccttgctattttcttttgtgtgaaggtaattttctctggtggtatgttctgatttcttgctttttatttttctttatctgctgtgggttttttgatatgaggttatcatgagatttgcaagtaacaacttataacccatttttttaaaaaataggtttaaaatgcaatgacaacatggattgcatgaacaaacaaacaagtacagagaaaactattaaaaaccctacactttaacttcatcctccaactttttaactttttactgtttgcatttatatcttatactaactatgtcttgaaaagttgttctagctattatttttgttacattcatcttttagtttttctacccaagttatgagtttatgtaccatagttacggtgttataatattctgtggttttctgtgtacttactattgccagtgagttttgtaacttcaagtgatttcttattgctcattaacatccttttctttcagattgaagaattctctttctttagcatttcttgtaggacaggtttggtgttaacaaaatccctcgtcttttgtttgactgagaacatctttatttctcctttatatatgaggatatctttgctggataaactattctaggatataggttttattccttcagcactctaaatatgtaatgccattatttcctggcctgtaaggtttccactgaaaaggctgctgccatatgaataggagctccattgtatgttgttcctttcttcttgctgctttttaggatcctttctttatccttgtccttttttagtttaattattaaatgtcttgagatagtcttctttgggttaaacctgcttggtgttctataaattttaggtacttaaatatttatatctttgtctaggtttgggaagtactatgttattgtccataccttaatttgtctctctacttcttctttaaggccaataatgcttagatttgccccatttagactattttctagattttgtaggtgtgcttcattctttttactttttatctcccctgactatgtattttcaaatagcctgtcttcaggcttattacttttttattctccttgatcagttcttctgagactctgatctgttcttcagtatttcaattgtatttttcagctctagaatttctgcttgattctttttaattatttccatctatttgttaaatttatgtgataggttctgattcctttccctttgttatcttgaatttcattgagtttccacaaaataactattttgaattctctgtttgaaagatcacatatctctgtttctcttcagcattggccactggagccatatttagtttctttggtgaggtcatgttttcctagatggtcttgatgcttgtggatattcatcagggtctggtgtctgggtattgaagagttaggtatttattgtagtctttgcagtctgggcttgtttttgaacccatccttcttaggaaggctttccaggtattcaaagggactttggtgctgtgatctaagtctttggtcactgcagccatatctgcattagaggacaccccaagctgagtaatgctgtcatcttgcagactcataggggtactgccttggttcttggctagggtcaggcgaatttttttttgctttaccatacagagattcttgttgttttctcttactttcccccaaacatagtctctcccactattttgggttgtcaagagctggggaagtgtgatacaagcacccctgttgccacctcactgggaccaagttgcattcaacccaaagccaacacagcactgtgtcttcccaaggcccactgtgacctcccaaggcccactatgaccaatgcctggctatcacctgtgttcactcaagaccaaaggctctacaatcagcatttggtgaatccagccaggcttgttttcttcccttcacggcactgagtttctctctccctgtagccaacactaccccaggcctagggtgagcaatgcctggctgctgtcgatgttcactcaaggccctgtgctctttcatcagcttatggtgaatgctcttgtcctgagtctctcctttcagagaagtgggctcctgtctggcccagggcaggtccagaaatgccatccaggagccagtgcctggaattcaggaccccaggagcttgtttgttgctcttccccactatggtggaactggtacaagcttcagtaaaaagtcccattttttccttcctctcttcttctaagcaggagactctacccatagccaccacagctgtgaatgtgctgggtcacacctgaagccagcatagctctgagtctcactcaaggcaagtggcaagtactgcctgcctgctactgctcattatttagagcccaagggctgtttagtcagcaggttatgcatcctgccaggactgggtccttccctttagggcagtgggttccctttggcccatggtatatctggagttgtcatccaggagctaggacctgaaaggggggcctcaggtctctgcctgttgccctattctattgtggctgttccaatacccaagttggaagacaaactcctctttactttccccctcctctccttaagcagagagaagtctctcccagagctgcaagctgtgctacctggagttgggggaggggtgatgcagaaactcccttggctgccccagcttgtgtctcattgggtcatgtgcatcttagcttcatgggctccaagtttagcaccaggacttgcccaggaattgcagtccttgtgggctagactgcatttcaagtttatttagtacccccaagctctttagcctgtggtagtggggcttactggaattcaggttccaattgctgggatgagtaattcacctctggctagggctaatctgaatgttccctccatgtcaccaactgagctctgccctgagtcactttccactgtgaccaggcagcactgtgttccaatgctaagttccacaattagtgcactgtacctccttgaagcacacagattctctctccacggcaggtggctgactactgctaggaataggggaagggtggtgtaggtaattcaaaactgtctttcttatcctcttcagtgcctctttactcgatatgatgttaaaaccaggtactgtaattacttacatgagttttggttcctatgaaggtgcttttttgtgtggacagttgttcaatttgttgttcctggttggggggaatgatttctggaggcttctattcagccatattgctccgccttcgtcactatatccctcaatgctattttaatttccgttaagtttggaaatttccattaaatgtcaccatatttaaattaacttcaaagaattatgttttttaaaagtattttacaaaataatggataaaaacactaaaagtaaattctaaattgagatatcaactaccaaacaagactttatatatatgtttatatattattatttggtgtcaatatttttttctcttggttcagtcaagataaatttagaataaatagtatacctattatttgactattgcagacagcattactgatggatgatgaatgctcacatagtaagaaaaatgagaattatatcctggtaagacaaataaaattatttttacataaattaaagtcaaaatgaattttgcttaatttgtgttaaaagatatgcaatatctcttagacatagtagacctctgggaaaaatatttcaagaggaaaacattagcaaatactttcatgttgtctattagcatcatattgctgttcaaattattctcacacactgtccaaatcatttcagaaaggttggtacaagataaagaacttgtcaacattaatacatactaaaaataatggcatacctcttcttccttctacagttcacacattcattttctgtcttaaatttaaatttcaattagtttttcattttttccaggttggtgtcttggatttctcctgttttggggttctttaagtagtactgatagaaaattttctttgtaaaatggcttattttaccatgccttcagatattgggtcatagtctgttttgcttactttaatcaaaggattcatttaagaaattttgtggacaccattttctgagcatctattaaaatattatcttggactattgaatttaaggtttcactttgtgtatcactgagttaaacagggccctggaaatctgaaggatatatacatttggattgctttccttaattggccaaagtgaggattctgtaggataagcttgaatactgcggtagagttcaggtacagaacatgggaagagttctgaattaatttgtatgtaaaggataggtgttgaactactgctagcaaaattttatagccaataaagggcttaattataaggaaggaaaaaaatatttatatgtttcttcaaacaaaaagaattttaagaaactgagtcattataacctcaatcttggtttgagaatccacttcagagtagattggcatcactgaaacattttttctgtcaaaagatgccagggcagttttatttgaaaacagttgaaaccaacatgtattcagttggatggtgttctgttcctgaacacctgttgctctcaataatttgaaaaaccttggtgtgagataatagcagaggtaacaatcacaccatcattcttgtgcacaccaatattaaggttttaaaatacgtgatatatacatcagatactgaatctggctgggaattcacactgttatatttttgatataatatcattatcaatgataatttaagcaactgatctcatgtatagcacttcagtgtttatttcttacttagtattatcatttcatataaactccattatactcatttttattgttttttacataatttcaaatattacttcacagtttacctataagtgtgaacacgttttttaaaataagaagttagtaacccaggtgaaattcaaagactatgatttactactaatgtgctcatttgagatagaccgtgaatatgagaagctatcatatatggattcagcatgagttcagtttatctggcaatagttccatctgttgtattttgaaattgcctactgtattagttcattctcacactgctttaaagaactacctgagactgagtaatttataaaggaaataggtttaattgactcatagttccatagaccatacaggaggcatgcctagataggcctcaggaaacttaaaatcatggcataagggtgaaggggaagcaagtatgtcttcaaatggcagaaggagagggagacagagagagagagagagagaaaagggggaagtgctacacacttccgagcaaccagattttgagagaactctgtcacgagaacagcagatggaagtctgtccccatgattgaatcactctcccaccaggctccttctccagcactggcaattacaattcaacatgagatttgggtggggaaacagagccaaaccatatcatctacttaaataaccattgaattttagaggttgaatcatatcaatatgcatgctatagactgaagatttatgttctctgaaaattcaccttgagatttttacctccaatgtgacaatattaggaagtcgagcctattactatgattaggtcctcagtataaagcccttatgaatgttattagtgcccttataaaacaggtctcagaaaatgctctcatcccttccaacatgtgagcactcagagggaagattgctgtctgtgaaccagaaagccctcactagcccctgaatctgctgacaccttgattttggacttcccagcctctagaattgaaaaaaataactttcaattgtttagaagccacccagttaatggtaccatgttgtatcaaataaaatgtaataaggaattaaatgcaattaattttgccatgcatgaaattctttggaaatgactgttttccttggtgactctatagtgctaaaataatattagacttaagtgttttataatgatattgggcttatgttgttattttttgtttcgtaaaatgtgtaattcaactactgtttttattgtaccatgtggatgcattaagtagccatgctgacagatgcaataaaatgagtaaaataaacaaatattttgatttttttaagatataaatttagcctttttttcactgcagttttcataccacacataagtaatttggcagatattctattatttattgttatttccttaggaaaaattggcatgttgatggcacaaattaaaatttggataataattaggagtaaataagataattcaatttggtcttgcctacaataaagatattctcaatagcttaggaatataatgaataccactttaaaatgcattccaaaagaaagaaggaaaggtacaatgtgttttagcagaaacttacttgtgtccctttggttagtggctgatacatagcacagaaattagaaggtaaacaattgccagatgaaaggattaaattataactaatagcaaaaattttgaagatagatataatttgaatattctgagaaactgttgatgtcagattctcagctaaggaaattatctgctttgaagctcttcagttatattattagcagtcggtttatgtctttgtacatgaacacgtcttctttttctcacatagtttattttactttagtaaatctgatgggaagccttatgtcagaatatgtaacaaacattgattcttgtaggctaaacttattttattaaaattatgttgcatatgcttcttattaagaataaaggtttatttagactagttaggacctgcttaacaagaaagacttcggcagccacctttaagcctgaagctttaaaaatgctgagcaaaattgtcaaagcataattaagggtaggggaattaagttcacttttctcccctaagtgtctttgccagagacagaaacttcaacaatagagctaagtggaaaaatggagccatgtcagttaccacaccatgctaaagactgattagtcataatttttggtaataatgcccacaggaataaacctgacaatggtgtactctcttgttagcattagcccttttttgtccccatttttcttgctctttcccatgggcctggtcacttagtgatattagttttaaaagtttcatttctcaccatttctgctactttcttgaatgtggtgagtcatgcagaacaattaacaagcattaattgaggttctcttatgcataagattttatgtaaaggtactgggggctgggaatattttcttatgactatggaaagctatgggaatagtgacactggttgtatttgcacacggcctggaaaagtgcaaagtattgggagttgaggagagacaaatgtcctgaaatctcagctgaaagagcagaggccttgtgctagaccctgagggtacagaaactatacgtattcggttatgtgttgcctgtatgatgaggaaaaacttagactccattttacaggaagtaaggtaccggaagtggtcaaaaattgagcaagtaataaaatgcaaaatgaagaatattttctacttcttgagtttgaattccacagaatgagttttggactttatttgaaatttgtcaattgctagaatatcaagaggcactgatcaaataaaaattattttaaaaatgaatacttcttatataatacactattgttggatacctatatctgcatatgctctaactaggatgaaaattacctatattcatattaaaataatagactttacagatgatctagaccaggggtccacaaccatcaggccacagaccaataggaaccagtcacaaagcaggagatgaccgatgggcaagcaggcattaccacctgagctctgcctccagtcagatcagtggagacattagattctcatatgagtgcaaaccctattgtgaactgcacgtacaagggatctaggttgtgtgatcctatgagaatctaacctaatgcctagtgatctgaggtggaatagtttcatcctgaaacaagtcccctatccatggaaaaattgtcttccatgaaaccaattgttggtgccaaaaaggttggactagtgatctagactatcgtaaatatgtactaaaaattcatacattttatatatattatatatatatatgtactgctatatcttaaaaagttatagtttattagtttcatattgctgctgtaacaaatgaccacaaactcggtggcttaaaacagcacacatttagtatcttaacaactctggaagtcagaagtcagcaatgggtctcatggaaagaaaatcaatatgatggcctggtcgagttctttctgaaggctataagggacagtttgtttacttaccttttgaacttctagaagctgcctgcattactgggctttgtagaccccgtctatcttcaaaaccagcaatggcctatctcaagtcttcctcatgctgcatctctctgattctgagtcatcttctgtctcccatttttgacatttaaggaactttgtgattcactgggtccacccagatagtccaggaaaattctattacaaggttggctgattagtcaccttaatttcatctgattctttcattcccctttgccatggatatctgtcgaatggggcgggaagcgttattctgcctgtcacagtcagtaatatcacacaagtaagatcaggattttatttcttaccaagtaacttttgttctgtccataaatattgagctgcttgtgtaagtatttgcaatgcacattacttttccccctcagtggttgattgttatattaatacagagaaaggaatttccattgtgctgaattacacaagctatttcttttatctttttttttttttttttttttttttttttgagacggagtcttgctctgccacccaggctggagtgcggtggcgtgatctcggctcactgcaagctccgcctcctgggctcacgccattctcctgcctcaggctcccgagtagctgggactacaggcgcccgccaccacacccagctaaattttttttaattttttttttctttagtagagacggggtttcaccgtgttagccaggatggccttgatctcctgacctcgtgatctgcccgcctcggcctcccaaagtgctggggttacaggcgtgagccaccacgcccggcctcttttatctttggtatatgtttccaactcctatgcctagaaaacttgtactttccatttagtgcccaattcaatgccatctcctctacaagaattcctccctgaagcctcaaagtagtttaatcaaacttctaatatggaaccataaaattatattgtaattatgtttatttacaatttcttccaatagatgcaaatgttcttaaaggcagatatattttatattctttatattccctatttcagttcctagtatagaaccagtacatagtatactgttaatagatgaatgagtaaattgttaaatgaattaatgatgaaaaaaattcacttaagacctctcatttcctctcaaatattttatcctatcttacagtagtgatttaataaaatatccatttaataaaattagccattgggaacttaaataatacaacaaatcctatcaagctatacacataatatcagcctaccaagttttctataacttatcctcttttttctctaccagtgtcagcatagctcagcctatcctaggtccgaattcattttgagactctaacttggtgtagggaattcagtgtcagattgtctttttctttgtcaggatcttgtcctccattctaaaaacctggctgctgccttagctggtatttatctgataatcagtgtctgagataactgcatttctgttaactgcctatttgggtttataaatattatctttttcaagatcttccataaccaagcactgaaagttttaggtactgaaaactgtctgtttgcttagattattcattcttaatacaccagactattgtcttactttacagataaggaatttgaagcttagaatagttaagtatcctgactgcaggttgcaatgctggtaaatgaccaaaatggcatttcaactcaggtcctaaaaattctgaagacttgttttaactactgtactctactgttttaactactgtactattttattttaagcattattctgactatccatttgcttgatataactgaggagtggtaaagatcaaagtagaggaagaggcagaggtagagagaagagaaaaggagggtaagggaggagatgggagacagaaaataaaaaaagaaaagaaaagagagaaaaactatgagaaaacatcccactattaggttgggcatgtattgagatcataatcctaacaaggttatgcatttcttttattaacaaacttaataatttcgagccatctttgcagttctagaatgaaagttacctgaaataatggtcagttttcctagatgcaggcaaaataatttgacttagtttaaacagaaaggattttattatagaatatttgatagcttacaaaatttcttggaggtcagcaaatcaaaatttcttggaaagtcagcaaactatagcaacaaaataccagacaagatttctgcctggaggggataaactgcggagctaggctgagagcagagaaaaaaaaagagaggtggaggggaagggatggggttatggaattttcagtgtttagtatgcagagtttaatttaatctacctgttttcagtaggatattctctttctcggttttgcctgatgtttcttcaatttggagcttatctaattttcttttttttttctttttttaaattttattattatactttaagttttagggtacatatgcacgatgtgcaggttagttacatatgtatacatgtgacatgctggtgcgctgcacccagtaactcatcatctagcattaggtatatctcccagtgctatccctcccccctccccccactccacaacagtccccagagtgtgatgttccccttcctgtgtccatgtgttctcattgttcaattcccacctatgagtgagaatatgccatgtttggttttttgttcttgcagtagtttactgagaatgatgatttccaatttcatccatgtacctacaaagacatgaactcatcatttttttatggctgcatagtattccatggtgtatatgtgccacattttcttcttttttttttattatactttaagttttagggtacatgtgcacattgtgcaggttagttacatatgtatacatgtgccatgctggtgcgctgcacccactaactcgtcatctagcattaggtatatctcccgatgctatccctcccccctccccccaccccacaatagtccccagagtgtgatattccccttcctgtgtccatgtgatctcattgttcaattcccacctatgagtgagaatatgcggtgttgggttttttgttcttgcaatagtttactgagaatgatgatttccagtttcatccatgtccctacaaaggacatgaactcatcattttttatggctgcatagtattccatggcgtatatgtgccacattttcttaatccagtctatcattgttggacatttgggttggttccaagtctttgctattgtgaataatgccacaataaacatacgtgtgcatgtgtctttatagcagcacgatttatagtcctttgggtatatacccagtaatgggatggctgagtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatgtgcatttctctgatggccagtgatgatgagcattttttcatgtgttttttggctgcataaatgtcttcttttgagaagtgtctgttcatgtcctttgcccacttttttatggggttgtttgtttttttcttgtaaatttgtttaagttaattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccgttgcttttggtgttttagacatgaagtccttgcgcatgcctatgtcctgaatggtaatgcctaggttttcttctagggtttttatggttttaggtctaacgtttaagtctttaatccatcttgaattgatttttgtataaggtgtaaggaagggatccagtttcagctttctacatgtggctagccagttttcccagcaccatttattaaataggaaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtctgaagtcaggtagcgtgatgcctctagctttgttcttttggcttaggattgacttggctatgcgggctcttttttggttccatatgaactttaaagtagttttttccaattctgtgaacaaagtcattggtagcttgatggggatgacattgaatctgtaaattaccttgggcagtatggccattttcacgatattgattcttcctaccccacattttgttaatccagtctatcattgttggacatttgggttggttccaagtctttgctattgtgaatagtgccacagtaaacatacgtgtgcatgtgtctttatagcagcatgatttacagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctcgacatcctctccagcacctgttgtttcctgactttttaatgattgccattctaactggtgtgagatgatatctcattgtggtgttgatttgtatttctctgatggccagtgatggtgagcattttttcatgtgttttttggctgcataaatgtcttcttttgagaagtgtctgttcatgtccttcgcccactttttgatggggttgtttgtttttttcttgtaaatttggttgagttcgttgtagattctggatattagccctttgtcagatgagtaggttgcgaaaattttctcccattttgtgggttgcctgttcgctctgatggtagtttcttttgctgtgcagaagctctttagtttaattagatcccatttgtctttctgtagagaataaactcctagtctgctagggacggaaggagaagttgcttgggtgcatggagtacttttagctaaccctctagttgccagccccatctttactcccactttgttaggtgcacagcttttctaaggtcccagagtaaatgtggggttgtttgagggcaaggaggtacactgctggctcaggtttcagatttcttgagactatttgctttccagtgtatgcgtttattttttcttcagctgctgccagctctcaaagtgctcaaattttacagtgaacttatcttaaaatgctcctctctttatactttctgccgatatagagatatttagtattaatgttcatttttaaagaattttgaagaacaattctatgccaaaaccaagctgaatactgtacacatgatcataaaacatagtaaacagtatacattcaattttatatgaatattggtaaatggtgtctgtatctttgtagaaaggaccaaattgcagttagcattatgaattttcatttaactttttaattttcttgttacatagacactagtcattaagtgtttaagaagagatctgattaaataaattggaattatcttttctttgaaatatatcttaattaaaccctgtctattatgaaaatatcagacctttattagtaatcatttctatattatgctgaaaataactttttttaactctgcttaatttatttcatgaaaagatttaacgaaaggttcagtgaagttttgcaaaaattggtgcataaactcagatatgtaaagattcacatattctaaaattttctccttcagccaaatataaactacacatataaaaaagtaagacattgccataagccccatggtttaataacattgctccacagtcttatgagtttgttttaaagctttagtcaaaaaatacaggatgagatttgttaatatacacaaaatttagcttttcaatgtgttcatgttgagtaattaggttatgtgctacataaattaatacatttttatgtggtaaaaacagcgtaagtggtaacagctgcctctaaagtatctttgttcttattcagatttaaattacctgttgatttgagtaagtaattataattttgtcctaacactgtgtaacatatggtgtttacattcttctcaagagctccttgagggaaaaaaagtacacagaaacatcaatataaatagtgatttaagaaaccaatgaaaaatatttacaaagattaattgtagttaataggatgttaaatagttgttaaagcatttgaatttgtcttattggattattgacttatgatattattttctattgtttgcttggtgttgacgttgttacataacatattcattttgagaaatctgttttccaaatggaagtttattcttttattatcatagaattcattttaagctatgtgttcctttttcttaacaacaaagcattattttacatctgtgtttatattttagacttagcatataagatattgataacctagcagactttttaaaaattaaaaagtataggatataagatttgttttaaaaccttttaagttataagtctattaaaatttctaatatatttaggtataattttagaatggaccatgttccaaatatttgctcaaaaaattatttgtttagaatgttgtccctgctaagccacaaagtgcccttgaacatgtggtttatctaaaaggtagctatattacaagctttaatttattgagcacttccaatgcgctagacacattttaatttgttttacatatgcttttctgaggaaaactttacagcgactccatgagttaagctaggcattttcaacctcatttcctatgaggagaaacagactcaaatactttaatacctctgatatgcctccaataaatggcagaaccaaaatgatttcaaaactcatgcctgtaagtactatgctatgctacttctctaatagaatatatatagttcttttacaattgcagggaacctttctgtttgtgtggaataattcattacatattttgccttggcatataagaaacactgtattttgaattcacaggaggggagtctttctaggttacttccaagggcttaggtaatttgggcctgagtcatgtaataacctacatttgaatcagctatgtaggtaatatttacaattttattattacaaattttggtgctctaattttcagtttgtcattttccaaatagtgggggcagttttcttcctgggaggtgaaagcgttcgagtttgatctggagtgatgtgaaccaatgtgtaaatttgtatttcccttcatctcacatcttccccctacagcctcttctccagatatactcatttcctgggtgatttcatgccatctattgacagatgcctttcaattatttatctccatctcaggtttctctaagtttcagattcatatattcaattgcctactcagtatttccacatggatggctaccaggaatctccaaattgataaaaaccattcaaaacatttgattctcatcccataatacctactttgctattttaagtttatttctatccaagtctccaaatcccttttccaatctcaataaatattttcatttaccatttcatcatataaaaatgaaaaataattttttcctcaattataagttcttagttggaccaaaaggcagattaacaagagaaacatagtgtattaacatgtgcactgcacatgatgtgagagaaacctcaacaaagcagtggcttagaacttctggcttatatagcatcttcaacaaagaacagtaaatttatagagaaattacagaacagaggaaagaggttttagttttaggagaaaactaatggtgtaaggatcctttgtagattcccctgttgcctctctaagctgataagcatcagaattgtctctggtgaaggagaatgcatatcctgcctttaggcagaaacaaacagaaggtatggagagctttcccctcatttgcttctcctttaatgtccttcaggtaaaaataaattttatgtcaaagaggcaattttggggtgacattttggtttccttcagttgctcaagccaaaaataagagagagagaggaaaaagaatagaaattcatacttgatttttcatactctttctcacacccattctgtgagcaattctgtgagctctgtgttgagaatatataaatatattccaaatctgtctgtttcttccacgtacactattatcagtatcatttctcacctagactactgcagtggtttctttgttcccactcttgtctcccctgtaattccatttcccacatgggagccagagtgatcttttaaaaaaataaattggattgtgtcattcccttgcttaaaacactccagtgccttcatatcaaacgcaagattaaagtgaaactgctttctaaggccttacatgttctaccccatggcagcttttccaatctcatctctgatttatcttgcaagtcttttctagatctggcaatgctggccttcatgttgttcctcaaacatagtaagttctctccttcatcaggatagtcatactaatgttttcttccgtctgtatcatcctgtcttcacattaccatatagctcattctatcactgtatttaagaatttgaaatcatatcagctaatcaaaggagacttccctaactgcccttctaaaatagctgccatattcaggttcattttctgttttgtttttcttcatggcacttattatttttcatagcacaaaccccttgtgacctgacattacattgtatgcatgtgtttaaaatcagttttgctcagtaaaatggaagcttagcatgggcagggacttattcatcaatgtatctttagctcatgcagcaatgactggcacagaaaacctgtttaataaatatttttgctaaaaaaattatttcatgttgtattttattttaacatatacgtttatgtatatataatctactaatttacctgagtgtgtatgtgtgagcatatatatctatgcagagaggtggggatttattaggagtatattaataaaaatgaaaatatgctattctgtgatgatactcagttatctggtcaaaacatcctttggttggtaatggatttattctgatctagtccctgtcttcatccagtttacacaggttgcatataattagccagacaattttgtgtcattcaagatacaacctggttcagaaaaaagaatcttgaattgtaccttaatgcaacccattacagtgaggttacagtgtcactcacctcggaaacagtgtcctcttgtatatacccatttcttcccttaactacatcaaatcttttttctgacttgaacattttgctagcatttttagtactttgttttagtagaaatagcattcagctgcaaaaataagacaaagaaaacaaaaacagaaaataacagtatcttaaaccctattgaatttaatcttacacataaaacttggtctgaaggtaggcagtctggagagcatagggctgctcctggaagttgtctgggaccctgagtcctattaacattctgctcccctttcctcatctccagcttctgaattaaagaccccattataatctaatacagctattggagttcctgccatcacatcagtgttccagatagtagttgggaggaaatggggaaggagaaaaaaaccatacttgctagctgagttagcttcatataaggagctactctggaaaccccacataacacgtttgcttatgtcacactggccaaacttcactgcaaataagcctagaaaatatagtgtgttaattggatactttgctactccaaataacatcaggatggtataactgaggaacaagagggggtgcatattgataaacaagtaagagtcagtgccagatatatgtgttttttgtggaacttattctactgttgctatagttattggcataagtttattttcccatatttccattacagctcccactctcatacatcacattattctcatctctctgtacctgccatcccatctagcagtgtcttttaaccaatagttagtcagtaaatacttgctaaatttggatttaaatgactcaaacccattagcttgtttcattagcactttattctggcagatgataaaatgctgaagaagccttgtctcttgtgtcctctgcacttctacagatattttaaaaacaagaaaaatgaacgtattctgcttaatactgtatttttagataacaaatggacaaattgcatacttaactttgaatgaaaacccaattgagttatcagtggatttgaaagagaagtattatcaatgcaaaacactgtatactgtgatttgtattaaataaacaaaaacttgaaacttctgaaggaatttgtgaatgaaaggacattagttaccttatgaagttaagcacagggaaatatctaatgatccttgctccttcagctaaattatatgcaataaggaatttacacttctaaagtatatttcctgttttactcaaaacatgttttcattttacctaaaaacctagcttttaaaatgcataagaaggccagccacagtcgctcaggcctgtaatcccagcactttgggaggccaagagggggtggatcagttgaagtcagaagtttgagaccagcctggtgaacatggtgaaaccttttctgtactaaaaatataaaacgctagccaggcgtggtggcaggcacctgtaatcccagcttctcaggaggctgaagcaggagaattgcttgaatccgggagacagagattgcagtgagctgagatcgttctactgcactccagcctgggtgacagagcgagactctgtctcaaaaaaacaaattaataagtaaaataaagcatgtaagaaaacatttaatagaaaattgtttactctctttccaaattctaaatatcatctctatggtttgtataactttgtagtaagtttcataaacataactttcctctccatattcaactcttaatgcaaaaataatacaaacaacttttcaacatttttaggaatgtttcttgaggaatcattcctaaaaatcaaaatagcctatttaagtttttaaattgaagttagccagtaagaaagtctttcttcggtgtcttagtttctaagctcactatagatttgtgttttatgacaatatataatatgtctgattattactgacagccttgtgtcatatgccaaatagcctctaattttaattttgatatatttgtgacacacacctatcaattctcttacaattttttagaagacttggcaagatataaaaattatattcctagttcttgttatgacaaattgtgaattaccaggagacaagaaccgtatacatatactttactgcatcttctaaaatatctagctaagtgccttgcatattttagatttttattaagtacttattgaacaaagtatttcttaagtttcatgaagtacttcttgaaagtatagcagaatgttaggttaaaataatgagataaggaacacagaggaggcttatgtgtactttattccactgatatgaatatattaaactaaaaataaatttatgaaaacttagatttaacctagattagaactttaattaatttggaagtaacttttctttgctccctcatcataaaaaattattttcctttatataagaacatttatcatggtttctttttatttgtctcacttttgaaatggaattggataagagattcgcaaatgacaaagttagaacaaattcagtttagagatcttcattggcttttgtttatgattctggaatgaggcaaaaccccattctataaaatagagtaggtgttccaattagctgagaaaaggagtttggttgtatagacagcaaagggaaagcagaaacagaaaccaaaaagcagattggctgtttcaaagttactgtccttttaaaggttaaagcagatggaactcccgtatcattcaggttaaaactggcttgcttgggatttggctattatatctctcaatcttctgatttataaggtcagataaacaacttaatttcaggttggtgtcatggaactttagcatgagtgacttcattttggtttggtctattgggccttgtacaggagcttagtccaaagcaatggcctcctataaagtttatttaacaaggtaatgagaccctggttctacgtagtgctccagaatcatgggcacttaatccattcaaccaaggaagcagacaagtgccagaaatggctgaagagtccacatcaagttcctaatcagggagctagctgcaaggtagaatccaggaacaaacaagagactagctgctggtgcttcaaactcagttttaacagtagggaagtaagccaaggagcacatcaaagagactgtggagtttttttcttttaaatctcaatatttacttttacatttaaatgtgatttaatggatgatgtaaaaatgtaaagtaggcaaagctcaaagtggggactgaagacaaccagctgtacaatagtccttgtttccttttctttttttttttttttttcttttgagatggagtttcactcttgttgcccaggctggagtgcaatggtgcaatctttgctcaactcaacctccacctcccaagttcaagcgattctcctgcctcagcctcccgagtagctgggattttaggcatgcgccaccacacctggctaactttgtatttttagtagagactgggtttctccacgttggccaggctgggctcgaaccctgaccccaggtgatccgcctgcgtcggcctcccaaagtgctgggattacaggtgtgtagtccttgtttcttacatcaagaaccagaccctatgctcctattaagaagaaaataactgaattatatttttgtattaaaaataatagagatgtgaaattaatgtgtgtcttttatctttgatattgctaatgggggaaataacagtaatttaaaacagtttttttgaataaaaaacttaagacatatatttggggaaaaataaaatgtttatgattcaatatatataaatatccaaatacataaatacatgataggtgatcatttctttgggaaaaaaagacaagcagattaaatttcttaaatataattcagatagcagttttgaaatttactgttcatctcatacttaattttattatttctgaaataagaaattagtgttactatgatgccaaatcaggtgttatttttaagtgttttttccaacatgcactcaatgatgttatataattatgttcagatcaacagatatatacccagtccctctaaccataggctattgtgtgtgattctgcaaagaatgataaaatgagaaagatatagctactgttcttgaggatattaaaatatagtatgttgaatagaaaaataacacaaaaatagtgtagtaggatggttaaaatagcaaactgacagaagtttgtatatctcatggtgatggctaaaggggataatctgtctaaggggagaagggatttaataatatttcatgctattgtatttgaatttttcccattctgttatgttcttttagtaacaccctatacactccttccagtctgttttctctaaacctcccttttgtcttcttactggaacatcttgcacctccttctaagccatccatatgacctttagtcatcctaaattcgaagatccattattaaattctcttagccgtatttctagacaccaacgcttcctcccaagtagtagatatctttcttttatgttaatcctctgtaaccctccaaataagctcaattatgacacagcattggaatgatttcttatgtgtttctctaatagactgtaattaatctgaaggcaagaatgacgttttatttatctctgaatctgatttttcaataaatctcaccaaatggagaggataactagaaaattgagttctttaaagatattgggaataggacaaaatgctacctcagtaaaagtgacttaattttataaataaaacgggattaagaaggagatgaaatagtctcagaagcaaaatagtcagaaccagaattgtgctggtaaacatttaatagtaaatctttgcaaaggaaacaaacaaacaaaatgatttgtagactttgtaaatttctatgttgttattgttgcaccatggccaatttcaagctaccaagtcgtgtctctgaacttggagttgggaaaagatgagcccaatcagctcttgtaagctagtgcaaggcaactccagtgaagaactcacgaagaactagaaaattgtttgtcccttgtagtatcccactgtggttttcacgatctgatactgaaatatgtatacacaaaattgatttaattctttctgataatttctttcgtcttcaccacatatataccacagagatgtactttttaaaaatgaccaaatcaagagcaaaattattaatttcaaaaaatttacaaaatgttagaatttgacttacagaaaattgtatacatatagttaaaacagctgtataaaactacttaatatgaatattttctttaaaattattacattttaatattgtaaaatattataaatgaagtataaatatttcactaagaagctttatggatttctttaggaattttttagtttcactatgaagaaaatataccaagttaaaacagtcttgtaagcaataattattgcctatttaaaataagaaatgaaggatatataatgaatatattagtaaataaagtaatatgtgccatttcgggttgaaaagtaactgtgaattcaaccagtaaattatttttaaaatactgtcaagttctgttcatgtattatatgaatgctgactgtacataattttattcttttttaatgtttgaattaatgacactattaatatcttacagttaacatctagcagaagcagatatgagctaatttgtattttcctgtcatataaaatctgaagtcttcttcagtaatgttaattttatcttgtcattttagatcttttacagcacttaatatcataattgtaaaaatattgttccttattaatatttgaacaaataacaaaaagtaaatccaataatactatttataatttattaggacatagaacaatcattttgaataagctgttattaattagtttatgataataatactagtaaaaaatttcagactttcaatgtatgaaaaatactcagtttaaacaaatagaaatgttctatatcattaaggaaccaaatagtctagtgattaaaaatacaggttttagaaatagatctaagttgaatctatgctctgtttcttgttatgggactacaggtaagttttttaatttatgtaatctctcacttatgagttagtttgatgctgaggttacaaaaacaaatacggccaacaaagtctctgtatgcatgaagctttctgttttttggcatatacagggagcaaacaaatactcatagtgtggtaatagagaagtaatagagaactgcaggaataaagagtaagttatacttaatctattctcagaatcagaaagccctcctgagaaaagtggtatttaagctgagacttgaaggaaaaataaaaattagctggataaatgtgaatatttgaaatgacaataccaaataaatttacagggctctctaaaattaaattaaaatgccacatataaatcccttaacagtcactgatagatgctgaataaacggtagatgatgctgtcgttactaactatggtttgattctctattagactccctaccctcacacttgtatggtactttttggatttatttatgatagaaatagtctaattgtgctcacactgactgcaaaagtactaaaaacacaatgagaccaacaatattatcttatttatctttgtgtcttcatctgatcacactgcttggaatttaaacaggtgttctttaagtcttccttagcaaataaatacatgaatgaatagggaaaatacagcttttaaccattaatacagaagtaaagttttgtgactagatgaagtattgttcagtaaataaaatacaggtttgctcccacttgtcctagtcatttggcctccgagttataggatggatatgtataaattcgattatttattcaactatccatatgccagtgtcggcaatatattaatttcaaatggtaacacagcaatgcactgatttagtctgttggatctgagtaagtgtaatttttaggagttcatatctataaacattaccccaaattgggattgaattggaaaataatctgacacaaagcttccctaaaggcagtgctttgggttaggcgttcattaaataactgaatttaaatggtgaatggactctttttccttctggatcgttgtaagaatagcagatttgagatgaagtgaatttcaaagtgttgcaaatggccaaagtgagaagagatggctcacaccaagagcatcagctgatttctgtagccatttcttaaggaggctgacaaattaacttgagaataatcaagaaaggtcaaattatgatcatctgattattttaaaaggttaaggaaatataaaaacatataaagaaagtaatttcagaaactaccaacatatgaaaagctttaacattttagaagactgatatgatttggctgtgtccctacccaaatgttgtcttgaattgtagttcccataatccacacatgtcgtgggaaggacccgacaggaggtaattgaatcataggggtggttacctccatgctgttcttgtgatagtaagtgagttctcatgagactgatggttttataaggggcttttctcccttctatttgacacttctccttgctgctgccatgtgaagaagtacgtgtttgcttcccctttcaccatgatcataagttttctgaggcttcccagccctgctgaattgtgagtcaattaaacctgtttataaattactcagtcttgggtatgtctttatcagcagcatgaggacaaactaatacagagacaaacttaagttatatgtgttacttgttggttctccttagttgaatcactatttttgcacatccaggactgccttctctctgtcttcttagtatcatctcttgcactaccaaccaaaacagttctctacagcgtagccatagttatcacttacaaataaaactttgattatgcatcacctctgtaaactgtttatggcttctaataatagcacttagataaaagccccaaatcctttttgttatttcacacaaaaataaccataccaatttttgtttgatatgaaaaaatacatgtagtgggctgaaaatggttctcccaaattatcatgccttaatccgggagcctgtgtatgttaccttacttgaaaaagggattctttgcagatgtgaccaaattaaatatcttgagatggggagattatcccagtgtatgtgggtgggtcctaaatgcaaccacaagtaagagagagacagagagagatttgacagaggcagcagaagaggagacagtgtgacaatggaagcagagattgagtgatgcagtgaggagccaaggaatatgagcagtgatcagaacctcaaggaggcaagaaacagactgctgtaaatggtcaaagtgagaagagatggcttacaccaagagaagacattaaagcagcagctgatttctgtcatcatttcttgtactaccaaccaaaacaactctctatagtgagaattgtcataattttccttgtgaatttgcatattttcataatacaagctagggaacccactaccagagaaaggggcttagttccacctattgagtaccttaaatcatggaggactcatgggtggagagaggtcaagcagtagactactaatcttacacagcctggaagatttgggaggagagccatttgtccctggtgcttcctgcagattccactatttttaggagccagtgaagcaaacagatgcactgaaaaacaatattaaaattgtttcaatgttctttcaattgaattttaactccaagtactcatcctttagtgatggtaggaagtataacttcagttatttgtgagttatctcaaccacagagttttgtcagtgtcttgatattttacaaacaatgtatccattggaaagtcccatcgagatgttggtaatcagttcacagagcacatcaaccatttaagtcccatggctctgcccgtttatgtcccacagttctgcccatttcatgccgtgctagagatgtaagcactttgggaagaactagaaactcctctgcctaggatctagctcattaagtcaagagtgaacaaggtagctcttcctcactgagtctttgccctctccccagatgatgccaggaacaagcactaggtctccttcattcattgaaccaatacacttcttctcctatctactttaggaatttttcctcatttcctggtcatccatttctcaaatgttttcttataactttccggtgtcctctgcattagcttttaaaatgtttatgattttataaagagcttctaatttcacattgattatttcaattaaacctaattccttgcttaaaatgagaggaaagaaggaaaacatatcaggaaaaacagatatttcaacagttcactaagttatattgactcaccaggttgtgttctcctgtaatgtgtttctcctaccacttcatcctctttttctgaacacccaatatacttctagaacttgtgccaagtcttcccttcgaggtagattgtaaaaatcaatgagagcaagcttgcacttaacacatgattatttaataaaaaaaagagaagtacttcaggagatgataccaccaaacagaatgtgttttatttgtttgtttttaacagaattagttttgactgatagagtataagtagaactataatccatgaagccattcatctgctatacagaaaaatcaatgcttggtctttaaatataaacatcgtcttcaataataagactgaatttatggaatgcacaaataatactgattaatttttcttaggtgttttatacctacagagacatcaattgtcacccaataatggtggtttttggagtataggctgcatggatcataatggcaaaccttatttaaacagaaagaagagcagaatatcagtcataatgttttctctgtaagaactgaaaaattgaagtaaatatatgaatcttaaaatatcaattgtaatattggcttttgcaactcaggcaattataagatataggacattttaaagactaatgaagaaaattgtatttaatttattctaagttttaaaaactttatttttctcaactagagaattagttgaaagctcccaacccatgatttcctaaaaaagtcacatctaacttagatattggtagcagttcatgctctttttaccgctggcttgtgtcccttccaaacactttaatggtattttactgttaaacaatatatatttctcaccacttgaaaaactaattcaaaataatatttctttattctatgaggtctctcactattgtcattctccttttgtggcctatgctcatttcttttccccaatgaaaagtagagaaaaaaaatcatgacaaccttgtgtgtctgcaagtctctgtaaaatgcctccatccaagtttccttccaatcaggaacataattcttagcaaataggtcgctaactcacttaattaactctctgctatgtccttagaggagtttctattatcaaacttgaattggaataacatttaacaagctgtacaaggcctttgggaaacctgtttttcacaaaaatggcttcttaaatgggctttgatctccttaaaggattctgaattactgcataaaatcctaatgcacttattaacgatgcatatatatgcagattttaaacagagtgaaagataaatttcttttctgcctccttggggagcatcctaatatggattttctttaaacatttcttgacctattgaacatttgataaacaggtattttacccaaagctccctccagatctttgacaattaagaaataacataaaaacctatttaggattgcatcgtactcttctctgttagtatttgggatagagatttgaaggagagtgatcctgttttccatttttcgtctcatataattttttttaatgcttactctttgtcagtcactccactatagacagggttgcaaagtcaattaagctatggtttctttgtttcaggaaactgcagactagtgaaaagtggagcagaagagaaaaaaataaacaaagaaaatatacaatgataggccagactgatacattgataaggcttataatagatttttacctagatacaagagtcagacatctaatttagaccaagagaggataatattgtgagttgaattttgcagaatgagtcatatgttactgaataggagaaggctatcctgagcagaaagatggatatatggaggtaagcatgacctgtttgagaatttttaagaaatttatgactgtcagctgtatgggttcctctgagggttggtggttgacaccaaagaggttagcaggaacattaaaggcattgtaggaaaaaaaagggaaaatgtgtgtgtgtgtatgtgtctgtgtgtgtgtctgtaattaagtaacctagagaggaaattttagagcataaatttttagaaatttggggacttgtcatatgccaaaatctagacaaagcaatcagtgcctatcaaccagcctacttatatttgaacatagcagatgagtcttcctagtgcagatgaaaatattttctatgtgtgaaaataacttcctgaaagttgtgtccacataatttcccaagttcatatataacgttctttatgcagaaattttatttacaactgaattcttgaggatcacgcctactaagtaacaccaggtgcaactaaataaagagaagtaaaatatctgaatgctcacccagaaagcgatcaatctatttcattttaatatattatttatatttagtgaatatacaaagaatatgtcacaaatcattggccaggcctggtgaatgtggacctatagtctcaactactcaggaggctgaggcaggagaattgccagagcccagaagttccaggctgcagtgagctatgatcatgccactgctgggtgacaaagcaagaacctgtttctaaaaaataaaaaaatatatatataagcaaaattaccttgtcattatgtgatgccatctggtattgaaattgaattttattcacacacataatttaatacagttttttaaaaatttctggattccttctctatattcacacattttggcaataactcatacatattttctctccattgatacagaagtagggacactgtaaagatataaaacatatatgacatctaagaacccttaatatttgttcactagagctcatacgagatgtgatctatactctgtagtttggagagctaaagcaattcataactactttagcactcagttcaatttaagatgaattgcctgtcttatgtgaatgtactactgagcaagctgaatgtcacttatctgatgaaagaacagtgcccagctatctcacatacaccctgtgtatcattcaaacttggaaacatttatatcatagtcattatcttaaaatcacagtgtttgccaacaaagccttccggcttgattccatagaaggacatttaaaaaaagatatggcataacagattcattgtcctgcttgtatgtgtttctaagtttgttcttttttttaggtaaaataaagaatttagcagtagtgcaaccattcacagttctaaaagaagcaagtgcaaatgtagagcaattttttttttcatgaaaggcagcataatgtgactgcacttacactttggatttgcaatttcactgatgatctaaataatgccattggtttaaacagttagttgctctactttgaaaattacctttgacctttttctcactagatatcaattgaattccaggttgcacatactgaactaaacgaggtaattgctctggccttgtgaacttaaaaggcaacttctttgtgaatgtatttgttggtatcattaactggatctaagaaaatataatttttataaagttagatcattcatatctaagttgccttttattcatgtggcttagtaaaagttaattgtactttcaaagtaccaaggcaaataaacagggtaatttttttttaaagggtctcgttctcgctctgtcacccaggctggagtgcagtggtgctatctcagtttgctccatctccagggctcaagaaattctcccacgtcagcctcctgagtagctggaactacaggtgtgtgccaccatgcctggcttatttttgtatttttttgccatgttgcccaggctggtgtcgaacttctgggctcaagagatccacacacctgggcctcccaaagtgttgggagtataggcatgggccaccatgcctgaccaaacaaggaagttctaataggtgtctgtggtaggctctaagattgccccagtgattctcccttctcagtgttcatgatcttgtataattcctcccctgttgacttgctccacatgaatagaatatggaagaaataagttgtcactttcatgattagtttacaaacaactgtggcatttgtcttgggtgctctaactcaccctcccttggttcactcactttgggagaagccagtactgtgtcataaggtcaccctgtggagaggtccaaatgactacttggaaacaggttttctgaagcctgccaacgaccttgtgagtaagtagatgcaatctttgagtcaagctttgggatgattatacacctagccaggagttagaatccaacatcatgagatactgagctggaggcaccaacataagctaggcctaatttctgacccacagaaactgtgaaataattgaaacttattccatgctgctgagttttgtgataatttgttaaataacaacagatacctatatagatttttattctgagtgtaggatgctgctgtaataagtctaaaatatgaaggtaactttggatctggtcagcagatttcaaggagaatgttagtgaaagtggaaagtgccttgacggagctattgttacatgtctcatagttttcaataaggctgtaggttaggactttcagaagatttaaataaatggtattggaaactggaggaaagataatccttgttatatagtatcagaaagtttaacaacaacattgattaaagtaaggcagaaaatagaaaatgtgcctaaaagactggacgatttgcctaaggagatgtcttagcaaagagttgaaggtgctgtctcgttttctctagcagtacatctatagagtggggagataaattaaaggaaggattgttaaccaaagaggagccagtacttgtgatggctttgaaaattctcagcctctctagaaatcaaataatgctaaatttaagaaatggcttcaatcaaagatcaaattcagagtacttccaggaaaatgtagtccaaaaatgaaagtgagggtatacataaaatcttttgtcaagacctcagaaagattaaagctggtgactcagaaagcccttaaagagattaagagcataccctctgtgtcctctgaaacattattatagcttctagaaagtttaaagacattattgctcatccatagaagtaggagctcaagatagagaagggcttatctcaagagatttttgaatgtggcttttgtcaaatgatataaaccccaagaaacttcacaggagacccatgaagttcttaagttatagatgcagaaacattttcagcttgaacaaagtggggaacagagacagtttagaattagaagaaaccgtttgggctctcagaattatgctgatagggagtagactgagagagctgctcaactgaatgatgactcagagggcagaaccagaccccagcagttaaagccaagagccatggagaattatacaaagtcttttgaccttattaagtaacttccagtaattgcataattggacttcagaattgttataggccagtggcttttttgtacctgccattcccccctttctgaacagaaatgtttaaagcagttaccctctatctgtatcattattatctgttgtgtatttgggaaaccagtatctaccagttttcagacgaagagggattatattcaaggatatgtatttatggaactagacctgaagtgtctacaccatggctgaacctgattcagatgacaagattatttaatttgagtaggtactacagtagtatcaaacttttgacgttggtggaagtgggtgagtatattttacatgtaaaaggaatgttaactggatgttaattagaggccaatacgcagagtatagtgatcctcaattatccctaccacctggtattcaggccctcatataatccccattttttgagtgaaggctatgtttattagcttctaacaaatatgatacaacggaactgatggaaagctactgctgagactaggttttgaagaggctgtggggcccatttgtgaggctctggctcactctcccttggatcccttgtcctgggaatgcttccatgtcatgaggaacccaacagtgagaccttcatgagtgaatttagaaaatgatccatcagttccagtggatctgtagctgagaagaccatagccctggcctacagcatgattacaaccagaagagacctttagttacaagacccagctaagccatacccaaattcctgactcacagaaactgtgtgagatgataaatacttgttccatttaatgttctatgcagccatagataactaatacagcactcaataaatgtttgctaccaaatattatgcgaatggaaggttaaactgtaaataaagtgagaaaaattagggcatataaatattaacattttgagactgggacatgggtcatccaagtcaatatttcaataataacatatagaaaataatgagttattgaacaagattttaagtatcttaatattgtgttcaaatgttaggggaaaatcccagagcaagtaacatctcttatgttaactattatttccttgctatcctttagtgtattcagtggttaccatgtattatgccatcattgtattcctttttctttctgtcattctatttccctctactgactttttttatgccaaatctctttcactagcactctctctcactacaatgcttcattatttctttgtctttcatgagattttgttttctgtctcacacatgtacacacaaaagcacaaccacatgcaaataactaaaatcattgagttacttatatagtaaaaattataggagccaaataaaatttcttgctcaatagtttactaagtctgaatagaacaaatcattttaacaataatgcaaaggaaatctatcacctaagttggaagaaaaaacagttgtgatttttaatttgtttcacaagaaaaaaattactagaggtgagtagttttttaatcattcaggaactcatgattatcctccaagtacagaatatctgtttgcatgggattgcttttgctatcataaatatagctatggaatttaatgcattgttggctattcacccttttatatagctatgattttaaagtgcctacactctgcgaatatttacataaattatcataattaaccttctgtggcttttatctttataatgaaatatcccttcattcgaaataaaatatgaaatattatttttcatttctaatgatactttgcttataaaatatattattctaagattgttagtttgatttattggatttattcgataattatctttttttagacaatattattgagggaccactttttaaaattcagaaatagatgttcttaaaatgtattgacccatttatatcaccttatagatttatacttgaattggtagatataaatatctactatttgtacatcccactatttcttttcttttagctagaaaggtataacgttaaaacccttttaccaaataaaatgattttatttagaaaatgccgggcactaaaaaaaaaaaaaaaaagaaaagaaaaaaatgcatatttttgtagaaagtgagatactatttttattacaaacaactttaaaatattttatattgagccataatgcatgaggtggcttaatttgtaaattttcaattttgaagctatttcatagatcttgatattggcatgggaaattggctttctttttgaacctcagtggatactacttgtttttcttcttaaacacagctttgtgtggtgtatcctctggtttcctgttactatttctccaatattttgacttaaatttgtttcatgcagtaattcttaggtgtcattaccactggcacttggtaggagctaaaacatatagccagtataaattttgtctatatggatactcgagttttgatctttgtttaaatcccaggtgctgccagactaaaacaagaaattatgcaattctcctcatataaccagctttagttctatagtgacttttcaccctgagaaaatttgatctaaggcaagaaagccactaacatttgtgttattcaataaaaaaggaaataatttttcagaaagcatgtaagatatacataagatatcaaattataaacacactcccttatttcttagagaagttcctatcatattgttattcaaagataatgttttactgagatagggaataatatgattagagttttgtgtttgaatcaatatattatgacaatcatgtcataaatgtctgagagaaaatatatgacaaacttcaggttaattactatatattataaaaattgagaccagtttttgagaggtgatgagtgagagacataataaatttatactcattatttattgattactgttctatatattctaacagataaaatttctcacagaaaatgtcaggtataacttacagtcactactggaacaaaatgcaaatatttcagtgtcattcgaaaaactaacaaggaattataagtttcttataatatatcagtcaatcaccagactcctttcatacttggaaatgtttccatgcatgggcttaagttaatgtagaattcaaacatttgagttctgttgtagcagataaaatgaagcctcaaatcattctctaatctgaagtacatcctggcagaactactgtgacttgtctgttaaaattgatttcctcttaaagaaaaataggcttttcttattgtgtcaaaaaatgatattatctattatgtgtcttttcttgtgacaatccttaccttttatgtcccagaaggaaaaaatattgtttttcctcctaagtttttatatcctattttactctaatgaataatctgtgttgcacacgaaatgaaatatattccaaaaagagtaaagagcaatgtttaaaaatgagtgtagaggccaggcatgttggcttatgcctgtaatcctagcactttgggatgccaaggcgggcggatcacctgaggtcgggagttcgagaccagcctgaccaacgtggagaaaccccatgtctactaaaaatacaaaattagccaggcatggtggtgcatgcccttaatcctagctactcagggggctgaggaaggagaattgcttgaacccaggagatggaggttgcggttagccgagttcacgcctttgcacttcagcctgggaaacaagagcgaaactctgtctcaaaaatgaatatagaatgggcagacatttgtaatactactgattgcccttaccttaattcacatcatctctattgtttgactttataatgctttttgattggcagccttgaaagatgaatcgacacatcagaattttacaatgtaactttgaagactgctagggaaccttaggcaagcaacttcctttaggacactaaaaatgcttgatggggtttggaactgaggtgctttgtgttagctattattgttagtgatgatggttaggtttgtgattattttgtttaataagactactcaggaataaaaagctaccttcaaataccttcccacctcctctccagtattttttaagattagactttatccaccctaaattacatctatattgaatggaaaaccaggtgttggtattttctgcactagtggcttaatgatagtttattgaactgtaatgctttgtaattagaatatttctagtaaaaacaaaatgggagagcccagaaattgtagttcccatccaaaattacaataacattatttctgtaatagcagaagagaaattagaatgtcttgaggtaatagctcacatatttagaagaagaaatttaaatattgaaagaacatactcaaaaaaggagacgttagatcgggtattcagaaacttcagcatgctgtcaatagatataaaaatgcaatgacattcattttttgatcaatgaaatgagaattgtgctggctaaacactacataagatacgataaaataaaagttggtaagttataaatactgtaagtgccttgggagtgagatataagggcacatcatttttatttaatttctagttagtctatgagattgaactctcagtacttatttaaggccagaaatttaattacaaaataactataaggttacattttgatctcaggttaaaagaataatattagaagcattaaaaatatttttgtgttaatcagcgtttaggaaaacagcatggtaaattcctgtgaaattgatttatactttcttcatttacctctaatatgaaatatattttatgtttagatttgcttccttaggattgtgacttgatttttctctttgctcaaaattatctgtgggtgtattattctttggggatagtgatggttaagaaatgctatttgaagcctcacactattagaagagttagttactaacattttcatgataatataatgagtcatagaaaatttgcattgagatttattgaataaacttgacatatttaaactgtttgccataattatgagcctagtacctgtatgccacaacagtattttaaagtactgtactttgcaccttcttcactaagaattgatctgataaatccctttttgctagattgtgtcatgtccatctttttaataccttccttgttcattattaagtgctgttagccatactgtctaatgaaaggtacataatatcaactctgattactgctgtaatgttttccaggcatgcttggtgatgagcctggcatatgaaacaatttcctacagtaataaaactaattaaagtaggcagtcatccacacaacacttcctaatgaattataataagctcattaatctcatctgttcttattccaaaaagaccactaataggacctgtaggtaagagtacaatcctcagccttaaaaatggacagctatcatgaagtcagacttaaggatttaagttaaaaaattacaaattgctaatcaatgttgtaaatgaaatgtgtaacgtctaaactctgctcagattatttattgacaagatccttttctatttgagttctcctataattgatttaacaaaggaaaaaaatgattcattgtaacataatgactcttcaccacctcaaagattacaattgaattaaccctctcacatatcctcctatatagaccatataagaatcatgaattgagtacttgagatcaagtgataaaaatatagcctgttttctctccacagagggctggagtatcttcttaaaatgtcaaagtataataataattattcttttgttaactcttctacagctttgtgaggtgcctgatcaaacaatgtaactaattattattccattcaggtacagatagtttggtaacatagatgtattgttctagaaacagttttacagtaaaagagataaggttgtaaaatataaaacatggagagacgatttttgaactacaaatgtgaatagtaagaaaagatcactttaaggggaattttgttttatcttcattgtaagttgatgttttttaaatgcagcagtttctgttctaaagctgattactactgtgccacatgtatggacttctttccttagaagtgacttataaatatgtagatttcacaattaatgcagaataatgataatgggttaatcgtaaataggaaggtacatttttcacttatggaatgatcatgttcaaaattgttatccacatttataaatttttagctaatatttcatattctttgtggagtaagagattggatatttggcacagaggattttcttttgtaaaacagatatttaaaaatacgaccactttggtaggtagaggttttccttagcctatcactgaggaaaatgtctcccaatctagaatcaactatctagttgccatgtgtgtgaaggagagttggttctgtgctatgaacaattaggaggcctgactttggcaaagacttctccatcatctagttgtacggccttgagacagcagcttacacagcatgcaatgcatctgtctttataaaatgagggggttaggctagagcagtgtatccccaaatatggaaagtaccagatagtaaattttatgttttcaataattcttggatacaacagtaaaacaattgtactgtatgaggtaatgcaattcctcttttaaattccaattcaattctcctgaaatcaaggaggtaagttttgtgctgtaagtctgtaatacactggcaaatcttactttttgttttgacaaagcaggtagatcacctcatagttactaaaagacaagggagatgtgttgctgaacagaataattttgaatttaagtcttttggttaaaagaagaaaatttcttgaaagttatctcaaagataatagaagattacacaaaagtcttaagaaaatgttcacagctcaaactgaccttgttttgaacacaaatccttatttgagaaagtcttgctccaattagtagacttaattaatgtcacctattaaggtaagctagctatctattgaataaactttggtaatagactttaatgttaataggaaacatgacttatcatcataatatccaacatttgtttaatgcttaacaactaatgtttgttaaatgcttggaagtcaggtactcctaaattatttacatgtattaacacgttagtgttcaccatataggttaatgtttacaacaaccttattaaataagcactaatattttccccattttacaaatgaggaaactgaagtgccaagagatttgagcaatttgagaaaggtcaaacagctggtaaatgacaaagttttaaaaattctgtaagtacccaatactctatgcatttctctctcttattgtttcctatctcaccatccccagtaatccttagttaacttcatcctctccattctcaaccataagcttatatctttcaacattatattcgcagtatctggcacaagataggcactcagaaggtatttgttgaaattcgtatgaatgattaactaatcaatgaatctgtgctataaaacagacaaattaaaaatgcctctaagtgccgggagcggtggctcatgcctgtaatcccagcactttgggaggttgaggcgggtggatcacctgagggtcaagagttcgagaccagcccagccaacatggtgaaaccccatctctactaaaaatacaaaaatcagccaggcgtggtggtgggcgcctgtaatcccagctacttggggggctgaggcaggagaatcgcttgaacctgggagacagaggttgctgtaagctgaggtagtgccattgtactccagcctgggctacagagtgactccatctcaaaaaaaaaaaaaaaaaaaaaagcctgtaagcgtaacttattggactttaagacctcacacttagtacttcctattttcctccttgacttagttttcttctgatcatcaattattaatcatggataatttgaaaactgtgctttcatgaatactagaaaactgtgctttcatgtcagaatgtacaggttcaaatgaatatgccatcacttatctccatctatatacttaactgtgtgactttgaaaaatgtatttaactttctcagtttcagttttattatctgtacaatatagatattaatatctattgtatatagccagcaggattgttgtattaactactttaaacacattaaagtgtgtttaaaaccaccaagaattttcagcgtattgtacatgtgttatgaggcaatataacatcatattgaaatagctagaaattaaagccaaacagtccaactattgctgaagagttctgggagattaggtaaaatgtttacacatctaaagcattaatgtctcaatgcttaatcacaaaatacaagttcctaactcagggcaattttaagggctagatttgataatatgttcagagtgcctggcatacagttaaaaccaaataaatatttgttgatcttgtttgtcatagtgttccttttcaaaaaaaaaatgttttcttattcatttggtttaatatctggggaaataaaagactcaatactgaatacatttcctagactattttcctggagttctctcaaaaacataaccactatttttgcctgtaaccaaataactcagattatattatcttgaacactgtgctgcttaaagctatgattgcaagtagtagaaaatttaggactaacaaagctaatttgttgagtctgtattttacacatcagtggcaattggaagactatgataggaagaaaatttaaactctatccttgtattcacaactccctaaatagaaagaaatggaattcaagcattcaaaaaatttactggagaagattaatttgaaaatagaatgtgcatgagtgcatggatagatgtatctcttcttggatgactgcaagtaagccttgctatgaaaatatctaagaagcaaaatttattgtaaataagttttccattaaatggcagtatcttattgggaatgcatttcttaaaaaaaaaaaaacacaaaaagaaacccatacactaacatattttttaaaaaaatctatcattctgcaaaccaacacttcagagattacacatttttttctacatcttgccatgtgcttgtggagcaaacatttttttgcagtgaagcaaatgaactacatgtgggataccatgtttaaactagaaggcaccctgcatccctcaagattcccaattccttagagataagggatagagattgttggttgacttaaaaaaaaaactctttattaactctaacattaaaccatattgaattaatttactatgatttatttcaaaaccagatgtgttgataacttggtaaaaattgcttcagacagtatctgagcattttcccagagtactaaggagcaaatctataattcagggccactactatcatcctagttaaatatactttatctccttcttctaatcctagttggtattctcacttcctctcttccaaccttaactactcgtcttatttccctcaatggatcttcctttcagatttatgcaaatattatgtcatatccctgttaaaaaccctttactgcttcattcattctctgtattcttaagataaagtctaagaagcacaaatgatatgacttattttccagtatttcaagtgccattcaatccaattgtgctttgatatttcatctatactaaatatcttttatttctttgaaatttctgtgttctcttttacatattcaggtgttttcttcctctttttctgtggtaaaatcttactcatgcttcttatttcaaggtatacattacttcttcaaaaaagactgggctaggttttcctggaatctaataattatcttacataacgctcatcatactttaaaaaaaaaaaatctgcgtcttgtgcaatttgaatctgtccctagcaccattttatgtgctgctgcattctcagctctttcttttcccaatggttagcatttaacattcacttattcctaaatgctttactgaatgaaagttaaagtaatgtgtgttatgagttcaagctcacaccagacgttcctcatgggttatgcatgtatccttacaatttcagattctgtagcagtcaccttggtgatcccctccccacacagacattcttccttgacactgagcccacgagctgaaaaatacctgatatttttttgaagctacggcttagacatgtgacccaatcctggccaatggaccagaggaaaaaactggatgaaaagtatacttgtgaggagaaaatgtctttccccctattaaatacagttgactgagaacatgctttttggatctgtatttgccttccaacaactctgaagaatcaaatctgaaaaccaacgccaatcctgtgcagatgggtgaaaataaaatatatgatatgtgggcctttgatgatttaaattattctttaaataattcttgtgctgctgaattaaccgagcctggaaccacttacctctagtcaccttgttatataagataatacatataggttctatttcagccacttataagtaggtatctttttatttactgtcaaaagaaccctcactgatatagatgccctcaggacttgaccctccctgagttcctgttaggcagttaaggtaatcatctgttggattagggaagcctagcttatttacttctcagtgtggacaagtttggtctttaacttgtatgctcttgttttccaaaaaggagatagaccagaatcctaaaaaagtaagtctaaacattggtgtccttttacgcttcccatctaaattatctttaagaacatttaagtttcattgatgatccccaaaataattcaagcaaaatgctgagttggtagaatataaggactgttatttatttttattgtttttacagaccacataccctagggaattctgaaaacctgactaacatcaattgaagattggggttcaggaggcctagatgatccaccatgacttattcaaaagttgaagatgaaaggaaagaataaagactctttccatccagttctctagtctgaaaggaaaagaaataggcaaaggacagtaggcttttctatatcattatattcattcaaatgattctcttaaaataataatgaactaaggaggctctgtaagcaagacaaacggtcaggaggcctccttgctccaagaatactccctttttactttattaaaatggtttgtaaaggtaaactaaattgactaaagtatcaatatttccatatatgcgtgatcttttagagaccataaactgtcagtgtattaggctgttcttgcatggctataaagaaatacctgagactaggtgatttataagaaaaggggtataattggcccacagttctgcagactgtacaggaagcatagtagcatgtgcttctggggaggcctcaggaagcttccaatcgtggcggaaggcaaagggaagcaggcacattgcatggtgagaacagaaacaagaacaaggaagggtggctgggaggcgccacataattttaaattaccagatctcacaagaactcactatccggaagacagcacccagccatgagggatccaccctcatgattcaaacacctcccaccaagccccacctccagcactggggatcacaactcgacatgagatttgagcagagacaaatttccaaactatatcactcagaatctggaatagaaagagtatgcaccataacacttttattctctacagaaacagacactgtgctgagctcaaaaaatagtgattcatcaaatatgaatgtgcaaacctcttttgtactgtatctgtggaatcctggttactggggctttgagcccctgtcccataaaatctctgtaatactaacctaactcatggcatttctttaaaatcaaatttaatgaaatgatggacataaagcccatggaactgagtgtgtaatcttctcttatttgattagatgttaaacttgaaacacttttttttgataaaatatgaaatacataaatgagttaaattgttgtgactttccttataagattgaaaacaataaggtgtttttaatactttttttctgtgttctcttgaaagtagctttacatgtattaagcaatcctggctttagatattagggacaataaaaatatctgcaattttcccagttttatatagccattgtttgcaagtatgaaaacctgtcttttgttactgaaatattatcttttattttggcttttttgataacttttatgtttgccttgagcaagtcacttatcttttctatttgtgttttctatttcagtttatttatgaaagacagtaataatgattgtgatgtaccttacaaaaaaagataaaatcgtattgaagagactgttgaatatgaacgcagtgtattaaatgcccgatataggaacaaaaataaaatgaagaacatttctattataaagtattttcctaaatagatttagtactgtgaaaggcagtaaaattatttcctgataaacactttcttgagtattcaaggattaattgcccaggataagaaaaaatccagtcttgattatattgcatatttcctggtcggccttcactgaatagttaattagaataccaccaggaggcgtcttcttgggtcatagatggaatatatttgtgggcaaaaaatatttttccttaaggaatttgtagactaatctaaggaaataaaaatcaattttaacttcaaatttcagcctaattagaagacagtagatcactcacacattcattcattcattcaattaatatttattgaactccttctctgtgaaaattattggactagatgatttgagacgtacaatgacaaaatatgacttctatcctcagatcttatcgttaatagggaagtgaagaaatatatttaaaaaactctattaaggcttttttagtgggtgttgaaacaaaggcagggaaagcagttatgaatatttctaaccagatataaaggcagtggcaatgggaatttaaggaaatgaatgaattaaaataattttcggtgaaaaaggggattgtttgtcagctgcatatggaatgttgggagaaggtgagaagtcaaggacagggatttctttcttttctttctttcttttttttttttttttgagacagtctagctctgtcgcccgggctggagtgcagtggcgcaatcttggctcactgcaagctccacctcccgggttcacgccattctcctgcctcagccttccgagtagctgggactacaggtgccagccatcacgcctggctaatttttctgtttttagtagagatggggtttcaccgtgttagccaggatggtctcgatctcctgtgatcgagatcccccctcctcggcctcccgaagtgcgttttgagacggagtctcgctctgccgcgcaggctggagtgcagtggtgcaattttggctcactgcaacactgtaacctctgcctccctggttcaagtaattctcctgcctcagcctcccgaatagctaggattacgggcataggccaccatgcctggctaatttttctatttttagtagagatggggtttcaccatattggccaggctgggggatttctggtttcttctctaaaagctaaaaagcttggaaggcattactccttccaagcttatttattccttaaaataagaaaaatttgaacaaactgaaaatcaacaatatttcttgggctcatcagataaattaggacataaaactaactgctactcccaaatctagaaaggcaggcgattatagagaaaagcagctaagatccgtttaactgcagcagaagtcactgaaaccataaactggtagggacacttaaatggtaattccgatgaagatctgactgaatgctgagtgtggactagcttgagagtaagaaactcctggggatcacattcttagggaatcccgcacactttgatgactctcacctctagggatcccatcaggttcttacggtaaggaactaagaaaaagcaccttttgtctttgtcagggatggggaaaagtaaccatctgaaatatgcctagagaattctctatacataagcctcttccaaggagaaaacactttaccagtcaaatatttatctcaccaaggagaaagaattcttactgaattccaggcctctctaacctttctgtccacattacatagaagaaataaaactgtgatggttaattttataatatgtgccaatttaatacactaagaaagacacagcccagggatacaggcccacttaagaccagctgtaattgtaagattatagaatgttttccctccccaactttttaacaccacatcaacaggactccagtataataagtgaattatagctgagagagctggaaagcacatgctgcaacttacaaaaaaaaagaaaaaaaactcattaatacaagaatgagagtcaggaatagtagtcagaatcacagaatttttgttgctatttgttgtcattacatttatttattgaaaggtaaaatattaagccagtttaaagactgagataaataggagagagtaaataagctaaaagttactccaaattagaggactttccttatgtagtagcattctgagtgaagaagtgctcaaccttgcccatactgttcctcgtttcatatgcacgtgactagctgaataattcttgaaaaacctgtcttttccccatcatcctggataatggaaagtgttctctatatgaagacaatttatagcacactgtgattataataacaaatagcataccagttatcataaatgcatatgctgattttatatattttggtaatcattcctttattcaactgattttcaataacaatgtgttccaaaagtgaggttacaaggatgaaaatgatgtgttctaattcacatctctagttggttttgataagtctggagctgtggaatgagaaggagtgggaggggactataaatctttgaaatgcttcccagatgatttagaaaaaatttacttccacaccctactgaaaactacctatctagtttgttatgcatatacctcagtatccatatatttcactacatttgacccttgaacaacaagggagatagaggcaccaaccctcatgcagttgaaaatccatgtataacttttgatgcccctcaaccttaactactaacagtctactgttgactagaagtcttactgataacataaacatggttgattaacatgtattttgtttatgtattatatactgtattcttaaagtaagctagagaaaagaaaatgtttttaaggaaatcataagaaaaagaaaatatatactattcattaagtggaagtagattatcataagcatctttatcttcatcctcgtcacattgagtgggctgaggaggaacaggaagatgaagggttggccttgctttctcaggggtggaagaggcagaagaatattcacttataagtggatctacacagttcaaacctgtatattattatttttgagatggagtgcagtggcatgatctcagctcactgcaacctctgcctccagggctcaagggatcctcccacctcagcctcccaagtatatgggactgcagggatgtaccaccatgcccagctaatttttgtatttttttatggagatggggtttcaccatgttgtccaggctggtctggaactcctgggctcaagcaatccaccctccttcgcctcccaaattacaggcatgagccaccacgcccagcccaaacctgtatgtacattaagggtcaactgtatgtagttttcttgttattatgttataatcctgtgacttgactggctctctttttaagatgctagatgttgtgcagctggataaagttcaagtggcaatggaagaacaggaatcatatttacattgataatcaaagtgaatagaaaagtctattactttcaagataatataataccattaaagtgcaaatctctcaatgtgacaaattctgaaaaatacagtttctatgttcgagcaaaataatttgacaattattgacagaaataaggtaccatttacctttatgaaatgttagtttctaaataaatctcaatccaatgccaattaaaactatacgtttaatttgtatgttttaataagttgtcaatttttttttacaatgttaacattttagtagattttacagtaacatctttttgaactgtgactgtgttttttaatttaatgaacaaaatgagtattgcttttctacttgtaaagtgttattaatatccaaaggattaacaaatgccatttttttctgcaattgcttgttatttaggctttttcatcaacatttgttatgtagcaaatactcatatagtttgcattttgtggagctgagaggtacttatgtaaaattgtttccaaactttaccttctccctattctctaaaacaaatttctggcctggtcgacttcaattcttttactccgtagctacagtctgaatggggctgagggggattcttctttgtcagatactttctcaagggctttcataatgcagaatcaaaaggaaagctgggcagatagaaagacgatggctcctaagcaatgttctgtagggcacgtggaagcgcaactgaagtgattcaaggaaactgatagaggagaaaagggcaatattagaaactactgtggtgaactatgtgttctaataatgatgttcaagatatacaaatgaagatcttcagttgttgtgaattttcttttttggtctgaatattttctttggaacacagtaatactcagaaactataacatggttccaataggttatatgattactaaatatctcttaataaatattttatttcccagataatgtattttttctagtacttagagcctttaatactgtaatcattttactcaaagtttagaaattaaaaaaaattaaatcacacataaatctaaaactctagtaaaataattgtcataattttgcatattttcaggtttttcatttaaaattccatttacaaacaaagtgtattttccatttaccacatggacttttgtgtacagaaaatctctctgtttttcctctactctcataccacagcgatcaacaatgaagacatctgtgaccaaatgtgtctgtatggtgggagggttccccacacagagcagcagacaccagctgggtatcctctaatgcaattctgatgctatcttcctgaagatactgtcagatccaatagattgggggctcattccccaagagtcctcttcagacatcagttgcaagtctggccctctgaacatctgagtgaccagcttcaagctgaggtttctataaccccctttttgtgttggattaactttctggagtggctcacagaactcagggaatcactaacttaatttaccagtttattataaagaatattccaaaggatacagatgaagtgaccatagagtgaggtatgggggaagggacacagagcttccttgcccaccctgggcacgcctccttctaggaactctacaccttcattcagatatcctaaagctcttagaacttagttctcttggatttttatggaagcattccttcctccaggatatgaggtgggaccctctcaggggaaggacttaatacaattagaaaagcaggggaagattagagtcctgccccaagaaagaaaggagagagattctgtttcctgaggcctttccctgagatctaatgcacccattataacaaaagactgtagcaaaggccacggagttatgagccaggaactgtggatgaaaaccaatatatattcaatcataacactacaactttgtgactatttttttgaatgcataattttcagtgaaaacatttactatcattgaataacaattttttaatggttgtttacttaggttgctttcaacatttagacattacaatgctggttatctgtcatgtggcctctagttttcagtcttcaaagatgttttcttttaattaataaggcacagatggaatggagatcgagtatgtgtagcagggtatttattcaaattttttcccatgtctggaggtgatacttctcttacaacttgattatgtgtgaaaaggaatttgaacaattgtatgtctccatgaacttcatcatgtactgattagaggtcaaagtgaccttgaccttgatgagattgtctagacattttgaccggcattttgactggcattgtctagatattttgactagaaagtggtgacgcttcctaaatgtggttggtggctgctcaactctctacaagaagtagggtccaccacagtaagttttgcagtttatctgaatgattagatgagtatagtgtgaaggttaaactactgctacatacactgacttaagtaggcagctgcttatgaatcaagttgtgactaaaatatgcacagataagggtactttatttttataacttaaataaaaaacctattactattatattagaaatcctgataagcccatcaatttctaatattatcctatgttagaaataagaataagcacttggagagctttgaggtgaaagactaaggtagaaaatgatcatgggttatgtactctatttttttacatccattcttctttttcttttttcatttatcagttattgaaaaatcagatatcaactcaattacttatatatgatctataaagtgtagccattgaaaattatgggtgtgtctatgtattagtttcctaaggctgtcaaaaaaagtactacaaacaaactgagtggcttagacaatggaaatctattgtcacagttctagaggctagaattctgagatgaaggtgttggtaggaccaagcatcctttaaaggtgctagggaaggatctattctggacctcaagcctggtatctggtagtttcttggtttgtgatggcataactccaatcttcacatggtggttccctgtaggtgtcctttgtgtccaaatttcccctttttaataaggaaactagtcattgtaaaaaggctcacttccctccagtattttctctttttaactaatgatgtctgcaaagaccttatttccaaataatatatcctgacttaccaggagttgggacttcaacataggaattggacagggggccggggagaaacaattcaatcattaacaatcaattacatagttaaagttcattagaaaggcgatcctttatcattgactgactcactgtcaataaaagattagtttatttccttggtttacagatagttctctgcctagttatgtactgaatctcattctttcttaacacctgaaagattttcctcccccaggcattcctctttccctggtatttttaaatcactggatcattttcatcagtgtttaaacttgattaagcttttctatctaacacatacacacacacacacacacaccatctcaatcttgttaacaactattctgttcacaagtttattgaaagaagcttgccttctgataattatgtagttggtagctcactactttttactttcagtttatttctgaactctctgtaatctggactctgcttccaaaacaccatccagagcagctttgataatgtcaacagtgacttacttttttaataagcctggtgaaaactattcagtcttagtttatttcctctctgttatgtctaacataattgatctcactctccttcttaaatttgtttgctcccaaagctattgtgacaccctaatttattttttctcttttgtttgttttcatttttcttcacaatcacttttttgtttttcaactgtttattttctactacatgaatatcctagtgattctcaaatctccattttctgatcagatatttctcttttgagctcatactcacgtagccaatgtctactgatatggtttggctctgtccccacccaaatctcatcttgaattgtaactcccataattctcacttcccacatgtctttggaagaactcggtgggaggtaattgaatcatgggggcacatcttttcctgtgctgttcttgtaatagtgaataagtctcatgaaatctgacagttttaaaaaggggagttcacctgcactagctctttcttcttgcctgctgccattcatgtaagatgtgacttgctcctccttgccttctaccatgattatgaggcctccccagccatgtggaactgtaagcccattaaacttcttttacttcctagtcttgagtatgtctttatcagcagcgtgaaaatggactaatacacctactatatttcttcggctggattttataaggaacatttcaattgaactcattatatattttaccttaaaattccacctgaaattttatttgctctcaacaggagtgagcaatacttccattccactagtatacatgccaaaacataaagttattcttgactctcccttctcatttgcctctctctactccacccatatctgtagagtccatcttctaagtagctttcaaattcacctccataacccatcttagtttaaatcttaattatttctgtgtgaattattaaaataacctttttaacagtctttagccttggtcctatgcagccttttctttataatatcctcagcaaactactgcaggagtaatttatactgtacccagagtaaactgcataaatttaaatatgattataattttccatgattaaaatttattattgatataccatagccttctgaataaaacataatttattgttatggaataaatgactatgatttggtttcttttggtttctctttgccaaggtatacctctccacataagtatactaaaatacttgttccccaaactcttgcctccaggaattttaatgttcctacctttgcttagaaaatacttggctttcttttatcttttactaattccttctgaccattgggattctggatacattttttttccccccagaatgctttctctgactctactaccttggtctatgtgtttgttttcttttgctgtgaggcaaattactacaaactggaacttcccaacaagtttctcatctccatctgagaccacttcagcttgcacttcattgtccagatcactatcagcattttggtcaaagtcattcaacaagtctctaggaagtctcaaactttcccacatcctcctgtcttctgagccctccaagtctctaggaaattccaagctttcccacattttcctgtcttcttctgaggcctccaaactgttctgacctctgcctgttacccagttccaaagtcacttccacattttcaggtatcttaatagcagcaccccactctctgcagtatgaatgtactgtattagtctgctctcatgctgctatgaagaagtactcaagattgagtgatttataaagaaaagagatttaattgatccacagttctgcattgctgtggggggcttagggaacttacaggcatggcagaaagcacctcttcacagggcagcaggaaagagaatgagtgttgagcgaaggaggatgccccttataaaaccatgaaatctcatgaggacttactatcatgaggctaccatggggggaaactgtcccaatgattcaattacctcccactgggtctttcccatgacatgtggggattaagggaactacaattcaagatgagatttgggtagggacacagctaaaccacagcagtgggtaaaatgccatcaaaccacattgcatgctgcagagtaatcttttgtggaaagaagagtcaacaaatgtggtaaacttcattctcttactttaagaaattgccacagccaccccagccttcaataaccatcaccctgatcagtcaacagccatcaacattgaggcaagaccctccaccaacagaaagagtacaactctttgaaggttcagatgattattatttttaataacatatttttaaataaagatacacacttttagccgggtgcagtggctcatacctgtaatcccagcactttgggaggccaaggcgggcggatcacgaggtcaggagatcaagaccatcctggctaacacagtgaaaccccatctctactaaaaatacaaaaaattagccagctacttgggaggctgaggcaggagaatggcttgaacctgggagttggagcttgtagtgagccgagatcgcgccactgcactgcagcctgggctacacagcgagactgtctcaaaaaaaaaaaaaacacacacacacacacgtttataagatgtaatgctattgaacacttaataggctaaagtataggctaaatgtaagttttatatgcactgggaaacccaaaaattcatcaaaataaaacagtttattgtgatatttactttattgcagttgccttgaaccagtcccacagtatctcagaggtatgcccatatatagtattggtttatgttgtgtaactataatctgtagcttcagctaatgttcattgccttcttgcagttcagttttttgactttgcagaatccctgataccagtgtttaaggtgagtcatattatctgtaattcctgcacagcacaatgttgacatctctgcttttttttctcttggaaattttatattgatgctcgagtccatgaaacatttctgaagcgttacttatttttgtattcttcttcattgtcacaattcagcaccccataaaatagggtactatgtatattttaggatctgccagtattaggaaagtcttttctctctagtttttactctcctttgttatcatataaaacctgaagggctttactttctcttttttatctaaaaactgcatatgtattcccaagcactgcccaatgttattcacgctgtcctttccctgtgtctgaaatgtacagggccccagagatggctcagcttctttcttccaggaggatggcagaagggtgcctactacctatagcaaagcccttgtcagcactgtgtcctgtgagatttagcgattcttttgatgatgtgacagaatacatggacactcagacagataaaaggcagaactctttgttacttacagctcaaaggaaagaaggctgccctgtaggaccatgcaataggttgcacgtcggggcaggatagcagcaagctggagctgagggtggcagcttgtgccaggcaggcaaggtgggcaatgcctagttgaacagatttcctgtggctagactaatttagatacttccaagggctctggggaataggggctgtccctagttgcctggtacttggcctggtggatggagtaaaggggagtgctgatagggctggtacctggagtgtgagagcctgataagggaagtgtttggagtgcagatgtttcagctgataaagaaggggtaataactggactctggccaggcctcaaaactgggtcaaggcagcatttaaaaaataaaaacaaaacaaaacaaaaactgtgttacacacttctagaaggtaatggagatgtgtttgatgtctttgaataccttttttctaccaagaaagtaagttcatagtgatgttcaaacataatttcttactttttttttcttttttaaatttaactttcatttaagttcaaggatacatgtgcaggtttgttatgtaggtaaacttgtgtcatgggcatttatggtacagattattttgtcacccaggtattaagcctagtattcattagttatttttcctgatcctttccctcctcccaccctgcagcctccaataggccccagtgtgtgttgttccccactatgtgtccatgtgttcttatcatttagctcccacttataagtgagaacatgcagtatttggttttcttttccttttttgttgaggataatggcctccatccatgttactgcaaaggacgtaatcttattcttttctattgctgcatggtatttcatgatgtttatataccacattttttctatccagtctgccattgatggacatttaggttgattccacgtctttgccattgtgaatagtgctgcaatgaacatatgtgtgcatgtgtctttataatagatttatatttgtttgaatatatacccaggaatgggattgctgtgacaaatggtatttctgtttttaggtctttgaagaatcaccacagtgtcttccacaatggttgaactaatttacactcccaccaacagcgtataagcatttcgtgtcctctgcaactttgccagaagctgttattttttgacttcttaataacacataccattctgtgaggtggtgtctcattgtggttttgatttgcatttctctaatgatcagtgatgttgagcttttttgatatgattgtttgctgaatgtatgtcttctttttgagaagtgtctgctcatgtcctttgtacactttttaatggggttgtttttgtcttgtaagtttgttttagttccttacagatgctgggtattagacctttatcagatgcatagtttgcaaaaatattctctcattctgtaggttgtctgtttactctgttgatactttcttttactatgcagaaggtcttttgtttaattagatgccatttgtccatttttgcttttgttgtaattgcttttggtgttttcataatgaaatatttgcccatgcctatgtcctgaatggtattgcctaagttgtcttccatggcttttatagttttgagttttacatttaagtctttaatccatcttgagtagatttttgtatatgatgtaaggaagaggtccagcttcaatcttctgcatatagctatccagttatcccagcaccatttattgaataaggaatcctttcaccattgcttgtttttgtcagggttgttgaagatcatatatttgtagctgtgtggccttattactgggttctctgttttgttccattggtctaagtgtctgttttgtaccagtaccatgctgttttggttactgtagcctgtatcatagtttgaagttgggtagcttgatgcctccagctttgttctttttgcttacaattgcctttgatattcaggcgttcttttttttccttgttccatttgaattttaaaatagcattttctggttctgtgaagaatgtcagtggtagattaataggaatagcattgaatcagtaaattgctttgggcactatggctattttaatgatattaattattcctatctatgagcatggaatgttttcccatttgtttgtgtcatctgtgatttcttcgagaagtgttttgtagttctctttgtagaggtctttcacttcccttgttagctgtatttctaagtatatttttgtgtgtgtgtggcaactgtaaattggattgcattcctgatttggctctcagcttgacttttattggtgtatagaaatgttactgatttctggctgggtgcggtggctcacacctgtaatcccagcactttgggaggcagagggtgggctgatcacaaggtcaggagttcgagaccagcctggccaacatggtgaaaccccatctctactaaaaatacaacttagctaggcgtggttgcgggcacctgtaatcccaactactcgggagactgaggcagaagaatcacttgaaaccagaaagcagaggttgcagtgagccgagatcgtgccactgcactgcagcatgggcaacaagggcaaaactctgtctcaaaaaaaaaaaaaaaaaggaaacaaagaaatgttcgtgatttctgcacattgattttgcatcctgagactttgctgaagttgtttatcagcttaaggagcttttgggctgagattatggggttttctagatataggatcatgctttctgcaaacagggatagtttgacatcctatcttcctattcggatgtcctttatttctttctcttgcctgattatcctggccaggactttcaatactatgttgaataggagtggtgagagaaggcatccttgtcttttgctggtttttcaggagaatgcttccagcttttgcccattcagtgtagcgttggctgtgggtttgtcatagatggctcctattatttttaggtatgttccttcaatacctagtttatcaaaagtttttaacatgaaagagtgttgagttttattgaatgccttttctgcatctattgaaataattatgtgggttttgtctttagttctgtttatgtgatgaatcacatttatttatttgtgtatgttgaaccaaccttacatctcatggataaagcctacttgattatggtggataagcattttgatgtgctgctggatttgttttgccagtatttttttgagaatttgtgcatcaatgttcataaaaaatattggcctgaagttttttgttgttgtgtctctgccaggttttggtgtcaggatgatgctggcttcatagaatgagttagggaggagtctctccttctcagttatgtgggatagtttcaggaagaaacatactggctcttcctgtacatctagtggaattcagctgtgaatccatctggtcctgggcttttattgttttgaaggctatttgttattgattcaatttcagagcttattattcgtctgttcagggataccatttcttcccgtgctcagtattgggagggtgtatttgtccaggatttattcattttttctagattttctagtttatgttcatagaggtattaataatattttgatttttttttgtatttctgtggggtcagtggtaataccttctttgttgtttctgtttatttggatattatctcttttcttcattagtgtagctagtggtatatctattgtactaaatttaaaaaaaaaaaaaaaaacagctcttggatttgtggatcttttgaagggtttttcttgtccccatctccttcagctttgattttagttatttcttgtcttctgctagctttgtgatttgtttcctcttgattttctacttcttttagttgtgatgttaggttgttaacttgagatctttctaactttttgatgtgggcatttagtgctataattttccctcttaacaccaccttatctgtgtcccagggattctggtacattgtgtcttttttctcatttatttcaaagaactttctgatttcttcctgaattttattatttaccaaaaagtcattcaggagaaagtttttcaattttaatgtaattatatggttttgagttaatttcttagttttgactactaatttgattgtactgtggttcaagacattgttttttatgatttcagttcttttgcatttgctaaggagtgttttactgctactgattttgttatcaattttagagtatgtgccatgtgacaatgaaaagcatgtatattctgttcttttggggtggaaagttctgtagatgtctattagatccatttgatccagtgctgagttcgtgtcttgaagatctttgcttattttctgtcttggtgatctaatattgtcagtgggatgttaaagtctcccatgattattatgtgagagtcaaagtctctttgaaggtctccaataacttgatttatgaatctgggtactcctatgttgggtgcatatatatttaggttagctagatcttattgttgtattgaaccctttaccattatgtattgtccttgtcttttatttttatatttgttggtttaaagtctgttttggctgaaactaggattgcaaccctacttttatctgttttccatttgcttggtagatttttctgcatccctttattttgaacctacgtcattgcatgtgagattagtctcttgaagacagcataccaatgggtcttctgattccttatccagcttgccactcggtgccttttaactggggaatttagcccatttacattcaaggttaatatggatatttatggatttgattctgttatgatgttaactgtttattttgctacttgtttatgtggttgcttcatagtgtcactgatctgtaatttagtttatttttgtagtagctgctaatggtttttcctttctgtatttagtgcttccttcaggagctcttgtaaggcaagtctggtggtaacaaattccctcagcatttgcttgtctgagaaagatcttatttctcctcctcttatgaagcttagtttgacgaggtatgaaattctgggttggaattcttttctttaagaatattgaatataggccgccaatgtcttttggctcatagggtttctgctgagatgtctgctgttagcctgatgggcttccctttgtaggtgacttggcctttctctctagctccctttaacattttgttctttcatttcaaccttggagaatctgaagattatgtctgttggggatgatcttcttataaaatgtgttattgtggttctctgcattttatgaatttgaatgttggcctctctaggtaggttgctgaagttctcatggataatactctgatttatgttttccaagttggctctattctcctgatatttttcaggtacaccaaagagttgtaagtttggtctctttacgtaatgccgtatttctcagaggttttgtttgctcattttcattcttttttctctatatttgtctgactgccttatttcagaaagtcagtcctcaattcatgagattctttccttttcttggtatattctgctgttgatacttgtgattgcattatgaaattcctgtagtgtgtttttcaggtctatcatgttggttacattattttctatattggctattttgtctgtcagcacctgcattatttatcaggatttttagcttccttgtactggattttaatatactcttgtagctcagtgatcttcattcatatccatattctgaattctatttctgtcatttcagccatctcaccctggtttagaacctttgctggagaggtgatgcaatcatttggtggaaaaaaaggccttctggctttttgggttgacacagttcttgcactgattctatttcatctttgtgggcttatctaccttcagtgtttgatattgctgacatttgcatgggtttttaaaaattcttttatcctatttgatgaccttcagggtttgattgtgacattacgtggattcaactgactggctttgtttctggaagattttagggggtcactgcttagcccccaactcctggactatgtgctctcactctgggggcttgtattaagccctgactttgttctcttggctccttgatgttaggaacccactgcactgaggtggggggaggcagtgggtggtggcggaaggtgctttcagaccacaggtcacaacactctgatgggtggtgccagccaaagcattttttagtgcagtaacagtaggatcagtcctcgttctcacgtgctagcagcaacagtagtggcagctgcagcagagtgccagcaggtgccatggttcctgcctcccttcaggcattcaccacagtggtgaaggcaacacagcttggcggtgaggggggtctctgttggcaactgtgtgtatggtcacactggaggtgatgttggctcaggggtggggtgctggtaggcacaggtctgggtgtcttctctgtgtcccggaaggtggagtggtcactcagtacgagggaggatctgctgttcactgtgcagtattagcacaagggcagggtgctggcaggggagaggttggctggttctgtgcctgccaaggctctgtctgctctgcaatggcagttggcggagggtgggggacagacagtctgtgaggtaagcaaagaaaaatccatctgggcagacacacaccagccaagtgatgtgggaccctggggaagctacagtatggggagagagtgtgcaggctggtgtgtggccgtaggcgtcgtgccactggagctctctgcagctcaggcacaatccaccagtgcagaagctatgggctcccaagtaacccgagactgccctgcaagcagtcatggccagtctggggccccaggagaagccagaagactaaggggtgctcaggtcgcgcaggccccatatgatgggcaaaactgcctgacagagttcaggtccagcagttccccatgactaacgtctcctatgggagcaagtcaaaccaagggggtggctatccctggcaatattctgttacacatgctcccacataaaaacctctggactccacatcagctggcttgctgtccttaacacttctttaagcatctctccctgccaacacaagtgtctgtagtggtcaacggggctcctcctgccagtgattcagaggcccatggtgagagcagactgccccttgccagttcaactgacccattccctgggagccactgggggccaggaacaagtcctgttgcacgctggacccgtgcagagttccgagctttctcctgcttcagcccagcttctgtgtcttccttctgtccactcttggtgccttccctctgaaggcctgttaggagcatgccagtcatcttggtcccttggtggtgctgtttcccataatttcttaatttaggaggtttaggtagataaatagataaaatttcctttattcctatgtaaaacacaaaaagccagtaagcatgcttcataacagaaaggaacttttaatataatgttttaaaccattttttcttttcttcttcttatcattattattttttgtagagacgaggtcttaccatgttgcccaggctggtctcatactcttgggctcaggaaatcttccgccttgtcttcccaaaatgttgtgattacacacataagctctgtgactagctttttattttttatttttttcatgtgtagtttacattgtgggaggagacatgtaaacaatttcttaccttgcttaagaaatacaggtagaatatggcatttcctagctatctcctctgggaaacaaaaatgctggaatcaagagactctcacaacctcttaaatgcattactttctcctaaaatgtcttatcaagcaatgccagtgagacagtgtaagttatcgctttatcacttgttgactgtttctgttaagaagctcattgttgataagtttgtaaagcgacttatgtcttaaatatagttccaaatcgatttttaatgaaacccatgggttttaggagatcagaaaactaatttatgttgtgtagtaactcattctatgaccctgggaaatttggttctcattcttctacatgcaaaatactgtcattttaagatagctttagaaaagtaaataccaatgtttatttttaaattttaaattttatgaaagaattggatcaaacaaaaaaataaggaaagacttgagtagtgtttttataaagataggttgaaatgctctgttctcttactgtataatcgaaaaaaatcagtaagatgggctacattacattagaaaagttgtacaacctcattattttttattgttagttcaaaaaaatgaaacaaagaggacactaacaaattggaaatgacaagaacatagtctcatggaacttttttgacatcttaacaaatttatcattgtaagctcatgtttttaacttttccaaaaaatgtaggacttcagtgaattttgttgagaggctgatgaacactttcttggtattatgatatatgtttttcttttatttcatctttgctacaattactttctctgcttactttttatgtctgaaaccctacttattctagaaatgtaatatgttttcaataacaaattaagaaagattgtgatagtaaaacatagttttgtacaaaggagtgttttttaaatgataaagcctctgtacaaatgtaaggtggtattattattttttgaaagatttatatcggtaagaatttttaagatattctaagagtaccattcattgtcaaaaagattatgctgatatccaaacattcttcctcaattgcttgaaaatcttaggagatatgccactgtatcaagagacaatgctatttccttatttgactaatatgctaaaaaaatacatttctaacatactggctttgaacaactgttttctcttgaccatcccgtaaaagataaattattaataatttcaatactaaattaataaatgccatttactttgatcatggatatattttaaaattacattatagtttgtgttttatttgtaaacttcatcaacatttcatataaataccagagaaaatcagagtaaatataatgtctaagaatcatttgtttagttttatttcaaaactgtaaaaaagacttagaatatacaatctatgctattgtttggtaatatattttttagttctttagaatatatgtataattctaggctgggggcgttgtctcacgcctgtaatcccagcactttgggaggccaagcggggtggatcacgaggtcagtagttcaagatcaacctggccaatatggtgaaaccctgcctctactaaaaatacaaaaattagccaggcatggtggtgggtgcctgtagtctcagctacttgggaggctgaggcacgagaatcgcttgaacccgggaggcggagtttgcagtgagccaagatcatgccattccattccagcctgggcaacagagtgagactccatctaaaaaaaaaataaattaattacaaatatataaatataaatatatataatatatattatatgtaaatatatttatatgtatatataaaattctgtgggtaaactatgtgaattttacctctagtaaatgtagttgtataatcagtaaagatatcctaaaaatattatgcttttaaaatttttaaatagtatttcaatagtattcatttaatagtatttaaatagtactcatttaaaaagtacacttactgtaaatcaatggaatgttaatctcttaagtgagcatataaagatagatctacaatgaatttttagttaatgtttataaaaaaattttatagcatcaagtagtaattattaatgctgaaatgatatataaaatattttttaattgttttgcgctaactaataaagaaacaaaattgtggttttcttaaccttgttttcagtatttgagaagcagtgcctcccatggacctatttggatgagtatatacctccactgatttatttcactagctacccaggtgttgcagacagcatgctactttgaaactaagtcaacataagaattatatgaggtcacttatttaggtagagcagaatatattgtcaatgattacacatcgttgtgttttctcatctctgacctctgtccttggccatattccttttttctttcttctttttttttttcacttgttcataaaattctgtccttgtttgccctgataaagttgtctgttttctttgttttttaatcttttgaattttttgtttataagaataaggaaacagcttgtaaatcttacagtaaagccctccagagagaagaccagcagtctacaaatacaaagaaagtcatgatgactcaatgtcaaacttgatgtgtttgagaagccaaaaattatgttcataaatttactggaggaattattgggaggtttgtgagaattagaaattattatttgttttttatttgcattttttaatgtttttgtctttttttaaattatactttaagttctggggtacatgtgcagaacatgcagttttcttacacaggtatacatgtgccacagtggtttgctgcacccatcaacctgtcacgtactttaggtatttctctaatgttatccctcccttagtcccccaccccctgacaggccttgctgtgtgatgttcccctctctatgtccatgtgttctcattgttaaactcccactgattagtgagaacatgtggtgtttggttttctgtccttgtgatagtttgctgagaatgatggtttccagcttgttctatgtccctgcaaaggacatgaactcatccttttttatggctgcatagtattccatggtgtatatctgccacattttctttatccagtctgttattgatggacatttgggttggttccaagtctttgctattgtgaatagtgctgcaataaacatatgtgtgtgtgtgtctttatactagaatgatttataatcccttgggtatatatctggtaatgggattgctgggtcaaatggtatttctagtcctagatccttgaggaatcaccacactgtcttccacaatggttgaactaatttacactcccaccaacagtgtaaaagttttcctatttctccacatcttctccagcatctgttgttttctgacttcttaatgatcaccattctaactggcgtgagatggtgtctcattgtggttttgatttgcatttctctgatgaccagtgatgatgattattttttcttatgtctgttggctgcataaatgtcttcttttgagaaatgtctgttcatatcctttgcccactttttgatggggttgtttgtttttttcttgtaaatttgtttaagttttttgtagattctggttattactcctttgtcagatggatagactgcaaaaattttctcccattctgtaggctgcctgttcactctgatgatagcttcttttgctatgcagaagctctttagtttaattagatcccatttgtcagttttggctttttttgctgttgcttttggtgttttagacatgaagtctttgtccatgcctatgtcttgaatggtattgcccaagttttcttctagaatttttatggtcctaggttttacgtttaagtctttgatacatcttgagttgatttttgtataaggtgtaaggaagggggtccagtttcagttttctgcatacgtctagccagttttcccaacaacatttattaaatagggaatattttccctattgcttgtttgtgtcagatttgtcaaagatcagatggttgtagatgtgtggtgttatttctgaggcctctgttctgttccattggtctatgtgtctgttttggtaccagtaccatgctgttttggttactgtagcatttcagcataatattattgttcaaaataatttatggattttacttgcttttagtttttgacatttgatttctatttagttaatagtcttaaacaatgagataattccaaatacaggcaaaatgcattataaaatgtataagactggagtcaggaaactgaacctgggacaaactacccaaatttctgagtatgtggctgtaactttccggatttataaaatagaagtacaggaatgaaatcacttgtatgtaattttttatccgtatttcagattctttagtaggttatatcataagaacataaatattgctgatatacttgaaatgagctatttgaaaatcattgcaaatataatttaaatcacaaaaatcaaaaattaaatcacaaaatatttactttaaaaaatttactgtatgcatttttacacaactataatgacataatttacactaatctgaactataatagagtttgtctctatgtttagatgatcttgtaacaagttatttcaaaatttagtggcttaaaactataattttatttagttcacaattttctatgtcaagaacttgggaatgattcaactgggaagttctagccttgtgtttctcaggcagttagagtgagatgttagctgagactttagtcacctgaagactccaccagcctagatgtccaaggtagctcatactcacagtattcaacacccagcattcaacaccggttgatgttgggtgtcctttgggagctcagtgaagctgtcagtggaagcgccatgtggtttctgcttctcagcatggctactgggttctttctgcaaaggagtaacctcagaaggagcattataactgaccatgatggaaggcctttcctgatctaatcctgaaagtcatgcagagtcatcatattctattaatcattgcaagtcaataagactagccaagatgcaaggacaggaacattagactccacttttcaataggaatactagcaaagggtttatagctgtctttaatctaccacactgagttccatatttatggataattattgaattaagaaataatagaattgaattttagttcaaaaattaattacacttgaatgagaaagagaatgtcataattattaaattatatttttcctatcaatgaataatatgcatttttacaagcacagggtcaaattggttacattagcctacaggttaatggaataacttcattttgaataccaagaatattaaaatcctgttcattctacacatcaatatgatttctaactcaatagatcatccttaaaaatatgttctagaattttgcaaatacaatgagaattttgatgggttattgctatcaaccctcatttgagagtaagagttgtttaaaggctttcattttgcctgctagatagatattttaggttggtgcagaagcaattgcagtttttgttatatagtaatggcaaaagcctaaattacttttgcaccaagctaatatttatgtgaatgttgccactgtatatatacaactaaagacaaaatgctgggtagcaaaaattcatttgcaaagccattcatagagaagacttttataaattgtcttcttatggcatataataaatattttatatgtgttattccataaatgaatgtaaatgatatattagcatctatccagtttaatgtggtgagattgtgaactccttcagaaattttcctgggaataaaatctgagaattttttaaatgagcataattttggaaaactgagtttctttgcagttcctagtagccacaatatagggaaatgttccattttaaactatttaattaacaaaatgttaattaatacaaaaatactgttgttaattgttcaacaaaaacaactgtagtagatataggccaaatctcagatcccatctcaataaaggactcactgaccagcttccaggagtgtggctagcccactacagcattagctttttcaagggtcagcctcagctctccagatgaagttcaagctcatcactgggtgatctgaagcaaaggctgagatctagctattcatgaggcactccccaaccaatgagtgaacaagggagtagtacaagagccaacccacttttgctcaacagggggatttctgtaacaggaaatcttagctatgagcccctcatttggctcatagagaatttgttagtaggaatcaaggtttgactgtcccctactcaatcctgaatcctcttcttttttttttttcttcacatttcctttcctttcccttccttaataaactttatgtatccttaactccatttgattcctggagaaccaacttgtgacattttattttatgaataaaattaacttttcttaagtgacatattatgcaagactttggtaatataagtagtaatacaatagagtttttgtcgtaaggtggttatagtttggtgtcatcatcaacctccacagaaatttccatgggactaaagaagttaagtaactagcacagaactacctggctagttacttgtagcatccaggatttgatcctgtatctctctgattgtaagaatcatgattattatcttacctgcatcctactatgctaatattaatatttcctttgcaatgtagagcaggtaaaaccttttaccattaacagtaatatttagagtctaggagtataagtattaaaaatgagtataatccttgtccataatacccaagatttggggaagaaattggactactgtaaaagaggtggaacagaaagagttaataagcatcttccttgtagtcaagctggttgtcagcaaatgaaaagatatattaataaattacaactaagctaggtgtggtggctcacacttgtagtcctacctcttcaaggggccaaggtaggaagtttgaggccagcatggacaacataaagcaactccatctcaacaaaatattttaaaagtttctgggtaaaataatgaccatggtgaaaatcgaatcaagaactcagtctcatttacatttgcaaaaaaaaaaaaacttatgaatatacttaaccaaggagatgaaagagctctgtaaggactataaaacactgatgaaaaaaatcatatatgacataaaaaatggaaatacatcctatgcttaagctcatggactgttagaatcaaaattgtgaaaatgaccatattgtccaaagcaatccaaagattcaatgcaattcctataaaaataccccaacgtcattttttgcagaattaggaaaaaaaaattttaaaacttatgtggaaccaaaaaagagtgctaatagccaaagtaatcctaagcaaaaagaataaatctggaggcatcatattacttcaaattttactacaaggctatagtaaccaaaacaatatggtacctgtataaaagtagatacatagaccattggaacagaatagagaacccagaaataaaaccaaatgcaacagccagctgatctttgacaaagccaacaaaaacatacactgagcaaagaacaccctattcaataaatgatgctggaaaaattggatagccagatgtagaagaatgaaactggatccctattctcaccatgtacaaaaattaacggaagatggattaaagacttaaatctaagccctaaaaccataaaaattatattagaaaacctaagagaaacgattctggacattggcttaggcaaagaatttttgactatgaccccaaaaacaaatgtaacaaaaaggaaaataaataaatgagacctaattaaacttaaaagcttctatacaacaaaagaaataatcaacagagtaaacagacaacttatagaatgagagaaaatatttgccacctgtacatcgacaaagaactaatatccagaatctacaagcaactcaaatcagcaagaaaaaaaataaataatcccatcaaaaagtgggtaaatgacataagcagacattcctcaaaataagatatacaaatggccaacaaaccatatgaaaaaatgctcaacatcactaaccagcagggaaatgtccattaaaaccacaatgagatgtcactttatccagaataaccattattaaaaaatcaaaagacaatagatgttaccatggatgtggtaaatggtgaaaatggaatacttatgcactgctgatgagactataaattagtacaacctctggaaaatattatggagatttctcaaagaactaaaagtacctctattattaaattcagcaatctcactactgggtatctacccaaaggaaaagaaatcattatatcaaaaagacatgtgcatgcatatgtttaccacagcacaattcacaattacaaagatatggaatcaatttaagtgcccatcaactgataaatgtataaagaaaacatggtattataagtcaggcacggtggctgatgtccgtaatcccaacattttgggatgctggggtaggaggatcacttgagcccaggaatttaagaacagtctgagcaacaaagtgagaccccatttccacacacacacacacacaattagctaggcatggtagcatatgcctgtagtcctagctactcaagaggctgaggcaggaggatcctttaagcataggaggttgaggttacagtaagctgatcatactactgtactccagccttggtgaagagcaagatcatacacacacacacacacacacacacacacacgcacacacacagcacacactgtggaatactatttagccataaaaataacaaactagtgaaagtattttgcagcaacttggaagtaattcaggaatggaaaactaaataccccatgttcttatttataagtgggagctaagctgtgggtatgcaaagccagagtgatataatagacactggagacttagaagcagggaagtgtgaagggagtgaggggtgaaaaattacctattgggtacaatgtacactatttaagtgataagtacactaaaatcctagacttcaccactatacaattcatccatgtaaccaaaaaccacttgtacccctaaagctatagaaataataataacaaaccaatgaaaataaaattaaaaaaataataaggtaaaaaaaaaaagttagttggatgtggtggtgcatgcctgcagtcctagctacttgggaggccgaggcaggaagattacttgagcccaggactttgaggttacagtgagccttgattgagccattgcactccagactactagacagagtgataccctgtctctaaataaatgaataagaactatacattctttgtagttcagtatggaagaagtagaaattctaccatgagaaccagaataaacaggtattatgttttctctaatcctttagatgtttttggttgttgttgttccttgtcagctcagataagggtgccagatttcagagaaaatgggtatactgctgtttatactgcttatttggtaattgtattggaaaaaaacatgaatttgagcatcttctttttttcaaatagagatggtgtttcactgtgttacccaagctagtcttgaagtcctgggctcaagctatcctccttccttggcctcccaaagtgctgggattacaagcgagagccaccatggccagccaaatttgatcaccttatatgtgtcagttattatgtttggtgctagtaatatggtaatgcaatagaaactatatgctcaaatagggaataaaactagttcagtgaggccaggaacagtggctcatgcctgtaatcccagcactttgagaggtcaaggtgggcagatcacctgaggtctggagtttgaggccagcctggccaacatggtgaaaccccgtctctactaaaaatacaaaaaattagccaggtgtggtggcacgtgcctgtaatcccagctactcgggaggctgaggcaggagaattgaacctgggaggcagatgttgcggtgagccgagattgtgccaaggcactccagcctgggcaacaagagcgagactccctctcaacaacaacaacaacaacaacaacaacaacaacaaccaaaactagttcagtgaggttggggaacaagcaaacaacactttaagtattgcatgaaatgatgtatggtatggatgctatggagcattcccaaaggggtgtgccacttggccaaaaaggaaaatctttctagtgaaataaagagtaattcttttttttttttttttttgagacggagtctcgctctgtcgcccaggctggagtgcagtggcgcgatctcggctcactacaaggcccgcctcccgggttcacgccattctcctgcctcagcctcctgagtagctgggactacaggtgcccaccaccgcgcccaactaattttttgtatttttagtagagacggggtttcattgtgttagccaggatggtctcgatctcctgtctcctgacgttgtgatccgcccgcgtcggccttccaaagtgctggggttacaggcatgagccaccgcatccggcaggagtaattcttgagatgtgtcttggagcatgaggtattgtgagggagagaaggatacaacgggtagaaggcaataaaatccagaaatttgcatgtgtaaagtgaggagatgtgaaacaacattgcatttcagtgctgtaggaatgaacaaagtgaggaggttgaaagtcaaaaacttgcagctccggaaataagcaagtaacagttaatgaagggtacaatacactatgctgaagagttttgattttcttcctgaaggagaagatgattagctgttaaattaggaagtgacaaaattaattcctgcttagaaaaatctctctggcaaataaggaaagtgatagagataaaggaaaaatcactttagagacaattacagaaatttgggtaagaagcaacaagtacttagactgtcaatgtggaatggagaggagtaagtccaagaaatagtgaagaagtggagattaaatttggttccagatttggttcaaagtgagtagcagctgagcgtatatgatggcttcctgattattaatttaggaaataggaagataatggggaaatcagcagaagtgaagtcttaaggtggcggaagaggatgttgaattggagtgtctgtggaacaatattgagtatatgtttagtgagtagttgtacttaagagctggagcttggaatacagataattctggattagctagttgtatcttgtagttactagctgtattagtcagggttctttagagtgacagaactgatggaatatatatatacacacacacacacacacacacacatatatacacttaataaactcacatatatatacacatatatatatatatatatataaacacatatatatatatgagtttattaagtattaactcacatgattacaaggtccacaataggccatctgcaggctgagaagcaaggagagccagtccaaattccaaaactgaagaacttggagtccaatgttcaagggcaggaagcatccagcacaggagaaatatgtaggctgggaggctaggccactctctcttttcacatttttctgcctgcttatattctagccattctggcagctgattagattgtgcccccccagattaagggtgagtctgcctttcccagctcactgactcaaatgttaatctccattggcaacagcctcacagacacaccctggatcaataccctgtatccttcaatccaatgaatttgatactcagtattaaccatcacaccagcatagagtagtagaggccatggatgtggatatattgtgtacattgaggtcgtggttgggtgtacatgcagagtgagaagattaaatgcccaaagattgagctctagtgaaaggcacaattgttacagggacatcactaaagatgagcactgtaacatggatattggtttgagaattaatatttaattatagccagggaccaaatggtagatatagtatctatactagtccattttcacaccactataaagaacaacctgagactgggtaatacataaaacaaagagatttaattgactcacaattctgtgtggctggagaggcctaaggaaacttaaaatcatggcggaaggctgaggggaagcaaggtacttcttcacaaagcagcaggagagagagagagcttaagggaaactgccacttttaagccatcagatctcatgagaactccctcagtatcaccagaacagcataggggaaaccacccccatgatccaatcacctcccaccaggtctctcctgtgacacatgggaattacaatttaagatgagatttgggtgggatcacagagacaaaccatttcattctgtccctggcccctcccaaatctcacattcttgtcacatttgaaaaccaatcttgccttcacaacagtcccccaaagtctaactcattacagcattaactcaaaagtccaagtccaaagtctcatctgagacaaggcaaatctctttcatctatgagcctgtaaaatcaaaagcaagttacttaacttccaagctacaatggaggtacaggcaatgggtaaatgttcttattccaaatgaaaggaattggccaaaacaaaagggccacaggcctcatgcaattctgaaacctggtgggccagtcattaaatcttaaagctccaaaatctcatttgactctgtgtcttacatccagggaatgccgatgcaagggatggactcccatggccttgggcagctccacccctgtggctctgtggggtatatcccctgcggctcctttcacagcctggtggtgagtgcctgatatagtttggctgtgtccccacccaaatctcaacttgaattgtatctcccagaattcccacatgttgtgggaggaaccccgggggaggtaattgaatcacaggggctgttctttcctatgctattctcgtgattgtgcataagtctcacagatctgatgggttcatcaggggtttccacttttgcttcttcctcattttctcttgccactgccatgtaagtagcatctttcacctcctgccatgattctgaggcctccccatccatgtgaaactataagtccaattaaacctctttttctttccattctcagatacgtctttatcagcagcatgaaaatggactaatacagtgcctgtggcttttccaggcacatggtgcaagctgttggtggatctatgattctggggtctggaggacagtgaccctcttctcacagttcccctaagcagtgccccagtggggattctgtgtgggtggctccaaccccacatgtcccttctgcactgccctagcagaggttctccttaagggctctacccctgcagcagacttctgcctgaacatccaggcatttccatacattctctgaaatctaggcagaggttcccaaacctcaactcttatcctctgtgtgcccgcaggcccaacaccacatgtaagccaccaatgcttggggcttgtaccctctgaagaaagacctgggctgtacgttggcccctattagccatgactggagctagagcagctgggatgcaggctgccatggcccaaggctacacagagcagcagggccctggacacagcccacaaaaccatttttcactcctaagcctcctggcctgtaatgggagaggctgcttcccttgttgggagaggctcctgtacggtgatgggaggctgcagtgaagatctctgaaatgacctggagacattttccccattgtcttggctataacatttggctcttcattacttaggcaattttctgcagtcatcttgaatttttccccagaaaatgggtttttcttttctacctcatggtcaggctgcaaatttttcaaacttttatgctctgcttctcttttaaataaaagtgcctgtttccaataatttgtttttgaatgcatatgactgaatgcatttggaatcagccaggtcacctcttgaatgctttgctgcttcgaaatttcttccaccaggtaccttaaatcatgtctctctagttcaaagtttcacagatctgtagggcagtggcaaaatggcaccaggctctttgctaaagcatagcaatagtgacctttactccagttcccaataagttccttatcttcatttgagactacctcagcctggactttgttgaccaaatcaccataacattttaatcaaaaccattttagtttctaggaagctccaaactttctcacatcttcctgtcttctgagccctccaaactgttccaacctctgcccattacccagtttcaaaggtgcttccacattttcagtttatctttatagcagtgccccactccaatcaccaattttctgtattatccattttcacattgcaataaagaatgatctaagactgggtatttatacaggaaaaaggtttaattgattcacagtttctcatgactggggaagcctcaggaaacttacaatcatggtggaaggctaatgggaagtaagggatgtcctcccaaagtggcaggagtcagagagtctcagggaaaactgccacttttaaaccatcagatctcatgagaactttctcactatcatgagaatatcatgggagaaaccacccccatgatccaatcacctcccaccaggtccctccctccacacgtggggattacaattcgtgatgagatttgggtggggacactgagccaagccatatcagtatctttttaaatgtagagttatttctgttctacttactatgtatgcacaaacatgagagggaataatttaggaaggtttcctggtttctgtcataggcaaataaatcgatagaggaataccaaaaacaaaacaaaaaactaagcaaaaacatatgtgtgtgtggatgtgtgtgtgtgtgtgtgtgtctacatgattatgtgtagcataaaagcattttttggatacattaacttattttttgcaactaagaatatattatgaaaaatatcatactatagagggaatttgagtttcgttagtcagatgcaattatctcccactgtgtgaagctgactttccttatcaagagcaaagtaaaagggctaagcctattatgctgtctctttgatgtttttataggatataatgaaagatgaatgctcgatgctcaagctgcagctgaaagagaaggatgaactcatttcccaacttcaggaagagctggtaagtgataacaatgcttggcccacgagtgtactttactttcaaggttatttgttccacgcccttatttattaacaccaatggcattagttatttgtaaatccttccagtggttcaatccaatgatcagtttttataattctgtcatgaaaactatagatctttgacaagctgaagaatagaaaggatgttttataatatatgtggaaatgtatatggttccagaaacatatcactgaaccaggattaaacatttcggttgtatctatcagaaatcttgaaggcttaggccacattgtttttgtaaagtgcatgatttaactccataaagctatacctaaagatacagatctataatataaagcaaaatacttgatctagcaaacaaaaccagattttacattttacttttataaagccatcaaaaatacattaacctaatgagacttcttgttaatttattatatagttcccaaattatgtaaaaattatacaaaaatatgcagtgtgtgtggttcaggttttagagtatggtttttaatgtaatatcatgaaagaaagtaaggaattacactttcataatataaaaatacatttggtagatagcagacagagcagtgggcattattttttctaagtatgtgttttctatgtatctatgaatattaacagtattttgcaataaaatgtgcactcaatataaattttaaaagatagtactctaaaacaataattaaatagaaagaaataagaagagatatttttaattcatcattcatttttacactaataatagattaaagaaataaccatgcaataagagagaccctgactcattatcaagatcaagaaacaaatccttctcaacgtatttttaatgattatttcagactcacaatagtgtattatgtaattattgaacacaactaaattacaaaacagactttatagaccatcgaacttctgaggactcctaacatattagtgagatattggagaaattcagagcatagtttatagactcttcacaactgacaatgttttccctgaaacttgatctttatttaaacagtgttctaggattggattgatgctgatccttggtcccattaacatgttactgtggctttagaagacttataaactagtacttagcataagaatagtatcacagacaaaaggaacacgtgttacattaccaaaataaccttttataaacctgtaagtaacatattgtagtgtcaattttatatattacataatgaaaacatttctttatttaaatatagccctctaggtacatattatctaataatgcttttttacgttgcatacaaaaatatctttgagttgactaaatatcacctatagatatttattgcataatggttaaaataatcaattttaacatagcagagtatttattactttgtcagagagtgcttattttgaacttgggtaattaactcagaaaagagtattctttttttctcagcattagttatgatcagttttaaaacattcatatacaagaaattggaccttcatttgctgaattaaatgaaaaagaaaatgattactttcaaagacagtactacatagttataatttaaaaaatttagtatacctccatctaaaaaagtcctatatatttctttttcttttctttatacttgaattactcaaattggctacttagtttctaaaatttctcagggaacaatcaagcagcattttaattttgtgctattgtagtttccataatcatcttgaataaacaggaaaaatgttaactttaaaaaaaatatagtttattttattaattaaaaaggactgcagctaagggagaagtatgtaattggtgattcaagaattttacttagaggaaacatggttggaaaaaaaattgtcattcaaactggatttggagcatggataagaaatgccaatcatgtaggccaatacaaaccccttgcatccacggaaaattttggtcctcctatttctggtcctggtaataaataacttgtgacattttgttatggtggaggttaaattttacacttatgctttacttacattgaaaatttcaaaaaattttagaaaccagttgagttataccctactatatactacaggttcataatctttaataatttagaactgattcagttttctattctttctcatgggtttctgatttcttgaccactgttattatcacaagcaattgtatctacatgtatgctgtagaatgaaattagatgtaattgtaccaagaaaggctttattcccaattagtaattaagaaagttttaaattttttgattatttatatttttgagttagcctcatcaatagtgggaagagttgtaaaaagttagggacagaatgggtctagaaaaaaagaaatgtttttcttttcttttttttctttttttttttttttaagatagaatcttgctctgtcaccaggctggagtgcagtggcatgatctcagctcactgtgcaacctccacctcctgggttcaagcgattctcttgcctcagcctcccaagaagctgggaccacaggcacacgccacagtgcccggctaatttttgtatttttagtagagacgaggtttcgccatgttggctagctggtcttgaactccttacctcaaattatctgcccacctcggtttcccaaagtgctgggattacagatgtgagccaccactctgggccataacaagttttttagtcatttaaatgcaagtgttttagtcatttgtttttagggcatggtttctgaacaatagtgctggtggcactttgttgtgtctgtgctatgaattgtaggacgtttagcagcatccctagcctctctcctctagatgccagtagcacctctacacattgccaaatgtcccatgggggcaaaattgcctccaggtgagaaccactgctacagggatattagattaaatgtgtagtccccaatgaaatggtatgttatagaaaaaacatctatttatagatacccaggaaaaaaacaaaaaactccagcacaagagatgcacctttccttgggctattaaatatgtaactgtttgtacactgtatttatctactaaggctaccaaaacaaaatgccatagatggggtggcttaaacaactaaagtctatttgtcagatttctggaggatagaagtctgagatccggtgccagagtgttgggattgtggtgagggctgtcttcctggcttgcagatggccatcttttcggtatgtgctcccatggtctttccttggtgcatgcacatagggagagagagagaagagggagaaagagagatcatgtgagccctctgatgtctcttcttctaaagacactaatcctgtcataaggaccctacctcatggcctcatcaaaactcccatcatctcccaaaggtcctatctccaaatatcatcacgccgggagtcagggcttcaatacatgaattgtggagcagggggaacaattcagtacatagcacatactctttgtgctcatgactgtttaatattagcaagttcagttgtggaaaattagagagttctactatatatttttttccagcattaaatgcacgtttcaaaaattattcttttctaccatatgatttcaaaattattacattgccttaattcttttttattgctgggtgggtagatttcacaaagcataaagacactgagaaactgaaaataataatttcgatttaggattatatattgatattatttgggtaaactattcagattattaattgcatttctaatgtgaatgtatttttgtattttatagccacacttccaatttattccttctttttaaaaagaaaacaataagctgtttgtactcttaggaacaattttaaaaagtcaagacttattatccctgaaatatttatgcattacttaccttggtgagatttactgttttcaacagatcgagataaaaataatcacttgtaattgttttattatgtccaaagggatattaaatgttagaatattacagtgtcctgggattatgtgctagggaaactaattggagaaaacgagacatacattctgtagccagaagtttgcagtatggtaaacagagaggaaactagttcacagcatggaacatctactcccaactgttctataatagaacaaaatctcctctgcattaaataagaaatagagcaaaggaaaaatttcttctcttcatcttcctggggccttagctttctttacttgaggagaagagtgagtcaatatggtgatatggaaaattgggatatgagtttcttgtcctacctctaatcttaattgcctatgtgaccagatttaggtatttttctctatttgggcattggtttcttcaactgtcaaataataccactgtatgttttggtctgttttgtgctgttctaacaaaatatcacagactggataatttatggtaatttataaaaacagaaatatatttctcatagttctagaggctgctaagttcaagatcaaggagctagcaggttagggcccatctctctgcttccaagatggtgccttgaaagctgagggaaggaatgcttgtcctcacatgatagaaaggcagaagagtatgaatctgctcctgcaagcccgttttatagcagctttagtatatacatgacatggaagccttcacgagctaaacatctctccataggtggcacttcccaacactgtttgggattaagttttcaatgacagaatttggggcgacatactcagaccataggaccataacattaaaaatattacatatttatcaatagtgaatttgatagattatagcatatttatatttatataactgtattatatattatatatatttttatagctatgttgcttataaaattattaagtggagggaaaagcagattttagaacagcatattgtataacacgatgtgaaaaacgtatattgtatagaaagtctagaataattaatagtatttaactttgagaaattagactgctcaatttctgctttaatttggtaatgtgtcatttttaataacaaatatattacttgtataatcagaaaaacaccagactacttctttggaaaataaatgaagaatttcaatgtgtttaatggttttcattccgtgatcagtgtgtgttgggggaaataagggccgcagagggatcctgtggatttctattccccacccacttaatgatagtagccctcatttcattgttttttgcatgtcattacttattacagtatcatttcaatcaataagcagtttttatttaatgcatatcattatactcctaagattttatttgatgaaaaaccacagctgagaacaaaatcaagcaaacaaaccaaaaccctgaacaagatgattgctaagaactactgcgaactattaaacagggtgggaaatgagaacaaaagctatgacatacacctcagtgagaattattacacatcatggtgattggagagaatattagctaattgagggcatggaaaagaaccaacgttcagaatcaaaaataaaaggaggacttttttgataattaaatgtttggataaatagtttaaaatataggttctatttatgttgtagaatatattggactttttgaatattagaaatacatcactcttatccaacagaaagatttagggattttactaatttaatttattaagatatttaaagcagagctatagatttagaccaaaagtctaaacataatagctaaacgtatgcatacttaatcataattaattataataaaaggtattttaaatatttgcatcataagtttaatttattacacttaatgatataaaacagagagatatttttctcacttctgagaaagtttcagtgtctttccctcagctattttgtgaaggttatgttgaagaatgccatgtaattttattgcttatatgatactgaagggcactgtaaatattatcctcaggttactaaaataaatttgagatatttgtcataaatgttgatggtgaagtgtagtcttgtgttttggggggatggatatgttcttgtaaatgattattaatcttatcagtggtttcaaaaatcttatacatggttttacactatggatgaagagtgtgtaccatacgacatcagaaattgaagaaagtatatttggtatttattaataaattaattcaaaatattttttaagtaagttagagttaaattacaaatgaaaacataataaatttagttagttctatgaccgtgaagagaagaatttaattgtcctaattaaggttagtagacggtgctgtgaatttactgttttaacttggatgacaatttacatatacactttcaaaaatgttaaacagatttgtatggataatcacattactaaatgtaagttgtcagcagtttatatttctgaacttttggggtttctaccattcagaattttcctgttggacacttttatttgttttctagccgatcggggtaaaatgtatcagatacagctttctatgtctatttctgtaaaaacatatgtgttttggctgggcctggtgactcacgcctgtaatcccagcacgttgggaggccaaggcgggcgaatcacgaggtcaggagtttgagtccagcatggccaacatggtgaaacctcatctctactaaaaatacaaaacattagctgggcgtggtggcgggcacctgtaatcccagccactcccgaggctgagacaggagaatcgtttgaacctgggaggcggaggctgcagtgagctgataacgtgccattgcactccagcctgggggacagagtgagactccatctcaaaaaaaaaaaaaaaaaaaaaagtttctatttaaaagtccaattcaaatgggtcaccggaaaaacaaaatagattttctgaaaaagtaagtttattagccctctgtaaaataaacactttaataacagcccttaataacattatttaaacaaaaaagcaaaacaaaaatacttattatgttttctttcataatcttcctctgtttactaacattacaacaactatacttttcaatgctagtgaaatttaagttacctctgtttactaacattacaacatctatacttttcaatgctagtgaaatttaagttaccttcaccaccacatctttttaagcagtaagggaatacattgactgtaggaataatgtatgactattatcagaggcaaaaatttaaaacatgtcggtaatgagagactctttcctaagaagatttttttgtgggtctgaattctaaatgtaggttatgattaagttttaaacttcacacacacacatacatacacacacacacacatttttccccacacactttaaaatttttttcaattatcacatttttttaattacctgtcctttaataaacaatgcatttttaaatggaagtttaactaggagatttcagttatggagctgaaacactcaacgattccaccacacatttttattttgagagttaagtttgtgatcttaagtcagaaccttccaactagctgtaaactgtttgtgtttctaaaatttgaggtgctacttattaatgtattcaaatatagatttcaaaataagcaatgagagcatagttattgtaaagacaaagacatggaacttgagatacttaaattatatcagttaatagtaaccatttggagtatttatttgtatttaagattcaaaacaaaagaatagtgtgtgaaccgtgagctctctattttggggggggatgtttggacattttagtttataattaaatattttactgaattttaataatatcttcaaaactgaactttattttttattttaaaatgttaattttacttttaaaattaaagcacaattaaaaaataaatgttacatcaagagcgtgatttagtaattacctatactgtatcttctgcagactctttttttattaaacaaatattacatttattaaaatttactttttactttttgacatatagtttacacaaagttaaataaaagttttaactagcttcatttcttttctggccattattaatattaatttattgccatattatttaatcctatgtttttcttttagaagaggacggttaaaaataagcttttcaggcatccattataatagatacatcattgagttgaacactttttcctcccgtaatgtaaatatgaactcaagaaagccaggcctcattaaaaaaaatgtttaaaaacatgtatcccttttcgtgttattcaacctactgtgttctcactcaaagcaaatattgaaaattatattcttacttgagtgtaagtaagcatgtaaacaatcatgtttctccaaccttttcaaatgtaatttactttattaactgtaaggcaagttctcggctcatttgttaacaattgaatagcaaaacatgggactgaataaaggcacttgtagaaatgatgatttttgaaaaaaattgaaggcagttgaaaaactgaaagtgtatcattatgtgtaatcaggttactatgcataataaaaagggtgagctaaaaataaaagactaagaaatacatatggctaactagcactttatcagaaatctagagaggagtaattttgatactttcagaattcaaattgaataaaatggtatgcccttgatactttaataacagaataattcctgcatgataagagaaacattctttgtgcatgaaaatcatatcatgaatttatcttaaaagtaattccccacttgctctacattctattataatttatggtattatttcatgctagtcattttagaatagaatattacagctccatggatgatttacatagaaatggacagctgtaagtactttcaaatcctctttctttttcatatttaggaaacattacgaacagaaaagtaatagattaggtatacttaaacattattaaagtgtcaggctactttccttcttttttcaggagaattaattgcatatattccagaaaaggcttatctcagcagtaattactctcctagtcagctctgtaagacagatgtagagtgtgaatgtgacagtatcctatgatacataatggggactgcctccagtttcttacacactccagtaccctgatgaagagctgccaaaaagatacaatctttaatattcaatggaatttgctgtagcaatagtacatatttgttaaagtctttatcacaaagggttgttatattgcagtacagcatggatataagaaaataattgctctatgatttaaatgccaataggaaggtgttttacctttaaggcataaattgagttaaaaatattccaccatattgtgatcaaattaggcatgtagttgaaattaatttatacgtaaagttaaacagttgaatattttggatattttaaatttattatataagctatgtcatacaatttacaaactatcttctttattttatacttcttttgttacactaatcaagattccagtacttagagtaatttaacaaacgcaacaatttaagtagtcagtgggacataatgatagccaaagacttagaaaaaaatatataacgcatgttcctgaattatcatggaaattaataatatgcagaaggggaaatatgtgtttttttgtgtgtaactgggccgtcaaaaacaaaattacagcaaatttagtttaaagatgtaattggcttttattaacaatttatgaatttgtggcatctcatataaagatttacaaaagttcctcctctgggcatggcaaaacaattggtatttttttgtttgttttgtttttgttgttgctttttttttttttttttgagatggagtctcgctctgtcaccagactggagtgtaggggtgcaatctcggatcactgcaacctccacttcccaggttcaagcgattctcctgcctcagcctcctgagttttctgtatttttagtagagacggggtttcgccatattagctaagatggtctcaatctcctgacctcgtgatccacctgcctcgtcctcccaaagtgctgggattacaggcctgagtcaccgcactcagcacaacaattgttttttataaggtactttgaataggaacaaggaaacaagctaatacaaaaagtggattgtttaacatcaggttacttcatgttactttccttgtaagagttaaagtggaggaaacttccttattatgcccaataaaaactagcttgtttgggatttggctatcacctctacatgatttcttggaaggccagaaaaataagttaccttgagtttggtgacgtggaatcttaacatgaatgactccattttggttcagtcttttggactctagtacagaagctcagtccaaaacaatggcctcctcctttatttaactgtatgtatataaataaacatgtaatgttctacttcacaataaagtatgtttaaaaatttgaaagtcagtctgagccggggactttgactggagcaagtgttaacatgatgaaggagtagagtggtatctgtcctcaaggaagcaaagggagataggcttacataattttaataacaacagccactagctactgagctcctaacctttgacaggtactgtgaatgctttaggtttattattgcctttactttttataatacaattgagaaataagtattattactcccagttcattcataataaactaaattcagggggattatgtgattcgtttaattctgcataatacatgacagttaagattgagaggaaaatctgtctgactccacgcacatgttattttccctgttacatcaaacagatttataaattacagagagattacaaacatattagtggtataaaataggataacacagttcacttttgctacatatcaataccgaaataaaaataatagctactatttatggattggttaccattcatctggtagtagcagtcagacttgggtggtcagggcagaaactcttgtgatagtgttactggcaaagccggtcccccagaagtggggggtctttccccgttcagtgttacaaagccattatgtgaaactggaaatgagcatcaagcagttcagactttatttgatggccatggaattgagaagtgggagcacagctcacaaatcaacttctcagctcctgagagctggaaagtcacagatagaaggctacttgaattaaggtgttgagcattaaaagcaaggggaggaatatccgtgcagtttctgggaataggcagagaaaatctcagaaccagagtgctgccttccttttatggtttcttctggtcattgtcatgatgattaactgtcatggcactgatgggactttcatttagcatggaaattagattacaataaagttagagtttcttcagaggtcaagtgagctgccatcttggataccactggtttcaactggtctgatcaggttgggaacttcagaccacagacatcctgttcttacaaattaggagagtcaaggtggggtagcaatttagctatgctatacaggcattacactgggtaatgataacaaaacagaaaaatttattttagaggaatcacctacagccacttcttccagccttggaagtgagaatggtgggtttcatcaaaaagcacatagggcatcacagacacatttaatgtcattttagtaatcatgtcctatttcatggacactctttatatttgagttaaacacattattacttgtaaaatcatgacagcattatcagagacatgaaaagagaacaatttgagcatcttatctaaaagctgtgtaggggagggaagaattttcttttgccctctgagagtttaataattgaatctgttaaataatctgacaacgggcagattaataggagaatagttacacaaatttatcatgtgcaccagaacattgcaggaaagacaactgaataccctaaaaccaagtgagatttatcattcttatataccctggttatagagccgagggggaaggggatgtaggcaatttataggagagtaaatggttttggaaaaaatgaatgggccctcagaagaatacatggtggtttgtgacaaagttggtctgtgtgtggtgccgacttcttgtcttcctctcctgtgataagagttaatcttccctggttgatgcagccctcagggagaggattggcaatagctgtattactttcggaggagctgtctttagccagataaggggagctctgagaaaatgtccacctatatccaacatacctcaagtgctctcaatttgaagtaattagcataccaaagtggcatattttgaagttgcattttttgaactctttcagctgagaaagcaaattttttagtgacttaaaatgtatctttatatttttataacatgtgtgaatgcaatatctacatacttatccataagtctatttatatcactaagaaatctcccatagtcagccaaatacagagtgagagaatggtcaaaagtgaggagaagcactaaatccaaacagcatgatttcatcatgtcttctgattaaatattttactcagtggatgaacaaaacaagaatgaatgggctggagattgtttttaaaaatttagtttcgtatcactttacaactctttgagctattctaggactattatagtttctgtaaggaataaaaaggaggattttaccagttgtaatccccactagaagcttgagcttaagtgtttttcctgtgtgttccctttttactgtcaaatgtggctttatcattacttgtttttccctctcattggtgggctccttaatgatagggtctttgttctcctatagcctcaatatctaacaaagcaggcaattagtaaatatttgaaggaatgaataaaatttatatcgtattttttgctcttacatttgttaggagaacttttagagaataaagcaagacaatgtcacattattaaattatatagatgaaagatagaaatgaaaggggaaagaaagactgtgagtttaggtatataatttcctggaggaaccactagatgccaaacaagcatgtggggatgtcacctaggaaacttaaatgcaaaatgggtatcaccagaaataacagcaagaaaataagtggaggaaaacagagctatgaaatgatccaaagacaagtagtcaagagaaattatagaagtaaaaagatagggtaaagttaaaattgattctaatctaaaatattgtagaaaacaaagaaaaactaaggaaacaacgttcaacaaaaccatgaaaacttttcaaaaatttaggaagtgctaagatcatctgcttctcttcatttcaccagaaaaacatcttagtgaaataatacaatttgaagcctctcttaaaaaactgattttttagatagaatggtttataatgtgaacaattcataatagaaaatagctatgggtaggaagttaatgagactggagaaaaaaacagctacgctaaaacataagtacaaatgaaagagtaaaaataaatttaaaatgccaaacatgttcataacctatattgatgaaagtattgttagtggtggtagagatccaagttaccatgagttaacagcagcctgtctgtatgggtccatagtaacttcagtccttgccgcctcagaaagaatttgactgaggggcatagagcagaaaaagagagcgaggcaagtttcagagcaggagtggaagtttctttaaaaagtctttagaacatgaaagaaaggaaaatttgcttggaagggacccaagtgcacacctgaaggtctgcgagagagtagatgacagcaaaaaaagagatctttaaccttgatcctagaactttataggctggtctgtttcccgtaattctttccttagggtgggcttcctgcatatgcagtgctttccttaccttttggaattgagcacattcagtgtgtttagggagttatatgcatgcctatctgaggcttccttcctttttctagtagcatgtgttcttgaaacatcacacttcgccattttgactgttaacactcatgcccaagaagctgcttctccctgaggcctacattcaattaacacttctaatgttagcctgtgtggaccatcaggagattctctccctgacagccaaattatcgtttctagagaggcaatacgataattgccaaaccatcaccggacatttctagtgagtcggggagagacctctcctgctccgctcatgcttaactacagcataaaatgttgagaagtatatgaagcaaataattgttcatactatgtgtcaatattatgctatgccatttacttgtgtatcttacctcacccttggccgtaatttttcttttatattgaggaaaccaaggctcaaagatgttaaataaatttctcaaagctgcagaatgtcatttaaagaatctaagcatatgcaaattaaattttactatgtttgctatggagaagcaaaaagtgcttcagtgtaaggttccttcactcaaattatttcccactgttaatagcatacacagacttgtggagtatgacactgagaggaacaaagcaaatagagaccagtcaatttgatggttatggggatttctgagctatttaagttcatggaactttgttgctttggaatgagagatccttaaaattcttctaattgccacagacacaactgcccatttttctgttttactaaattcacaatccctactctattttgcagtttttggtttattacacagccagacaagatgaacttgaatcagtaaagtccccaaagatttgaggcagccaaacacacccttccttttttctctattgtataacttttgttaattgtccttggactatgaacaaacaactttggtagtaacactaaattactatttaaaaagtgacatatgtgtattttaataatgaatgctgaggagtgaatcatatctaacactaatataacagatatcccatccatataaactcccttcccattgtcctttttcatgttaatctgtaatcatttcactcagcctgtattccacttactgttcccaaccattctgggcattatgttggttttactgtcagtctcaatgtattacaaacaggggaactgaggttcagcacaattaatgaactatctcattagctaacaagcagtaggaaggtatgcgcatactaagatatgcgtcagtgtggttctacactacctttgctgaagactgacttctttatgtgtgatatgcgaagagatgccattatggagaaaggaaggtagggttgaatactgaaaaaggtatttgattattgatttttctttcttagtggatttgacttttacagtgaagaataataggtactgtattcattattttctatcattttgcacactgagatattggattgcatagcctatcttgttataatctgtcatttaagaaaactgtatcattatataatttctattgatgagcatttatatattttttcctcctctgaactttgccacaaaaggcatatttgttttagcaaacattgataacctgctaggaagatgagaatatgcctattacactgttgaagattggctacataacttgagttatctacaatatgttgcaaaaggcagatacttggcaagtttaatgccatccatctgatgtaattgaacttaaggttggatgaatagcacttcatttcatccttgaaactttacgaacatgactgttattatctcaacaactaatgttgcttaaagaatgttcattacttgcatatcattttttttccacaaaagaataaccttgactaaatattaggtaaaatttagtttagactatatttttgaaaactttttaaatgaaagttatctaataagagaagaggaaaaaattatgttacctaatattccactacctcaatatagcctttttgatatattcatatgtctctccctcctccaatttttatatagcagaaatgataatggctatatgttttgtatcttgctttctaataattgtatatcacatatatcttatatgtgtaattacgttcttaaaataaatgttcaaaactctgattagtggagtaaagggcaagacagtctttttacaagcatcaggtattactatgtgactctttttttttcctagttcagtgttataagtaacaatttactagtaatgttatcttttatcatttgtctattaaaacaagcatatattaaatggattgccttcttgaaataaaataaaaatttaatagatttatttttcaagttttctttccatagtagaaatgtctgcaaatgaagagaaaattcttcatttcagttgtatatattcaactacagctataggtgtagatacagatagaacatgtgatgatagaagcaaatatctgaaaatatttttctgagctgcagtgaatgagcaagctacataaataatgaagcttttgttttctagtgtgtgaaaaagtgtctacttcttaaaaaactaaagaacttaagcatcttcatcgctttgagttgactttttttaatgtttgatgatccctcttttgtgatgtatactgaactaaggttaccaatgtgcaccatctttgagatccataaaaaaataaaatagtgttttttggaaacattttttatcagtcattaagcaaatgatcattatttcttttgtcagtttaaaatctgcagaaattttccatattcttattttaattagaaatgtttgacaattaaaaatccacaccaaaggatgctgacaaggccagtctttgtcaacactttatagatttgtccttctagaaccaaatggtgtgtacttcttaaagagaatattatggaacaataaaattgcaacattatttatagtgttcttccatagaaaaattactaagcttacttttgtaaagaatatattttctatgtataaatgggaagaaccaaatctactgataatcaatatatgttatcctatttatagtcatctgtgagagagcaggaagatattaagcaattggtgttactttaaagacaatggtctttcgttattcacagcttttcaaataacctaatgggcttatcctaattttctgtgcggccataacgaaagacttgagactgggtaatttataaataatagaaatttaattctcacagttttggaagctgggaagtccaagatcaaggaactggcaggttcagtgtttggtgagggcttttaccctgcttccaagatgacaccttgttgctgcgctgtgtcctcaaatggaagaaaggacgaagaggggcctaactcattttctccagcccttttataagtgactagtcttgtccatgatggcagatccttcatggcctgatcacatcctaaatgcctcacctcttaatagagttgcattgaagattaagtttcaacataaattttggaggagacacagacattcaaaccatagcagggctacttccctttctctaataggacagtgccaaatagcctctgaagttatggagcctacagatggccatcttattatgcctattccttgtgtgtttctttttttggcaataataaaagacttaatgatgagctatttgtgcatacctataaatacatttcgtttgttcactaccagccagtctcctaagaaccagtgtataaaatggttcatgacccactagcactcaaatatttaatgaataaattaatgcattattcttagtagacaaaatacatttgtaatctctcaattaaacaaacaaacccttttcctgtggcttgaatgtgtccctcaaaagttggttgtgttgaaaacttaatccccaatgcaactttgttgggagctgaggcctaccctcctcccaacagctggtcttcaccctcaagaatggattaatgtcattactgggaatgggttattcaattggagagtgggttattataaagctaattcagcccctggtgcctctctttgtctactctgtttgcttctgctttctggccttccaccatggggtgatgcataccagatgccagtgccatactctgggacttttcagtctccaagaccgtgagctacataaacttccttatgaattacccagtctgcagtattctcttatagcaacagaaaatggactaagagaagtttgatgtgtgcaactttaaatgaatttttgtgtatttttacagtttaaaggcagtcctctgtaagattccagcaatcagccctcatggaagcctcaagcctattttccttcctagtactcacaaggtgatttttaataatcaggataaaatccaaagtgaataatttatttcttgctaaaaaaactttttaaaagttattaggattccacacatcattctcaaagggtaaatcaaatattagcccctcagtaagttgaataaagaattgataatgaacaccacattgatgctagatgctacttgatttaatagtttcaatacaatctccctcttcctgttgaaattccttagctatttacagtgcagagagaaaaaaataataattctattctaagagtagtagtgaacagttttcaggtgtttatcactgatacaaattaagaactgtgtctatattttgtataattgcatcatacagctgtattaaatcttatagtatcaaatattagatctgatttaatagtattaataaatttaaacccattttaatcaattttcaaaaaaataccgtgttcagttacagaaaatggtgcttagttgcagactgtatcgtaccttttaacacctgatgtgtacatcccatgtaacggaaagggcgacaataaaatggggattcaaaggaaataatatggcagaataagatgtgtaagcacgatcttattttcttttctcgtacagaatacttacagttattgagccttccagaaattggaagttacctgaagccactcaagtttccttaaaaaacaaaacaaaactgtctatagttaacttgatatgccacttttcaaatgtttctaatatttattttattttattttaaagtatgtttttcatctgcatctaccaacatttattcttgggcttttaattttacctttttctcgctggcctggtggctcacgccttaatcccagcactttgggaggccgaggcggatggatcacgaggtcagcagattaagaccaccctggctaacacggtgaaacgccgtctctactaaaaatacaaaaaattagccgggcgtggtggtggacgcctgtagtcccagctactcaggaggctgaggcaggagaatggcgtgaacccgggagggggagcttgcagtgagccgagatgacgccactgcactctagcccgggcgacagagccaaactccgtctcaaaattaaaataaaatgaaataaaataaaataaaataattttacctttttccaaactaatgtaattgcttacagctcatatttgagcttctaaatgcaatgctattggacgtatttgccacttcatatttaaggcctcttttactgtgtacggtatttattaccgtggagccatgagaccaaactgcaaggctctaatctcagttcagctatatgtttagaatcactgtgtgctgttcatacatgggatttgccccctgagcatattttatttaaatctggttgcaagacattttttttttctttcttcatacatcatcgataacatctaatgctttgttcaatagcacctggaattttcatccaagatgacagcttagggaaattgaattttcccagagaggtatctccaactagaatatagttttaattttgccaagctgaaataaatcataccagattgttttattctatgcaagacatctgggagacttttgctgcagtctacagaatctcatgccattgtgaaatgtttgccttatggacaacacaaggtctggggcataatactgcgtgtttgctcatttccagtgactctatttaattaagtctagaatacaagcatagagactctgctttgtgaatctgatgctcttgtatatgacttaagtttatgtcaggatttagggaaaacattctcattttggtagcattcccaacattttgagatagtttgacttctgttcagacctagcatgagatttttgatatatgtgcaaattgtgtgacactgttggataaaaaattcttaggtacaaataaagttgacaggtaggacttctgtccatccacatccatgccccacattccctgatctttttaataataacgacaaaaacatgatcagtgtgcactcagaacagacatttagatcaaactaacctttgggtctggcatcctaatgaatgtattagtcaaatgtcacaaactgcacaaaagcttttgtattagaaaaacaaaaaaaaaacaagcttagaatggatgagcagatgcatattcttctgagcttctttgactcacaagctttgctttgagagtcacctttccccccactgccctctctgactcactcttggagtttctggtacataattaagacatatggacaaattcccaaattctagggctaagaataccagcaaaggtgaatttactatgaaaataaatgaagtttaagttcatgaagcttcacctatacccatcccttccaagacttgattttcttctaggaagttgtggtatgaagcagcagccacagccacacactagagtgtgtgggccacagaagtcctgatttgaaccctggactgggtggagtcttggaagcccacactaccttcatgtccctcagaacctcagaggtaacattcctctggtggacttcatcaagtgttcatcccctaactttgactccaaggagaatgatctaaatcagatgttgctctgttccctggtctagaccatcgcaacaaaactgcttggccacttggccgctgtttttctcaagaaacaagtaacttcactgagcaaaaatgtaccagtgtggcatttgcaatgatcagttgaagctgaaaataactttatctaccactaataataaaaataaaatttaatcaaccaaatcataggccacactgaatcatctttctactatctttataaaaaatattgtaaaaattgctgtcatattaagaagcaatcaaagcatatgaagccaaaaataaggaaaaacagtattatagatgactcacattcagttaaccataaaaatgaaataatatgtttttctaattataatttttatttctggaatttgtcacttttaaataatctgtgattatttttcttctaagtatatatctttttaacaaagttaacaaaaaacaaaatatatgggcactaagaggcactctagagaaagactgaaattttttttgagtatttgaattacccataattacaaattttagcttctcactattcacaatacattttatgtccctttgttttgcttagttagataggatggaaatcttggctttctgtcatttcctgtgcagccctctgcaaattcttttcccaacctatttctttatctgtaaaatggagattataatacctatttcatcatattactatgttaaacaaaatgtttttgaagtacttagtacgatgactgaatacaaacaaataataaatagtaggaaagtctatgttgattatactatgtaaaataagtataaaaaaatcatgagacagcagtgtaatattctaagacattggaagagtttaaaagaacagttttggaaaactgacttcatacttgtatgtactaaaattgagatgcccatgggacatcttagttgagatagctgttagatatttggattgcaggtctggaacttagcagagaattacagttataaatttttaattattaatgtatcagaagtagttgtaaccatgagtaaggatgatattatatgggacagtgtttaaggcaaccataagatagatttgaggataaatcccagtaatgatatttggtgcttagtttttttagaattatcaaggaatatagaaattgcatattaaaatgccctgcataatttctagcacatagtagctattctgtacactttattgtttattttgattaatttaagcaattcagtataaaaaagaaaaaaaacccaatctttttagtctatcaaaatttaaaggaagacttctaaacattaacatagtaattttgtatatcccatataaatctatataagaaaataaatcctataaactaagatacttttaaaatataagaatatgagtactttttttttagtgaatgtgatctttatggaatttttttattattagaatggaagtgaccctggaagctttcttattgtatttatttaaaacatttcagttgtacaatttaattcagttgtctaataattaaaataaattgtgtaaatatgtaaattgaatgaactgttttctactgttatgtacatatttgaattcaatttatatgatctgcttgatcatttttaataatttaatatgtatttaaatataaatatttcataatattttttttaagtttttaaactttttatttgcatattaaaaaaattgtgcattccaataattaaaatcatttgaacaaaaaaaaaatggcactctgattaaactgcattacagcctgcaggacaccttgggccagcttggttttactctagatttcactgttgtcccaccccacttcttccaccccacttcttccttcaccaacatgcaagttctttccttccctgccagccagacagacagatgggaaaggcaggcgcggccttcgttgtcagtagttctttgatgtgaaaggggcagcacagtcatttaaacttgatccaacctctttgcatcttacaaagttaaacagctaaaagaagtaaaataagaaggcaatgcttgtggaatgtacagtgcatattggcggcgcacgcctcattacgattcgcctgcttgcttctcctgttcaatcgtttctttggaaggcagtggatttttctcttgcgtctctgtcttcttcagtttcggcttatcgaatttctcgatctcagccatatcgggtttgtcagacatggttgcggaggaaaagcggagcgaggcgcgcgagtacgagcgaagtctggtctgcgcagtggccaccaccgagttgtcgccataatatttttaataatgtttgcatttcttctatattgctaacttctttgagaaatattattatgatctttgtctaagaagcctattatctagattgagaatctaaacaaatacaaaggtaagcaattagtatcatctaataaatgtctcagttaattctatcacacacttagataagtttatcaaacgtgtaagaacataatttaattaagcagagcatgtttcagtaaacaaatgtgagtgagctttttataaagtttcagattcaactacaggttatgaaacaagtgaaaactaaatatgggatagggcatggaactgtgccttcaccatgtgttacatctatagagcatatgccaactgaacttgctacagcttcattgttgcatcgtacccatcaagacccaacagtggaactacaaagacaggtgacttgtttctagaaagcaggtcctaagccctgctttaagtgtgtttatctggagggaggagcaagaagagaaagcccacatctacagatcaaattaccctaaaagagagactattggaaaggctgagctttcatatttcatccttttgcccaatcttaccaagtagttaaggcacttctgttgttgaagtaaaggtgcagaagatagaacaaagtctaaaaattcttctcccattcttctaaaagggtagaagttcatactttaaaatttaagatggggacactagaagagaaagaaaatggttcccccaaagggaagtataaaggattgatacatgaattgtatatttattctctcatcttttagtcattagtcaatattctggtctctaagttagtagatgggattgaagttattgtaataaattaatataataatgtgactgtgtaattatataaatataatcaagtaaatataatacaatatatgttatataatccatataacatagcatttattttatagcattcttttgatatctgctgctttagtaacttgcaatttattgttttattacatctgctattaaaatgaacatcaactatttattttcataaataagagaatcctttattttagtagagagaaaaattttaaatagttctaccaatatctaatattaaatgtgtgtgggtggagaagaatgaggagaaaggttgtatcttaattcagaattagaaaggcgacaaaataaccattttctattacaaaagacgttaactctatgacattaatttcaccatgggaaatctgtaatcttcattttagagaaattaattggtagcagtactatttatgaagtgctgtgtgctcaaatccttgaagaactttcctacattatgattagcctaagatgtctagcctggagtgtttcacatttttctagctttgtgattacatcctcccactaggtatctaatgaactgaagtagaccgccctgcatttcagcaaattcaggagtaaggttttatgagtattaaaaaataattgaaaatgtcaatattcaaaatgtttcatagttcatatattttatgtcctcactacagtgcctatgcatatagcttaaagcatatcaacagagggaaaacactatattgcagcaagaagcaccctcatccatgaaagctgtaaagctccttactctttttttttttaatagttataaccttgtatgcaagtcactgtgaattttgctggcaattgtggcatttctcatcagagagtaaattcttcttcaggctggtaaaatgacatctgaataagaaggcagaaaaaaattttcaacctcttaaaacaacttctaaaaattgcaagtagacagtatcatgtattgcataatagttacataaagcagattacctaagattccctacagctctaaaacaccatgccctgacatgtcctgattgagatttttgagatttttacctgtattctagagatactgagtcagcagctagagtaagttgtcactaaatgatgcttttcctgcactttggcagataagatcagtatctgaaaacctcagccaatgtagaagcttgagaatggcatgtcttctgaaaaacaaagtttattaaaatattagtttgtgacttagataactcattcttaagaaagcaggaatgtggcagcaagggtagaaacaaacatagaagacaatgcttaataaagaagaaaatatttggccaggcacagtggctcacgcctgtcatcccagcactttgggaggccgaggcgggtagatcacgaggtgaggagatcgagaccctcctggctaacacaatgaaaccccgtctctactaaaaatacaaaaaattagccgggcgtggtggcagatgcctgtagtcccagctactcgggaggctgaggcaggagaatggcttgaaccctggaggcagagcttgcagtgagccgagatcgctccactgtattccagcctgggcgacagaccgagactctgtctcaaaaaaaaaaaaaaaaaaaaagaagaagaagaaaatattttgcatgttttccctgacatagtctgggtcaggaaacattttctattagaactgtttattagggcagttttcttctttacctgtgcttctctctattctgtagactttcaaaagctaggttgaatcttttcacattataaatcaaggtgaagctgtattattcctcttctgagtgttgtcttggtactctggaagtgtgtctgactctcattcattatttctaacaataagccaaactccaaagtaaaaaactgtggtttctcttctcagttaattcttataagttgcccaatgaatgagaatttgggcatgactcacaaataggaacttattgtgtttaatctacattctgctgtctgtcttttcatatttcccttttcctgcatattgacgtatttactgatttctctgttttttttttcccattaaaaaacacagcttggcattagtttatgctcagtaaatgttaattactccacctcattagccttgactggactaatttgttagtcaacatagcttattctcactagtttcttattcaaaacatctttaaacaaagcaaaattattttgaaagcaaaaacatatattttcttctgtcttttaaaatgacaattgtttattacattaataatctcattaaaattcttgttattttttctttgtcaagaacaagttagacagaaagtggtttttgtatgctcaaattttaatttcttgattgggtgagttctatggctatctgttgctgttgaaatttgatagaacttctcagggagagagtaaataggaaagtagtgggaatgtagatgcaaaaatgggtacagaaatgattagtccagggatgaagcaacatctggattatacaggaaactggtctaatttagtcagcactggagtcagaaagggaaggaggaggaaatttgggaatgttcaatagggcatgggtttggatgtgcagaaaagagactgtagtaattgacctgacatgtctgatcattgaagagaaccatcagaaaatgaagcaggaaatagtaagaaatgggcttaatgttaggaaaaatagctccttcaggaaagagatgtataagaaggatgcagttcactggtaaggtataggcagggattctcagggaactaatgcaaagggagtgggtcattcaaagaaccctcatggttagagtaaccgtattctggtttgtccaagacaatgccagttcacaaagtcattcttgcattattaatggttccctttctcccaaaaatttacagtttttatcatgtttgtagtcaatactcaaaaaacatgtgtgaggaggcttttgcttgttagaactatgaaattgcttttaggttggcagagcacatgaaagccatttctagacttagtttgaaggggatgacatctcttgaaaagagtcagcacaggttaataaataacccttaagagctgcactggatggtttaaggcccaacttttcaccacggattatttgcatgaccttgggtaagttacaagttacataacctctcatttcttcagttttctcatctgcagtgcaaaggtaataatagtatctacttcatgtaatgtggtaaggcttaaatgagtcagtgaaaaaaaaaagtgtgtgtaacattgtggctatttactgctaaactggttccattctgcatccagtaaatgtaattcctacggattttcaggtggctctttgatctgctgcattaaaatgtggttacaggagaaactggtaataaactaagagttaggcctcaaatagtttaaagcacttttcaaatgcaaaatattcttaacctgcattaatttatgagttgggtatcattttgctcttaatgctttagaaaatgatttaaaatttttaagatttgactcattcttcagattaatttttttcctatctcaacatccaagtattttctagaggattatatttttggtgtattgtggaacttttctgattttacaacacacaacataaacagaatcattctctcatacctattcgtcccttccttcaacttttgctggattttccgtatgccttgttattgtatatctggtcaagccatttggtacaaaacattttttaaaaacaaatcttttttatttcttggtcatgttaatctattccaagagagtgctagttatattccctccttgggcataaaatctatgtgttgttgtcagtttctttgttctgtaattattactgcactcctttaagaaaatttaactatctgatgagcctaataacattacttagtcactagaagcttaaaggtaacaatataaaatgtatattttttatattttcagtactcttgagactcagccaatctttcaagattttgtgtatttgtcaagcactctatgacctcgtatattattacacactatacattctccaatatattattataaattgtaccaccattcaaatctccttcctctgtttgtgtgtgtgtgtgtatgtatatatatatatcttccagtgtgtgtgtgtgttgtgtatatatagatagatagatagagaatatatacatagatatagattgagaatatatatatatatgtatagagagagagagaaagagaggaagacagatatgtagcaactgggtattactaaacttcagagttcttaaattatacttgctttactgtgcatgttaaaaaataatatctaagcctaaggcattgattcacatttttacagcaattactggcagtagcaaatactattaccactaaagaatgaagacattcctcataaagactactttcccctccctcattccactccagccacattggccttcttattgttccttgaacacacagagcatgcttcttccttagggtattttgccttagctcatttcttagactagaacattcttcccccaattaattttacatatggttactaacccccttccttcaaaaatttgctcaaatgttaccttcctcaacttcactactctacactatttaaagttgcaacctgtcccccacaccacttgtttcattcctattatcctgctttttttttctctgcatagcattttcataccttctaatacatgatactatctaattatttatatgcctatggttaatatctgtccaccccagccaatatgtaagtgacagaagacagaggtttgcattgctcaacaacatatttgtagttgctagacaaggggttagcaaagagccagacagtaagtattttaggatttataagccatatagtctctgtctcaattaaactttggcattgtggcctgaaagctggtatagacaatatgtaaatgaattggtgtggagctatttcaataaaacattatttatgaaaactaactataagctggatttgacttgtggacttttgagacaatatctggcacatagaagctcttaaagaatatttgttaggccgggtgtggtggctcactcctgtaaccccaacactctggggggccgaggcaggcagatcatgaggtcaggagatcgagaccatcgtggccaacaaggtgaaaccccgtctctactaaaaatacaaaaaattagcctggcgtggtgacacgcgcctgtaatcccagctactagggcggctaagacagaaaaatcgctagaacctgggaggcagaggttgcagtgaacctagatggtgccactgtactccagcctggtgacagagtgagacgccatctaaaaaaaaaaaaaaaaaaaaagaatatttgttgagtgaatgaaatagatttattgaaacctggcatatttaggatgtgagcataaattactaataaatttgccctttctcccaatccaaaattgacaatcatttttttcatttaaaatattgacactggccttactgcccatcataatcaaaagagttccctgtcctgttaaaactatagtgcctgcttgcatatgacagaggaactgtggtagagtagttatcagaatcagaactaggagtgaaaggctgtcctaggccagaaggcaacaaaaccttgaattcaggattcatattaaatatatttgttagttagtgcttttttttaaatttaattcctgaacaacaaaagtatattttcagtatgtgaacatatcatgatttatacagcctataatgtttttcttatttcaactgtgaaaaaaaaaaaaaccagattttcttatttcttgagttaattgtaaacttgaagtgatggcaatggacttgtaacttattttctcattctgcagtacatttccaagccactatacaaatgctgagtcattagtgtcatagtgctgtgtctatttatagattttttttatgagtgttattaaccataaatgctcaatatgaaaaaaatgaaggaaagtagctttgtctaatcacagtagaacactggatttattctataacaaactgaagggtgacttaatcacctcaaattaaaacttgttctttatctcacatataaattgaaattcattgcattcttatgtttccaataaatggcagatttctccattgcccagtaactttaaggtgattgtttgctcactataaatagagatatgtgtgtttatgtatagaaatccttcagcgtgagagttaaattactccatcttaaagaaagaaatgcattaatgtacaaccatggaaggtgtgataagtttaggtatatcatccatcctcacagaatctgtttgcagttattggaataaaattattttctttatagagatctatttaatattgttatagacacctgcccatcataatgattaaatttttattgataaaaacaattataaatatgtataggtacatgtgatattttgatacatgcagataatgtttaatgatcaaatcaaggcattttggatattcattgcctcaaacatttattattactttgtgttgagaatattctaaatcttttcttctacttattttgaaatatacaataaattactgataactgtagtcactcttctgtgctattgaacaccagaatttattccttctaactaactgtatttttgtacccattaaccaacccgtcttcatctctcctgccattcttcccagcctcttgataatcatcattctcctgcctcagcctcccgagtagctgggattacaggcacgccagcacacccagctaatttttgtatttttagtagagatgggatttcaccatgttggccaggatggtcttgatctcttgacctggtgatacacctgccttggcctcccaaagtgctgggattacaggtgtgagccactgcacccagcctattttgtgaaatattatgtttattatgtgttagtcttaatttgatttaattctttacaatggggtgtcttcgttccctctgaaactgttcccccatttgtagcatacttttacattcaagtaaattatttaccaatatgttcttagctgatattacaaaggctttattcattcattcgtttaattattaatgtattaaccaacacttactgaatgtttatcttatgtcacaacttggtgatcaaaggaggattcttacttaaaccattatacttttctgggacatatatattagtaaaaaaatgatttccattccatttaaagaacactgggacagatgtatgcatgggctgtgtgtgcatgctgtcagtggagcaccccatctggcctgcggcagtgtccccttggttctgatcaggagaccttgagctttgccacttagcatctcagaagtctccctcaggatcttgaccttgcttcttactacatgttctttctgaagatttcctctatgaagtccagaacttttatgatttcatttccatttctcacgtatcagttttttttattgaattctctccatcttttacattaaaatctttctttagttcatcatctatctaataacagatacttacttcaccagactcatctttgttatcaatatttcctttaactttcttaggttgtcagattttaaacgtcgacttaggtatactttaaaaaacaagagaaaaaaaggaaaaagtcgcaaataatccagaaaacaatataaaaataatgttataattcaaatcaaatacgcactgtgagcattcagtgtttccatggatcttctaataattttttgttgttgcttttagattttttgttttgatttgattgctgttttactttttgctatagatatgcagtttttattttgatgatgtttttctttttctcttgttctttttactcaaagacctccagtgataaatgatatatgtaagcatacatatcctaacatatatatttgtttttcaaacttagtatgtggtagtcatcataattagataagactgatgtttctcattttgattatcaggaaggtttgtttgaagcaaattattgtggatttttttatgtttgctgcatttgtacttcttacacaatcacttttaattaacaatgcatagttgtatatttgctaaatgtaaacactatgtaagggggtaggaatttattgttcagaagatgagtgcatagtagcaatgaagcacatatatcatatttgatttgtaccctggttttgtggatcacaactatgagacagtggaaaaaccatcaattccatgtaaaattggtgcccaaatgttaagtgatatttatagaaattataactggaagctaagggcagaaaatggctctaagatataagtggcaatagcagaaatatagtattgaaagatataaaagggtagtataaatatcttataagtaaatttctttctttccctaggaaaaggacatagtgaatgaagtcttttttttctccaagtctgacagtgcctcaaacattctaaaataatcttttctcccctattagtcatcacttaagtgtgagtttatttgaagtgattttgatttactgataactcattttagttactcagaattaactccctgcggaagacctaataacaatcagttttatggtcatgtgcattacctttccccatgatatggtttggctttgtatccacacccaaatctcactttcaagtgtaataatccccacgtatcaaggacaggaccaggtggagataattgaatcttggaggtggtttcccccatgctgttctcgtgttagtgagttctcacgagatctgatggttttatttattttatatatatgttaggatatgtatacttacatatatcatttatcacctttgctcaacactcattttctctcctgccaccctgtggagaggtgccttctgccatgtttgtaagttttctggggcttcgcctcccatgcagaactgtgagtcaattaagcctcatttctttataaattacccagtctcaggtatttttttatagcagcgtgagaacagactaatacagtaaattggtactgcattaagtggggtactgctgtaaagatacctgaaaatgtggaattaactttggaactgggtaacaggcagaggtaggaactgtttggagggctcagaagacaaggaaatgggggaaagtttggaacttcctagagacttgttgaatggctgtgaccaaaatgctgatagtgatatggataacgaagtctgggccgaggtggtctcagatggagatgaggaacttgttgggaagtgaagtaaagatcactcttgctgtacaaaggtactggtggcattttgcccctgccctagagatctgtggaacttttaacttgagagagatgacttagggtatctggtggcagaaatttctaagcagtaaagctttcaagagaaaggagagcataaatgttgggaaaatttgcaggctgaagatgcaatagaaaagaaaaacccggccaggtgtggtgactcatgcctgcaatcccagcactttgggaggctgaggtgggtggatcatgaggtcaggagatcaagaccatcctggctaacacggtgaaactccgtctctactaaaaatacaaaaaattagccagatgtggtggcaggcgcctgtagtcccagctacttgggaggctgaggcaggaggatggtgtgaacccaggaggcagagcttgcagtgagccgtgatcgtgccactgcactccagcctgggcaacagtgcaaaactccatctcataaaaaaaaaaaaaaaaaaaaagaaaacccattttctgaggagaaattcaagccctatgcagaaatttgcataaggaggtgaatgttaatcaccaagacagtggggaaaatgtccccagggcatgtcagagaccttcacaatagcccctcccatccaaggcctggaggcctaggaaggaaaaatggtttcatgggctgggcacagggacaccctgctctgtgcagccttgggacatggtgccctgcatcccagctgcctcagctctagccgtggctaaaaggggccaaggtactcctcagaccattgcttcagagggttcaagccccaaaccttggtgaccttcacatagtgttgggcctgtgggtgtacaggagtcaagaattgaggtttgggaacctctgcctagatttcagaggatgtatggaaacacctggatgtctaggcagagtctgcttcaggggtggagccctcatggctcactaggcgatggcccagtggggactctatatggggcttcaactccacatttcccttccaaatgggaagatggccaccatattctggatcccagaatcatagatccaccaacagcttgcaccgtgcacctggaaaagctgcaaacactcaaccccagctgtgaaaccagctgggagctggcctttatcctgcaaatctacaggggcggagctgcccaaggccatgggagcccacttcctgcaccagcgtgccctgaatgtgagacatagagtcaaaagagatcattttggaactttaaggtttaatgactgccctattagattttggacttgcatggggcctatagcccctttgttttggccaatttctctcatttggaatggacgcatttacccaattcctgtacccccactgtatcttggaagtaactaatatgcctttgattttacaggcttataggtggaaaggacttgccttatctcaaatgagactttggacttggacttttgggttaatgctggaatgagttaagactttgggggactgttagaagggcacaattgtgtttttaaatgtgaggacatgatatttggtaggggctgggacagaatgatatggtttggctttgtatccccacccaaatctcaccttgaattgtcatattccccacatttcaagggtagaaccaggtggagataattgaatcatggacgcagtttccccctgtgctcttctcaggttggtgagttctcatgagatgtgatggttttaaaaggggcttcccccttcactccacattcattctttcttctactgccctgtgaagaggtgccttccaccacgattgttaagttttctggggcctccctaggcatgtgaaactgtgagtaaattaaatcttttttctttataaattacccagtctcgtatttcttcataacatcatgagaacagactaatacaccccagtccgatgaataatttcagaaaacatttcagagaagcaaaccaaaataactacaaagccaaaacacaaaagaactctacaggcacatattttaacccttgagaatctgccttaattgtgaacacagaatcaaaattcaaggttcttactagggatgataacctttcctacactttgccaatcattgtattaattctgtgacagaggctgcctgaagtacatggggaggggtggggggggcgctgtccagtttttaaatggttgagattttacccttgttccaatgcagcccttggagactatgcacttgaaccacattttattggctacttatagagcttttttttttttttttttcctgatccgacctttaccatcatgtgttttacccactcaaacaagtattctaaagaagaggtgtacagaatgtgctatttggcttgttttaacaatgttcacaaggttgttctgaaattaaacagtatgtttctagatagctggattgatctttaactgtggacactgtaaatcttaaagttgaacatgtttctttttaaattttgaccactagcttaaatgtacagccatttagtaattgtacataactgtgtggcatgttatctgtgcgttaatattactcctcagttttttaatttgcctaaccactactttctttcttcaaaatattcaaatcttaattttgacctttaatatatatgtaaatttcttccaaccctttgtggaagactagcaatcatggtcctgtcaaaacagaaattataccttaatttgaacaggaaaagtttaatataaaattattaactataacagtagttttagataatccagcattagcaagtacataataaagagaagtcaaaaaaatataggaatagcagatataaggaacaaactttactcaaactttactcataggactgagataaaacaactacagaagagcccactcaccctaaagctgagatctagatcttgctgaatagcgtataattatggctcattgaatggcaaagaagtcactgtggtagtgcattggcggaatttactggaattctctcctctggtacttgctggaaatctacactgtacagtgttgaggaatggtgtttatgtcaatatatcttggaagggacactcttctacgagactacttaagcagattcctaggggaagcttctggccactgagtgctgcaggcagtcatgcactgcaagccatggtgctgcagaagccagatactgcagaagctgctcacactctgagtgcttagtgacagagaagctgctcacattgcaggagactgtttagagaacacatcagaactaggaaagaaaaccttcatctctggcaacggctctaaccctttactgacaaagcttaacatcatgctagctaggaagaacatttaatgttcccagctccttttttgttgttgttgttttttccagaagaggaaaggaagggtaaatgaagtaggacaattaattgacaagtggcacaaaatccttgttacaagcaaataattaattgtatctttgctttaatttgacaatgtgtgattttcagaaacatataaaagtttttgtatattaaaaagaaactgatatcttactatagagcgatttatacttatggttcaaaactctctttaggttctggcaggtgtattcattttcctcaaggctagtgatttgagagagaccctaagctgcttgcaagattagacaactgtatttatacagtgatttgggatgactttgaggaggagcgagagataaagtacggaataaagaagtacaaggtttaaatatatatagtatcaaaacaacagcaagaacaaccacaaaaaaaaacaaaaacaaacatataaagatgtagagtccttcttctacctctgttcataccctactaatttactggctttgtattctctgtaaggataagctatttttatggacagagcagagaatgaaagtttatacatagtatgggcaattttcttctggcacaataccctttagagatgttcatttttttctagtattttcttcattttcaagaatttgtaaataaaaacaaaaatctttggaaaaagaggaactcaatgaaccaaagcattgaagcattgctcctataattcgttttagtgattaataaaagtacaagaaaatcagacaagatgtaaatataagcagaatcatgattaaaaatccaatttaacatttaagctacaaattaattgttatttttgatcaatatgttattgattcttttcactgggtcatcttgtgttttctctgtgctcgtgttttaacctttatatttgaaaaacacatttaaactatgtaagccaatacttttaaagaccagtattttttatttattacaattaaaacaacttcaaaatgaacatgttggtttaaacaaaaagactttgaaaaagtctatatacactttggaaagttctgaggaataatacatagtgtttctgatctcttgtgttttatttcacatttcataaacagcaatctccatagtagtacaacttttatggttgtccaggaggtaaaactaattcagatgagttatgtaaaatatatttacacaataaattcagtaaaggtgtaacaataaaccatgggaagagggggatgcagcccacctaccccaattataaaagccaataaacccattcatctatgatatatattttaggacatactatatgcatgtcaaaaggaaagttcagagaagtatatagtatagtatggctcctgattacagtgaatttgaattatcatttatttcagtctaccaaatgtacaatgaactgaaatattccaaccattcttcaagaagctagagatacaaaaatgaacatgatatggtccaaatttctgcagaaatagtagtgaattttcaaatacgatggtaatgcaatatttcatggatattgttgagttctaatttagatcttgaggaaagggtagtctttagttacaaggtaaaccagtttggctggaatgcaaatcctggataaggatagtgagctggaaggtacagtatccatgctggaattaatagtatagatttactccaagtaggtgtttcatgcaaattctaaaaccatatatttcaagtgattgttgctttgttattgctcagataatgtcttataaacaattatccactctatgcctaaagtcattttttgcattgctattttattttaggaactcatgtgcaactgctttcaggaaatgattttttaatgtctactacaaattgtttcggctaagacacttccctgagttctctgttgctgaaatttggcctgaatactccacttttccatcctccaagacctctatcatttgagatatttcctttttcttacttaatggtataggtggatacagcctccttaccttacctctttttttcctagcctgaagaagagtactcagaacttttttttttaatttagaatttattgatcttcattataagattgctcctatgatctctaggctactacattactgtataaatcattctcacactgctataaaaactactggagactgggtaatttataaagaaaagaggtttaattgactcacagttccactggctctacagaaagtatggctgggaggccttaggaaacttataatcatggctgaagggttaaagggaagcaagcaccttcttcacatagtggcacgagagagtgtgtgtgtgtgtgcgagagagcaaagggggaagtgctacacactttcaaataaccagatctcgtgagaactcactcacgagaacagcaagaggaagtctgcccccatgatccagtccagtcacctcccaccaggtccctccaccaacattggaaattacaattcaacatgagatttggctggggacacagagacaaaccatatgaatgaccagtcagaatccaaatagatgactacatttgttttcattctctgaagatctcataccaccactttgcttctaccaccaccactgctcacactaccattagtggagactagggatctagaaaacagaggtagggagcctcagtactatttgctcaatctatttctttatttttagttttggaataagtctagctttggaaactattaaacatagaactactgtagaattattaaataaatattttgtttattatatcatttcctcttgcaagaattaaagctaaagaaaaaatgaaaaatatttggagtttagatattaaatcttagctggtttccactagtaacatattttgcatttttatgtagtgcaatcattattcatagagttcttcaataatatttacttaaaattattttttcaccagccttttaactctaaagtgtgttaggaaaatactttttttcttggagataagtgatatttattaattgattaatatctttatgttctggcttcactattagatgactatttactaactctgtatcttaacatgataagaaataattatttgaaatcacttcatataaatgaagaggctatgtctttggaataagtagttagagtttagcattattcacagtggcattttaaatatttatctacttgtgcctcattgccttcatctattacatgtgaatgacactcattcatttcacacattcattcattcattgaacattttttttcagcaactaatttatatattaatatgaactaggttagcaacagccaatgcagaggaaagacaaggcattgtcaatatatttatagcactcatatttctactttcaaattaaattacataacctatgcaaaatattaatttaatacacattcaactcaatttggttattccccccatcttcctttcttccttctccaatgctaattataaatgacagcttcttgctgattgggctcaacacatgagtcatataccaatggagcagatggagtagcttccttgttctgttttgtttaagctgatgttgatttctaatttctaatgtacttcatttacttataaattgttattgctgcagttattattttgcaagactcatttataagataatatatagaaagtaacattcgatgtatcaaatttttaaagctaattttaaaaattaacttgacatcttgactttatattcttgatagtttcacttaaagaatatataaagtgattttgaaatttcaaaaacaagtatgggaattaagatgggttttgtggagaataaagtgggtctgataaattaatccattcccctgggttcagatgctatgttttataatgtggtagaattatggaaataaccatcttccccgacgtaaaagaagtatggcataataacagaattctagactaaaaacagagtattaagatctattcccatttataactcataactcattagcttgtgactttaggaaatttgcattatttcattttccacagtttctgtctataaaatagaaataacaatatctttggatgcttcaaagggttattgtaagaataaatgaaatatatatcaaaatgtattctgatatgtataaaatgccataatattttatcagtgtgaacttccaaatctctatgtaggggaggcttagaggttgcaatctggttggaagtagactctggcagggactcattcggagctggatttttttttttttttaagactacaatgttttggtcttagactttttttgtttttccttaaaactaccatgataggcatgctatcttttacttcaatcgcatattaattttgagggagttagagtgaggctggaattctggggcttaaactgtgttagttatctctatctttgtgatagattatcctaaattacaaaatttattatctcccaatttctgtgaatcaggtatctggaagtagcttagctgagtcctttggctcagcatctctcataaagctgcattcaagctggcctgcagttgtctcaggacttgactggggaatgacccactttcaagctcagtcacatggtctttggcaggatttagtttcttgctggttattgaatggaggccacagttcctcagtagctgttaacctccttgccacattgatctctccatatgtaacggacaaaatggcagcttatttcctctaagggagcacatgagacgagtccagagaatgagagcaggacagaaatcacagtattttatgacctaacctcagaaatgttatcccatcacttttgctgtattctattcattagaagcagattaccaaatacattgcatacatgagaaaggaaaattacataaagtgcatgaacaccagggagcccttttagtagctacctaccacatcagccacatgacatagattatgggtttttcttgctccttctcaacctccaactgtcataccaaccatggaatatatatttttctttatatttctatgctgggtctaacatgaagaacaacaggagaaatggggaaatgtaggtcaagggatacaaggtagtaaatatgcaggattaacaagtggagagatctaatgcacaacatatggactacagttaataatagtgtattgtattcaggatttttgctaaatgagtagattgcagctgctcttgccatagggagaaaatgggtaactatgtgagatgatgtacaagttaatttgttccacatttgtaaccactttactatatctacatatatgtatcttataacatcatgttatatgccttaaatatacccaataaaagttattttttaaaaaagaacagatagccatttcccacatctaaatgcagtgaagtacagtaacagaattctagcctagaaatggaatgttaagattgagccccatttctagcttattagattgtgattctagagaactcactttatctctttttcctatatttccatcctgaaatgggaaaaaatggtatttcttattgcttcaaatagtagttattcctaagaacgtagttgcccacattatgatttgaacaaagatgaaagaaatattcacctcagtaaaatttcatcacaaatcgcttaagtaaaaatggatgtcccacatgacagagcgtaccaggttttctcagtttcccaaacatacagactctaattgctttttagatcaaataagacaattgcacacatagaaccttcaacctcagtggtaatatataaaagttaattaaaccttttctatttgttttcttcaaagttcaaattctttacgttaaggaatctaaatacatttgatttggagatagtattgcctgtggtatttcaattattaatatggagaataaatattgttattcatgtgctgaagtgacttttccacttcaaagtggtgtctgtaaaggaaaataatgaataaaatctgcatttcttacctttaccacgtctatggtcacagacgcaacaaagcctaatctgataccataatataatttagaagtattttattatggcatttgatatatgcaagtactctacagaattgataaatttatactttttacttaggaaatgattctgccctccatatttgcttatcatttactgccaaagaagggaggaaggaagagagggaagcggaagagctgtaagaaatagtgacttatcagattgggagtaaaagacaaatacatatggctcttgaaaaatgacctagaggtcaaaagatattttgcagtgcatttatgattttcacaagtttttggcacctacttgacatttatgtcttgaaagagaaagatcaaaatgaaatgtgaatgcctaatttcactagtctaatgtttgaagtgacagaagtgaccagtgaccaggacaaattcatatgtagcacacagaaactgatcccattctagtcttacttctgacacacattgttgtttggcacaatggaattaactaatttctctttccctgaatctcatctgtcatgtcaggctaaaggaataataggggaaacataattttagttactgtaaataaagtttatgaatttcacattgtggaaaaaatgttattgtccactcaatatatgtattttgaaggaatattgactgcatatttaattaatttctctttcaaaatcatgatacaactacagtaattgctctctttatgggaaaaaggctctttctctagcgaagctttatgattcataaacactgacaaaagattcaaggaattctggcttatgtaattaccgggcatgtatttaattgttttccttggaatacttgtttataggatgatagaattaaaaaataattgaatcctaaaatctgaacttcaaatttctatttctctctgatattatgattaatatagctatttatttgcaacagttctcagatcattgtttttctttataagacaattttgtggtgcaagtattacttaatacaaaatacattaataaataaagttaagtgtaccaaagcagatgctgctactaaacacatgtttctttgctagaatcaagatatatttaaggactgttatgagattaggaatcaaagtgaataattttggatctttgccgttgttgaatgaatttattgttttttaacacagattttatttcatatgtatggcttagtcctcaaataggtaagacttcactgagacagttgtatttaaaaatttgatataatttttatcaaacagatttgaatttgaacaataagtactagatttgaggtatgaaaatgtgagcctttgtgtcaaaattaaaaactttttggcattaaagatgactatcaagaaagtgaagacaaccaatacaatgaaactgtttgaaaatcatgtatctgataagagacttatatccagaatacataaaaaatttgtataattcaacaataaaaagaaaaataacctagttttaaaatgggcataccatttgaatagacatttctcactgtaagatatatgaatgtccaataagcacatgaaaaatgtgatcaatataattattcattaggaaaatgcaaacccaaaccacaatgagataccacttgacacccactaggatggctttcatcagaaagacagaaaataaaaaatattagcaaggatatggagaaattacaacactatactttgctgttggggatgaaaatgatgtgactcctttggaaaaagttttaatttttaaaaatgttaaatatagagttaacattttttgatatggtaatagtttctacttctagatgtgatgcaatatctactcctcggtctatacccaagataagtaaaaatatatgttcacttaaacctgtacctgattttcatagcaatggtattcataatagctcaatgtggaaataatgcaaatgttcatcaattgattaatggatttaaaaatatggtatattcatacggtaaaacattattcatccatgaaaaataaaacactagaacatgaagtaaacttgaaaatacgcaaagtcaaagaaggcagagagaaaaggccatatatggtattattccatttatataaaatgtccacaataggcaagtctatacagacagaaagtagattagtgcttgtcagggaatggaggagtggggaatggggaatgatagttaatgggtatggagtatttttttaaggtgaggaaaaatgttctggaattacatagtggtgatggttgaacaactctgactatactaaaaaccactgaagtgtacactttgaaagggtaaattttattgtatatgaattataactcgataaaacaattatacaaatgataataaaaaatcagcaagtaagtattgatgaattaggatatgtgccattcgggaaacaaacaagatccaaggatagtaatgcacagggatatattttagaaattagtttatgttggatttttcaaaagcagaaaaagatgcaaacctctgagttttctggatttaaaattgaatgcagaattgtctactaatgatatgagagttacaaaacttgaactaaatcaaaaagccagtgctaagcactgagagatgtaatgtgtatttaaattagtccctgcagggtttgtagcttatgattctaataaataaattccaaaagcaataacacagtattatgtataatgattgatgtcccagtgatataaacatgcagctataggattatacttattttgcttatttaaataactgagaggttacattttaggagaaataagtaatctctaagtacacatttaagaagctttggagttggcatatttttaaaatttgcccttgtaatagaaaaggccgttgattacttgcttttaacgaattagtaacttttgcttgatgaagtaaaaaaggtacaaaaagttaactaattaagcaagtgacaaagaaaaagcatacaaaattcttgtagagttatcacaacttaattaactcagaatatccaataataatcactttaaacatttaatgtactttgtgaatactatgtctcatttgacccttacaaaatctgtgagatagggcatcagcctatatttccagatgagaaaatagagaaaatgagattaaatgtaatatttcatagttggatgatttcttagaaagccatgatgaaaaccatggatctcctgatatgatgactcatatatatatatatatatatattttttttttctgttagactagtgttgattgctcagtgatattggtgggattggagtggtaggagtggtagtgatgaaagactaaaaggaacaatgttttgataaagaaatatattagagtccatttttcacagactaagaataggtagttcaaaatctgagaagtaaaaaattaaaaacataaaaactttgtagaacaattagaagatacatttctgagtacaatttattataagattattgtgaagtaggatttagttatttatttaaaaaaactcagaaggttctcagcataaaaatatatgttagcaattagattgtgttttcatatgcacttaaaaagtgtctgggctggtactgtgtccccaagactagtaaataattatgtacgttagaaacaacctaccatatggtccctcttctcaaatgaaagtcaattactctctaatgaagcatttcaaaagcattttggccattttccaaataaatcattattcaacatttctttttagtaatgacaactgacttaatggtggccctggttttttatgcttcctctcttgccttatgtgaatgtaaatctaatcctacctttaaagacaacaggatgtcacagtacagcacccttagctagttcaaggcatgaaacaactctatcacttaaggattttgtgatggcagcttcacattagtccagcaattcaagatggaaataggacaatgtaacagaggacacaaaagctgttgctttatgactgaagttgcaggatagaggtgagccttgattctgtgttatgtagctggactccacaaaaacgctactactactcagcatattatgcactcaatagactggcctggtttggaaatgatgccacagtttgccccatcattatgtcttctctctcttttattaataaactttaggttcagaaaacccgtattacagaagcacactacaggagcacactattttttgtctttttttttttttttttgagaaacaatttctttttattattattattattatttaagttttagggtacatgtgcacaatgtgcaggttagttacatatgtatacatgtgccatgctggtgtgctgcacccattaactcatcatttagcattaggtatatctcctaatgctatccctccccgctccccccaccccacaacagtccccagagtgtgatgttccccttcctgtgtccatttgttctcattgttcaattcccatctatgagtgagaacatgcggtgtttggtcttttgtccttgcgatagtttcctgagaatgatgatttccaatttcatccgtgtccctggattacctgatgtaacatttttccttcttttatttttcacagaaattattttattaacatctttttcttttgagatatagagtagtgagttcctgtaatattcaaacaaacattattcacaggaatcattattttcctctgcctccagttcaataacaattttctttttcagtcagatgatagatacttttacatatcacatctcactaactcctaaataagtgtgatcatatatgtttctattatacacccttttcgtttcctttatccctcatttttctttgcgtttctttttttctttttacagcaaacaaagctctttatttagctatctttaacaatgtagtaaaattgtaatttttgttagatatttaatattgttattatccaaaataacatttgaagattgtcacttacccaatcagaaaaaaagaaagaaggaagaaaaaagcaaaaaggcaaagaaagaaaggagacaaagaaagcaagggaggaaggaaaggaaaaaagattgttaagccttcatttcttaaaacttgaaacatatttgcttactctaagtggcagcatggtagttctatgtaaaaacactttgtcattaaaacaccaacaaaagccctttagcgctttgttgaaccagagaatctcatctggatcagatttttttctactttattcaattctacctatcacgtttttattttattttattttattttattttattttattttattttattttattttattttattttattttaccaccatgagctgtgctctaatatcactttcttatatcagggctcttcatttccatcttttccatgtcaacttgctcactaatgttttcatgggctaggatcctcccatattttccatgaactgctgtttgtttgcttcagcatgcttgcttgacaacccacatcctttttctaacctgagtgctctatgcttgctttctacatgcctctgtgataaacagattcttttattctgcaatgtttgtcagaaaagaaagaagttggatttaggttatgctatggtttgaaagtgtcccccaaagttcatgtgttggaaacaacctccaatgcaacagtgttgacaggtgggacctctaagaggtggttaggtcatgagggctctgctttcctgaatggattcatgttgttaccctaggagtaagttcgctatctaaagagtagttttcttatactatctctggcaagctctctctccatgtgatacctcctaccatgtgatgacacatcaaaaagatcatcataaggtgtggccccccaatcttggacttcctagccttcagtaccattcagccaagtaaacttccattgcttataaattacccagtttgtggtattctcttatagcagcacaaaacagagtaaaactgattctcagtgaaaaatagatctatagatgcaaaacatcccttgacaatctatgggaagagtggttatttcttttttgattattgatgttcccagcaatctaggcacaatctctggtccaataaatatttgggactagtctactgcaagtcgatatctgttgaactatgctatgtctagcattcttgtaggctaaaatatcaccaatatcttttctttgtgtttccaatgacttgtaattaattacatttctatgactgctggtaggtgttctcgagaggttttgactattaaatattaaatatcaagagataacttttccatatgtctgaaaatttcaatgtcataagacccttaggtttttgttttctttattcatctaggcagcactttttcattttggtgaatccaatatattcttttccttgtcagttgactattttagctttaagaaattgtaaaatcatgtaaaattgatgttattttatagacagagtaattgtaatacggcttgctcagttgcctaaagatataaacatatattgacaggaacaggctagaaattgtcttcagatgatcactcacaaaaccaagtgcttttgctatagtcatgaataaggatcaagaatgaggaagataataacacaaattctctctagaatttcttgtagagctatttcatttcagtttgccatagttttgtttagtcagaggtgaccttttgagcaatgaaaagacaattttgccttcaattgaacactaatccctactaattagaatttagaaagtcatgtttttttaaatgtctaccttccagctgtcatatctctgatatgtgtttgcctttattcttgttggtttcctattgattatggaaacattagacttagtatctcacacactaattcaggcaactggtaggcatacatacatcagtaaagtaattcattttatccttctagcattatatcctcctatttttttgcccatttacacaaataatcatttcagtatgaaagatgttataaatcatttaacacctaggggacagttacaacaacaacaatgcaactttatcttctcaattttttttatttccttatccctctccatacacattttttactgcctgtattagtccatgcttgcactgctatatagaaatacctgagactggataatttgtaaagaaaagaggtttaattggctcatggttccacaggctgtacaggaagcatgatcggttatggggaggcctcaggatactttcaatcatgctgaaaggtgaaggggaagcaggcatgtcttacatggtcagagcaggaggaagagggaagccagattttgcagtaactcactcttgggccaggacaacacccagaggaatggtttaaaccatgagaaaccaccctcatgattcgattacctcccaagagtccccacctctgaaattgggtattacaattcaacatgagatttgagtggcaacagagatgcaaaccatatcactcccccatgcttgttccctcagccctctctcttctccttgacaatggctagcactgtgaattttacaaaactatggaaaattagaaataaattactaatttgctttgaggaaatatttgagcatgttataaatgagtgagtagccgaagtaatgaagcaaattacaaaggcaaagaagcattaaccttattttacaaagggtctttatagtcacttcccagaacagaatgtctgctagtgaaagaaaattaagatagaagagcaatgagatagtttgtataggcattagccaaaatcttcaatacaatttggaaactaattattgatcttcttctacttgtttcacatatcctttatttttcttaagaaaacccattaaatttagacttacattttaggctataagttgaatccataacataagaaattttcttgtgtgtagcaaggctatggatatgaaatttcttaagatgccacaaaactaatcagagattacgtagaataaaaaccacttccacttcactattttttctcatctgcagcagcagttcccaaactttttggcaccagggactggttttgtggaagacagttttttcatgtatcgggggtggagcagggtggggatgaaactgtgccacctcagatcatcaggcattagattctcataaggagcctgcaacctaaatcccttgtatatccagttcacagtaggattcacacccccatgagactctaatgccaccactgatttgacaggaagcagagctcaggcagtaataaccccttgccaactgctcacctcctgttgtgtggcccagttccttataggccacggactggtacaggtcagtggcctggggattgaggatcgctaatctagggcgtttaattagctgaattacttctattcgcacttgccctccccagctctcccctcctttgtagaatacagtgtgctgtatgccatccagaaggctttagatggctcactgttgccagttttgagagacttgacaggctcttcataaccaagcctcagaagacctgagtaaacttatttctatccactcactgtcaggcacagtacactcttaaaacaacagctccacacagcttctcagaagggaataaagaagccaaattaaaggtaattcatctttcaaatatttataaatatttaaccgcattcaatttaatagagaaacatgcttacagttttttaaaaatttctggatacgtagttgctatatatgtttacaggatatgtaagatattttgttgcaggcatacaatgagtgataatcacatcagggtaaatgagttatccatcactgcaagtatttatcatttctttgtgttacagacattccaattatattcttttagttatttttaagtggacaataaattattattgattgcactcaccctgttgtgctgtcaaatactagatcatattcatcctatctaagtatatttttttactcattaaccattaccctcttcccccaatacctccactagcctttccagcctttggtaaccatcattccactctttggctccatgagcttaattatcttaatttttggctcccacaaatgaatgagaacatgcaaaatttgactttctgtacctggcttatttcacttaacataatgtcctccagttccattcatgttgttccgaaggacaggatctcattcttctctgtggctgagtagtactcattgtgtatatgcataacattgtttttaatctatttgtctgttcatggacaattagattgcctccaaatattgactattgtgaacagtgctgcagtaaacatgggagtgcagagttcttcaatacacttattttctttttaaaaaatttttaattcttgtggatacagagtagttgaatattatttatggggttgatgagatactttgatataggcatgcagtgtataataatcacatcatgctaaatagtatatccatcttctcatgtgtttatcttttgtgttgcaaatagtccggttatactctttaagttatttttaaatgtgtagccaaattattagtaactatagtcaccctgttatgtcatcaaacacttggccttattctttctaactactttttgtacttactaaacatccctttttcccccaccactcccaccttactaccctctccagccttcggttaccatcttcctactctctatctcgatgaggtcaattttgttaatttgtagctctcacaaataggtgggaacatgcaaagtttgtctttacatgcctggctaatttcatttaacatgatgacctccagttccatccatgttgttgcacattacaggacctcattctttcttcatggttgattagtactcattgtgtgtgtgtaccaccttttctttatctgttcctctgtcgatagacacttcagttgcttccaaatactggctattatgaacagtgctgcaacaaacataaaaatggagatatacctttaatatactgatttcctttcttttgggtatatacccagcagtgggattgctagatcgtatggtagctgaatcaattttagatttttgaggagcctccaaactgttcttcaaagtggctgtactaatttacattctcaccaatagtgtacgagggttcccttttctccacatccttgccagcatttgttattgcctgtcttttgaatgaaagccattttaaataggatgagatgatatcccactggagttttgatttgcatttctctgatgatcaatgatgttgagcaccttttcatatgcctgtttgctgtttgtatgtcttgttttgagaagtgaatattcacatcctttgcccatgtttaattggattattaagttttttcctatagagtagtttaagcttcttatatattctagttattaatcccttgtcagttaggtagtttgcaaatattttctcccattctgtagttgtctgttcattttgttgtttgttttctgtgcagaagctttttagcatgatgcgatcccatttgtctatttttgctttagttacctgtgctttggggtataatactcaagaaatctttacccagaccaaagtcctagagagtttccccaatgcattcttttagcagtttcatagtttgaggacttagatttaagtattatttccactttgacttgatttttgcatatgggtagcaataggggtctagttttagttttctgcatagagatatctagttttcccaccaccatttgttgaagagactgtcctttccctaatttatgttcttgtcacctctgttgaaaatgaatttactgtagatgtatgaatttatttatggattttctattttgttccattgctttatgtggctttttttttctgccagtaccatgctgttttggttactatagctttgtagcgttaagttgaggtcaggtaatgtgattcctccagttttgctctttttgctcaggatggctttggctattctgggtcttttgtgactccatctaaattttaggatttttttttttctatttcagtggaaggtcatcggtattttgctcaggactacattgaatctatagattgctttagctagtatggacattttaacagtattgggtcttctaatccatggacatggaatatcttttcatttttttgtttcttctttgatttctttcaagaatgtttcatagtttttattgtagagatattttacttctcttgttaattcctagtattttactttatttgtagctattgtaaatgggaacactttctagatttctttttcagattgttcactcttagcatcaagaaatgcacagattcttgtatgttgatttttgtatcctagaagtttactgagtttatcagtttgattgtttttagtggaatcttcaggatttttcaaatataagatcatattatctgcaaacaaggataatttgacttcttcatttccaatttggatgtactttatttctttctcttgtctgattgctctagctaggacttccagtactatgttgaataacagtggtgaaagtgtactcttgttgtgttccagatcttagaggaaaggcttttagtttttctctgttcactatgataactagctgtgggtctgttatatatagcttaaattgtattgaagtatgtttcttatttacccagtttttttaggactttttaatcatgaaataatattgagttttattaaattctttttccgtgtcagttgaaatgatcacgattttgtccttcattttgtttttatgatgtatcacatcgatttgcatttgatgaaccatttttgcatcctggagataaacccacttgctcatgatgaatgatctttttaatgtgttgttgtgttctgtttgccagcattttgttgaggttttttacatcaatgtttttcagagatattggcctgtagttttcttttttgatgtgtctttgtctggtttggtatcagggtaatactagcttcactgaatgcatgtagaagtacttcctcctcctctatttttcttagttgtttaagaaggattggtgttagctctttaaatgtctgataaaatttagcagtaaagccaccaggtccttggctttttttttttttttttttaccgggagactatttattatggcttaaatctcattacttgttatggtctattcagattttggttttctttatggctaaattttttgggttgaatatcctcaaaatatatttattttttctattttttccttttttaatgtatgtttgctcgtttctaatgatcttttgaatttctccactatctgttgtaatgtctccttttttttgtcttttatttcatttatttgggtcttctctctttttttcttagactttttaaaggttcatcaaatgtatcttttcaaaaaattaacttttcattttgttgatcttttgtattctgtatgttttcatttcaatgtcatttatttctgctctgttctttattaatttcttcagctaattttacatttgcgatttgctcatgcttttgtagttctttaagatgtattgttagcttgttcaagttttaaaaaaaaatatttaggatcatatagctatacatttttctcttagtacttcttgcgctgtatcccatagatgttggtatgttgatccatgttcatctgtttcaagaaattttaaaatttccttaagcttctcattgacccagtggtcattcagagcatactgtttaatttccatgggcttgtgtagttttcagagatcctcttgttattgattttcagttttattccattgtagttagaaaggataattgatattatttcaaatttttttgtttttgaagacccttttgtggtctaacatgcagtctatcattgagaattatccatgtgccaaggaaaataatgtgtattctgcaaccattggatgaaacattctgtgaacatctattaggcccatttggtctatagtccagattaagtctgatgtttctgtgtggattttctatctgtgtgatctctctaatgctgaaagtggggtgttgatgtgtccagttatttctgcattggagtctatctctctttaattcaaataatatttgcttgtttatctgggtgctctagtgttgggtgcatatatatatttataattgttaatatcctcatgctgtattgacccctttatcattaaataatgaccatctctgtttctttttatggtttttgtcttaaaatttattttgtctgatgtacatagagctactcctgccattttctgcttttcattttcatggaatatcttttctcatctctttattttcagtgtatgtgtgtgtttatgggtgaagtttgtatcctgtagagagcagatagttggggctttaaaaaaaaatccattcagctactttatgtcttttgattggagagtttagtccatttggattcaatgttattaataagtaatgatttactactgccattttgtttctcgttttccagttattttgtattttttccttccttctccttccttccttccttttatccttcttcccaccttctatcctggcatactttttgtgaaagtgattttctctggtggtatgattacatttcttgctttttattatttgtgtatcgattgcagttttttgcatttgaggttaccatgaggcttgcaaataacatcttataacaaattactttaaactgttcaaaacttaacactgattgcataaacaacaaaaatagcaagcaagtcaatataaaatgaataaaaattatactgtaacttcattccatcagttttcttactttttgttgcttttatttatatcttgctatactgcctatgtcttgaatagttgtagttattactttcgattggttcatcttttagtctttctactcaagctatcagtagtatacatcccagaattacagtgttataatactctgtatttgtctgtcaacttactattaccggtgaactttgtaccttcagatgatttcttattgcttgttaacatcctttactttcagattgaagaactctatttagcatttattgtagaacgtgtctagtgttgaaaaaaatccctcaaattttgtttgtctgggaaagactttgtatctccttcatgtttgaaagatattttctttaaatatatcatgccaccctctcctggcatatcaggtttctactaagtcccctgccaaacatattggagcttctttgtatgttacttgtttcttttcccttgctgcttttaggacctcttttaaaaaaatacttgatttggggagtttgattattaaatatcttaggtagtcttatgcgggttaaatctgcttggttttctttaacctttttgtacttgaatattgatatctttcttacatttcaaaagttctttgttattatcttttgtaataaactttctaccccgatctctctgtctctacctcttctttagggccaatgacttttagattttctcttttgaggttgttttctaaatcttacagactgcttcattctttttaattcttttttcttttgcctcctctgactgtgtattttcaaatagagtgtgttcaggtttactaattctttctttttctgaatcaattctgttggtgagagactgatgcattcttcagtgtgtcagttgcacttcttagcttcagagtttctgctttggtgttcctgttgcgggaaccatcattggagggttctattttactatcttgttccacctccccagttcttgtaaatatgaaaccaaaatctttacaatggtattgacctttaaaactccttgcagatctgtaattgtaaacaaataatattttgaagctcaggtcattattttttatcttatgaggcacatgattggttatgacctttgaacaataatcttattgaatatgcacagatcatcttaagtgttaagagtgtctaaggaaatatacattacctgccagatttatgtatatgtatgtacatttttgagaggaaaaaggcaatttttaaagctaacatttggggacaaacaactaatattaagctaaaagtaaaaatgccttgaccttcttatactggttctatttttctctttgtccctgatagtgacagatgacattcatagtcccaatgagcttttctcatatttttgatttatcaaaatgcatgatttaataactgtctttaattttattttcaaaatataggcaaacagttgcatatggtacggtactaaatgtgttaaagaaccttttgttccctactctatttcgaggtgaaagagaatgctaatgtaatgataagtaaatgattctttcacatttggctttccttccatcttcaatttaaaaagttagctaggtacccactcagaataattgaataatgcttctttctacctaacactgctgtagaagcatttatttcctctcatatttccagttatctctaggcacagctttaggtaatatcttaaaagttacaaaaatattttcttatggtatgatttcataaatcctttatcaacaaacgcaaatcattcaaaggtttgtatttgaagttttttaaataagcacataaagctagtggccatgtagcaaacctctaaatttttttaaaatgtttcttttgttcttatttttgtgaaaatttgttatgtctttcaactttagaagaagttttttttcccataaaaaaaaaatctcaccatggggtttctattttgatgctatcttgtggatgggacatttggctaggtcatcaaatggtctgcatctcaccagctgctgtttttccctccctcccaagaccttgagaaagtaacgtaacattcctaagtatctatttctaactttgtctaagtatttcacaaaaaacgaattcaacaaatgcttatagatgacttttgtattcataagttgattttctttaaaggaaatactaatcccttgttttcttctccttgctcatcttgtttagtaatttagaaaacccaatgcctatattaaaaaacaaaattggctgggtgtggtgtctcacacctgtaatcccagcactttgggaggctaaggcaggcggatcacaaggtcaagagatcgagaccatcctggccaacatggtgaaaccccgtctccactaaaaatacaaaaattagctgggcgtagtgatgcattcctatagtcccagctactcagaaggctgcggcaggagaatcacttgaatctgggaggcggaggttgcagtgagctgagattgcaccattgcacaccagcctgggctacagagcgagactccatctcaaaaaacaaaaacaacaacaacaacagcaagaacaacaaaaactgcatcatctctctgtatccatctctttatttctctctctagtatgttcccgagtgcttgagttctctaatgatctatggcatgaagcagcctttatcagcttggccacttgaacaattacgtgttgcacatcacatcaaagaaaagggggatgataaatgaatatcatcttgttttggtggctattaaatgccttcactttcatacaatgagaaatttgataaactgagttgagcctcatggttaatgacatttccaaattttagaatatccataaataatggaggaacttattataaacaataggggataaaacaaagaacctctcttctgacacatgagaacaaatgacttcacatctcatctatttttagagaatgatgttgaagtctattcatttatcctctgttattcatttttggataaataatgatgctcttttaaaacctgaagtccaaatgccttaatacaataagatatgtgacattttataggcattttgtaacaagtcttgcatgtcactatagtgcggttacatacaatatcaattattccctaaggtattatatagttgtagatcataaacttatagcttaaattaaacatcacagctggttgctttaatttgatgcattatgccacaaatgtttcaacagcttgactaagatgagccatactgccgattcaaaagaagagcgaaggtcaatgcacaggaagcctagtcatttgcagattttctttgagaatattaaaaagcattctgcagaatatagttaaatggaatataaccaaacaaaattaaagaaaacagagcagactattgcgatggtgtttcacttataaaaagcagcctataaattcttaatttcatgtcagtgtttacgatagcacattttaaaaatcatgaatagggtgctttgagaatgttgtttacttctttcattgtggtagccttgcctgcttcttttcaaacttaaaacttcattaaatctgcaaaggaaggcaattatgagaagaaagataaaaaatgattgccccctttttcccctctctccaggaaagtttttccccctcaattagaagaccagaaaagctgtcttttcactcatcccattcttcactccaaaagtctttagctaagaatactgataataattccaccaagattatcattcattataatgaaaacccaatttttattctaactccaagggtattctaacccataataattagccctaaatattatttttgaagcaattcacaagctaaaataatctgttagttaagatcagaaaataaaactccctcaaatcatgtgtgctggcaacacaacagagatggaagcaatcatgtgtgaaaggttaataacatgatattttaagattaaaaagatgaaactaagcttttccgtatttgtcataaagacataaaatttcaaaaacaaaatgagaacccaaatatctctgagagtttgctctcacaacatctaactaatcatcatctcttagttcagaaacacttagttgttcataaaccacaaatcccttagtatgacatttggagccccattcaatcccattcatatatcattaaaccatacttaattacacactctagccattgcctgtgtgtgtgagtttttctttagccactattttaaacactcttcctcctttcaatacagttcaattattgtctcctattaacgtaatgctaatactttcaatcaaaattaacccttcctttattgatgtatctataaaacgtaattattatgggatttcagttatggaatactttttgtctcagagttattttaacaggcaaaatataaatttctttgtttcatgtatgactcatcttttctttagctcttcattcttctgtgtaggtaattaatgtctgttgagttaaattacatcatcattctaatccaacactttttttctttatagtgagggaaactaagtttcagagagtttaagtatgttttctgaacaagagaaactagtattgtttccaggatcaaagacttatttcttgctcaccatacataagtgccttataaggtgcaggtaaaaagcttgatctgcttaaagttactgatatagtcagagtttggagctactgcaagtttctaggtgctcagttcagccttaactggagcagaaaacatgccctgacctccttatcttgttttttcttaactctcttgtgtaccagtatttttggagtcgatttgaataacaatagtaatctgctttacctcactttacctatacatggaaaaagtataatcctggaggaaagtataatcaattgaaaagaatatggcatttacagtagagaaagctgaatatggaacctggctgtagtattggttgtcttccctaactttacattcagtattcctatttgccagtcgagggaacaatacttacctcaaaaaagttattgaaaggaataaattgagttcatttttaaatgttgactaagaaagactctgacacagataatttgctgaataaaaacaaatctattttcccccactctgctgctaaatatacccagatgcatttgattgaagatatattaaggaatggagaatagaaggaaaaaaaaagaaaaaaaaaaacagaagtaaacgggagaaaacaaacccactaagatttggagatcttgcatgataccactacatcagtggcactaaacccaataagatttggttctaagctttgctcaatttagtctctttcaagtagtctttctttagctattttagtcccttagtcacattagtccctttagttttagtggaaaaaaacatcagttactatccaaattatacattctaatgggaggaactttggcatgtccagcaagcttccattttctcagatgtaatgtgtgcattatcatgggaaataagccaaggcagttgctggctttttgtgttcccttccattctcccttttgctatcatcctagaaaatcacagtgatccattgtgaaactgaaactaagtctcacttttatggactatttatccttaatgaccttctcttttattcagccacagctgtatgttccaaaagtctaggtgttaccataacatagaccatgctatctagctatcttacacaccaaaatcctactccataaccatgagcccctgtccttgtaattcttctaaagccatccgcaatgccttgaagtccctgtcctttcagattctctcagtctatgtcttattttggccttttaaaatttcctgctaagtcttattattttcatctatattcttaattcatttgtacctctatttgggtacagagtgcaagcacattcagaaaatctcacttttagattaataggtcttttcacttcccctgttctactcttggggtgttgagaaatgctaaatgaataatatatctgggaagataggcttgtctaaagtgcatggtctaaaatatcaaaatgagagctccatgttgctatatgttctcatacccctaccctgaaaatctttacactatagttactttgatctcagctctgtgtccctgcacaaattaaaaactcgcttaagatattaatctttcctcaatggagatgcaaatgtactctagaagtggatgttctgtgtctgaatctcaactatgccactgactagttttgtgaccttagatcaaatatttatgtctgtacctctgatttcctatgtgataattagaaaagtacataatagttttgtgagaattaagtgacttaataattgtgaaacatttagaatagctctggtcatatagtaattaccaaacagctatccactattattggcatttttttgaacagaaatgtccatttcatttccttcttaacataaccaaaaatgatgctttaagaaaagtactcttccaaatatcctcaatggcattacctccagaggttttgctccctgtctagcaattttcttgtttgagcattcagtgtgtttgaacagttgtcccatcacataacttcactgcctttatttttgtctgactgtcttatttcagttaaccagtctttaagttctgagattcttttatcagcttggtttattctgctgttaatacttgtgattgcattgtgaaattcttgttttgcgttattcagctctgtcagacctattaggttcctttttatactggctattttgtccttcaccccctgtattgccttattgtgattcttattttccttagattgggttttgccttcctgttgaaacttgatgatctttgttcctagccaaattccaaattctattcctgtcattgcagccagcttggcctggttaagttgtgcacatataccctagaacttgaagtataataataataataaaagaggaagaagaagaagaagaagaagaagaagaggaagaggaagaggaagaagaagaaagaagaagaagaggaagaagaagaagaggaagaagaagaagaggaggaggaggaggaggaagaagaggaggaggaggaggaggaggaaagaagaaagaagaaagaggaagaagaagaggaaagaagaagaagaaagaagaagaagaggaagaagaagaggaagaaagaagaaagaagaactcttattggagaactggtgcagttgtttggaggacatataccactctagacatttgagttattggagttcttgcatgggttctttctcatctctgtgtatgggtgttcctttaactgcaatatagattgagtcaatagatacagtatagatgcagtatagatacagtcaatagacttattttctggatgttttcaccaggccgaggctttgtgcaaggtttttatttgaagctgattttttgtctctggttttggaagaaagtatgctagcaaagtattttttgtgttgaagctttggggtgtgatccagtaggtggcacttaggcatactggtcagctggtagactcttgtccagctatgtggctcccctgtttcctctcagttgtaactgttttctttctcaatgctctctgaaagtgtgggttcctctcccattgagtgctggctgtagaaggtggcttggcactcctgggctgcccactgtatctctccggtgatctcagtccttatgtttcttccccaacctggaaacaccagaggaaggaaccttagtagtagttatggctaagggacttttgcttgtctcctgggggctccacaccagagatacgggtcagtaatcactcagtgcagtcagcccaggatggaggggctatgctgtgggtccaagccagaggttccctgtctggtgatgagcagttggaggtgtgtgggacccatgggagactaactacctcctctctttgggtcaactgcagcttattggaggtgtaggtaaagcacttggggtctttgctacttcattactccaagggaagcaagagcagttccactgcagaggcagtggcagagaggctttcagttgcccttggaggctctgtccagggagttgccaagtttctactcactcagctctggcaagaggtggctggaagcccagtcccagaggaactgtctggtgaggaaatgtgggcaccaatgtacatctggccacttttctgtagggctgctgaggtatgctgggggcccacttcagtctctagtcacctcagattttcctgtacctggaggtatcaccattgaaggcacttcgctgggctggggaggttactttgtctctgtgtcatgcctgcgtgggccgtcatcctgcctggcttttctccattctccatgggttgagttgtttcctctattagtcccaatgcaagtacttagatgtttcagttgaaggtgctgaatttacctgccccttttgcccctctccgagagagccacgcacactagctgcttctagtcgaccatcttggccacctccctaaaaattaaaaaaaaaaaaaatgcttaagtgtttttagtaaacataagtatgatttcttatatgagtttttaaaaatttttaaaaagaaaaagaaaacatcatgtttcttaaaaacctaaagtttatactttcactatacaattttacactcttaaatatcaacctcaaactcgtttccacaatgccatctttctcatcttaaaatactttgaaagtataaacatacacacacatgcaggagaggagagaggcagagactgagacagacagacagacagagagagagagaggggggaaagagattttaaaagtgaactagaaaacagtaattcacatttagtttggggaatagaaagaaaactcccaaacagattactttgagataactccaagaccttttggtccttatgattatcctcaatttaaagaaaaacatatgtacacacactgccagatgtggtggcttgcacctgtaatcccagcactttaggaggccaaggcgggtggactgtctgagctcaggagtttgagaccagcctgggcaatgtggtgaaaccccatctctaccaaaaatgcaacaacaacaacaaaaaattggccaggcttggtggcacacgcctgtggtcctggctactgaggaggccgaggtgggaggattgcttgagcctgggaggcagaggtttcagtgagccaagatcatattactgcactccaagctgggtgacagagtaagaccatgtctcaaaaagaaaaagaaaaacatacacaaaaaacacctatagatgaatcccacttcatctccctactcttcccctgtctattccactctcaaaattcaactcactgcagctgaactgcaggagaagcagcaatgcgaatatgttttatgatgatacctttgcaatataaagttttcaaattctagacagttgctcttggcctgaagaaataactactacattaaacccttggaatctagtaatttcaaagaatagaaaattagaaatttcatcaattgtgttataataaagttggatattttcaatatttaatgcttttcttcaaaatatgaagacaacatttgttatataatatcagctagtcacgttatcctctttcacagtcctttatttttcttccaacatcaaagcaaaatgtgaatgaaaatacatcacatatatacctagtcataataaggagctaaagtcattgacacaaatttacgaagggacatgaatggatacatctgcctgtgtaaactagctcacaaatgaatacacacatatgcacagcattgagaaaccctaaacaaagcacaaaattgtgaatacaaagattggtttgcaagcagaacatagagagccaagacacacttagtatttactaagtattttatactgggcatttttttctgaaacttttatatttttcatttatatgctgtgaatataatgcctgaactgtctatatcataaggctgctgtgaggctcaaatgagttaatacgtgtgaaaatgcttttaaaacttgaaaataaattggaaaggttcttaactaattatagttaaaagagccaatacttttataactgagctctatctaatcattaaagaataatgagtagctcttattttgctcatttacttttatattgtagaaaacactgaatagctttttctaattcattctatgatttgaatctaactttaacactgaaaaaaaacaaagccaggcttcccccctcaaatatacgcaacttcacttaggaataggttacataatttctcggtcaaatatttgtaaattaaatctagtgatgaattaaaaagtatcacagaaatagtaggcagtatttatcaagcgcttcatgtttagaacaatatttatgttcatgtttagagcaatatttatcaagtactttatgtttagaacattttatgtttagaacaattctatacagtagtttctaatattatcccagttagactgatgagaaaagctaggtctagagaggtaagtaacctttctatcaacacacatgtagtaagtggtaaagctacaatttaaacccctccagtatgactcctgaactcatagtcatagcaccatattatgctgtttcactgaattttagtcaataataaagtttgaataaacctgtcactataattcatggcaatagtaaactaaagataacaactacaggttgtttccatagacctagtagagatgatgttatcatcaatgacaaaccattaactttatatgaaatggcccacaaaactttgttttattttcaaaatatgcatatttactaaaaatggtacatttaaattcagttaaattttcactaatatttatattgacactacagtgtgccaggaatagtgtgtttgggacacataaagaatgacaatatggagtaaaaaagaaattctgtccactctcaaagcaagagatccctaaaggatgaaaaagacaagtgaagaaagtctgagattttttttttaggtcgaatgaatggcaagtgtacatagtcctaaaatagccagatatacatcaagaactaaaaataattcagtgttaatcgagagaattataaagtggagagtggcagagatgtagcttaggaaaaggcaggtgccagttagcagagagccttctgtcattctgtcaccgtgaggtgctttggcttcatgctgtggaagctatttgaagccacttcctctttcagatggaatatatctgaaggctatagggtgaaattaaacataacaaaattgaaataatacagaaagttggcaaggaccttataaggacaattggagagaaagaaagaaggagaaagggaaatgcatttagaaattgttgaagagctaaaatcatcagagattggtgactaattagagagggatgcaaggtgacctctaatataaggtaactgagtgacatgtgaagccatttctgatattcataaattaggaagaagagtcagtgaggggtagaggaggctgactgatgagttaatcatgttcaattttaagtatctaagagacctctggatagctatatccaaatgcagataggcacagatgactagctctcaatggagaggtcactacaatgaatttgggacttgtagacccacaagtgatactgaaatcatgccaagatgaacaaaaaagattttgcatgcataatatttggcatatagtacattctacaaaagtatttattttaaaattaaataaagcaagttgtaatgaattaagaaaaatgtgtaaaagtagccccatttaggggcaacaggaagcacccatggagaagggatacatgtatatacacacacgcacatacacatgttgatatcaatatatataatcaatttatatacatattgtctgtggtcatatacatatgaagtaaaattattaaaatctccaggaaagtaagcatcaaattatctattaattctagctagagaaagtggtaaattggatagctctatacagaagacttgaaaaatgtctctttttatttctgttttataaaaaaattctgaaggagcagaaaaaaatgttaaaatttgacaaacctgcttagtgagtccatatctattttaaaatgtgtttctataagcttgaaatattttctgataattttattaaagagtacctaccaaatgtggaacagacttagtgtaaactacaatttgtaaaatttggctggaaggtgaaaaacaaacaaatgaggattccagaagaggagtgatttttccttttaaaagataggaaagatttcagcattttatagattgaagcaatgggcagataaagaaggatgatttttgaaatataggcaatagaagattgcacaacaatactgttgtgaaataaaaaatgagaacatttgtatgatctttgtcctttaaattcaattacaatagagttagaacttttatattttaatatatgacttctactaaaagcataaactcattttgtctcattctgcattataataaagaactaaaggtaaaatgttgtacctcttaggtgacatcattgaaaaacttatagtaagacaaagtcacataattttttttctcagaggaaatcaataaccatgagactccttcacaaactgcagtgcatttatatatttcaaagcatcatcacacagttgcagtattctcagtaatacattaccaacaccaaaacaagccagaaagagcatacctgctgaaagaaaaaggaaggaaaatgtgttacccaacatgtatgattttgtatttctgaatattgaagactgttgaaaagatgatataattgaatttattgaaatgtacaagatggcaatagagaatttacaatttatgatacagaatttctgacctgccctatatagtaacaactattgtgattctgtgagttagaaattcttttaaaattttgggcaatttatttggaagtacctttttaattttgtgagctcaagagggatgtttctcctttttggcccttagagaatagagaatattcttctgagatatatttttagccataaggtcattatttggtgtgctggaacgatgatggagttgaggaaaagatgacaatgataggagatggcatttgtgaaaaaatatgatcagtgctaaaagaaggcattacaaccacctcttgagtgacagaaagtctcttaatgaaatgctgaatttatcagatacataaatcaaatcatcaactgttacagcaaatctgccaaattaggaagaattcagctaccatcattactaatcccattactacaaattccttgtttcttactcttttcattccaaatgttctcttcctgatccttttgctcattttttttctcaatcctgtcactgacacttctgcatcttggtgtcagttcattgtctgaggtaagtcagtcaccttgcagtccctcacctcctgcccccaagagctgttcctcattggtgttctccagtgacctccactccctgaggtctcatatcagggcaagtcttcctagtcagatgatcaaagtctcaaaggtgttggctgctggtacaacaggattgggattcatattctgaggttaggcatgcctctcaccttttaagtaacttagttgaagctctccttgagaaaattatgaactagacaaaaataactcatggtacctcccaatttgcagaggtaggctcctttaaccctcctaccatcttttctggccctcagcctctttttaattccatctttcaggcatcaggttctgattcagcttcagtcttttcttatcatggaaaaaaaatcatcttcttgttcttaaacacaataattatcagcctaagtgagctacctcccccagaaatgcctgtcactgtttcagtgaattttaaacaccattgggggagaaaatttctctttggcagatgttaagatatttctgaaataatacagttgtatatgttaacttgtaagaagatctttatctctaaattgtaaactctaagataggtaataatcactgttagtaaaaattgtaataaaaatacatacagaatatttataatgtactagattttcttatttaatcctcagaacagtactatttgtgattatcctcgttttactgatcagaaagttgaaacgcaaagaggtttgtaaacttgcctgaggttgcctgacaaagaaagaactacagagacctcagtcttatgaagctaccattataaagaatatttcttaaaaaattctgtgtctactgaattgaaaaaagaaaatcagttctgtactgaactcattgtaatcctcatggggtcagaaatgtctaagcattctccagccaaattatttctcctgtttttcagtatccaacaagtattacacacattgaaactacttagaagaagaccaatagacctaccaaatgaaaacattttaatgaggagatttaaaagggaaggagatttatacacacacagatataaaccttccttaatgatgaagtatataaaacctaccctcagcttctttttaattccattttttaggcatcaggtttctggttatgtgatacagaatacaataaagacaatcttaggtagaattaagattttccagattcaggccaccaagaagaattatactggctgaggatactaccagtagggaataaagattccataaataacaaaactcaccttttctatttttgagaagagtgtggggagagagagagaaagatgctgtatcttttttatttacccctgcttgactttcaacagaccctggttccttgcctaccttctcaccatgtgcaagaagttgtgcaaaatgattccagtgcatttttgttactgggtaaattgaaggttaacttcttgggcaatttgttacagaaatcagacaagcttcaaatctattcttgcaccatttctctctattctaaatgaaattataaattcatatattcgggaacctcagaaattccaatttccagaatatctagaagagatgttaaatctaatttttaaaaaaccacactggccaggcacgttggctcacgcctgtaatcccagcactttgggaggccaaggcaggcagatcacgaggtcaagagctcaagagcatcctggccaacatggtgtaaccctgtctttacaaaaaatacaagaattagttaggcgtggtggtgcgcacctgtagtctctgctacctgggaggctgaggcaggagaattgcttgaatccgggaggcagaggttgcagtgagctgagatcgcgccactgcactccagcctggcgacagagcaagactccatctcaaaaaaacaaaacaaaacaacaacaacaaaaacacaataattagaaatcaacaatgacagagagatcaacacatctggaatttagttatgagaaaagcaaaaatgtagtgggtgcaacggagaaaaagttgtaaaaagcccatgtaaaaataaaatgacaaaataagttataattaaattgaggtaatatagttacagactttggaagaattcagaatacataattatactgatgatagtaaatacacaactacatttttatgtattttctttattatcttgaaaataacttaatgctactgtgcattaaatacttcttcattacagttgaattcaaaaaaatcagctctaatgccagtgagaaacagcacatggggatatataaaaagtagattaaagaggaaaacacttttatattcctaatttatcacactattttattactgatttattctactctttatgctttaatatcgagtacccttccttgatttaaatatactttgaaagggcaagagtagaaagagtagtgaacaagaaggcaataaaacaaattcagagaaacaatcctttctattttctgaaaatataatggagacttagccctgacttacagttttgtttttatatataacaatttgataacctctgttgcttgccacaaaaaaaatctctggtaacaatttaaaatgaataaaataaaacaataccagtattttaactaattaaatgggaaaataatcacctgtaactttgaggaaatgcgttaacatttctgcatgtcttttcattcaaaatcaagttaagtcctttgaaagtgggcctagagatacaagtgaaaaaaaattgttttgagatgtaagtaacataaagagcgagaaacagaacagatgttttcaattttctatccagtacagggtcacttgatgttactatagcattagtaaagctttttaactctatattgagcaattgtttagtcctccttttcagggtcagtagatagctatcaaaatttgtattttcattttcatttgactagaaatttcatggatgaaatatcagaaatatttctaaaagtcaaattgcatttagtgtcacatagcaatgtcatagtttgtcagatagtccaattttactgttaaaaataatacgtgatcaatattctacaaaggtaaaagaacggaagaaatcaagatatacaaaaaagttgtatcaacatcacttgagaaaaactgtcaactgcgtgaaagaatcagtatattgttatgaataagaattccatttacaaatgatttcaattcatacactgaattccacagacatttcctgctattattttacttttactctcaaaatacagagaatctcggaacctgccaagttatagaattaaaaagccttaattatctactgggtgtaagaaatttatgtaatggtaacaacacataatgatgatgaattctgcttctcttattgactcactctctcctacccctccttctccccacgcaagttaagtaatattagacaaacctgactattgtttcttcacagcagttagtccttactcagatgattaatttctgtgaatctagaactgttttcaatactttgggaaatactatacacaaaaacaggaatggagaaggataagcccattagggaaactgctagagcaaattttttttaatgaataaatgttgcagtattattgacagtaaccaagatgcagaaacagcttaaatatccatcaacagataactggacaaaggaactgtggtatatacataaaatggaatattattcagccttaagaaaggagatgtgccgttttacatagcatggatgatccttgatgacattatgctagcagtgtcatacattctaacaagatatatgtgtatatatttgcacacatataatcttttaatgttttctttaaaaactcagttcctcaaaatcagctcttctttatttgaaatagtagctgacagtatgggtagcacaataaagtatgaaaagtagataggctcaaaaaatacttgaaaatagcttaaacttattagtgatgcctaaaagtaaatattgcaggcataaagagcatattttcttttatgctcaatagaaaactctgttgaatcacaatttcttttgttgaatagcaaaaatctttctagattttaaaaaaagtcaaaattgcctccgtgtactctaggaaaaattatggtgtttaataatgcacaaaaacagtgattataagaaacaacaaaaattgagttactattgtagacagaatattgtcattgaatgtgacatgacataaagtaggggggacctggattccgatatttggtttgtcgcttcctagatatgtgtctatgaaaaatgtattttatttccctgggcttcagactcctcatctcacactttaaggattagactctaaactcctatccggataaattgtagcagatgctactggtgctgtgttcatatatatccccttacattattttacctttttgtgtgtgggtgtgtgcacatgtgctccaggtgaatgctcactctaagcagccagtaccggactgtctttgtcagtgagctgtccttagctttaggaaactaaggcctacattgcctgcagacactgagagcctgaaaaacatgggcatgcccagctttgctctcttcaccaatgacttggcctggactgggacaattctgaaatgagatttccctttctccagagctttcctgtgggatgaagccaaagccaccctctgagatcttgaagcagtcctttggatgtacttctgttttcctgacttcctcactctactgctgttagttctcctcagagtacttcctaataaatcactttcacaggaattctcatctcagagtcatctgtttctgaggattccaagcaataatattttgatttattttgttttggtttgacattggtttgtgtgaactctaatgtctagcattagataaggcacataacttcagaaaaaattgtaaaaaactactctactataatctgtatgagtaaaacaagtcaatgtaaatatcattttaaataagacccataagagactatagttacattacatagcaaagtaacaataatatcctgatgtagattcttggcatctgtgaactactaacatagattcatgtaaattagataatttccaaataaagttaggaaacttaacaaaaatgtaatctattttgagagtgaaacagaaaaagcaaataataaaaatatataaataatcaaactaaaataaataaaaaaccaagtgaattggtcagtcttatgaatgtattttaaaatgtagaattaatatagtatactaagagtaaggtttattctatatacaaagggatattattaataagtggctaatcaaatatatttatataatgtcaatgtcaagtaaacacaaagattaactcaattttgtgttttcatttaactttaaattaaaacaatgttttaaaaatactatttttatagtactggtaatatatattatatacatatctaatttttaaattatttataaggatttaaaaatgcttgcctgtggaagtacatattattttacaatacaagaaattactttgataaatactaattgtgggtttaatcagatcagctgaatgatataaatttaccttaagactaaaatatttctgagggtgaggactcctttgatatatgccaatgtatcaaaatacttttttcttctggcaagtgaaataagaagaaaaatcagcacaaccactatatctggcatttattttctctcttttaccagctggtttccttgaattcaacctaagagtgcggttttcatttatgtgaaaaaagtgtaaggttaacagtacattcactcctattttgcaaggtatttttcttttgctgatcaataatttcaaatactgctctaaagttttactgtttgacatacatcattttgacagttccttaaagaacttaaatgctacctacaaatgtaatatcaacaagatctatactggagagtagtctacactgctaaaccaacttcattcttgctgtagtggcaaactgaaaaagaaaattctcttccccaccttcttcattttaatccatgtaactcattttattaatgtgcatcatccagcaaagtaaaataaaaatttgttttttatcttgttaaacgtagtgttagattttaaatacatttatctaaagtgtatttaattactggcttcacaaaatctgaagttgagaattgctacacatgggtagagtttttttgataattaagaaaggcttatttttatactgttatatctttactggcagtagacctttaattttacatttctcatcctgcttttattttctagcccctctccttgcattattcctttttaaaactttgactagattaggattacatatacaaagaatatgtaaagtcacataaagctgtaaaccatccaaagaaggattttgcttatttgcctgcttttcagaaattagcattactactccagctttcctttgatttatatttattaggtatatattatcaattattttattttccatatttctgtggaacattatacatacagcacattgttggattttgttctcacgtcttcaatttagtatctttgtcttgtatttgattagcttaatccatcttcatttattttaatttctaattttttcccatatcctggacttcctaattcaattctagaaaattttcttgtggtgtttaacagttatgtaggccgattttattattgatttcttaacttaaaaaatacatatataatcacttctatttcttaaatgcgtaaatgactttatcttccataatatgaaaggaacacattagtataccacatttatttcgccttgtgttctcttcacctcccattgcattactaatgcctggaatattacttctagtactatgaatttttcttttctttgtttattcatttactgtagtatatcacatttatataaaatgattagattgctgtattaatactgtgattacagagggcatttattttgttcagttagttgtatatcttttggactaaacttctgagtactactattctcaggcacctacttcgtttggcctgtgagctcatattatctgtgcaatattggctttttggtgttggagaaagaccaaaggccagaccatagtcactgtcagtctagagtagtccaaggtgtatatatgtgggagttagggcataggacatgggctttctaacagaaagtcccacacaccaccaaccagagttattacttgattttacaatgaccaagcaagaaacgactctactcagaatttcactcctaaatcctttgggaagagaatgtaaggaaaggacagttttacaaagctgtaatctgtaaagcttggaaactggatttcagaagtaaaggactgaatgtctctggcatgtcagcccccacatactttcacctcacccagaaaaacccctgccaatataaatattcacaactgtagtttgaggaaaagaagataggcattgattgtccaaaaacaaggagatgggagggtgggatggcaagaggtaaaggagaatttaaactgtccttccgatgctgtctctggcttctctttgccctaagctgtggccacccattcactcttcacacagaaacatttaaaatagacttatttctgttattcttcttgttagatcttggattctgtctttctctccttattttgttctcagcattacttttacaaatattaaccagcaatccatgcaagttggacatcttgttgaacacctgaattcttgtgtgtgtgtgtgtgtgtgcgtgtgtgtgtgtgtgtggggggtgaatttttatctctattcaatatgtgttatttatataaataatttctatttagcagtctataatttttcctgaaactcatttcccgtgttaaattattcacatattttcattttatgttattttattgttttacatacactgactttatagctagataatattgttgtagagttgaaaatctatgtttaacttacaataaaaaaagttatccatgtaaaatgaaaatagatgttctgaaatagggccttataaatattcctttgaaaggacacttcatgaagtgtgaaaatgccaagcatcagctaataaatctttgtgacaatttctgtttaaatgcaatttttaaataatgcaccaatttaaaacgtagaataaataacatagtgagaccagaaatcttatccaaaattgtattctgttatgaatacaattgaatactgctagatattacttactttatagcttaagaaatctccatgcattattttaatggctcaaaccaccctatcacatttttttaaactaaaacaatacagcagtcaaaggaaatagttgatctatgtttgatactatgcacatacttatttacatgaaagcatcaacatgagcgcatggccctgtgttgaaaatgccgaggcaacaaatactgtaagacaactaatacttgtttaaatttcagttctttttgttgattctttttactccccaaaacaacttgtttgttccgggaaacattgactatatagtctattagctgcatctctccctatcctctctctactctgcctccccttttttgtcttcttctcaacttgcttctcctgttcatttttgccttattctttcaccatttctttcctcctccttcctcacattttctcctcttttcccttctcttcttcctccattatcaagtagtaatggtaccatttctcatacttacaagtgccaatgatggttctactcatcattcaccagacactttccatgtgctggacactgtgcttagctttttactatatgagtgattacagttggcagtgctcggaattcaatgggaagttcaatttaattggcatgtggtttgattaaaattatgctctgacagttttaaaattagattaaaatagactaattaatttagattaatcaagataaattttaaaactctaaaattatgtgtatacacttttaataaaatatatagcttcttaatgtatactttgtccctaggttgatttaaacatggagcaaaatataatgcttcaggtgtaaatatttaagacagttcaaaatgaaataacactaaaatgaaattaaattgctcataaatttattatataagattgttattctttaaaatatcctggctgtattctttcttttgcattaggacaccagccaaaaaccatatggcacataacatcagtaaatgttatcatataacaataatatttaagggtgcctgaaaatggtcctcttggagaaaattagttaataatataagcagatgcaaaattgcctctaggtaggcatatatttttatcagcaaaatatttgatgattggcttccaaggataaattcactataattaacttctgtattaaaattgtttacaagagattggtaacattagacaactcaaactgggttgttctctgtaagaataaatggaagtcacaagatttgccttaagcacctctttcaaaaagaataaaaatacagaaaaccatttgtactgtaattgcaggaatcaaactagttttactttatagattcacaatgaagtaaaatgtataaaatcatttacattttaaataccaaggatcaaggtccctagcccagttgaagaaggtagagtaaacatagttgaggctttgggtgaagtataataaaaaataaacctatgttagagagcttatcagaatctttgaacagaaagttgtatatattatatatatatttctcccctggggcttacagtgtcctggagagtagtatatcatacaaatagccagtgaccagaccatgaagaaccaaatgaataatgctaaagtatttcaaacatatgttgaatttataagggaccaatgaaacatgatctgattttattttagaaaggtgagtttagctgcagtatggagcatatattaagtgatacaaaactggaagagagaacacagttaaatggttactgcagtgattccggaggaaaaaatatgaagggctatactaaacactggtagataaaacagagaggaaggaacagctctaaaagttatttaggaaaaagaattatttgaacttataaccagaaaaatgtgagaagctaagtatccaggatgacccctagggtctataacgggagattctttgatagcagtgcctttcactggtacaaggaatctgcacgaagaaaaaattagaagatgacgaagtttgtttattctatgctgatattatgacatatctaagtgggtatgcctagtaggcaaactgacatatgggatgggcattgttaaaaagaagttgtatagattttagtaataaaatgagtgtaaggagagaggtgatctttcataattttggttcaccaagtttcagctttctactattattcatagttctaattcaagtcaattattcttaagtgactggcatcacgaatattttggtaatattctgaaaataattatttaaaattaatggtcgtgaagggaaattggtataatagacaaatcagataaggtaaagttagtgtacatacagctggtaatattcattttcccttgctagtaagccagtatgaacctgaaataacatagtatgtttactaatctagccaatatttttaaatataaatccaatactgggagcactggtgaaaaactggtacacacattttatttctagtgacatttttgcttgttaacaatattttgggacacaatttaacaaatatttagaatgagccatgaagatattcttaaaatactatttgattaattctattcttacaatttaacttaaggaataactgaaagtaaaaatagagatatgcaaaaaatgtttaatgtggttcaaaaattagtctaaatatcttcaagatttatcaaataacataacaacagcaaaatgcaatggtacataaccattacagattcacatgtaaagaaaggagagtgaaattaaaagaatttctatgagacattgaatcttacaaatttttccttttttctctgaaaattgtatttcaattgaattttgttttatatttggggaccaattacacttttttttactctaaataatatatacatataaaatcataacatttttatttattatggattcctgggttcttttgcaggtttgttacatgggtatattgtgtaatgctagtgtttgggtttcaagggaacccatcacccaaatagtgaagagagtatccaataggtggtttatcaaccctcaactccctctcataacctcccctcttttgaagtccccaatgtctattatttccatctttatatccatgtgtaccccttatttccaattcccacttataagtgagaacatatggtgtttgattttctgtttctgagttacttcacttaggataatggcctccagctctatccatgttgctgtgaagaacataatttcattcttctatatggctctgtagaattccatggtttatagacaccacattttcttacccaattcttgtttgataaacactaaggttggtttcatgactttactattgtgaatagtgctgcagtaaacataagagtgcaagtgtctttttgatgaaaagatcttcctttgagtaaatacccagtagtggggttgaaaggtagttctatttttagttctttgagaaatcttctaccattttccgtaggagttgaactaatttacattgtccatgaacagtatataagtattcccttttctccatatgtataccaacatttgttatttttcaactttttaataaaagccattctgactggtttgagatggtatctcatttgcatttctctgatgattagtgatgttgaaggttttttcatatgtttgttggcaacttgtatgttttctttagagaagtgtctgatgacctttgcccactttttgatggagttatttattttttcttgttgattgtttaaggtccttataaattttgaatcttagtcctttatcagaatcatagtatgcaaatattttctcccattctgtaggatgtatgtttactctgtttatagtttcttttgctgtgcatagctctttagtttaagtaagtcccatttgtctacttttctttttgttccatttgcttttgagttctttatcataaattatttacttaggtgaatacacagaagagtttttcctagattttcttctaggattcttatagtttgaggccttacttttaaatctttaatccatcttttttttttttttttttttttttttttttgagacagagtcttgctcttgtcgcccaggctggagtgtaatagcacgatctcagctcactgcaaactctaagtttccaagcaactctcctgcctcagcctcctgagtagctgggattgcaggtgcctgacaccatgcctggctaatttttttttttttttgtatttttagtagagacggggtttcactatgttggccaggttggtcttgaactcttgacctcaggtgattcccccgccttggcctcccaaagtggtggaattacaggtgtgagccaccatccctggccttaaatctttaatctgtcttgagttaatttttgtagtatgttgagaagtaagggtccagtttaattcttctgtatatagctagctagttctctcagcaccatttattgaataaggagtactttccccattgtttatttttgtatacttggttgaagattagttcattgtagatgtgtggcttttttctgggttctctattctgttccactgctctatgtgtctgtttatgtattggtaccatactgtcttggttattagagccttttgtatggtttgaagttggataatgtactgtctctggttttgtttttaatgcttatgattgctttgggtatttaggcattttttggttccatgttatttttagcattgatttttctaattctgtataaaatgacattggtcatttgataggaatttatttgaatctgtagatttttttgggatgtgtagtcattttaacaacattggtttgttctatctatgagcatatcatgtttctctatttctttgtgtcattgatgatttctttcaccagtgtattgtagttcttgttgtagagatgcttcaccttcttggttaaatgaaatatatttttaggtattttattttattttttgtggcaattgtaaatggaagtgaattctttatttggttgtcagcttgaatattgttgatgtatagaaatacaattgattttgggtacattaatttatgtcctgcaactttatttaattcattgatcaggtctaggcattttttggaggaatctttagggctttctatgtataaaatcatttaatcacaaagagagatagtttgacttcctctcttttatttacatgccttttctttgttttgcttgcctgattgctctggcaaggacttccagtattatgctgtataagagtggtgagagtggatattcttgtcttgttctaggtcttagaaagaattctttcaacttttaccattcagtatcatgttggttgtgggtttgtgatatatggatcttattattttgagatatgtttatttgatgcctagattgttgagggtttttatcatgaaaggatgttggattttatgtaaaactttttctgcctctactgagataatgatagggttttttaaaaattttgtttatgtgataaatcacgatgattgatttgcatatgttgaaccattgtttcatcctagtaacaaaattcacttgattgttatggattatcttttgatgtgctgtttgatttggtttgctagcattgtactgaggatttttgcatctgtgttcatcagggatgttgacttatagttttctttttctgttgtgtccttgccaggttttcgtatcaaggtgatactcgtttcctagaatgaattaggaagcattcccccctccttgtttgtttttaataatttcagtaagattggtaccagatcttctttgcagatcttctttgcctatctgatagaattctgctgtgaaaccctctggtcccagagtttttttttttttttttgtagatatttttattactgattcaattttggaactcattattggtaggctcagagtttcagtttcttcctggttcaatttttagaggtggtgcagttccaggaatttatccattacctttgggttttctagattgtctgcgtagagatgttcttagcagtctctgagaacgtattgtatttctgtggtatcagttgtaatgtcacttttgtcatttctgatgatgcttactgaaatctatttttcttggttaatgtagctagtggtctatcaattttgtttatccttttaaagaatcaacattttatttcgtttgaaatttagtaatataaactttcctcttaacactgctttttctgtgtcacagaagtgtttgtatgttgtgtctctattttcatttgtttcaactttttaaatttctgctttagttatttgcgcaaaagtcattcaggagcaagttgggtttttattttgtttgttgtttttttcattttcttgtgtagttctagtattgatttctaattttattgcactgtggtctgagaagttgcttgatatgactttgatttctttgaatgtgttgagaatctctttatgatcaagaatgtggtcaattttagagaatgttccatgagcagataagaaaaatgtatattctgcaatttttgggttgagtgttctgtagatttttttaggtcatttggtcaagtctaatttaagttcagagtttctttgttagttttctgcttggattattggtttagtgctgttggtggggtgttgcagttccccactactattggatgactgtctatctcttggtctagtagtatttgttctataaatctgtgtgctttgatgttacatgtgtgtatatttaggatagttaaatcttcttaaattgaatcatttagcatcacataatgctctaatttgactttttttaaaaaaactgttgtttatttaaagcctgttttatctgatactaaaatagcaacccctgctctttcttgtttttcatttgcatgatacatctttctttatctttttactttgagcctagggctgtcattttgcatgagatatgtctcttgaacgcagtagatggttgggtctctctttttttttaatccgattttccatttttgtcttttaagtggagtatttaggctgtttaccttcaaggttaatattgatatgtgaggttttgttcccatcatagtattgttagctagttgctttgtagtctcaattgtataattgctttacaggatctgtgaattttgtacttatgggtgcttttatggtagcaagtattgtcctttcatttccatgtttagaattcctttgaacatttattatagggccattctagaaatctcttagcatttgtttgtctatgaaagacatcgttattcatttgattatgaagcttcattttgaaggatataaattcttggctggcatgtttttttctttaagagggtaaaaataggcccccaatctcttctagctgataaggtttttgttgagaagtcagctgttagtctaatgggattttctttatgggtaacttgtcccttttctcaagctgcccttaagatttttttctcccccttcatgttgaccttggataatctcatgactatgtgctttggtgatggtcatcttgtgtagtatcttacaggtggtctctgattttctttcttgtatttggatgtcaacctctctagaaaggttagggaaattttcctaaattatttcttccagtgttttccaggttgtctttttcttcttcctcatgaatgccaatatgtcataggtttggttgtttttcataatccgatatttcttaaagactttcttcattttttaaagttcttttggctttatttttgtctgagttaattcaaaaactggcttccaatatctaaaattctttcttctgcttgatctaggctattgttaaagctttcaattgtattttgaaattcctttcatgaatttttcaatactataagttctattttttttattttgttttgttttgttttagtatagttatgtcatgttttatatcttgcattttttttctggtttctttgtgctgaattttaactttctcttggatcacactgaatttcctggaaatacatattttgaattattcatatgtcattttagatttttaattttggttaggatccattgctagatagctagtatgatcctttggaagatatcaagatactctggctttttgtactgctcaagttgtgctgattccttctcatctaagggagatgtacctttttatttttgtttttgctatcatttggatggaagatttttttttgtattcctttctcccttgaatgcttgaatgtgtgattgtgttgtatgttttctatgatattttggctttatttctgggtgctttgaggggcccagtgctctgtttgggttccttatttggggctagcttctggctttttcagatgctgcttgttgtagtgatgtgttagacatatgcctcctgcaaggcttagggtgaggaggaaggactcaggaagcttattttatggactagcagtgagcccttctggcagcaggtttttaatttggttgtacagttcaggatccagtccagtagatggtgattaagagtaacatctgtcttgccctcaagtaggttgatgatgagtggaagcacctgccctgaccaagtgggatatggcaggcagagatcctgttgggtgtattgagatctcaggggaggggacaaggggatggtgcactagctccttgtcctaagcaggcagggacatgatccacttccctatcatgcccctctcacagggcacatgttcatttatatagactttaaccttttgttcctgaatgcagcacagctgcagctggcaggtacaccctttggctgctaccaccgcacattgaccattctctaaaattgactacattcttgatcataaacagtgtctcaataaattcaaagaaatcaaaatcatattgatatggtttggctgtgtccctctccaaatctcaacttgaattgtatctcccagaattcccatgtgttgttggagggacccaggaggaggtcatcaaaacatggtgaccagcctttcccatgctattctcgtggtagtgaataagtttcacaagatctgatgggtttatcaggggcttccacttttgcatcttcttcattttctcttgccaccactatgtaaggagtgcctttcacctcctgccatgattctgaggcctcctcagccgtctggatctgtaagtccaattgaacctctttttcttcccagtctcgggtatgtctttatcagcagcatgaaaacagactaatatacatatcaagcaacttctcagaccacagtgcaataaaattagaaatcaataccaaaaccaccaagtaaatggaaagtaaacaccttcctccactcaaggcacatggctactgccagagctttcaggcaccacaatatgattagactgtcatggttcattgattttcagggaacagatctacttcaatacaaaaattagccagatgcattggcaggtgcctgtaatcccagctactcaggagactgaggcaggataatcacttgaacccaggggtggaggtttcagtgagctaagatcacaccactgcactccagcctgggtgacagagtgatactctgtctcaaaaaaaaaaaaaaataggtaagacaggtaaacatagtaaccaacctgaaagtagtaaacatagacatacatgaatttttaccttttatagttaaaattttactattgatttttaaattcctaataatttatttaaatgaaaaattaataattttttttgacaggaaacaaaactgtacatgaagttggcaacttatgattctaacaccatttactgagatctttttatatgtttatttcttttgaattggttttgtttctttgactcttggtcttggttttatcttttccttgactggttctcttttgactgtaattgtcagaaggacaatttgatttatcttaaactaaacggaaatttatcaaaagaccatggggatgactcatcaaacaggactgagagccagtgccaataccaactgtaattaacaacacaattgatactttcactctctgcactcatttgtgctgttctttaattttgtcttctttgcttcctgttttctttctttttctttgtagaagcaaacctctgctatttctctgttctacttgagcataaacttaaccattgtttgctctcaagcttttttacttttgacttaagtaccacaaaaatattaacttattttctttttattccttataccataattgccagaaaggtttcctattctagcttggaaagaggatctgttccctaaaaatcaatgaatcatgacagtgtgatcatattataatgcctgaatgctctggcattagccatgtgtcatgagtggaggaaggtaaagttcccgggaaagtatgtatgtgtgacgggagcaataagggggggcctggtcagaaaagtagcatgtttgcaaccatctgaaacaacgaatgcattcatgtaaagattccttgtgttcttagcccagatactagcagtatttatagctttcatcagctaaaccctgttatatgatgtgtatcactacatacctgcttggatgtttcacagttatctcacttttcattatgctcagtatctcccattcacccttattttcagttcatcctgcttcttcttcgcccattcatcccatctccaattgaacctgcttctcctgaagtgtttctcatatcaggaatatcaccatcaaccagcctcccatttgctcagaacagaaacttgggagttgttctttactgttcccttttgctaaacctaccaattacaattaattattcacttttaaatctaactcttattttgagtctggaaaatagataggactctatcccttttgcaaaaagcatttcctctagacaattgcattatcctctaaatttcctttctccgatatcatccctacctctaatttcttctgcatacaacagacagaatgatgttggttaaatacaattgaattgtgctagaaacacttctatgatttcccactgatctaaacataaaattgagcattttgtagagcctacaattgtgccaatattctccttgctcactacgttctagtcacaccacacacacacacacacacacacacatatattagtttcttaagaaaaaatgcatatactcctcccccacgcctcttgaactttatccagtttttctttctgaaacaatcccttgcttactgcctggctgtgtccttgtcctataaccttaaatgtcatttcttcactaaggcccaccatgagtgtcaaatagaaatggcatctttatgttattctttctcctaacttccctttatatcacttaccaaaatttgtcgttttttacctggtaaaacatttgcttattggaagtctatctctccttcgaagtagaagcagtgaaatagcgagaacaatgaccctttgcttacaactctctatgtcatgagagcattgtgtgctgctctctatacatcccactcctttgctcggggcctgcgcctcttctgctagctgtatagtggagttgtgtcctactcaggagttggactctaaaagggctcactgtgaacatttagccaaaatgtcgcataactagttttgtttataaatataaatatgcaaaataatacaatgtatatttaaatatacaattttattttagttctaattacacagagagaaaaagtgagcacagtttaatttgcataattaaatgtgctattactgatggctgaattaataaattacagatactcattaaatatttgttggaatcaattaagtccagctttaaatgtctttgctaccatttctatttgaaagatgaataaacagacatctaaagcaactgagtaattcctctagtcacgtgtaatctctttaggttttctgtcttcttatattttgctattcagataatacatatacggatttgactttatttttaatttttgctcatgactatgctgaaggaaacttgaaggataatgaatttcatggcactcagaatttcttgagtttgtcagtgaagtttggtctgtgtatacagtttgtctggtgaagtttgattcatgacatcaattgttttctagctgatcgtcaacctgtaataccatgctgactctgcaagtgtctagtgatcttattcttgtctcccttatgcttgtgtttctggaatgctgtcatcagcatattactgttaatgaatgactgtcttggagacttttgtgtcacttcacggtttactataagaatttttatacacattgaaattaaatcaataccataaaataaaatgctcacaatctcctaaaaaaccgaatattttctttaaaataggaatcttatttttaaaccatagtgattaagtgggcagggtattatatcctgatcttcctcaataaaaatatcaagcaagttaaagctggaaaaatctttatcatatattcaagatctcagtctcaatactgttggcaggtttctgtttctagtgatgcaagggttctggttttttttaatgagaataattttcaaggttgaattaaggacttatggttgttgtattagtcagtgccattttaactctcctaaatcttcgcaatgcctatattcaaaccctattactccaaattcattgtgtgtgtgaatgtatttgtatgtgtgcgtgtgcacatcttgaggcttaaaggggggcaataaattgcaaaatagaaaattcagacaaattgaactataatgcaatgctatcctaacttgtattggaatgcagccatataagcttctagtacattcttctctgaactgaagtgacctactggagttgctgacataaagggaaaattgcagacctttaccacagggcaagagcctataaacttatgcctagacaagttgaaacttcatcctgtagacagatcatgtcaataagaagcagagtatgtttctttatcccaaggtcacctaccagtttatagatgaataaaagtgagagagatgtagagcagaaattccctaatgcaaatatgggccaagggaatggagagcccctgacaaatagaatgtatctgtttacaccaggatgctgctagtgagggaatgtttgggacttgatgtgttgaaaaattcttctggacctatttcctgtagaagatatgtctgtattcatcattttttggatgatgattcaaaaaatcgtcatcctttggatgaatcacctcattaattttcattaattttcatcattaattggatgaatcacctcattaatctttcactcacaatgtaaaattcaggcaatagtgaaaatggagtatataagattcttttttaataaaagaaattctaatctgcgtatgaaagtaaacatttgtcatgtgatgttacagtatcaatttctcagacgtatatttgatttttacccgttgtttaatatcctcacttttctctttgtactgtttttttttcttactttcttttgtcttatcataaagtatctttgcagaccagaattactggaataaacccttagttcagatttcatttccaatctttccctacttaaatttatatatgatacaaatgccagaaattttgctggacttgtcatgtcatcaatattaacttccaatagcaaatgtgtctgcaaatgtcaagttcaaaagctgatctctgatgccactccagccttatgcatattctctcatccacccaattcttcattttttaaaaacaatagagtatctagagtgtgcctaaaagtatataaggaagtgtggagtcaatatggtactaaataaacatggtccctgctctaaggaacttaaatactagtgcagaaggcagaccaaacataggcaaaccacaaataaaagaaataattgtcagtcaaaatgacatttagcaaaaaagatattaagacagagaatcacttggagataagaatctactttaaaaagaatatctgtaaggcagtggcacctaatatgcagaagattccagatgaaggaatagtaggttaaaacttcctcaagtggtgaagatcttgatccattcaagaaactgaaagaaaatgagtgtgaggagagtcatgtttgcaagtgaaagagttgtgttaatatgagatgaaggtgataaaatagataaggtgatataaggcaggggctggctgtacatcatggtaaaaagtttaatttttattatataaaccagaatgctgcaataacagtataaaacaagaagcaaatggtagtcatgtgtgtaatttagtatgctaaatatgttatacttaaattaatatatccaaaatcgtatgattttaagatgcaataaatatatagttattcatgaaatattttgtgagtgaaacttttttgtactgattcttttaaaatccattgtgtatttgacacaaacatctcagtttacagcagctgcatttcaggtgctcatttgtcacctgtgcctcatgactactctattggaatggaaaactgttagtgtgttcaagaaggagactgatgtgatccaaattacattttcatgttactctgctattatttacagaaactatgtagtggagaaggtatggatgaagacaggaaaatgagttaggaggctgtattagtttcctgtggcttccgtaacaaagtaccacaaactggctgacttaaaacaattgaaatttattttctcagaagtctttcttgagaccataaatctgaaatcaagatgtgggcagagccatatttcctctgagggctctagaaaaggagtcttcttgacctcttttagcttcaaatggttgctggcaatttttgaagttgcttggcttgtagatggatctacactttctagtttctacctctgtcttcacatgaccctctcttctgtgtgtctgtgtagctgtgtccaaatgtccctcttcttataaagaacacttgtcttatttgatttgtggccaatccttatcaagtataatctctttttaatgtgattatatctgcaaaggccctatttccaagtaaagtcacattcacgggctccaagtagacatgaattttggaggtacacagttccagacagtgcagaggccattggaataaaaggtggtggtggcttgtacacacccagcacacatctatacttcactcccctctgcaccctaggtagtaggctggggtggaggcagtagatataaaaagaagtgattgtgaaatacattttagagatgtaattaactgatgtcttgaatgtggaggggcagagccaaagcaatttggatgatatttccaatcagagtttctatcatgcctttcctgatcagtcactaaatgcccactgtttttatcctggaaatttgtgtttctagcttctaaaggatctaactcaaagccatctcttttatgtccctctttacgaggcctttcttaattagctttaccttattggtaagagtattaaactagaagaaatggattagcctgtcttaagtactaaagaaatcaaatatatatttgtataatccattattagtgaaactttgccagtgtttaaatatactgcaatgtactctttgaaaaaatctagaaactggaaattttagaattgaaatagaaatcataattcaactcacattgtattagttcattttcacactgctataaagaactacctgagactgggtaatttgtaaagaatagaggtttaattgactcacagtaccacaggccctaacaggaagcatgactgggagtcctcaggaaacttatgctcatgatggaaggagaaggggaagtaagcaccttcttcacatggtggcaggaaagacagagagagagaaagagagagcaaagtgggaagggccatccttttaaacaaccacatctcgtgagaactcactatcaagggaacagcaagggggaaatctgcctccatgatttaatcatctcccaccagggccctcccctgatacaaagagattgtaattcacatgggatttgtgtggggacacagaatcaaaccatattactcattaaaaacaaaaagcaaaacaaaactacatatcctttacatctagaatatgacgcacagttatctgggtacaagtattcctaatgatttcaatctctaaatatactaagttttccaattcatattttttatcagtctgtctcattcataaatgaaatcacccaagttcttaaatctagtcatatttttagtttgtacaatctcttataggtgttcaattccataaatataaagtatactgtttaattttgtaagccctattatttcttgtaaaaatcacctgcaatctgctctcagagtggtcacagtgaaggatgtcaggcagttttctagttcaggtagcataaggctgaataaaaataaatatgttatccagatgttgtattattgatttactgacattccttcatttctgtttgtgtttagagtcttgacccattttttaaacatacaaacctgaaataagtttcctatccctttgtccttttctgcaattttttaaaacctcacattgcttttcctgaggtatggggacccaaaaactgaaagcatctcattaacaggccaactattaacacttgtgggtcccaggccaagaatatgaatgaaggctcacagaatgtaagtctaaatattgaagttataaataaagctttaaaaaccatggaataaaatatgttctaacctcttatcttggaaagtatactttgataattacttaaaaagcacattccaaatccagatttctttggacttcctggcattctctgcaggaacttagcaacgtggagagagccagcctgtgttcttatttaattccaatatccattgttaaatctgggtaatgattgcataagagttctttttataagtctccctttttttcaagttagcaattttctacaacaaaaaaattatattaataaagtttagtgtctccttgatagctcccgaaaattttgtgttccatgagaggaggttttatttgcttggctgtgtttcttgaagattctactgatgtcttcagtgatatgcatgcccccattaaaggtgggtgacaatgatcaatgtgatctgtataatgttgcattttcattcctgagctcatctttggccttggcatcattaagcaatccctatgattctctctgtgtctctcttgcttttgttttatttaaataatcttgggggcggttccaagatggccaaataggaacagcttcagtctacagctcccagtgtgagcgatgcagaagatggttaatttctgcatttccaactgaggtaccgggttcatctcactggggattgtcagagagtgggtgcaggacagtgggtgtagcgcaccaagcatgagctgaagcagggcgaggcatcgcctcacccaggaagctcaaggggtctgggaattccctttcctacccaagcaaaggggtgacagacggcacctggaaaatcgggtcactcccaacctaatactgcgcttttccgatggtcttagcaaacggcacaccaggagattatattccacgcctggctcagagggtcctacacccatagagcctcgctcattgctagcacagcagtctgagatcaaagtgcaaggcagcagcgaggctgggggaggggcgcccgccattgctgaagcttgagtaggtaaacaaagcagcctggaagctggaattgggtggagcccaccgcagctcaaggaggcctgcctgcctctgtagactccacctctggtggcagggcatagccgaacaaaaggcagcagaaacctctgcagacttaaatgtccctgtctgacagcttggaatacagtagtgtttcttccagcacggagcttgagatctgagaacggacagactgcctccccaagtggatccctgacctgcgagtagcctaactgggaggctaattatgtgtctgcccagtaggggcagactgacacctcacaagaactggtaccactctgagatgaaactttcagaggaacgatcaggcagcaacatttgctgttcaccaatattcgctattctgcagcctccactgctgataccaaggcaaacagggtctggagtggacctccagcaaactcaacagacctgcagctgagggtgctgactgttagaaggaaaactaacaaacagaaaggacatccacaccaaaaccccatctatacgtcaccatcatcaaagacaaaaggtatataaaaccacaaagatggggaaaaaacagagcagaaaaactgaaaattctaaaaatcagagcacttctcctcctccaaaggagtgcagccccttgccagcaatggaacaaagctggacggagaacgacattgacgagctgagagaagaaggcttcagaggatcaaacgtttccaagctaaaggaggaagttcgaacccatggcaaagaagttaaaaaccttgaaaaaagattagacgaatggctaactagaataaccagtgtagagaagtccttaaaggacctgatggagatgaaaaccatgtcacgagaactacgtgacgaatgcccaagcttcagtagctgattcgatcaactggaagaaagggtatcagtgatggaagatcaaatgaacgaaatgaagtgagaagagaaatttagagaaaaaggaatgaaaagaaacgaacaaagcctccaagaaatatgggactatgtgaaaagaccaaatctgcgtctgattggtgtacctgaaagtgacggggagaatggaaccaagttggaaaacactctgcaggatattatccaggagaacttccccaatctagcaaggcaggccaacaatcaaattcaggaaacacagagaacaccacaaagatactcctcgagaagagctactccaagacacgtagttgtcagaaccaaagttaaaatgaaggaaaaaatgttgatgttaagggcagccagagagaaaggtcaggttacccacaaagggaagcccatcagactaacagctgatctctcagcagacactctgcaagccagaagagagagggggccaatattcaacattcttaaagaaaagaattttcaactcagaatttcatatccagccaaaataagcttcataagtggaggagaaataaaatcctttacagacaagcaaatgctgagagattttgtcaccaccgggcctgccctacgagagctcctgaaagaagcactaaatatggaaaggaacagccaataccagccactgcaaaaagatgccaaaatgtaaagacaatcgaggctaggaagaaactgcatcaactaacaagaaaaataaccatctaacatcataatgacaggatcaaattcacacataacaatattaaccttaaatgtaaatgggctaaatgctccaactgaaagacacagcctggcaaattggataaagagtcaacaccaataagtatgctgtattcaggaaacccatctcacgtgcagagacacagataggcccaaaataaagggatggaggaagagctaccaagcaaatggaaaacaaaaaaaaaggcaagggttgcaatcctagtctctgataaaacagcctttaaaccaacaaaaatcaaaagagacaaagaaggccattacataatggtaaagggatcaattcaacaagaagaagtaattatcctaaatatgcatgcacccattacaggagcacccagattcataaagcaagtccttggagacctacaaagagacttagactcccacacaataataatgggaggctttaacaccccactgtcaacattagacagatcaacaagacagaaagttaacaagtatatccaggaattgaattcagctgtgcaccaagtggacctgatagacatctacagaactctccaccccaaatcaacagaatatacattattctcagccccacactgcacttattccaaaattgaccacatagttggaggtaaagcactcctcagcaaatgtaaaagaacagaaattatagcaaactatctctcaaaccacagtgcaatcaaactagaactcaggattaagaaaatcactcaaaaccgctcaactacatggaaactgaacaacctgctcctgaatgactgctcggtacataactaaatgaaggcagaaataaagatgttttttgaaaccaatgagaacaaagacacaacaaactagaatctctgggacacatttaaagcagtgcgttgagggaaatttatagcactaaatgcccacaagagaaagcaggaaagatctaaaactgacaccctaacatcacaattaaaagaactagagaagcaagagcaaacacattcaaagcgagcagaaggcaagaaataactaagatcagagcagaattgaaggaaatagagacacaaaaaacccttcaaaaaatcaatgaatccaggagctttttattgaaaaaaaaaaaaaacttttttgaaaagatcagcaaaattgatagaccactagcaatactaataaagaagaaaagagagaagattcaaatagatgcaataaaaaatgacaaaggggatatcacccccaatcccacagaaatacaaactaccatcagagaataccataaacacctcttcacagataaactagaaaatctagaagaaatggaaaaattccaggacacatacagcctcccaagactaaaccaggaagaaggtgaatctctgaatagaccaataacaggctctgaaattgaggcaataattaatagcatactaaccaaaaaaagtcctggaccagacggattcacagctgaattctaccagaggtacaaggaggagctggtaccattccttctgaaactattccaatcaatagaaaaagagggaatcctccctaactcatttcgtgaggccagcatcatcctgataccaaagcctggcagagacacaacagaaaaagagaatattagaccaatatccatgatgaacattgatgcaaaaatcctcaataaaatactggcaatctgaatccagcaacacatcaaaaagcttatccaccatgatcaagtaggcttcatccctgggatgtgaggcggttcagcatacgcaaaccaataaacgtaacccagcatataaacagaaccaaagacaaaaaccacatgattatctcaatagatgcagaaaaggcctttgacaaaattcaacaacacttcatgctaacaactctcaataagttaggtattgatgggatgtatctcaaaataataagagctatctatgacaaactcacagccaatatcatactgaatgggcaaaaactggaagcattccctttgaaaactggcacaagacagggatgccctctctcaccactcctattcaacatagtgttggaagttctggccaggtcaatcaggcaggagaaagaaataaagggtattcaattaggaaaggaggaagtcatcttgccctgtttgcagatgacatgattgtatatctagaaaaccccattgtctcagcccaaaatctccttaagctgataagcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccaacttacaaggggtgtgaaggacctcttcaaggagaacttcaaaccactgctcaatgaaataaaagaggacacaaacaaatggaagaacattccatgctcatggataggaagaatcaatatcatgaaaatggccatactacccaaggtaatttatagattcaatgccatccccatcaagctaccaatgactttcctcacagaattggaaaaaactactttaaagttcatatggaaccaaaaaagagcccgcattgccaagtcaatcctaaaccaaaagaacaaagctggaggcatcgcgctacctgacttaaactatactacaaggctacagtaaccaaagcagcatggtactggtaccaaaacagagatatagaccaatggaacagaacagagccctcagatataatgccacatatctacaactatctgatctttgacaaacctgacaaaaacaagaaatggggaaaggattccctatttaacaaatggtgctgggaaaactggctcgccatatggagaaagctgaaactggatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacactgaaagcaatggcaacaaaagcaaaattaagaaatgggatctaattaaactaaagagcttctgcatagcaaaagcaaataccatcagagtgaacaggcaacctacaaaatgggagaaaatttttgcaatctactcatctgacaaagggctattatccagaatctacaaagaactcaaacaaatttacaagaaaaaaatgaacaaccccatcaaaaagtgggcaaaggatatgaacagacacttctcaaaagaagacgtctatacagttaagagacacatgaaaaaaatgctcatcatcactggccatcatagaaatgcaaatcaaaaccacaatgagataccatctcacaccagttagaatggtgatcattaaaaagtcaggaaacaatgggtgctggagaggatgtggagaaataagaacacttttacactgttggtgggactgtaaactagttcaaccattgtggaagtctgtgtggcaattcctcagggatctagaactagaaataccatttgacccagccatcccattactgggtatatacccaaaggattataaatcatgctgctataaagacacatgcacagatatgtttattgcggcactgttcacagcagcaaagacttggaaccaagccaaatgtccaacaatgatggactggattaagaaaatgtggcacatatacaccatggaatactatgcagccataaaaatgatgagttcatatcctttgtagggacatggatgaagctggaaaccatcattctcagcaaactattgcaaggacaaaaaaacaaacaccgcatgttctcactcataggtgggaattgaacaatgagaacacttggacccaggaaggggacatcacacactggggccattgtggggtagaaggaggggggagggatagcattaggagatatacctaatgttaaatgaccagttaatgggtgcagcacaccaacgtggcacatgtatacatatgtaacaaacctgcactttgtgcacatgtaccctagaacttaaagtataattttttaaaaaagatcaaaaaaattacatcaggattttattttagtgattaaagaaaataaacacctaaaaaaaatcttttattattgacattgaagtcccttacaagatgatggtcaaattctctttgtcccacctaatttctagtttaaacttgtctcagaaggctgtgaattttctcatgttgaattatattacttttcaatttgaaaagttagcttttcccctcttttacagtgtcagtttttctagaatatttctctttccataagctttacctttagattcatgacttaggatctaaatttaggattatactattttaagcagactttgtgtttcttttacattaaaaaaatctttttctagcttttacctatcttttgccaaactttcttttgcaaattttggatagcaaccaaatgttttctgtttccttcagcctcaaggtacatattcagtaagtatgtaatcactattatatactagtgtctgttaattgtattaactaacatactagtgtctgttaattgtattaattaatgtgtgtacatttctttttattatagattctaaagcaaactactacacgtaggccatcatgttccaagtttttgaaagttcatctttttcatcttgttgataaatttcatcaacttttatgtaggtaattcaaatagaaatttgggataaattggactgattttttgggattattgagtatttttatttcagctcgttttacagcactgaaagctggagtaaaagacattagatatccctagtcacttgagacttcattttaaaagccagttgtactggctttgccatggctttgtcttggttttgatttctaccacatttcctcctcttcagtgcttcctcagcggcgtgtacttgagtatgcgcacgtgcaaatgaaaaaaacatggatatatttgtagtacctattatgtctttcatgctcattcaagagagatatatatatatatattagtaataaaactaaattttaaaagcctaaaaattaggacccagcctttttatatagacaagatatgtcatggagtcagattctatgaatatccagtgtgtaaaatacacacacacacacacaaacacacacacacggagttcacatatcaaatgaatgattttaacagtttaaatagaatatatttttagattgcttgaactgataatatcattgctatcaaaaggatttcatgccttttcaacatttagtttttgtttgtttgacatcttccaattttgtgtttaactctatgttgactttatcattttattccaaacttacgctccaaaatgcattgctgatgatatttatattagtaggcattctgtggaattgtgcttttacaggaaatacattggtaaatcttaagtaatcttaaattgtttccacagtaaaaaaaaaaaaaaaaaaaaaaaaggacttagtatgaatctgcaagaaaatatagacaaggtggacaccaaaaatagttttatttccatctgtaattactagctatgcagcaagtataaaaatatatatttgatatgtttccttgaatatgtgatgtggaggcagcaacactatttgtaagctttttaaaagagttatagtatctttgcagagatactgtactagggtctagagaccaataaaaaaggttttcatctgggctgctccacttactatcttgtgtgatatttaccaactgatattaacaaagtatcagtttgctgttttttataaaaggaacaaaaacacagcttttgtatgttctggagaggattcatatagatatatattacttgatacagtgcctggcatataacctacattctactaatggcatctattattagtagtaataattaaagtggtaatgcttacagaaggaaagggaatgtgagtacagttaagtacccttaataaatttatatattttattaggttcatatatatttatttgtgttactgacttttattatacaaatgttattgattacttttaatctcagatgaaataacttggaaacttagagaagaaaaatatttttattcatatagcaatattatataactcaaaacctccacatattcaggactcagattacatggaaatttaacaatcaatgtaaatcacaaaatctgtcactttcatctcattttagttttacttttttacataatatgctagccttttttgctttttctaagcacacatgttttattaatcataaatgtgaaaaaataagcggtgtattttgtcattgcttggaaaggaaacttaaagacaattaggtattttgtcaggggcatagatttatttataaaatttatctactacaaattgagttgttttaattcttcactatccttctgagagagattagaagaaggaatgacaatgtctgcttacatgggagaatactgaaagaaggccaccttaaatcacatggtgtaaattcattggtggtcaaagctcagcacacttccgcggtttgtcttctccatattgcttccttctgtatggatgcatacatatatatccatttttatgtacaatataaagtgaaggatgtatttaaataagttccatcctcattcagttaaaatattttatggtctttaattataaaatcatattttgaaaattgagctgactctcaaatcttttggcatagcattctatcctttctggcataaacttgagttaccactctaatctcattcctcacattgtccctttaattgactccctttaggcaattttgaagtagtagttgtttatgcatatctttgtcatagtctctctgacttctaaatatttgcaattactattgccttcttagattccatatcactcagttccacttcaaattggctaatagtaattcatttttctggtcttagctgggatgtcagtagcttctacattccaaattatttaactcttttgtacgtcccctctccaacataccatttccatacacacacacctcgggctctctccgtggtaactgtattttacctatagaatgcgaattgtcttatttttctgactcacagtggaagtgtcttcatagaaagggatatattttctttttttcccttagtgtcccctcccctctaagcaataaccataatatgcatttaataaaaagttataaaatacaaatatattcctatcatgaaggtgaaatttctgtatactgaaataaactgataataattttagtcaagactttaatcattatatcaaatcaatgtgaaactgaaaatacatgatgatactttgtttctatatctctgataaaatatatatatttatgaaattaatatagatagatttattgtataagaaatcaaaattatctgcaattctaccctctagtaatagctacttttgtggtacattttctgtttaattatctataaaactctttttgtacatattaaatttatcaatttataaatttccatctaccatttagaaatacaagagctccatcaagaatcatctcctgaaagctatgtattctttctttaatcttctaagtgtatgtgatagacatttgtcataaactttcatatgtttacggccttctattaagctaaaaatatttaattcttaattattgtacctaagtctataggaaacttagattttattctctacatctgaatatggcacacgtgcatacgtaataccataataaataattcaaacacatcatttgttgtgattaatgcctacaagagggagtaacaatgacatcccttgaaatgtctgtgttttatttaagttccaaagataactgttccttatttaaagtttttatttgtttgtttgttcttgttttggttagtatattggttaataaagttgtttggaattttatttatcattatttgaattttctaagtcttataactcagagcagtaatccagaagttaccaacaatttccaactcctatcctcaggatgaaagcccttgaaatagaaatgtgagctgtggcataatggaagcatttggcagctattttcccctgctctatacatgagtgcatagactctaattcatacaaaaaagtttatataattaccgatttgcaacaaaatttacttttcatgtacttatgattctaatctatctcaaaagtagataatcaaacttttgtaaataacctttcaatgatggacaatgttattgctcctttacctattactacctctccctgttcttttcttcatcccaatcaatatgtctagataaatacatttttttctcatttgaaatttagtttggaaaatgcagccacatttttacttatctttttcaaataattaaaaacttctacctcactcatgtaacatcttcctgcatgatctaatctgcatctaatttttctctgactagcagcactagatgttttgtgattagggaagtcagaagtgatgagactttaatagaacataaaatatttcttttctatatttcagtaagttaaactaaattatatttacctaaattatgtacgtactttgataaacatctcagataatcttgaaaataccaagcagcaatgaaggaaagtgtgagggaatagggagggaggggaaaaggagaagagggaaggggaaggaacaggaaaggaagggaggtgaggatggaagagttttgtgtaactggaattcttgagagtgaggttcttgataaccattgtcaatcctgggaaaggaagaattaaatcacagtcctttatcgtttgggtattatataactatcttattaaccattcaaaagaaaagaaaatgatagacattctgctttaaagcaagtggaaagcacagtctcatggaatcccatgaatttctttgaaaactgtctcaagttacttaaacttcctaaattgtattgtttttatttaacatgagtggtatttacagtacatatttgaagataaaatgtgatcaagtgagtacaacactctcagctgtgagaggcatttagtaaatacattacataataattaaactcaagatctcattttaagtgacacatttaggaatgagaagggaaggtcccagaaaaaagcacagtcagattagtttactcagaaatcgtagtttcgcatttgaaatatgaaatcccaacctagttcgtgtattacttcccttccctagttatcacagggtcggatttgtgtcagtctcttaaggtaaacattcctaaatgtgtagaggtttttggaaagaagaagcatgacaaaattaaaacaaactgaatagaatccattgggtcttttattaagaatattttttatttcaaatgtaagtgttctgaaactggatcagcaaaataatagcaactaagttatttaaaaagataacaggaaacaaagcatagacatttggtcttggatttaagcacattatgactctactgttgaactgtggttctgactcagtgacgcctacagtagaagaaaagatgcttaaggtgggacagttgtgacctaaaaattaaagctctaaatatttaagcttattttaagagcactaacacagcaaagcatatgcacagagaagaacatgaattatacactaatcaaattttaataagtggagaatattagtgtagaagtacacacctcaccaacaatgtgttgttgctgttttttcattttgcagggaaaagtccggcatttacagaaggcttttgcttcaagagtagataaatccacacagactgaactactatgctatgatgtaagtagctctgtaaaaccatttttaacttcattattggcattcagacctccacagcttattgacctctgcggctgctgtgtccatgcattgatttaacaggatttagcggtgcaccattcatcttttgctcttaaacaatccccaaatacctcctggaactaaaaaagatgattacaggcaccaactggcataccaatgccttattaatttttttacatcaacaattttggtacagtcttttgaattagtgtatttgcagacatgtagaagatatgcattagaagactagggcaatttattttttaagaaaatatttatttattaacagtttaataaagttactatgtttgtaatcaccaaaggtgaagcacatcatttttatatgcagacacttaaaggcaaaaacaactttgaagaaaaatttaaaataatgttttagctcttgggcttcagtgcaggcagcagaaagtaatttaattgaaagtatttttctgttagtgcgaaatacttgttgaactgtcaaaataggattgtaaaacatgttttaatacagtattacatctagtaacactggatgatttgggaaaacattgatataaatgctcatttttttcttaaacacagctaagaaatttgcattttgcctaagttcatgactttcaacttcctcttgatgaaaaaataaaggaattaatttgatcttgtagctaacatgtatgaggaccccctcttctatttaaaaacatttattcttatttttagcactttgctgataagtagaaataaaatagaaataattttaagttttatgatgatgaataatgataaattatatgtttatctgcatggtctcattatgttaaataacaaacttggatgctacttttgtgttgccgtgcaaattacattaatttaatataaaactacttttcttttaggaaataaaccaaagctttgaatcactgcacaaattgttttcaagtgtttatataccttattttcttaattaaaaacaacactaaaaaatatgaattaaaaattattcaattatgtttattttaaggtatatttactctagatatctaaattctagatctcaattttgtaactgaaatgcttctagcagtgttgtatgttacttaaattatgttgacatctatttttaaaaagaaataattttatggtccttaaagagtatttaccacaagtagttcaatattggtcttttgtgagggatttttttcctgtctaaaaacttggttttttgttgttgttgtttgtttgtttgttatttgagatggagtctcactctgttgcccaggctggagtgcactggcgcgatctcggctcactgcaacctccgcctcctgggttcaagtgattctcctgcctcaccatcccaggtaactgggattgcaagcacccgtcatcactgccggctactgtttgtatttgtagtagagacagggtttcatcatgttggtcaggttagtctcgaactccttacctcaaatgatccacgcgccttagcctccaaaagttctgggattacaggcgtgagccaccaccccctgcctaaaaattttttaatgaaaatatttatatgctagtccttaggatataaacccaatatgtgttttacaaataacaacctttgtatctataaatctgcaagacagagagtttgttcaatatgagtaataaaatcataattttcattaaatcttattctaatataacatcatacaacacagggactacaagttaaattagaatccacttacttcaagcccccaaatttttaaataagttaactgaatttcagaaaaatgaagtcacttttttactactacatgacgtttgttgggagtctagtcttttatttaaggtaatgtgcttggaaaagagaaaacaaatatacatttggattcaaattttcaattttatttaaagaaacaatgtttgggagacagaattctaactttttaaatgacaatataaatataaaatgtaagacttttatgtaataccatcaattttatgtgacactattagtgattgcttgtgagaattggttactgaggaatgaacgacacctctggggaaatgacttatctgtggatagttattctaacaccatagttaccagcagcctcttacgtatttgcctatccatgcctcataattttctaatttctatgatatttcttatatcaatgtcatttagttctctaagcatgaaaataaaaatgtaaaatgaagccatggtaattgttaatcctcattaaatcttcaatgttcctagcttgtttcgtatgttacagtgatagtttaatgcatcttactgtattgaattaaggttaaagaataatactttttttgacaatgagtccctaaagaatccccttcatatgagcaaattaaatttctaaaatatgcatgtaaaaacttatgaaagtaactagatgtaactgtaatactaaactttagggcatcttgcatgtgaaaaactggggatggaaatacttaaacaaatcaaaaataagtaaaacactttcagtatcataaactacataactggaaatatatgattcataaactgtacaatttctcccatgaccaggatatattttcaatatttatttgtaaatattttttaatattttatatgcaataataatcatttattcttcaatttatagtattttgttctgtttcaccctcaggaaatatagtttcaccttattttaactttcaaaaatattttataaacacatgtatctatttataacttgcaaattgtgtttattcaaaaacaagaaacatctcgtggaaatcttgtacattatggatgtttcttatactcttttgttttcttcttaaagctgccaacattagccacaaattgttctttacagattattatggatcatgttttattggtatgagtatcagaatatatgatactacatgtcatcattaatataatttccttgggaaaatagctgttgctacacattttgcttaagataagaaatagaattcccagaaaacattaattataataaaatctattaaaaattcactgccatgaataagtttaaagatttgtacaataaactacttttatcctgcaccagatttgtcaggagacatgaaactaatgttagtttacaatgtgctctgacttctaacgcacatggcaagacttaaaaaaaaaattcagagtgtctcagcacaggcctataaacaccatagtttttgtgatgagggagattgttaaataaatgatgaatgtgtcttaaataatcaatgccaatttaacctcttccacgttcctctgtctgcacaggcttagtttattgaaagatcaaagaataatttcttaggtgtcactgtgttattaaaacaggatagaagatgaatagatgtagttaagtagcattgctgcccatttcaagattacattgaggggtagggaagttttttatctaattacatcaaatgtataaacagatgtttcaatgtagtatatatgctgtctgtaaatattttatagcttgaactactacaaatagcattttgattacaatatttgagaatgcataatcaaaatattctaaagatcttatattctgacagtgagaaattcagatactttcattaatttgacatctttatggacagcttatgtcctgaagaagattgtttttgaaaatgtgacaggttgattgactttaagttcaagttttcttttcagataatgcctgaaattgacacagaatagtcagaggatttaaaaatttctctgagccacaaatgcactaaagttttaagtaaagcagtttcttccttcattagcatgtgttttacactaacatttaataagaagccatttttagtcttgaacttggcagtgttttctttaagacttctgatgttatcaggtatttcattaaatattaaattattattaattactgttagtttaaatatcattaggggtttcaatttggcttcttaaaatggactgaactgtggcatcacgtattttgtctcattcatgtatgaataaagcataaatcagtttgttaatggatgctcataccactgtttattttttcaaatattttaacacactttccaaatggtgggatttgctttataaatacagttttctacttacacatgaggaaaataatattatttgcattatggatgtacactttgaaaaacttttcaatgcaattatctgtgtatttcacaatctctggtacttttctcagatttaattttggtggtgctcctggcgcagtttgcagatagtcctaaaaaatatgaaaatagttcatcatgctgtattcatgttaggaataagaatgattagtttttactgtaattgttttattagatagagcagaagtgttttttgtgcttgtgctaatgtattatgtctgcctgtggattaagccctgttctaagaattgaataactatcaattaggctttctcatcatgctgctaatatactgtagtttattaaagtttctgttttgctcttatttattacttctatcttcttaaattcagtacttctcctgatcatgtatgaatgtgctctggcatttattagaaaaaagtgactcccccgcacatgcttcatgtatttatatttacttatctcaaatatttctgtttatttttacaaattaaaaaacatttagttttaaaaattgagttatatattccaggtttgcttatgggctataatttttcccattacattaaagataacttttagataagaacattgtttaaaaacatctatcatgtttaaaaacatgattatctgccacgggtgcttattaacatgtaatggagtcacatcttatccagtggtaatgttctaagggcatcacttttgaaaatttattcatgctttcattcaacaaatatgactaagtcccctctagcagccagctccattctaggtccttggaatatatcctttaaccaaacaaaaaatattcctgcatggagcttgcaactggtgagggcatacttaaaaatcaataagctaagtaaataagcaaattatataatgcatttgaaggtgctgaaagcaatgtgaaaaataaaaatagcacagagaaagaataattctaagtgtatagtgggagggtcaagactatgatcagaaattttaaatagggtgatctagggaggtctgagtttgagatttgagacttaaagaaggtgaggtgaaaatcgtgtttaatcaaaaattcctttgtgatgtgcttcttgaaaattccttgacgtcccttcagtcagtaagaactaagcactttgtcattgctggagccctagataagaatagcttcatttacacatcatgtagtataaaaattatattctagattataaaatctagattcaggctcagtacatcaagagactcacactagaggaatacggtctacctgagggaacagccgacgcaacttctatatcatattcatctagcataagcactgagaagaaatctgcgtaaaatcaaccacacagtattaattacatttgcttctcctctttctgtttgttgcttgcattcaccctaccctcttttttccctgaacactattcttcttccagagcagagttggatttatatgctttaaatgtataattagacctcattgtatatcagcgtatccgatttatcagaggtgtgctggtgaaactaaacaaatttagaaagcactcaatgattacttggtgaaaaaaaattaactaaaagccactaattttttataattctaaaaatttataacaaattaatatgcattgtttcattcacaaaacatacaggtatggatattgctatatactatattattttctatagtacttttttatatccaacaagtatttaaaaattactgcgttatgccttttagaatgaagtattaaactcaaatcagcatagacaactagtaatgtctaaacataagtgccaacatgcagttgtttttatagtgtggcactgaatgattctttttaaaatcttgaatctttgcttaggagccagatccccctggactgccaccaggtctttaattctgcagtgactacatagaattagtatcagtgaaccaaaagcccttttgttaagagaatgtgtggttgagatcgttatgaggaaaacagcaaggctagatgtcatctatgaaagttcttataattataaaaatattcattaagatgaaacagcacacgaggatggggagagaatgagttgttgctggtccaaggttataaagcttgagttgcagatgaaataaattttgagatctgctgtacagcagggtgactataattaatgataatgtattatgtatttcaaaataactaaatttcaaatgtctcactacaaaaaaagataagtaatgggatggttgatgtgttaatttgtttgatttaatcattccacattgtatacatatatcaatatcaaaatatcacattgtatgccataaatgtatacaatttgtcagttaaaaataatgttaacttaaaaaaattgaaaagagtacacacgcaggaggttttatatagtttaaaatagtaataatagatatcatatttgctgaaaattatgttgtggtagtgttgataaaagagaagaaaaatacatatttgttgaatggaaaatttctctctgtccacttctacttccaactcatagattgctacctttataggaaatctaaatttaatttcaaatttttctaatatttttcctagactgccttaggagtctcttagagtatctagtgtactaagtgagattatataataagaagtcctggctgggcagggtggctcacgcctgtaatcccagcactttgggaggctgaggcaggcggatcacgaggtcaggagatcgaggccatcctggctaacacggtgaaaccccatctctactaaaaatttaaaaaaaaaattagccaggcgtaggtggtgcacgcctgtagtcccagctacttgctactcagagactgaggcaggagaatggtgtaaaaccagggaggcgtagcttgcagtgagccgagatcgtgccactgcactccagcctgggagacagagagagactctgtctcaaaaaaaagaaaaaggaaaagaaaaaaaaagtccttacagaaagaatttttaccaccctttggaaggaaacaccaagtataagcttgaagtatctctcattatctgtttacaaagcatcaatcaattgcagctaattattataatctgtatgaagctaagttctatgacttagttcaggtacttgtttaaagtaaatttttgtggacttatattaatttatttctatcaaaaacattgctttcctttgatgtggtctacaatcaggaaaaatttgcaaaaggaaatttatccttattttatatatatatatatatatatatatatatacacatgacatatatatacatacatgatacatatatgtacatatatattgacatacacacataaatatccttgaaatatatatatatatatctttgacatatatttgaaatatatatattcttggaatatatattatatccttgaaatagatgtatctccttgaaatatgtcattgaaatatatatctgtacatacacaccaaaacatcgtctattaatacacacacacatgcacatatatacacacacacacacaaataagacataggtacaaaaagtttgcttttatttgatgtattattcctattatagaagttagaattagatgcattctttaatttttctgtgtatataataagaattactgggaatcatctcttacattaacacaatgtttaaaatgcttatttgaattttaatatgattaaattgaatttatataactattagctaggaatatttgctgtccattttattatacttggtacatattaatataaagatgatttctttttaaggtggtattcaaattaactctcagaaacactaattttttaatcgcagaaatcataaacccatataccttctaatgaaatagtgataacaattttttccgtaacatagaagatggtattttgtttttcacagtacactagctcatggcttttctgttttgtcatggtagagcttttgtttcactaggcaatcagatttcattaagttacctaatttttccctcagttttctcatgagatctgctattccctttgacaactctacttgtacttgatttagatgcacaaaaagggataatatgtaccaagagcattggtcctcagtgtggtctttgtccatcaaaatgtttttcagctacttgattaatgctttgggatttgagaatagctagcttctaccttttgccagtgaaataactgatattgatttgagaggaaaaaagtcattgaaatgtttacattaatagtgtttcaaaataaaactgtaaagggatttttaacttataaaaagccatagagagctaaagggaaaatattccataaatgtttggcttaataacaagccaacaaaagaacatggattttcagaatattatattagaaagtttcctaaaagaaagccacatgtatcattaaccttatgctctgtaaaataagaataccaggaaattttactcttttttcatgccacattgttaagatggtaattagaattttaaatttataaagttgatctattatagagaaaatttataccaaaaagaatgtaatttgcatttcagagtactgaaagcatcaaagttctatacataccagaattatttcaggtttgccattattttatgagttctctgtttataaatggctttatagatttgaatttaaactatcacattagaggacatttatttaaagtgtggtctaatatagagtaactttctgagagaaaagtacttaaacaggtttagcattttgttgtattggaaaagtataccctaaatatgaatgaattattcataagccaaagaaagtgctaatatagaatgaaaagtattatgtttttaagttttgggggttataagaaacacttagagcccagcgcggtgcctcacacctttaattgcagcactttggtggcccaggcgggcgaatcacccgaggtcaggagttcgagaccagcctggctaacatggtgaaatcccttctctactaaaattataaaaattagcctggcgttgttgcggacaactgtaattccagctactcaagaggctaaggcaggagaatcgcttgaacccgagaggcagaggttgcagtgagccgagattgtgccactgtactccaggctgggtgacagagcaagactccgtctccaaaaaaaaaaaaaaaaagaaacaatgttgttccgtctcaagaaaggaaggaaggaaagaaagaaggaaggagaaagaaggagaaagaaagaaagaaagaaagaaagaaagaaagaaagaaagaaagaaagaaagaaagaaagaaagaaagaaagagaaagaaagaaagaaagaaagaaagaaagaaagaaagaaagaaagaaagaaagaaagaaagagaaggaaggaacgaaggaaagaagaaaagaaagaaagaaaagaaaagaaagaaagaaacaatgttgttccaaaaatgttacctagaagtgtgtgtgtgtgtgtgtgtgtgtgtgtgtgtgtgtgtgtgtgtgtgtgtgattttattttatttttttttttgagacggagtctcgctctgtcgccgaggctggagtgcggaggcgcggtctcggctcactgcaatctccacctcccgggttcaccgcattctcctgcctcagcctcctgagtagctgggactacaggcgcccgccaccacgcccggctaattttttgtatttttagtagagacggggtttcaccgtgttagccaggatggtctcaatctcctgacctcatgatccgcccacctcggcctccccaagtgctgggattacaggcgtgagccaccgtgccaggatgaagtgttttttttttttaatttatgaaaaagatgctacagaccctaattgagtctgaaaagattaacttttctttgcaggagtatcagtaatatgacacaattatatgtcataaaagtacaaaactaaaaagaatttatgtaattcataaaaatgtaaaaaaatacttggtgtgagtgtattattttctatacttttggaagtttttttttttctccactttggttttagtatgttaaaataatcatataaatgctggattatgtataaatatattacaagtacatatacatgtcttcatatatgtttttgacatgtcaaatagatgaatattattttactgtaatgttaatgaatgcattttactattcataatttaaaggactgaatatcattcaatcacgtgaatattttaaacattttttacattttgttttaaattttctcctactaaataataacaatggcacatatcctttagaagagaattttgaaaactctaatataattaaagtcttatcctacacctagcaatggtatctctagaagtttaacctgaacatacactttcatatgtaccaaataatattttcataaggttttctttatgatcattttttgtaacagttaaagaagaaaaacaacacaaataacaataggaggctatttgataatggctcattatcaaatgagttacagtataaggacaaagacaaatgcaaaaaacatctaaaacttcaatcagaaacaaaattatattactatttttataataattgtgacgttatttgtgtgttataacatttaacaaccaaatctaatgtttctagcatccaagttatttcaggataagagaaaataaacataactatgaaaatacaagttaaaggaaagaacctgataatgttatattcaaatgtaaagtgtcaacatgaacttattatttgctaattgaagaatattttcttcttttgcccctgaaaaagtataaacctttcaagcttataggcttaactttcagtagtcaggaaacaggaagtaggtggataagttaaacaataccatgaatcaaaaatcagacaaaatccaaatgggcagtattctacaagacacctcatggtatccctaaaaaagaagatgctattaaaaattgggggactatctgctgggcatggtggctcatgcctgtaatcccagcactttgggaggccaaggcgggtggatcaggtgaggttgggagttcgagaccagcctgaccaacgtggagaaaccctgtctctactaataatacaaaattagctggacatggtggcacatgcctgtaatcccagcaactcaggagactgaggcaagagaatcgcttgaacccgggaggcagaggttgcagtgagcctagattgtgccattgcagtccagcctgggcaacaagagtgaaactccatcacacacacacacgcacacacacagacacacacaaaataggggactgtcttgattaaggaaactaaacagacataacgacatatgaaatgcatatatatatgtatatatgtgtgtgtgtatatatattatatatatatgatgaataactagagagagggagagaggaccaaaagcagctatggcaactcttaattactgaatctaggtgctatgatttcaatgttcattgcctccaactctcatgctgaaatttgattcccaattggagatggggtttaatgggagaatggggggtgtttggatcatgagagagatctttcattaatagattaatgcccaccctgggggtgagtgagttctcactctatgagttcctgagagagcagtcacctccctgctgtctctcctgcttcctctcgggtagtgagtgtcctgtctgcacgtaccggctccccttccatttttgccacaagtggaagtaggttgagactttcaccagatgcccaatcttacagcttgcataatcctgagccaaataaaccttttttaaaaataaataaactacccagtctcaggtgttagagcaatgcaaaatggactaagatatgaggtgaaggctacacaggtgttaatactacaagtctgtttttctgtatcttaaaagttttctcaataaagggaatggtttcccaacttaaaaatatgcaaaaatatttaaatggcattatagtaagatgtaatatatggccaggactaaattgggttgggaagtccagcagtaacatgtatttgagggacatctgaagaaatttgaacaaggattgctattagatgtaatgaaaacttatttacatgaacagtttagaggttactactggggaaaaaaaggcaagtaaagtgaaaaacacaatgtactatgtggttctctttttagttaaaaaaaataagtgcaaatgaatccagaaagcttggtatagtgatgatctctggtttgtaggaatgtaccattttatttccttatttttgtttatctctttttgtcactttttgcaatgaacatatgtatttttataataataaaatatactttcaaagtagaaatatattatttaaaaaagaaagctcatcactgctaacatgaatatgaaattatttgcgcaatgtatttactttctattcaaatctactttcttacaaaataaaataacttggaaaattttgtggaaacagaatttaatgacaattttgtttctaaaatgtaattattaaaaataaatgttaaatattgtagaatttttctttctaatttgacaatatattgaatgcattataccttaaagcccaagaagattaacctattttgtaactgattttcctagtttataatatccccagagtggtaaatcataaaaaagaatctttcaaattattattttcactacaatgtagtcacaggaagccatttgttctcattaggtgaactttactatttccttgcagttgtcttcatgttctacttgcttaaaatgacacagatggattaagttttttttgtccacttcacatcacaaatactaaagtattaaaacttttatggaaagagaaatgttagtatcatatattttcattacatgtgtgtctctgaacatattcaggctattatggtatttttcccttcattttactattttaaaattaaaaagtggatctgggttagactttcattaagtatatgaatgttgggaaccttaaaatacacagaaaaacagaattccagatttctaaaatgtataatataacatataaaatatattctctctgtctttcacattcactcaactagtatttgtgtaataaatactgaatggcaggcatcttcttaatgtttaattcttagtcttaaagattttgcagaccttttttaaagaaaatggttagtaataacgtatctgcatctgtgtgtaacatacagttatagtcctggtgttccttttattacctctattcatttataaagttatgtaaaagaaaaaaaaagagtaagagatattccagacactgagattgtagcagtgaacaccaagcatacacaaccagacaagtttttttgtcttcataaacctcatattctagtcaatgaagacaggcagtaaactaaaaaccaaagaagtaaaaaagagaatttcacaccgtattaagggcataaaggagataaacagaaagatgacattaagagaaaccacgtgaagggaaggagctactgtgtagaaaagagccatcagggaagatggttctgccaatgttgcatttgagctggaactcgagtgatgggtcactgttcacagaaccagaacaagcatggtgacagggaaaatcatactaccaagaacattcaactctcaatcctgctgagtgcttcaggatttcctcatattgcttttggtcttgtcatgttacacattctaatctatataacacacagataaatttgccgaaaataaaaaataaatgcaaacacacagcttacgtcgtgttgtatttctaatttgaaacacacacacacacacacacacaaacacacacacactgaatggctcaataaggcatatagggtagaatccacactccccaagccagcatccatggctgctaaaattgtaccctcccctatttatgcaattagaacacctactgttttcaaactaaaaccttttattccatcaacactgattcattacaaactgttaatcattttctaagtttttaggtttcattttggtttctttttaaccatttcatctggaatacctctgccccacaatatatctgtattttaagccaagctccaatttcatatccttgattggacaacgcaaacaaggagtgatttctctttctgtagaactccctcagcagttatcagttctatttaacctacctttacagttaccagtcctatataatgttgccagtttcctatattaacatgtatctgtcctattgattataacttaccatctttgtagtatggctcatcctttcatatattcatttatatcactctaactaaacttttacattcctgggagcagatatcatattctatgcttcttgcaaattatacttcttttcatatatattaccagcacaaaatgaagtctctttttgtaaaaagggtgacatattttgaaatgtcttgtatttcttattacttaaaattgcaataaagtttagagactaaaatataataataagataataattgttgcagattagcaaaattctgttgaaactttgtgtttatttagtactttggatggtgactacgggttgcaaaaatactaggacagccacgtgagacttatgtagtgcttaattatttaattttcttgcagttttctttaagatggaagaatacataaagaaaaaaagtttattagaacttgtttttgtactctaattataaaaccaagggaatgaaaatatttgctaattaatcttccctctttaatctcatgtttggtaatagagcatgtttaattggaagttgggagcctataagcattactaatatatttgttataaatgttaagagcaatttttgattgagaaaatcataaatagaaccgttttatgttggtctgtgtttgttaaaagtgtgtgaacatttaaaatattcatattaagtaaaatttcattttattttattgatttcattcatttctttttgttttcttcttttcaaggccctgtggaatcctacatgcactgaaggtttatttaaaccagtacttatttcaacttaggttaaatcattatctgacaataagaaatgcatcactaatctgtgacatgtaaaatattgagtaaaatcaattttttcatcatttcatattttaagtatgtaatatagaaaaattttcagttcaattacttcacaatttttgcatttgcaaaaatcatataaaatattgatgaattaagattcaactaacatatttctgctttattctcattgtatttttaaaacaaaaatagattttgtttaaaaaattctttctatatgtaaatattctaaaatgtaatattccacttggcactaagtatttttgttcactcttctcatccatgtcattggtctcccttgttatagtcttaatttaatttcatcacatattctttgtagattagatcagtttgaaaacaatgcctttagtgtcttccatcttagtaggacatttcctactgaagaacaaaattatctacagtcttttttccctcgcatcaagaccaaaatatgaaagcagtatgtctttaattagaataaataatgaagagtcttactctaactacagaaaatataacacctgtttagattcctaaatagttgaagatggtttattggaaattaacctcatattaaagggagtctcctgaatgtatcctaaaaggatatctgtggcctggacttgaattgcttcctgatttctgtgtgtctctgtctgttgcctttgcataacaggtcactttaattatcaagtgacccggtggctacaaggcactcatgaatgttgcagtttactgcaaggataggtgacagagatagacagcccaaaagaatggctcaatgttgtggtcagggttcagggcaatagaaatgccatagagccaagaagaagaaagcaggttttactgagagttctacctgttgggcaaacagacaaggaagtaatcatggttaatggtggtaacctttataaatatgttataaaattaattaaattatttcaatcattatgtaacatgtattatgaatcataaatgctgggtgcaaaacatggtattaaaataaaaactataaatatatttatttacacaaaatggtgtatttgcccttgttgattttgcctcttaaaacaccctccgtgatctaaaatacaaaaacattttttgtttttctaacagttttctagagttccttctttatcctattcttatctctttctttttattgtcttattttatacttaaaacctttaaatgtagataatgcaaaactccatccccttaaattaaagcactcccctgataaaggtttttatctacatgaatggtcaatactgtattatcttgaagaagcaagaattcaattgaagatcttttaccaggctaccaagacaaaataatttgtattagcaactgaagtaagtcaataaagaaaggtacattttttcctcaaaagcaatttagcagaagctttaactgcagacaagaaaaggtcacctaactaggtacaattttatgatttctttttaataccagcaaaacattatttttcttccctccctcccttcctcccttccttccttctttccttccttccttatccctcccttctcctcctttctccttttattctttccttgtaattgaatcaattctaaatatacatcagtaaacatgtttacatatcaataattttattttcaaggggaaatattttcagactttctcacagtgttcattatataatttgtccattagactcttaaagtgttttataaatatttatttgattacattaaaagtgaaattaaaatagggattaacggggatgttgtttttgtttttagaaaaatgcgtgagaactgttgtaatttttgtgctatattccaacgtgtaaaaaaattatggttgataattatttcccaaaagggggacaagagacatcagtatttattgatcaaaggaacattattttctgctgttatgccagcatgtttgtccaaaatgttctcacagttattaattcaaaatataagattgagcaaacttgtcgtcatctttcaaataaagaaactaaaatttgaagaagtcgagtaactttctcaaattcatatagcttttctaacaaaagacaaagacatagattgttctcatatgccccagaccaaaagtcagggttttgttttgttttcctgattccaaaatgctggtgggttgtagaatagcagaattaaatgtgatgtatgcattgattacatatgcacatatataattgtgtattatgtatacataatattactaagcttgaattttcaagtactctttatgaactagggataattgcaatggtaaacacttactatgtgaatgctacctactatgcctaaggtgtgaaatgtatgagttaagggaattattttataagagtgagaattatttatacaaatatagagaaatgcatggaaggaaagccatggacccttttgctaggtacttcaatgactatgaacatattttatttatgttttaaatcattctgacaatttaatttgaatcaccaagttttagaatgtaggcacttatcattgtctgttaagtttattacatatagctatgttttaaatgattttttaatgaagaccctaaagtaatatgttattatatgtagatgttactatatgatatacatatgattttattgtgacacacataaaaacttccttgctgaagttatccaaattgtatcattttccttagttacctaaatttaatattgttttaaatatttatttctttataaaacaaaatgcaatttctttttcatatttaacttgcaactagaagtagaaatgtccaaattaacaaggagatgcttttcaggttgtattttgagcttacttctccttatagtactctccaaatacagttatatactattttcaatttttaatatataatcactctctctaaaacaaatctctgtcttgttggtgattttttaggtaatcaccaatattatatgctggcaccttgaaaaacaaacagtaacactaactcattttcaaacacatcagtttcatttgctatatttacttgaaacaagtctacatgtcaatgaatagatcgatgtatatatccctcattgggggaaagacaagctattctttcttggtgttaataagcattaagagttgttagaatatcctgtcttctatttttttttcgtttgtttgttttgttttgttttttttgagacaagttctggctctctctcccaggctgcagtgcaagtggtgcgatcttgaccctgcaacgtctgcctctcgggctcaagccatcctctgacctcagccttccaagtagctgggactagaggcacacaccatcatactcagctcatttttttgtattttttgtagagatggggtttcaccatgttgcccaggctggtcttaaacttgtgagctcaagcgatccacccaccacctcggtctcccaaagtgctgggattacaggtgtgagccactacgcccagctgggaaatatcctgtcttttaaatgacatcttttggtatctgaatttgcataatggagaagattatgataggctataaaatggggggaagaaaaaatatgtaagcatattattttatctcttacaccaaatcgtactttttgaatctatgcattggtgtgctcttgcctctcttgtgtgaagccttttttaaaattatttttctattttcctctttgatttttgtatggggatacacatacaagaaattgatgaacaaaagtctcaaatgataataaaatattttctggctactttcttactatctgaaagctgtttgcctccttaatttgtaaacttgtggtcacgttatatatgggcacacacacacttttatgggaaatgagggtttcctcatttaaaagctatctttgttaaaaaaaagaaagaaacttgatacagaggagaaaatatgtaggtagcataagtattctttgggaagaaataaaaatggcaggtgaatgctaattttatcctgatggagaaaagcaattattgcagcaggggtaaaaagattgcttcttccctctaagatatagtttagattttttaacttacctaaaaaaattatatatatttaattaaatatgtatgatatatagaattaaatatatattatatataaaatgtatatattatataatttttaaattatttttcatatatatatatatattaaaggaagtattccctcacccctgtaaggaagaataagcagtaactgaaactttgatgaacagcctggaaggtatatgtgctaataaattttgaatataatggtcggggagagtgaatgaacctcatgccttcatgctcaggctcttcagaaaactttcttcctaatgaggctggcaagatttctgacctgagaagaaatttctgtgtacattttcactaaagataacaacagtaagcttgaaagaacaagtaactttggcaagaaatatgctacacagattttaattttgtttacctcgtggttcatatattccttaaaaagttattgtgttcatatagatttagggttcaatttatatttctagtacaatttttatagaacgttattttgtgagttatccattttgagatagtgatcatcttacagcctttcggttgtagctacatgaattttaagaataagatcctgaaaagtaatgactaacctcttgaaaactacctgatccatttcagtaatgcctatgcaacatgagtaaaactttacgcaatatactaataaacatgtactctaaaagggagagagacaggaggcggagacagaaagagagagagagaaagaggttcttgttctatcacccaggctggagtgcagtggtgcgatcatggctcactgcagcctcaacctcctgggctcaagcaatcctcctgcctcagcctcccgagtagctgggactacaaacatgagccactgtgccaggctaatttttttttttttttttttttttttttttggagatggggtctcactatgttgcctaggctggtctcaaactactggcctcaaaacatctgcctgcctcagtctcccaaagtgctgggattacaggcatgagccactgcccccagcctgttacttttgtatcggaaggtaaactttagaaaacaagtaagcaatttgtattgatttaaaaagtgaaaaatatcaggccggcgttgtggctcacgcctgtaatcccagcactttgggaggccgaggtgggcggattgcctgagctcaggagtttgcaaccagcctgggcaaaacggtgaaaccccgtcgctactaaaatacaaaacatgagctgggcgagcggcttgagcctgcaatcccagctactcgggaggctgaggcagagaattgcttgaaccccggaagcggaggttgcagtgagctgagatgacgccactgcactccagcctgggtgacagagcgagactccgcctcaaaaaaaaaaaaaaaaattgaaaaatacctagtagaatgctatgtatccattggaaatttattgttggttattaatgaaaaaaatcaatggtgagctaatacaaaagaccgcattgtcaaattagactcataccaatcagatatcttaccccaatatcaaggcttattattcatttcacttaaggaacatattattcatgacacttaaggaactcagatgaagcaggaacaggtctggggtgtggaaggcagctctccaaggtctttcattcgacattgaacatccactttgagatccacagtcatagctcagatctttaggagaagttttttggaattacctcacacagcagagagagtgtttcattcatgaaatatctctattttatatcccaacattgtggcattttccagagtgccatgctcataaatccataaattctaagttcatttagtcaaataagtccttaacctgggacatgctgttaacatttccatatgtaaggaccctccttctaccaaatactattagtctattgacctgcaggactaattttcttgttgacagagattagaagttacctgttttctttctcgtgaagacaaatcagttgctataactccttcttccccacctgctctgtctccaccattcactctgagcatgatatacaccattgacatgaatggtaaatcatgtcttggatttttcatgtctctattattgtgaagaaaatgctttatagaaaatgtttatctgatcgagaccacagttattttggtttctcttccgtgttttgaatgttttaaaacaagttgaagtgagagataggagagattgcttttcttgatgattatctttatgtttcccttcattttttcactttcagcaaactcagaaattttgaaggacaaagaatttagtgatttaactaggaaaaaaactaatattcagttttttttctggatgtgtgtcataatatactacaaaaagagaagagccaataatttaaatttatatatcatattttaaattagaggtattttttaaaattattttttcatttgctatttatgcagaattagccctgatagaataataacacattcagctaaatggaatggatcatgttccttctttattatgtctttctttcagttatactatagacttcattacatattttattgaatataattgcctttctcaaaatacttcagatgttgttttatttaatgagttataaaatctgtgttgttttatagtccattttcttttacttggtgtgtatcagaaatacatgacaattcccataagagaaaacacataagaaaacccgaatacaatatttgcagcctgatttctctgttctcctgcttttccacaaacagactgtgttatttctaccctcaagtctcagcacctttagtgcccgaaccgctaatgctatttcttctcgcttagcttgtttgtatgaaaagaaaaccaagttccatatgcttctccctaccccaatatatttcataacttctccaggcatcattgaactctatcttctctaaatcactctacagttcaataatggctaacatttttttttaatctatgtcaggggttgttctaaaagttttacatattttaaatattttgatcctcacgaaagctataaagtaattactctatatgatttccttttacaagaaagaaaactgaaatatagaggagttaagtaacttgctcacaattacatgactagtattattagcaatcaagtattctgctcaatagggaaatatcacatatacatcacattggtatgccacttttcaaaaaataaactaaaattttaataagataactttttgcctttgatttttataattacaattaagagtgacactaataattataatgattgatataatgctaattttataagcatgagcaaatacaagatactttaattttaagtcctcgaagagaataatgactaatatttattaggtgctgctgtgacaatgttctaagtgctttattatgtatattgacttatgtaatcttaaaaacaacagcaaactcaagaaagattgtaatattattctcaatttatggaggaggctgggtgcggtggcccatgcctgtaatcccaacactttgggaggctgaggtgggtgtatcactcgagattaggagttcgagaccggcctggccaacgtggtgaaaacttgtctctactaaaaatacgaaaattagccaggcgtggttccaggcgcctctaatcccaactattctggaggcggaggtaggagactctgttgaacctgggagactgaggttacagtgagcctagatcatgccactgcactccagcctggaggcaagactgcacctcaaaaaaaaaaaaaaaagagattatagaggagtaaattatgacctagaaaggtaacatgaaattcttaaggctgttcatgtcaaacaaatggtgacataactagaatgtaaatataagcagtcttgatttcagattttaacaccctttaccactatactgtatccaaacctcacccatagcacagaataaactatatccattatcagtcagagtaagctagatggcactggagaaacaacaattcccaaatattagaagtgactcataacatcaaatattgatttcttgcttgtgctatgtatctattgctgttcagcaagcaacgcttctccaggctccctcactctaagactcagactggtggaacaatcctcctctgttatgttgcagtctcagcgggaaagagaagaatgtcttagattgtacaacagatcttaaatttccacccagaagtgacatataatacttctactcatatttcattgatcaaaacatagcaagtcacatgatcacaggtaactcactccagggagcaaggaggagcaaatcaacatatgcctacaagtggggaaatgaagtttaaccagcaaacagcactaatgcctactattttatctgtttttccatggattaatctggtcttaatgaaaatatggaaagtatcatttggtaaatatgctatgttactgacacgaaatatcttggattccatcatgtttttcagaaaaatgtaattaaattttttaacctgtaattgaatatttctccttaatatatcacatgtacataaagctatctcaatttttaacatatgacataaacattatttacaccatattctccagctatgtttcagcagctcaactagatttttcaaatatttcaacattttaaaaaatatttctacttgcaatcaatgcattatctactgaattgcctggaacttgttgatattaccacagtcctattccagcttattttaactattaaaacagtcatacttgctgatatataatctaagcattattatacttgtcagaattaattcacaatgacagtgttatttcaacaacactttttagtcatttatctccttacaacctatcatgaagcacattttttcctttgcaagtatctctagagactgtaagtgacaagtataatatcttaaatgtgtgaacaaaaatgactttcctgttcccaaacaatatgctttgcttgatccagaaatagataatttgcatcaactgaaaaaataggtatcatgtaattttttctctgtgctaacttaatggtaaaccttcccatagcatctcctaaatcatgtgttgtattttcaacctttaagatataaaaatatgaccacctttaattcccacattacccaatttacatttgtacttaattagaaaattgtctactgtaattttagttcataaacaaagtaaactgcatctttctgcccttttttcagtgttgagtgtaaagtgaaatccttggtactatttttttttccagtctgtaattaatttgcgaattcctactatagtaattgattcaaatggttttcattgtacaacaatagttaggtaaacattcattatatcaagatggtggttagcattacccaaaatctgttgttttactttaactataatccaaatataaatgtaaatataaataaatatatatatgaaattagtgtcttcacttttcaggcaatcttttccaattcattttcaggatttaaaaaataattattgaagctggaagagaacattaatcagagttttagagatacatattttcttgttctcaatttttttcgtttattctttttctatatttacaacacataggatgaaaacaaagatttataaatacgagaagtattatgaggccatgttttattgtcacaatttaaaatcttgtcaatagaatttttaaattaatacacagattatgagaatatatcaattctcactgtttggcaataattttctaagttttgtagattctgaaattttaagcatttatatgcatcataaaattgcatatttacatgcattcttatgctttgtaaaaaatagaattaggtaaaatatcagactattaagttcagcataattttatttctcagtcagacttctctaggaattcatgattcacatgaattcacatgattttttgtttaattatttattcaagaaatgtttactaaaaacttacagtgtgttgggtccttaggctatgaaccatataataccacgtactgaccaaccacagatgaatagagtctagcaggatatgtaggcataatcacaatactttttaatgttattataattagcgtaacaagaatatgtctgacgtggaatgtgataattttatgagcataatgtattttaccacaattagagatcacctttcaacttattaaattttaggattatcttataaatttgtatagagaaagagatgctaacatatttagtacctcatgagtatcagacacagacctacttggtgctttttgatatgttctgtttactcttctgcttccttttattaatttttgtatgaaaaagacacatttgatgtctgtttatgtgagcaatctgctgcatagcaacccaatttaatcttttcggttccatcaaatatttaagaatttctttacccttaagaagaataaaaccataatagagtagatgatataaaaacacataacaaaataaatacctaacttgcaagaatattataatatcagactggtaaaacatattaaactgctaaaaaaaatcagaacataatacggtaaataggagtgtgtagggtgtgtcacaatgattttgttgtcactacagtgagtcagggggcaacaccatctaagaattcatttgttaactaaattcccaactggagttataggttttgttttcatgtgatatatgaggaaaacgaatcattacaatgcaagtaaaataagtgccatgtccttcatgcattcattcatttgacaaactatgtactgagcaactgttttgtgccaggtatttctgttgttgttgggcatacacagtaggcaaaataactattattcctaacctatggcatttacatctcatttaatagccataatgattctaagtagcagactctagaattatccctactgtactgatgaacatatagagcatttatatctcatttaatacccatgatgactctaagtagcagactctagaattatccctactgtacggatgaacatatagaggcctaaaaaggataaaaaacttgcctgctgtcacaataagtgctatgtgtcccttacgttagtctgacaataaagactaagccctctgctatcataccacacccctccaccaggtatggtgataggagtgattatctgtatctgaaaagtgcaaaaagggaggaatgcttttgttacattgccaggcaaatgaggatggagatgtgcaagaagaaccacagttagctaacctggactacctgctaaatcccaattaaaacaacatgttaataaaaagagaaagtaaaattaaaaagtcaatagacatccttggtaacattttcatggctatatgttatagatatctgtaaaaaaattaatgagtttgatttttatttgatcatatagcttctacatttctgagccattacactgaggtcttttaattttttttccctgagactaaataaacgtgatggaaactgagatatatttttattactgagtacgtctgctgttgaagacctgaataaacaaagaacaaaactgaattatggtgctgcagcctaatatcatcacctactaatcaaatatagaaactcttaaaacaaaacatacacatacacacacacgtgcacgcgtgcacacacacacatacacacacgttgaattcccacagctctagctgtctgattcagaaagagagaaatgaagtcatctctgtttttggtacaggcttttgtgtaactatagagccaagaggcatacagtgataacctttttaacaagcatatatggccattaaaaacagcagggtttcagcctggttatcttgggtatagagataaccacttttgctgactccagggtattcttgaaaacaatacgattgtactgtggagtctgtatttgtttatcctacatgtaattggagcagagctaacatgctattcccgtgctctcttttgtcccatacttttagagacctatatgttacatttctaagtttcataaatatctttagcatagctaatcacaaactagtgtgatatcttttatcattgattttcactgaaaaattgtttattgggcactaggtgcctggtatatgcacttttataagcaaagttaaagggagtattagcctagaaattttacttagcattggtagagattaggagaataaataaaatttatctcactaacaaatacctctgtatgatttctcaggagcgttaacgtcatgaatcctgtggctcaccacttcatgtctgaaggttagtgagccaatgactcatccctcaaggctctggatttgtttacttatttagcaaggtatagcagaaaatgacagcatgcccttaacacaaagcttttcctctagtactcttgtccaggaagaggtaataaaatttactttaaaaaactactcagtaactgaatagtttatcaaggcattccattgagaagagaaatctttggggtataaaaaggaaggaaaatgttgtgaagggcatcactccctttttcaatagagaatgtgtgaaaaagtaaggaaacttttttcggttacttttcttcctttcataaatgtctcatgaggcggaaagaatactgcaaggggagatattcttctttatacatttccataaattctactatttgcagtatattctgtagaaggttcacaaggttttgtcagaagtccaacatgataaaaaatgtacgaagtacatttgtaaatattaatgaagagatgttatcaaaaactacattttgttaatgctttgcatatactgcaaagagaaatagaatttgatgtccagcttcctaaagacacattttaaagactttcagtgagcataggtaattgtgatttattctgaatgcttctaaattctttaagtctggctttcataattgcaagtagaaagttgtattttctaaggagaggatactgaggtgattaggtaattgtcacacatgaacactcatattttaggttaacagatatagtaggctaattctctagggattttctgaatgttaattttacacgcacacacatacagacacaccttgcttttctcccttttactatcatgaatagggataaaacactaactgtcaatttggggtggaatattaagaaaaactaaaacttaaatcacattatgagaaaaattcaccagtaaagtcacctttaatggaggcatacatgcatacatcaacagagacaattaaatactttttctgttgatatattaggaaaatatttattagaagggagcaaagcaaatatataaaaagaaaatatcaagtcaaactatatgagaggaaaggtaaaaaaataatatttgggtaacacatgttaattctttttgttaccatctttagagcagcaatactcaatcagaggcatttttgccccccagtgaacactgagcaatacctagagatagttttggatgctacacttcagagatgccactaaaaagtaatgggaagaggccaggtatgctacttaatatcccacagtgcacaaggcagctcacctcagccaagaattatcctgcccaccaggttaatattgccaaggagaaaccctgctctaggtggtcattgttaacaatgttgaaatcttgattgataacataaaaatattttgtagcacttttcaggtaaataaaaatgggacttgtttactatctcatagaattccttttttgcctgaggaagcatcataatgtcatagtcctagacacttgatttcctacaactggcctgggactgagtctctattattcaaggtgatagcctatcatatttgccgaggttagctctgtatagttctgttttcagtccctcactttcctgtgacaagttttgaccaagatatctaggaaaataaatttaaatcatagactgtttttccaggtgcttctgcccactcccactaggctccagaagattctatttcctgtattctagaaacacccttgagactcacacagaaatctaataatgatcctgtgttataaatttttccaagttctaaatttaaagaccatagaaaaattatctaaatagtttctgctttaatattgtccgtctttacctttaatattttgctttaatattgtccttatctttacctttagtattttggggcatatttatattattttctgtataaaggattttcagatgcaacttcagtgaaatatgagttttgacatccatgtgttatgttcatatgcaattttgtcatctagttaacttttattgttatagttactaaacaaaacaaaaagtgattggcatattagtggcaaagttctgatataaattagaaaattataacagaactgaaggtgatcatcttagaacatcaaggaaaaaattttttcaactttaattttaggaaagcaattctcatttaaagtagtatttcattgatttttttttattttaacaaacataaatttagcaaaataaaaatgttctattttacaatgaaacttttcttactagcaatgttaattcagtaaatatttattgaacatttactattgtcaaggcaattagataaattatttatcctagaaatattttagatatacaattatttttaaataattgaaagctaaataaatatgaagaggatcaaactttatttcacctgcattcattacaatatataaatacacctatacattcctatatctatgtatgttaatatagttaaatataaatattctttacttatttatcctttggatatatgtgtatatttacatccatgtgtatatactttttacaagtaaatgtgcagatgtgtatagagaattttgtattgactcacattttttgataattgactgaataatttcatccatagtataggttttggtgagtgatttgtatctgtaaacactcaaataacaagcaacaaactattttttaaaatcccttatcatattataaatccacatagcttttccaatagtctttttagcaataagagaaaaattacaaagctcaatagagttgtcataacaaaagaggttcataaatttttctttaattacactccgtgttgcctctcataaaagtagcatacagcttctactatcggattgaatgcttaccaatttggaaaatgtttgttgatttttacataaatactttcatttaagaaactaatgatttttataacatttctctttaaagaaataatttataggctgcattggaaagcaaatacattctacagtattttatttgttatcagttccttcatatgtgactacatgaaacaaaatttgtatgctatatttgcagaataaagtagaaaatacattttgcatacctcaaagtaaaaagattctgtaatacaatttctatatgtattccttctctccaaaacatattttattataacatgaacattttagtagttaacatttttatttgtattgaattttgccaattagttagccaattttataattcatttcagtttttgtttatatttaaattacagtttacttaatatttcactaggtatttgtttcataaaagatgattatattagtgaatcacaaggatctgaaggaattcttaacatagttctcatcccaagtagctgataaaatagatgaatttcgtttaatattattccatggtagttcacacatgaactaacacattaaatagtgctttcagcttccacttagtgtaggattgaataaaacatgtgctgaatgaaaacaaatgatgcataggaagtatcaatctctgtgaatatttctctataaattctattgaagtaagtttcaactagggaaactatgatggctttgaaattcgtttttatgtgttgagggtatgcagtacatttactaaaaaaaaatgattatcaagtgataaaatggttgattttggttaaaacaacttctctaacttctctcttcatacatacccacttagctattgccacactagctttgattcttctatatacatgtatgccctagctttagggctctgatctttctgcctggaactatcttccaccagatacttttatgcttagtgtttcacctcctcaagtctttcatggccaaaataagattgtaaatatttatctacattatctatttcccttccttggttaatatttctcattagcacttgttaccatcgaacgtgttcgtgttctatgtatttattctgtttccccatttgaatataaactcaaggaaggcagattttatcctatgtttttcattgctatacccctgcacttggaagacccagctggtcccaaaaagacactcagtaaacaccctatgaatgaaggatatcagatgcttgtaatgcacaaggcccatgtcacttttcgggagtgctacacttgtgttggttttaatccttctgtaagagctggaaaactagtcctaagaggctgcagcaggcaagcattagctcacaaaaataaggcaaatcaactgaaggaaattggaccaatgagtataaatatcctacaacttcaagtcacattaaatcaaactcccaatagtaaacactccctcacactgcttcccagccttttcatgttgtgctacagatagataatgataatatttaagtagtatattggggtaaactgacaaagctgtggccagaggattctgcctcaggacattccattccaagcatttaatcacacttaaaatctaaaacccttactctgatttactatttatattatctgactcctgattgcctttccagcttcaaaagatggtcttattcttcttgccctcctgcacatgcctcatttctattactgaaacaaattaagtcctgtcttggggtatttgtactagctgtttcctccctctgaaaggcttctccgtcttaccaccattctacttattcgtaattcagatcataacttaaatatgtcctgcttcgaaagactattccttaccattcaatctaaagaagccaatctaaaatagatactctctcccacatcacacagatgtaatgttctgcacaagatttactaacatctaatgtttttcttgtgtattatatatatatatcaatgcatttgtttattctgtgtctctctgggccaagaatctctcacttcctcactgcaagatgggtgtaggaccgagaacagtgctggacacatcataagtgtttagtaaatatttaaagtgggtaaaattaatttccataaataaaaacgtgtattgatattgccaagtgccttagaactttgtcaaaagataaaaatgatttttatataatttcaataaaataaaaacctacagaagcattattatacagtggtttcaggtcagattttggcttaagaaagacctactaactattttctgggacaacttacttaacttgcaaatccttcatttcttcgtatagaaaaaatagggcaggatagctaaggcataggattttcctaagaataaaattaaatactatatatgaaatactatgtgggtggcataggtaggtaagaaaatctcttgaacatgtccctagtgatggagggacactattcagacaggcatctaaaatgattcctttttaaattaatttacctatccattaatccatttaataaaagttgagaaacttctgtttcctggaaagatgctgtatatgagacatagagaaaagaatttgtattaattttcaaaattaggtttcttatggagagaaatatgtaaataagcaattaacagacactttaagaagtgctatgttactggtttatacaaggatttcccaggaagtatgaaggcagaactccatctgatattcttttcttttcttcctcttcttttttttttttttttctttaaaagacagtattttaactctgtcacccaggctggagtgcagtggcctgatcacagttcactgaagctttgaactcctgagctcaagcattcctcctgcatcagccccctgagtagctgtgtagctgggactacaggtgtgtgccaccacaaccagcctttttttttttttttgtagagacaggatctcactatgttgcccaggctggtcttgaattcctgacctcagcaatcttccttccttggcctaccaaagtgctaggattacaggcatgaatcagcagcagatccagcctgatatttctttctttccttttttttttttttttttttttgagacagagtctcgctctgtcacccaggctggagtgcagtggcgcgatctcggctcactgcaacctctgcctcccgggttcaagcaattctctgcctcagcctcccgactacctgggattacaggccccccccaccacgtccagctaatttttttgtttttaatagagatggggtttcaccatcttggccaggctggtcttcaactcttgaccttgtgatctgcctgccttggcctcccaaaatgctgggattacaggcgtgagccaccgtgcctagccccagcctgatatttctaattgaggtgactctaaaaacgaacagcaatttcatggtatataaataatatatacataatttatattataatattattatataatattatataatataacataatatcatatattatatatattatataattatattatatatattatataattatattatataatatattattatttatattatatataatatatattatattgtatatattctatataatatataatatataattatatatataactatataatttcatggtatatgtataatttcatggtgtatatatatatatatatacccacacatacacacacagctaacaaaaggtaagatttggatttttaaactgaaatttcccctgatggagaacgcttgtttatgtcttgttaaatatttaggcaatactcagcctaacagattatcacatattgacataaaatgatgaaaggactagggactctgtcttggctcttaaaaataacatcctaattcaaacttacacctgcagcaagcttgaaaaggcatatttaataaattgaaaaaaatagtgaataatgtgttacagtttgaaggagttacttgagagagcttctaggttagctgggggatcttccaaactccagcacataattaagagcattctattagatgtgtgtggaatcctcttggagatattttgaaaatttatttatgggatgcatcaagttttatttaatgtttaagacctctgaattttctctgaattagaaataatccttctttttttcagaaaactatgatcttatacaatccaaatggtcaagggcaatgtaactaggtcgtgaaacaactgagtttctactataccaactgtgataaagtttataataagtaactagttgtctgctggttttcctgtcttctttttaaattatgcaagaggctaataaaacagtaaagtaatagctctcaggtttcaaactgttgtagttattggctatatcccttgtggtctccctgcatacctcttgggtaaggtttcctctctagggctgtcagccaacatgcctttgcttgagtttatggtaaaacattttttttttttctgcactgacattctggagcaggctgtgtgttttgggtcgagaaggctgcatgcagtccagtgtgatggctgcagcccacttgctaaccttagagacaggtcttgtagtctcgtgtccctcccttgggagataattaggatcagataagctcatgagggtggaattctcgtgaacaggattcatgtccttataagggtccagagtgactgccacatgagaacccagtgaaaagacagccatttatgaagcaaatcctcagcagacactgatcttggacttcccaccctccagaattgtcagaaataaatacttgttgtttaagccacccagactatggtattttgctctagtagcctgagcagattaagacagataccatccttcttctgtctctacttgtgtttagattattagagtataattttcaaaaagttaaaaacaggagtctcatgcaaatttaaaatgaatcttggtcaaagattttatataacaaagtaattaggttaccagtaacacgttaaaatcatttcaaattgcatttgaggaattagatatttataaggaacagagaatgttagaataagattacaggagttatctgttgaacagatgtaaataatttgcatctctgctgtaaattttctataagggaacatctgctcttacagaattataaaacagcctcattaaaaggaagtcagtgcatcctgctgtagcacagtgctccactggaagaacatgcagtattctttgcctatttccaatatctatattatatttctataatacgtgtcaataatacgggttaatcattgtgattattctatttcttggccacctactctatgccaggcacttggtcagatgttggaatccatttcatctaatgccaaaaatagctgcccagtaaattcttatataaacaaactgagactcagggaagatacattttccaaagtccaaaccattagtaagtggcacacctgagttttctttgttcttttatttaaaacttactatatatgctatgcactactttaagggatttataagtcttataccatttaatcctaaaaataacttaaagtgccctcactttatttatgagaaaactaggcatcatagaattgaataatgtgccaaagataaatttgacaccattacctgggacttcctaatatatgatcagataaagagacttctgcatcctgtggaagttctgcctcgggttttctttttttttttttcgtttgttttctctgatagcaatttgccttctttgcctatctcagtcaaccttgacctttaatccagcacctctcttcttgcctgtgacctctgaactcttgactctgagtctgtcatttaatacacatgctttgtattctggagcttctttccacgttactgcgtctgcttcaatctaatacccaaatccagaattttaattatgccttttgctttgacattagatttgtctatgtctgtctcttaattgtgctccagcaagacagttcggcaagaatcgcttaaattccatttttcaaagataaggaaatagctttcctttgtaataattggacatttaatgccatgagttagaatggaaagatacctgaaatcgtctttcacagagatagcctgttcacattgttttcattaatcattcattttttttaaaaaaaggattttacgtaatgcttttatatgcaaaacatcatgaagcatagttcaagaatacagagattaaaaattagacattattctgaaatggattcagccattaagaacattatactcactagaaaaactacacagaaacatgaaatgccttgtttctaacctttgcaccactcctttccccacagtagaaatatttgactcctcacctatgttctggtatcttgtcagtctttactcattgctcctatttattctacccagtctacatcattaggttcaggcttcttacctgaaacctcaactgcacctcaattcctaagccaagttagacagaagtgagaagcagatttatctgatctccaccactctcagcctatccccagctcagacagatttagttgtatcttcttccagtgtcacttctctgtgaactaaatgcctcactgctgaccaatgggctttcattttcggtatgaaagctacacttgccttcacctcagagctcttattctgtttatggaaccgctgtacctggaatcctgattctcgactccttgctgcattagctggaattatgttcttattcttagctacaagactagattgggtctagaagtttctatgaagttgtgaaatacttatttagcaccttaatatatgttaagacactgctacaagtgtttcacaaatactataaggaaggtactatttttatccccatttaatatgtgaggtaaataaaggatagaaaagtgaagtaacacaggcagtttggctcagagttcatgctcataatgactatgcaacctgtctccctaattatatcttgcatttacagctgtgctttcattcccagccactagagcaccagaattgccctaatgttgacaaactcttagattccccattagcacctgctctaaagatgctactttatcctgttctttgtgttatattcccagacctcccaggttaaaattgcttacctgtcatcatgcgttccttatttagagttcactttcccaatagttacacccagatccccttcttttccctatccagcattcatcaaatgtttcttcccagttccagtatagaccttctagcttgcctctttctcctattcataggtaaaatccttaaatatatatgagatagtaactgtagctcaattcaaggaccaaaaatggtcaaccattagatcacctgatccatcttttagcctttaaccttatgaatctgatcttgtaggtacatgtctatacctatattaaatgtatgaataacatatatacatgaaacttagacaaaatagaataatatgttgaaagcaaaagaaaatgtttcatatgaatatttgaatgttaatataaagtttcattcataaagtactgacaccttaagaatggattagagatcagtgatagattttacaaatttggcttacaaatataatgtttataatgatattattttaattttaagtaagtacatttatattcataaatataaaaatcaaacatatacacttttaattactattcagcatggtagaaaaatattgcaattactaaagactagaatataatattcttaataggcttcaatgtcaatataatatagaattgttttaaacagttcctttttctgatctgaaagttgacaatagattcttgaaattaattaatttggattgacctttttctcatttagcctgatggcaccaacagaaaatgagaaaagattgaatactcagaatgcttagataatcacatttcaggaaaacaaaaacaaaaacaaaaaacattgtttaaagtcccccattgagcactttttctatgttaatgagaattcccatttaattctcataacactttgagaaaatatttatccccatttgagaagaactgagatttagaagttcagtaacttgtctatgataatacatgttaatagtggatccaagaataagactcagatcttgccaactcacagaacattctgtaccattcacatctcctcaaacattatgatgccaatgtaaaaaaaaatctcttagtaaagataagcatactaagatgtaaatgggtatgagaaatggaaaatggcaagattgttgatttcttcattataaaataggaatgatggctttttgcaatatcacagtcaaaaccataaaaaatattttatacttctgtatttaatatactatttaaacatagcaatgaaagaatattattttgactacattagcttaattttaaaaaaggaatattttaatctaaattcaatttgacagtaaaataaaagagtatttgaaattctgaatacttatatgccctgtaaacttgcttctcagaatgtgcttcagtggcccacataggtaatatttttaactgaatataaccatattacatgtggaaaagtttagagcttggtaaaaaatcatttgaaatgtgtaatgttcaagcaagaaatatttagtagggtactgtacattagagatgacagaatatttactaatggcaaaagacaagccatgtcttgggttcttacctttcaccttctagctagtatcacaggcacaacaggattgtttttttctacactgtagccagagtgtgcatgtttttcatacagggctattttaatattcatttattcacttttggataatgaaaaattctactagtcactctaggcaatttatcagcattaatgataatgcagccagagtagcatgaaaggaacaaattagaacatggatttaggtaattatatattgttctagtttagcaaaaaaaaaatcatgttttaaatccgaataccattattctttagtaaaataaatcatattggatttcaatacattgctaattgttcaggtttctttttaaggtagaatagtattttaacaaaatttgttattggatatttatagttgtactgaacagctcttattatatagttccctagattagtctatttaaaggcgtttgaggaaactaagctttcatttaaaaattctgaagcaaatttgatcagtacatctattgaatagcatcttgaatctccgaggatgtgatctaacagaatcccaaaactaggttccttaacagcagagtctatgaattatgaaaattgatgacagatagatctatagatgatagagatgcaaatatggagatatatataaacatatattatgaaatacatatatacattttttttgttatggactgatttgtgtccccaaaattcatatttgaagtcataacccacagtagcttagaatgtgaatacttagagatagggccttagggaagtatttaacattaaattaagtcatttaaatgaaagtacaccctaatccaacatgactggtgtccttgtaagaagacggaaaacatgcaccgagaaaaggccatttgagggcacagtgagaaggcagccatctgcatccattggagaggacagaggcctcaagtgaaaccagacctgctgacaccttgattttagaatcccagcctccataattgtgtgaaaataaatttctcagtttctcacatggcatttaagccacccagtctgtggtattttgttgtggctgcctttagcaaactaacgtattgccttatgatctattgaaaggttcaagtaaaaaaaaataaagaaaatttaatagggcttcaagaagttaggagttgtcaaatattctttttattttcttcttctcttgcttttgttaataaagaatttctggggtagaaaaacaacattttttctcactaatttgtgtgatttccagcagttcattattagaaaccaattattttaatgcaagaagaactcttttttacactatttgtggagagcaaattatataaaattgacatacctccctaaaagtggccttaaaaatgttcatgtatttttactgaattcttcttttagaaattattttaagtaaacaatgcagttgcttaaagttttctgtaaataggtgctgatcacaacatagttcatagaagtgaacaactaaaaataacattgtttccaaattgaagtattcccataaattgtgattttttttgtatctataaatataataacagatatgtatttttaacatggaactgcctggtaatagagaaaataaaaattctttaagagacatgtaataaaaagcagcagttctagaataacacagtaaaggcatctgaaaatctgctattccataaaagcaacaaggataggccaggcgtggtggctcacacttgtaatcccacactttgggaggccaaggcgggcagatcacgaggtcaggagatcgggaccatcctgactaacatggtggaacccgtctctactaaaaatacaaaaaacttagctgggtgtggtggcaggcgcctgttgtctcagctactcgggaggctgatccaggagaatggcatgaacccgggaggcagagcttgcagtgatccgagattgtgccactgcattccagcctgggcgacagagccagagcaagactctgtctccaaaaaaaaaaaaaaaaaaaaagcaacaagaatatgggcaaaaattgtccaaatcaactttttaaattctggaaatccaccaaaggctttcgataccacggagtgtttattaggggtaaatggttgaatctcagttctaacagcaaacattgtgttattttaacttgcccactttctctacctcatgtgcagttgccttgctatccggtgaccttgcaacaaagacatctgtgtaaaagatcacctttgtagccactaagggggccttatctatgtggagctacccccaaaagcctcattcccagagttttatcaatatttgaattgtctaccagctccctagaacagggccatttacaagacttgtttttatttgaactcagggcttactcattgcaaaaagccctatcctatccacaggacatttgacagaaacaatcaattgtttaatatttcagttgcttgaggcagtgatacaagttggggaaaatgagtctgaccaaaatcttaaatggaaaatctgggagatgatatgtctacagaggcctttaaaaaggcttcttataaattctctggaacctagaaagccacaacaagtgcaggggtgtgcccatattcaaggctgtgtgtatgcccaagaaagacctgacaaggccctgttttctcacctctgggtgaccttgagtttctgcataggtaggaaggaaaagctaaggctgactgcaaaccatcagatcgttgaagacatgcccccaatacatacacaaaaccaattggcaaaagccgggagacttattggccaatacattcaagataatctttgtttaattgtaagttgatcactattgtaatccaccagggacttcagtgaactacagatgacaagaataaagacttttcagaatatttcattaaaaaaagatgacaccaaaatcaatgaactgcaacaacaagccatgtgaaagagaagaatctgatttttagagtttctacattatatgaaaatgtccaattgccaaaaaatgtaaaagacgtgagaagacacaagaaagtgtgactcataagagagggaaaaaatagtcaaaagaacctattttatgtatttaagaagtgatggaagccatgtctaaagaactaaacgaaagtgctttttttcctgaataaagaaatcagcaaagagataggaaatatttttaagtaccaaatagaaattctggagttgaaaagtatagtaactgaaatgaaagtaccttcatggactcaacagtatatttgagcaggcaaataaataatcagttaaatttaagatagattcatagagattatccaatctgataaagagaaaaataaaagaatgaataaaaatgaacagagactcagaaacctgtaaaaacgctgtgaagtgtatcaacatacacatgagatttaagaaggagtgaagagaaagtggcagaaagactatttgaagatatgatggccagaattttcttaaatgttatgaaaaacattgatctgcctaagaaacttgaagtccatgtggtataatttaaagagatgcatatttcaacacatagtagttgaactgttgaaagacaaagaaaaaaaaatgtgaagacagcaagagaagagccactcatcacacaaaagtctcctcaaaaagatggctgacttcttatcaaaagcagggaggccagaagaaagtgggatgatatattcagtactgaaacaaaggataaaagctgccaatatttcttatccaaccaaactgtctttcaaaaatgaaagagaaattgagatgttcccagataaacaaaaactgcgcgaattcattgctaggaaacctgccttataagaaattttaaagaaagtccttcagactgaaagagaaggacaataaatcgccaattgaatccgtggaagggataaagagcaactgtataactacacaggaaaatatgaaaacttatacatttatttttatttattactcttatctgatatcaaatacaattgcagaaagcaatagttgtaaaactatattgatgtatgttcatgggtcaataggcttaatattgttaagatgataatataatccagattgacctacagattcatcacaattcctatcaaaatcccagctagcttctctgaagaaattgacaagttgatcctaaatttcacatggaaatacaaagtacataaaatatccaaaacaatcttgaaaatgaaaaacaaaattggataacctacacttttcaatttcaaaatttattatgaagctaaaataatcaagggagtgtggtactggcataaggtcagagagattgataaattaaatagaattgagaatccaaaactaaaccctaatatttatgaccaattgattttcaacaagtgtgccaatacatctcaatggtaaaaggaaagtcattttgggctgggtgtggtggctcatgcttgtaatcacagccctttgggaggccgaggtgggaagatcagctgaggtgaggaattcgagaccagcctggccaaaatgatgaaaccctatctccattaaaaatacaaaaaattagctgggcgtggtggagtgcacctatggtcccagctacccgggaggctgaggcaggagaatcgcttgaacccaagaggtgcaggttgcagtgagctgagatcacagcaattcactccagcctgggcgacagagcaagactttgtctcaaagaaaaaaaaaagtattttcaacccatggtgctgggacaacaatatatccacaagcaaaagaaagaagttggacacctacctcacaacatatacaaaaataacttaaactggattatagacctaaatgtaatagctaatactacaaaatttttataaaaaaataaatgagtaaatccaataatggttagtgatggtttcttagatacaacacctaaagcacaataaacaactataacaatataaattggatttcaacaaaattaagaatttgttcttcgagttgatgccagcaagatgataaaatagaagttttcagcccttattccaccctaagaaacatattttttcacaatctcccatggacaaaagcactgttatgagaacctgggagtccactggaaaagtgccagcagcccaatgggataaataatccaaaaatagacacactgaaaaaagtaagaagaacagttttactttatcagcatcaccccttttcccaaggcagtaaagctcagtgccaagagagaccctcttaatccatgatttctctaacggagaaaactgaaagcgtagtgaattcctaccttccttaatcatgtggaatgctgtctaagaggcatgccccttccaaacctcacagataacatgagaacagtaggtgtaagtatcctgcagatatttaagagtagaaaaaagaaagataggctcacagacaccagagaacagaacttaaaataatatgttaaaatattaacataaaataataataataataataaaagaaccaaaatagtatgtcgaaagaactttaaaaaagagccaagaactccaccaaaaggttcacttatgaagcttgtgatatgcatcccttgcagatttcctcaactaacccacacatgcccccagcattcatcccttccttagcaggtgctccatgtgtgcccccacagatagcacatgcaaacctctgaagactgtactgtagcacatatagtcaccttgacagactgctggactgggagaaagcacagaacctaagcacttcagagcaaactgccctagggagaaaataaacaggggactctcagcacccaacatggctttgtagaattgagagaagacatacaatacttaaacttttcctcaagagggaacaggaggagtggaacaggtacatccatagaaaaggtctgggagaccccaagaatccatatccaggctgattggtgaaggtatttctctccagagatgataaattctacaggaagttacatcttcaccaaatgaaaagactgtaatgaaagactgcattgaacacaaaaactcaaggaaacataacactatgacagaacataatagttttccactaaccaacctgaaaatattagagatctatgaaatatctaaaaaaaaatcaaaataattgttttaaggaagctcaagatgctacagaaacacagaaaaatgaacaaaaagaagaaaaacaatatatgaacaaaatgtaaagttcaacaaagagacagaaattatttaaaaaaacaaatacaggactgaagacaataaatggaataaaaattgaaatagtctttcatgagcagactcaagcagaagaaagcatctgtgaatgtaaagacaggtcatttgaaatcatccagtcagaggatataaaaaaagaacacaaaagagttaagtaagccagtgagatctatgggacacaattaaatgaaacagtatacacattatgtaagtgtctgaagataacaaaaggaaaagagagcttatttaaagatataataactgaaaatgtgccaaatcttgagagggatatgaacatccacgttcatgaagttaaaagatttctaaaacagaataacttcaaaaagaatataccaagacacacgataaaaatattatgaaaagtaaaggacaaagaaagaattttgaaaatagcaagacaaaagccacttgttataagcaaggaaaccccattaagctattagatgatttctcagcagaaagcttccagtctaggagagtgagataatatattcaaaattctgaaagaaaaagactgccaaccaagatactacacccacaaaaactgtccttaagaaataaagaagagataaacactttcccagatgaacaaaatgacaatctataaaatgtctaacaaaaatttagagggaatttattaacattagacatgccttaaaaaatggtaaagggagttcttcaagatgaagcaaaatatgctgtttggtaagaggaacatatgaaagcataaaactcactggcaaaggtaaatatatagttaatgtcataattatctgatgcagcagtggtagtgtgtaaactacttgtaattctaatctaaaggtaaaagacaaaagtgtttaaaatgattagaatgaaaataatatgttgaaagttatacaatataaaaagaagaacctctagcagatacacataagaaataaaaaaaacctctagtaaatatacatagataaagataaagaaatcaaattataccaccgcaaaaaaaaaatcataaaattacaaaggaatatgacaagagaagaagaaagaaacaaagaaactgcaaaatgttcagaacaacaagatggtaattttccaaatctagtcattacctatataattattgaaaatataaatggattaagctttccagtaaaaatagatagagtgggtgaatggattaaaacacacgatcaaacagtgtgcttcctacaagagacttgctttagctttaacaacagacatagacaggaaatgaaggaatacaaaaaatatgccatgcaaatggtaaccaaaagacagtaagggtgagtataattatattagacaaaacgaacatcaagtgagaaattgtcacaaaaaaccaagaatgtcattatataatgagaaaaggtcatttcattaagtggatatagcaagtgaaaaaaatatatgcatctaacatacagcacccaaatatataaagcaaacattaacaaaactgaaagaagaaatagacagaaatacaatagtagaagatagatactatgttatcaacattgaatatatcatctctatagaaaattaaataaggaaacaacagacatgaataacattatagaccacatgggctcgacagacattttatccaacagcagcagaatgcacatttttctcaagcacacctatgacatctttcaagatagattatatgtttagtcataaaacaagtcttaacaaatttaacaaggctgaaatcatagaattatttctgaccacaatggtattaaactagaaatcaataagaggaagaaaaatcacaaaatttaaaatgtgtggaaattaaacacactcctaaataatgagttgaatctaaagggaaataacttgagagaaaggaaaatagtaacactacataccaacatttaggacatgaatacagtgaaaaaaaattactaaaagaaattttatatcaataaatgcccatgttaagagaaaaaggcctcaaataaaccacctaactatatacctcaaagaattagaaaaagaagaacaaactaagctcaaagttagcagaaggaaggaaatagtaaatattacagcagaagtaaagtagaggctagaaaaataataaaaaagatcaacaaaatggtatttgttctcatactatgataaagacatacttgagaccgcattatttatggggaaaagaagtttaattgactcacagttccacaggctgtacaggaggcatggctagggaggcctcaggaaacttagaatcatggtggaaggtgaagaggaagcatgcaccatcttcacatggcagagcaggagagagagagcaaagttggaagtgctacacacttttaaacaaccagatctcttgagaactcactcactatcacaagaatagcaagggagaaatccacccccatggtccaatcatcttccaccaagcccctcttccaaccttggggattacaattgaacatgagatttgggtggggaaagaaaagcaaaccatatcagagattgaatcaataatccaaagcctttcagcaaagaaaagcctgcaaccagatggttttactagtgaattccacaaacatttaaaaaataataaatgccaatacttttcaagctcctccaaaaaaattgaaaaggacagtatgcttcaaaactcatattacaaggcccaaattaccctgaatatcaaaccttacaagtattctacgagaaaagacaaccacaggcaaatatccctgatgaacatagatgtaaaagtcctttccaaaataacagaatacagtacatgaaaggattacactccatggtaaagtgggatttaaccatgggatgtaaggatgattcaatatatcaaaaataatgtcatacaacacatgaacagaatgaagaataaaaacatataatctcaataaatgcagaaaaagaaattgatgaaattcaacaccttctcatgataaatactatcaatatattggataaagaaagaatgtacctcaacataacaaaggctgtatgtgaaacacccacagaaaacattaaacagtgaaaagctctatgcttttcctctaagatcagcaacaagacaaaggtttctactcttaccacttctattcaacataatgctgtatgtcctatccagagcaattaaacaagaaaaagaaagaaagacaaccaaattaggaagaagaaaaattgtctctgtttgcagatcacatgatattatatgaagaaaaccctaaagatgccacccaaaactattagaactaataaataaattcaataaagtaacaggatataaaatcaacattaaaaatcaatattatacatatatcaaattactttgttgtacaccttaagtttatacaatttttatacattaacaattagatatccaaaatgaaattaagacagcaacaccatttaaaatatcataagaaataaaaaaaacttaagaataaatttaaccaacaaagtgaaagatctgtgcacttgaaactataaaacgctgatgaaagaaattgaagatgacataaataaatgaagatatcccatgttaatggattggaaaaaataatattcttaaaatacctgtagtacacaaggtgataaaattcaactcattctttaccaaaatctcttattttttgcagaaacagaaaaaaaattctgaaattcatatggaatcataacaggtacagaatacccaaagcaatcttgagtaagaagaaagctggaggcatcacaattcctgatctcaaaatatattattaaaataaagtaatcaaaactgtatagtactgtggaaacagatgtgtaaaagaatgtaacagaatagagagtgcagaggtaattctccacatttgtagtcaactgatctttgacaaaagtcccaaaagcatacaatggggggacgaaggaatagtctcttcaataaataatgttgagagaactggatatccatatgtagaagaaagaaactggaccattatctcacactatatataaaagtcaactcaaagtggattaaatacttagacataatacctgaaactataaaactgctagaagaaatatagaggaatgctgcttgacatttggctgggcaatgattttgggacatgacccctaaagtacagacaataaaaacagaaatagacaagtaggttttttcatcacagcaaaaagtttgtgtactagcaaagaaaacaatcaacaaagtaaaataacagcctaaggaatgggaagaagaaaatgtttgcaagctatccatcccataaggggtgaatatctacaatatatgatactcaagtaattcaatagaagaaaacaaataacctgattaaaaattgggcaaaaggctcagtcatttctccaaataagatgtatgaaaggccaactgttatatgaaaaggtgctcaacatcactaatcaccaggaaaatacaatcataagtacaatgagttatcacttaacacatgttaagataactgctgtcaaaatgacaaaacatgacaggtgttgaagaagttgtagagaaaaagcaacccttgtacagttggtgggaatgtaagttgttactgccattatgaaaaacagtatggagattcctccaaaagttagactagaactatcaaataaaccagcaatcttacttctgggtatatatccaaaggaaaggaaataagtacgtcaaagagatatctgcatttccatattcattgcagcattattagcaataaccaaagcatggaaacaacgtaaatatctgcccgtggatgaatggataaagaaactgtgagatacagaaacagacaaacgcatacatacacacaccaacacacacacactccagtggcatatcattcagtcataaaaaagaagaaaatcctgtcattgtaacaacatgaatgaacgagaatgtgttcctggtccattcatgctaagtgaagtaagccagacacagaaagataaatactgcatgatctcactcatatggaaaatctaaaaatcacgatctcataaaagcagaaagtagaatggtggttttcaggggctgggatacgtaggaaatgatgaggcatttgaataaacggtagaaagctttagttatgcaggataaatcagttctagagatgtaatttgcagcaatgtgacaagatttaacaatactgtattgtatacttgatatttgctaacagtagattttaagtgttctcaatatctacaaaaaagtatgtggggtgatgtatatgttaattgtcttgattgtggtaacaatttcacaatacatatatcaaaacattacattgtatacatatctcaaaacattacattgtatacatatctcaaaacattacattgtatacatatctcaaaacattacattataaactaaaattatgcaatttttattttttcaattacaactcaataaagctgggagaattgtgcttgaaaaaaaagaaaaaggctttcaagaaagtgaaaatacagcctccagaatggaagaacatatttgtaaatcatgtgtttgataaaagactcatattcaaaatacataaaacatatttttctctaaataagatacacaaattgccgataaatgcatgacaagagtctcagcacctttacccattaggggtatgcaagtcagaaccacagtgaaatacttcataaccataggatagttaaaataataataataaaaaaagataggcaagtacaacttttggcaggtatgtggagaaatccctcctacttcattgatatgattatataatagtatagtcactttagaaaacagtaagatgctttcttaatctattaaacatagaattaccaaatgacctaccagttccacacttcagtgtatacccaatatataaaaacttatgttcacacaaaaacttgtattcaaatgtacatagcagcattattagtagccaaatgtggaaataatacaaaatatacatgaactgatgaatccataaagcaaagtgttatatccacatgatggaatattattcagccttaacatgtagtgaaatactgatctattttacaatatagatctaccttggaaaatatatgtttagtaaaagaagctcatcacaaaacatcacttattgtatgattcaatttatatgaaatgttcagaataggcaaatttatggagacagaaagtatatttgcatttatcaggggttaagagaagggagagtaggaaatgagtgctgatgggtattgggtttatttttcagatgaggaaaatttcttagaattagatagcggttatgttgaacaattctgcaaatatactaaggaaacacagaattgtataatttgaaattgagatatatggatatgttaatttgcttgtctatgctaaccattttactatctattgtacataaaaacttcatattgtgcaccttaaatatatacaataatttttttctaaataataaaagaatgaaagaactgaaagagtgaattttatggtatgtgatttatatctcagtaaagctgttataaaagaaacagatacctaatgagtaatgaaactgtcaaacacggaaacagagtctctaagtaatttgctcactagttactgcaacttctctctgccaggccattatattattagtagtagtatggttatcattgtcattgttatttttgttgctaaacagatgaaaatccagttactatgtaaggatattgcaacatcacattattaccaatgtgtttttaccttattagcaatgtgtttgtttaaaacaaagagatatcctatgtatatttgtaacaatatttgaaagtaacccattttttctaatacaaaatactcattatattaattattataaattagaatgatgttatttattgttattatattcccaaagctctagaatgttaaatgatgaaaagagacctttactgggaatttagagtgggtaacatgtctaaatctaattttgccttttattaattgtgtgaccttaacttctcatttaactccctttgtactggtgacttcattttaaaaagtcagaggtttatctccgaaattggttcagtttgctctaatttttattttttgtgttacaagcataattagtatagaaaagccaattaacctaaggaaactatttgccacagattttgataggcagaattaagatttttaatttacattaaaaggctagacacattattaagaaaagtattgtgaatcaaattaactaataagaaaagggaatgattgtataatttacaaaaaacaaaatcaaaatacaactcatgaagaaacagggaaagtggaaaaatgttcacttaccaaaatgcaaataaaataagatttcttttttgtatgtaaaattttaaaagctttataattatatctaatttagttatagatcaaatgacatattttgctgttataaagtaagtagcaataattttaggtcaagcagtttggcggtaagaattaagattaaaaaaaatagtcacagccttcaacccagtaatcctatttctggaaatccaccttaaaatataaaccaagattgtgtaaatattttaagattaaaatgataattgtaacattatttataatactgaaagtctaaaactaatccacaggatcaacaataaatgagtatttaaataaagtatgttgtagttatactgtaaataaataaaaatgaaggaaatgttgccaaagaaaatatttctggagacttcatactactaaattatcagcaagtgtaggtgaccaaaatatggataattattttatccataatattttacaaagttttccagttttccatgactattcctctgtggtacacacagaaaatttcccatccaaaaccgtttgccatttcttctctactagcaaaatttcgaacttctttttagacaagcattattctcagcattcattcagcagcctttgaaagtgaaggtgacatgagacacagctgtgcttaataaaaatataaatagaaaaaattgagtgaagcttccaaaaaatttgtttaaaatgctttagtttttattggtaccaaccttttgttctctgcctctccttcttcatatttggaataaaaatacaatgctggaggtaaaacaaccaacttgtgacaacgagaacacaatataaactaaagcttcatgctaagcaagacttcgcagaaagacagagggcaccaggattcttgatatcactttggagattgttccagccctggccacctacctccagccttcttaagaaacaaaactaaattcctaacttgtttaagccattgactaattatgcattctgatacttgaggctaaaagcaatctttgacatatacatacgtatatatatatgtatatatacacacacatatgtgtttctattacatatataaatgcatatattataattatatgtgcttgaattggtggggttgtaattttctacataatttcaaattgcatatactggcattataaattgaacatgtatatttgcaattatgtatgtatatatacacagacatcatatatgtgaatgaataggagtacactagacagttaatttcctattcattcttccatatttagctcaaaggaactttctctgtgaagcatcttcattttgctttcttataatttgaatgaacctctaatacaacatacataatcttatattgtaatcatttgtttgtatatctgccttcccactcccactcatttcattgtcagttcttgttgggctgggatatcgactccatcatcatttacacatttaatagatgacaatagattagctcataagcaaacattgtaatgattcacttagatattattttcattttgatggtatctgtttaattctataatattctcaattccttttcaatgccctatgtgctatgatgtatgcaacaggcattcaatgatgtcattaattaactgataacagttgcaatacatgtatattaggggtttctgatatcctgcaaattacatctaatacaggaaacatttggctggatattcgttgatctacagtctagattcaaaatacgagtggatattttcaaatattttcatataatgctttttcagggactgaactaacagcaaatgacctagcacacagattccacaaccaaactgtgtggggacagaccaagttactaccttgatatattcaaatgcgtcacttaatcatttatattttgtgttcctcaatggtaaaaagaggataataatatttttattgggttttgtgagaattcaaagaattaatgtacacaaagctcttagaacaatgttgaatgtatggaaagcactcaataatactttctataaacaatggtttgcagtagggatgcataattagatcctaatctgccactttaaaaatacctctcaagagtctgtctttccaaaatgtctattattttcttttcttcttcattgcttcattaaatctgcagttaattaatgtatttatgttacaataatctaatttagattcagggaatgtgttgaatgtcctcacatagcttctcaatatgaaaataataaataattctgtagactgaataaaaatgaatcagagtgagattgaaattgcaatctcaaaattagattttgtgatgagggatctgtagaccgtaattcaatctttctctttgcttcagttaggttagatgatgttccttggaaaatgtgaagtttatatgttttgtatgcatggtttgtgaagaagtcattgatgggaattgtttatgtgatagtctttagaaagcttgtgtgatgaagctcagctcctataaaatttcacttcaaaaacagccctttgaataccagtttcccattttggagataatcttttattgtcacaaaatatgtatttaaatattatgaaaactaaaaacaaggtaaagtgtctccctaagtacaataaatattgaatagaattataaatttattctagaagagggaaaatgcaaacaactacttccaagcaccctaaaacaaaacagcaattcctttcatagttctaagttatactttctgatgtgaaatgagtaattatgcactgctttattttaatatatgtatataaacataaatatatacttttaattatatttaaggtgtgtatatatgtatgtatacaaaacattttaaatattttttaaagcaaagccaattagatactaatacagtcatcacattacctaaacatttatttattcattcattcagtcattcatcaaagatatgatgaatatctttgatattgtagacttatcatgtattgagaatggctttagggatctgaatataagagataagttcctatactcatggaacttataaaatattttatattttaaatgttatatatttacctgtatttctggatagatgttatgaaaaatgtctttaaatttgtttatatggtgtgtggcttattcaacctgcccatttattttttcgttatgcaagtacgcactgatgatctaatatgagctaaggacttctggtagttattaaggctgttcccaagggcacttgagagaattacacttctccatctgccgccatatgactactttctttagccagtgaaatgtgagtaggagtcttaacttgtgtcacttctgatagatttaaatatcaaagtgattgtggaaggcatggccattggagcctctatttgtctggtgattaatcgaccgcgatgaatagagctccatttcacgtttacattggctgtgtagacggagatgaaagatactctccctgtgttaagccataaaacatcagagttattttgttaatgaggcataacctagcatatgcttactgatatagcaccattgtaggtgctgaggatataattttaagcaaagcagataaagtacctgcccacatggaatttatgttcaagtgatgaaactataactaaaaaaaaataataaactgatacaggatatgatgatgaatagcactaaatgctataaagtttagtaaggagataaataatcagggtggatgctattttggatagaatgctcaggagagtaatttctggaaaggtgatacttcatcagagaccttacttaaagggcaagacccttaggagctgcactagcaacagtgttgcaaaaggcctggcacacaggttccaaaaatgcaagctatgtagtcctgagctcaccagttaggagctccagcaaataatctggagaaattatggggaaatatgatagctctgaggcaagagagtgtgccctgtgaacagcacagagcccaatgtgtctgcagtggactgagcaagggggagacctgtaggagataagtcatctaaggtcgtgtgagtacacagaacaagtgatgcctcatagaccttcatgaaagtaagttagagaagaaagttttgaacacaggcattatgtgatttgacttatgatttttaataatcactttgaattcttgatgaacaataaactctagaaggtaaagagtagaaactggcagactagttaggatgatattgcagtattgggttgttgtaatagcgatgatactaagtgtagactgagctaacaggatttgctcttattttgtaatggtgagatgaagggagtgtggcaggggccagaggagaggagagagagggaaagtagggatagattagagagaaggcatggaaagacgtactcgaaggaaggaatgccacgatgaaggcctggaccacatagaatgagaagtcagatcccattttgaattccagagcagattttgcccccaggctatattaagaggtgaatactcgaactaccacagttactctttcattataatgaatgttatctagaatttccggtagcgcatgctattggtgccctgcccatagtccttgattaattatcatttctatgcttgtgggtgcaaattgcagtcagctatcacctttgccaggagggctctacaggtagacctgaagtagaagggcattaactctctctagggaaagccctcaaacaattacagaagttggtggataaatattcatctccctacccccttgggcagaccctaagctgtgagttctgcaatgatacttagagtttcccagtggggttaggcttcaattgtccagattgctaacatatttgacaatgcaaactttatttcttttcttcccctttccactatgaaaaagtttagatatttcctagtatcagctcctaactaaactatttgtactcaaatctgtttctcaggatctgcttctaaggaaacccaaataaagacagtttatacacggatgaaaatttattgaagttgaatattatctaaagtaaaaccaaaggttttccattctgaaagtgaatcaaaatctgttgatggttcatagatacaatattgcaaagataattacgtttaatccccaaagcaaccatatgatgtttttagggggagcttcttgaaaatgaagtagctatttaaatataagtttaaacatcacaagggaaaggatctgtttgatttactcatgaactccaaagacctggaggagtccctgtcacatacaggcactcagtgagtatttcaaagaatacttaaactaaaaatagttcacatccatcttggaagaatgtttttgatggggaacccaagttcaagaggataactacgtgagctctgaaggagaaaggaactttcaagcaaaggagagacatcaagtgaagcagtaatagcaattaggatagcttatatgaggtctcctcaatggtgtggttgctataaacatttttataggtgccttacctaaggctaagagaagtaaagcatttttttcttagtcccaaaactgatgcatgagagtagctacatttgagctcaggcttgtctccatcttcctgcacccttgcataatctcgaattcttcctgctgactggcctaagttaggcagttagattttggagaatggatgtaagtccaaatatttcttaaagcaaagactttttaaataaaatgaatgccatagtcagttcaggctgctatattaaaatatcataaactgggtggcttaacaaacgtttcttacagttttaaaatctgagacattcaagatcaagatgctggcagactggtatctggtgagggctcttttcctggtttgcagatggctaccttcttgctgtaacatcacatgacagaaagagtgagctctgacatcttcctcttctttgaatggcagtaatttcatcacggaggctccaccttcatgacttcacgtaaacctcattacttcccaaaggccccacctctaaatattgttacattggggtgtagggtttccacatatgaatttgaatggagggaacacaaatactcagtccatagcaatatgcataaattagcaggattttttcaaacttacttctcacttgtaatttgcaattttaaccaaggtttaatctaggaccagaatgggaaagatattatatagaatgctagatgagatccaatagggtgagggcaaaggaaaggctgctatttattattctatatttcaacaagtaaatgatagcatctaaacaaaaaaaaattcctgcaaaatgtcataaattaccacacactaatatcaaagtgcctaaaataaacaaactcctatcatgaagggaagtaaaattcaactaacaggtgttcccacaaaggagaaaataaggtcattcctttgaacctaggtggctgaaaagagtgagaaaagatattctctaataagacttctataataggttcctgaggcttgacagcctaaagccaaaacaaaacaaagaaaaaaaagatagagtccttagaagcagaccagtgaacccatactcacttgcaccttcaggccaagaacacgattgatagttatagtagtacatctaagtgcatttcctcaggtttccatgacctcaatccatctccctctccttagaccttctcatttaccagtcagcagcatgacttacgctatgcatattcattctaccctgcctccagcacagagactcaaacacattctttcatgaatcactatcacaaccttttaacagtttggagtatattaaaataaaagcaattccatttgaatcccatttttttttgtccttggataaatgtaatcaataattaagttgtcagctttttgtagagaatagacatctcatgttgtttttaatgattattcatttacacataattctttgcttgcctaaaaaatatttctactacctcaaattcccagtctaatttaatttttttctctttatgtactaaacatttttgaaatcagcaactctgttattttgtcaaatttactgtaaataatttgggtagagaactggatatgtgacctccagggcatcttcagtcactgaaaatctgtgatcctcttcctaaatctttcgtggactctctccagatgtttgtattactagaaatacctgagagtcctgttttaacagtgtttattaataatatagagccttaaagaacctcataaagcaagattttggtgttttcaagcaagactaacaatccaaattaaggaaaaaaataacttacaaatatcaaaaaacaaaacaaaaagcaccaaagggaagggagtagaaattatgcatttgggctattagacatccttttctcacacacttagtctgtaatatgttacctaataaaatttaacactcaggcatttttctagtgagaatatttcatctttctgtgcactattcttttcctttagtggaatatctattatactcatttgcctgtatgccatgcagtttggcacataatcacacactgtttatacgattctctaaatgcttgtctccttgagagattacaagtaattcaattcactaaagtactgtttctctctttttgtatcagcaacagtattgaagtaaacattatgatacttctcagtataagtgacagtcctgggcacaatgccttcctcataataaattccattattggttggattaatgctcaaatgaataagtacttgctgaattgaagtaagatgaaatgcatactggacaagaatgactgttggtagcaaccactgaaacaatttttgttgtctaagctgttcacacaccatttgtccttaaaggtgcgttgttgagaaagtgcaatgtaccgagtactgtgttaacaacttatataatctaactttatcctcacaataaccttaaagaaaaacagagtcataattacttcattttcaagtaatagagaacttggattggcttaaataacaaatggtataacttgattctagttgcaagtaggcaaggatctgtctcttggctgtacgttagccaagcaggatcctggtaatggctgccagtagctttcgtgtctcccctcttggttgcaagatggctataattacaaagaagacaacttcacaccttgaaagcatgggaaatgcaggggagtttgtttgggagagtctaaacaagtgtctcttagttgagttagccccccatgcctggatcaataactaacttattgacttaagctaatcaggatctcttttaatggagtggtgtcaaattagcactaagagggggaaaaattgaaagaaatactaagcactagttattaaagagtgtggaaatgtgcactagaatgcaaaagtaaaataaaactattatatccattgcatctcttttaaagataaacattgacactctttctacagtcagacttagtatcttagtctgtacacagtcagacttagtatcttagtgaattattctttatttcattatgtcgtttaccaaaatatccctattgatgtgttttgtcttaaattccactgtctgacttatttccagacactgcccccaacttccatctcccttggctaagtgaagctgaaggctctggccagcaggaaaggcgaaggcagaataattgcctgacaggttttggattggaaaggaactggggagggaatggaggaggtagctttcaacctctctctgtcgttttattttaggtgtatatctggtgagtaatataacaccaaaaaattattttaaatataatttcataaattatctgttaataagtgagtttttgtttgtattttttgtaattgtaattaattatatttggacagatctacatcttattttgtgttgtttcttgcctcttttctctgcctctttttattcttctttcttacctctgttgaagtgataggcttttattccttatttttacctttactgtttagaaagccatcagattttttttttcttctttagcggttactcttaaatatttaataaaatatttggctaactttttaagataagaaaacaaaactgtaaagggctaatgttactttcttaaaatcacacagttaatattggcaaaagtgaaattccaaattaagtctgtcttcaacaccaatataataatgcctcccttaaatatttgttcattgtcttcagctctgttatctgccatacaataggtgcttctaatttttttattttggcaatgaaagagattcctgtgtactctcagtattagtaatacatacattttctttttattatacgtcatctgaatggcatgtctctttgctgccattcatttctatttaactgataaaattttaattcgctggctaattttctccctgcaactaatgaccgcccacttgtattttaggaatgtgttaattgaagaaaaaaagaaaagaaacagaatgacttgttcaattaataagtgacaaaatactgttaggagccatatttttgacagcaaaaatattagaccagttaactaatacattcagtgtaggatttgttttttattcagtaacttttgtgattagacataatgctagttaataacattaagtaaatcagttagtacattttgggtgaatattatttttgcattctgagaacccataaatgaaaaacagtttactaggagtttagctgaacatataaaatgaattgattaaacatgtaaagaaagtcataaaacttcatcagtttgattttcggcatgttaagtatatcttaatctggtaaatcaaagtatgtgcaccactgttccaaggagaaattttgaattaatttttggtaactttttggagtcctgctttctgtctttttctcttaacttatactggaagaaaactgtttcactgatgtttcatattcaaaactagcttgactagttttaaccttgatgtttttaatacacactaatattcgtgaatatttctatttgagtagaagtgaagattcatatgaggtagtctgaaagtttgaatgtcctcaattttataaatgaatttaaaacacctgattatttctgaaacaaaaattgctaaagaaaaaatagagtgtatatatgaacctgtatttaaatatttgatatgcctggatcagttagagagatctctaaatcaaagaagctggccaagccaagtgaattggagaggaaaatactgagatcatcagaattagagagtagaggctagttagacaccaaaccacatgcaataaccctcagaataaaatctgaggaactgtgtcaatcatcaagtttgagttggtcttgggtaaaaaaatggcagtagaaacactagcaactttttgacatgagaaggtagttaaatttaagtttcaagggaaaaaccataaatcattggcatgattatatttacaatttcgatattattacagaatatttgctaaactccccataacaacgccttcggagaccctgtgtatcatgcaaaggtagatttagtcaacttgctaaataagggagagcacctgcttaagagagagagaatgagggaagagtcatgtagggtttatggacctcgggttagacacgtactgtacaaggcagatggtcataagtgaagtctagggagggattgatcagaatttgtaaattaggtcagttgccagaactgtccatgagcccatgcaatcaatgaattgaactgctaaatcagcttgtgattttatctagaaaaatacacatgtgaacaaactggtgctaaaagaatttaagcttagtttgtctgtcaggatatggtctttacagttcatctgtttttcaagtcaagtagaatttgtggtttgtgtttcatttcgtatctagtattcagaacagtgtcttcccttttttatttactctttacccatagcccttccatggcattttgactgggtcttgtagtttcatgtgactattttacaattcaccaaaaaataaaactaaaccattatattgcttatgacatttgcctagtgactcttttgtcctgttctagacttgccttctcctgtagatcttaattctaagcatcctttctctctggttcaaaacaaatctttctggaatataacttccctcagtgttttgagattttcaaatgttgcccagtttcttaaatatatgctacttgtaccaaggcacccattcatattcaggactgttaaattgctagataatttaggaggaaaaaaaatgaatttttattactttttaattcaacttgtgttttttcttgtataaaattaccatgatttttgtttttatctttagcattagacttaaaaatgtgttgtacacaggtcatagcagcttgctttggacttgtgccatagatctctgaggatgcaaactcattcacctctactgttcattgtacccagaggaaaagcttaataagtactgctgtaacaaaatcatattattaaatagagtaaaatttattgacataaaccctataaggtttaatatcccctaatgtttgaaatattcaggttttataattttcacagatctagccaatattttattagaaattatgagaaagaggatatgctgcataaagtcagaactaaaatccgcaatattgtaagttggagtaaagaatgataaactaccaggcatggtggctcatgcctgtaatctcaacactttgggaggctgaaggaggagaatcacttgggcctaggattttgagaccagcctgggtaacataatgagacaccatctctacaaaaactaaaaatgaaaattaaaaaattaaaaattattcaggtatagtggtatatgttgtagtcccagttacttgggagactgaggcaggaggatcccttgagccaggaaggtcaagactgcagttaaccatgattgcagcactacactctagcctgggagacagagtgatatcttgtctcaaaaaaaaaaaaaaaaaaaaaaaaaaaaagaaagaaaagaacaagcttaaatatcctggtcttgacattttttttggttcatataacataatgttgatttttttgttcttatcctaccaatttaacttgctcaatagtcatatctttgtaaaatgtcagcaggaaattttgattccattaaatcaagccaattattgctggtgctaatcatcatgtttttatctgataagataaaataacaaagtgatgtttctaaaatttatgtgtctgtgttatgggaggggttccactaatatttacatttaatttttgccttttagaaatgaaaactataaatacttataatgacataatagacttgatggctgatttgtttcattttcattattgaaactctcacatatttgtatttgttactgatattttcactacttattttaagctttgataatacatggaaaattagaagccattacaataagtaaacaatgagattctccagcaagatttggcacacataagtggtctgttttgtggggttttttattttatgtcattgtttttattttactttccctttttgaaagtaaactaatcaacagacttggctagacacagcatctccaagttggaaaatgaagtattgaacactgggataagctacagaatatatattctatacattcaccaagaattccatttagcaatccatgacatgggaacataaaagtttcatacagtttgctaaggctttgataaattttatgttgaatattttgaggcagatcctgaaattctgaggatattgaaccacctttacagccaagagacatttccctttggcttcaggagagattttacaccttgtaacagagaagaatcatggagcctgcgtgtttgggcctttcagtctcctcttaaacattacagcaaaaataaacctaagacttgctattatggaacagcttgagttgctgggaaatataatcagtgtagatatttgtgtatcattgtttaccatttctatgccctttatctgagttaatgaaacacatctggggtatacgttttgaaggaaaatgaaaaagatctgcttatcctcacttaaaatacattctgttcatctccacccagagcattagaaaaaataggtaaagtaagctatctgagatagcttctgagaataatggtttcattttaaatgggagaatgcctgaagggatttctactgtaagggtaaagaaaagactgacatgcagaaataatgtctacagtaagatgagtgaccttccttttgaaaggtggaaggaagaatgcctagaaatgtcagatgcataagactaaaaatggagatgtttcccattctgaaatttatttttgatctttgggttagagcttcagatagtactgcaaaagctccctgagtgactctaatctttagcagtgttgaaaaccactaaaaaaaagcaagtcttatatttgacagaaaacagggagatagaattagagagagagaaagaaagaaaggaagagaggaagagagatgggagcagggacgatccggaaatatatagagcattaatatcagaaattatatggttctagcacttagttattgtttcttctgggctcttagtgacctagggtacccagaagatgtctggtccatgagatttttacaaccagatgcgaccttgaaatgtaaatggactttaagagattgtgtgacattatgaagtgggtccttatttgccacataatgcctattgcatgttaaatgctttaattatttatttgtttaaattaagcaactctcaacaatatagttcaaagagtgctttcaagtggagagtagagcataatatctcccaagtttctgggagactgtttcagctacaagatatacgaatgtcaccctatcaaaggcctgacctctgtatccccttaggcctcaatggtatgaattctactcactggggcaaaatgtaccatatagtaaagccatgttcttcttaaaatacgatgtacataaccaaacacagtattttgtgctcaattttgccattgcagaggatagacacttatcttccttgatctggatattatagttcttaacgctgacagctcttaatgctgccaaagtttcatcagcactctggctgctttatcagactctgcttatcagactctgcaattgctttgagcttgcagtgaatatttgtcagggagtgcttctggaaagcagttctaggttgccattctctcagaatcagatggagtgcttcctgcaggtctagattcttgggcccagatgcactgaatcagaatttctgacagtagagcccacaaatctgtaagtacaatacattccctgggtctttctaaaataccctaaagttgagaacaggtcttctgtttatctgtgaaaaatgaaaggggctattaccacctataaatatgtagatttgtgatgaattgggcatttatgggaacaacaagaatattagtcaaaaacagacctggggttgagtctgagactaggaagtggcagcagaatttttaaatttctaattctatattttcatgatttaactacctatcctctaattcagtgtttcttaaactttagtgtgatcagatcgcaaggagctgatagaatccaagcttaccctttcaaagactaatttttaggcaggtgttggggcccaggaattgcctttttaacacgcagtcaggtagtattgtgaggaaatgatccacaggttgaagtctcttgatcctgttcttttgtctcttccaagatgttcttcccttcaggtctcttttttttttattgcctcctcatcttctctatttctttgggttcttctccttagtttgagcagacttaagccactcatatcctaagattattttcttatcaatttgtattaattttctagagatgacataacaaattacccacaaactaggtggcttaaaacaagagaaatttattgacttgcatttttggaagctagaatcctgaaagttctattggtatcatcaggccatgctgtctctgaagcctttaaagagaaatccttctttgtgttttgcagcttctggtacttccacgtatccacttctggtacttccacgtatcccttggcttgcagcaccatgattccaatttctgcttcagtcttcacaaggctgtcttctctctatgtcagtatgtctatgtcttcacatggcattctcctccctgtgtttacattttcctcttctaaggatctcagtcatattgaactaggtcccactctcatcaagtatgacctcattttaaattaattacatctgcaaaccctgtttccaaataaagtcacgtccatagctatgattaggacttaggacttcaacatatctttttaggaaacacaattcaatccacaacaaaactgtatgttccagtctaactacttccccatctctctccttttttcagcgaagattctgaaacaaatagtttatactgattgttatcacttatttaccacctacttactgcaatctggctttggatgttactaccattgacagttctggagtgaccattgaagttaattgacaaatctaaagaatgcttgttagttcttgccttacttgttacttttattgcactccagagtattgaatgttctcatcttaaagcttttcttatttgaactgacctaagtcagcctgcttaagtacaacttttagttttactttggtaaattgctatagctgtgaaagtaaattattacaaaagcaatctatgataaaattctgccaaacttgtagataattttaactacactagcacaaaacttgagccattgtgccattaactaggggatcttactgttctttgtcatttaaatgtttcaatcacactttgaatttaaggtttactaaaagcagatacatcgagtgggaattctattattttgcataacctcatgcatgatatcacactgctcatacaaaaaatatttaaaattaaattatagatatctttgtaatgtaactctcatcttgatttcttgtcacatctagaaagcctattgccaagtaatgatattacaacaattttagtggattaagcaatatacatttattatctcacagtttgttttgggttaggaattaaaatatggcttagctaggtcttctgcttagtgtatcacaagactgagatcaaggtaatcttcaaaactgtggtcttatccgaagctcaactggaaaagggttattataagatattatgattattataagctcattcatgttgttggcagaattcaattctttgtggttgtagggccgttaggtcttcaattacttgctggctgttcactggaggccaccctcagctcccagaggccccttgcaattcttactacatagggttccctagtatgactctttgctttcccaaagtatgacttactttgcttacccaaagtaagacagggagaccacagacgataggtgctacaatcttatgtaaccatctaatcatatacccaaatcatatccattctattatttagaagcaagtcacagatccttcccatgcccaaggaatggggctcacacaccggcatgaacaactggaagtgggcatcattggagccactttaagtgtcttctgtccacaaccctaagtctcctcactgtaaatatactgcttaggtatttgcatcttcatatgtgacttcaactgccagttatgtactgttgcttccaaaatctatgtcccagcctctctgtctatcctaaaatgttaatccaaatagtcaactttcttttgatattttgatgtaaatgtagtcatttttatgtggacatcaatctcaacacaattcctttctcttcagattgctcctctctctttttaccattgtgaataatgatgcatcctatatccagtgtgcatgggacacaaacctgagattgtgatttaattattctcgggtggaactgagtcatcacagtttttaaaaagcttccagatgatttaatttgcagctataatggataactaatgatctataacattactctattttgtctgcttgatattattatgcttatttccttattttttttttctatctctcttctagaatgtaagcttcttgaaagcttcttcatcaatatattactgtcttagatggttaggtctgctataagaaatacatagactggatggcttaaacaacaaacatttaattctcatggttctggaggctaggaagtctaagataaggtatcagcaaatttggttcctgatgaggcccttctttctggtttgcagatagctgccttgtggctgagaaatcatctatcttgagtctccttataagagtgctaattctgttatgagaaccacaccctcattatttaattacttcctagaagtaccccttccaaacactaccatattgaggtttacgtcttcaacatacgaattttgagaagacataaacagtcactaacatacattacaatatttggcatatagtaggtatttaataatttgagtaattgataaatactacttattatatgtcagcattatgataagtgctctatacagatgttacttgacttatgatatggttacactcatcctgacaaacccatcataccatcataagttgaaaatattataagttaaaaatttatttagctgggtgcactggcatgctcacgtagtcccggctatttgagaggctgagatggaagcattgcttgaacccaggagttcgaggctgtagtgcattatcatcacatgaataaccactgcactccagcctaagcaacatgtagagatggaaaccccatctctacaaaaaaaggaagaaaaaagaaaatgcattcaatatacctaagctaccaaacatcatagcttaatctagcctaactacaaatgtgctcagaacccttatattagcctacagttggacaaaatcatctaacacaaagcctattttataataaaatattggatgtcttatataatttattgaatactgtaccaaaagtgaaaagcagcatggttatatgggtactcaaagtatggtgtgtactgaatgcatgatgctttcacacatgcttcacatggtaaagtaaaaaaaaaaatcataagttgaaccatcataaattggagaccatctgtatacattattttattaatcctcacaaaaacgtatgagtctattttcaattccattttttaaaaaaactgattaggtaaatgtagtaaagcaatttatctgaggtcacatataaagtaaagctgtgattgaaactaagtctgcctaacatcaaaactcatggttctgaccaatatgctaaacatatgctttccagctacatgtatttattgccgaagttgttataccttttagtgtgttgtttcttttttggaaaagcctatttctttgctgattcattaatccactgtggtaggattaaaagtcagatcatgtagctccaccagaatatagttatcttttcatgttgtgcatgaccatatatattcaggtttctgcttctggtggttattctaaatgcagttattatcaagtaatgcttaccgcttgccaacaatgtgctagacacagagcagagcagagcatctgacatgctttccattctgcactctgatccataactttcatccataaatctttttgcaattttacaaacatgcattctccaaacattcccatgaggtaaatgaatatttattatatccactttacagatgcataaagttagatgtagactaattaagtaagttcttcaagggcagagagtgagttggttggaaaatcaaggttagcattgaacattctggatgcctgcttctaaaaggaatgaatggtgtgttaagttgatttcactatacatagttgaaaatgtttattttaagctttcatgatatattttccattagtttttggacattgcccagaagaattcacagtaaattaatagtcagcccttagatatgtatgcagtttgtgtctgttggcttctgtgggagatgcaaaaatgaaactgaagaaagaatttagcccatagtaattacatcttcctgtagagattctggtaattatgtttggatatttttttcactatataatttaaagttttgtatttagtaatgtacctctaatttagcatatagaagtaagcagctaattaaactgagattactttctactcacagccaacatttaaaacatagttattattacaaaattttttaaagttatattactttttatgaatatgaactcaaatcaaaatgcatagcacaataacataattaagaaagactgtattagttcggtgtgttgccatttaaagatccaaattaaaactatatgcttttcattccaccaaatggtagatttttagaaccataaaagatccatagttgatttgtggactcacaactggtccttaaacaacatgatacatctttctgattcttttgttattcttattttttaaatgataatttgatttaactatacagatatgcaactatatatgtataagcatcacctctgtgtataattttcaatttgttcagattttgagattttgtcgaatctatatttaaatttagatgcatggtttatgctcaaaatcattttgatggaaataatattttattatagtccaacaatgctataaataataaaaggaatgaatatacaaggttaaataggactttattttcatctgtatatactgtttgaatcactgatgagcacatgcactaatataaaatttcctgttaatacatgccaaatcttgttgtagatgtgtgtcgtagaaaggtaggcattagatataaatctctataatgaatggtattttaataaggcaatctttaactttctgtttcacaagcttctattgagaatttgttgggaccattttatggtatcttaataaatttgctgggctatacattttataaattgacttcctaagacagctaccccattaataggtaaatagataatacttccatttatttattatttctgaaggctttccacctatttgcaagtattagtggacctgtcatgaagaagaaaataaaaatagattgaaatagtacaactggcagtgtgattattttgtattctaattgattagctgagggagaattatgtaactttcatcagttggactaaaactttaaatcattctaccaatagaattccttttaatcatttaccaaatttctcaccaccaaaatttcacaccaactttcacctcctttaccattcccaaacctagaaaacattattttgttctccattctaaatttttttcatttcaaaaatgttattgaaatgaaatcatatattatatgatctattaaaactggcttttattaactcagtataatccattaagaataatctaagttgattgtataaatagtgtgctgctttctattactgagaaacatggtgtatttataccatggtttgtttaaccattcaccccttaaaggacatttggattacttctggttgttaagtattatgagtaaagccactgtgaaatttgtgtacaagtttttgtgtgagcaggtttcatttctctgaagtaaatacccaagaatacaattgctggactctatggtgtattcacttcctgttgccactgtaacaaagaaccacagtgatttaaataatacaaattttgttatcttacagttgtgggagttagaaatctcagtggcctaaaatcaaggtgtgggcaggtttgtgttccttctggaggttgtaggggagagtcggcttcctagttttttccagcttctaaaatgtgtccacatttcttgatcatggcaccatccttcatcttcaaagccagcagcacagcatcttcacatccttccctctcttgcttctttctctcacctctgcttctgttgtcacatctcctctgactctgactgtcctgcctccccgttctgttataagtattcttgtgaacactttggatccacgtggacaacccagattaatattcctatcctagggttcttaatttgatcacttatgcagagtcccttttataagtaaagtaacatatttacagcttctggggattagggcatagacatctttatttgggggataggagcagagaagggtggcatcattctgcttactacatatagtaggtgcacatttagttttatgagaatttatgattgtcagcttcctggaattcatcacacacatacatgcatactcatacacaaatgtatatggagaatgtacatataagttgcatagttcttattattaatattcaaatgaaggaagtgttcccattcctgaagagaagtaaagatttcctcttactaaattgctaaggaaatttctcccttggaaactttacaaaggctacactgagagaaaataacctagagttttataatgaacacatacatgatttttcatttgtcaatttcttacagtgacctgatgaaagctgagagcataatattgaagtccagctctgtaaaggcatttctgctaatgtgatcttggtatccagctgaaaataataaaatatgctcactagaatttcccaattaaatatttgcttaataatgaaatttgctttaattttccattgaaaactcgcttcttttttattttattttattttatttatttctttttttgagatacagtttctctcttattgcccaggctttagtgcaatggcgcgatcttggctcaccgcaacctctgccacccgagttcaagcaattctcttgcctcagcctcccaagtagctgggattacaggcatgcgtcaccacgtccagctaattttgtatttttagtagagacggggtttctccatgttgatcaagctcgtctcaaactccggacctcaggtgatccaccctcctcggcctcccaaagagccgggattacaggcgtgagccactgcgcccaccctaatttttaaaataatcagttatttattttccgtggattttcccctctcaacaaaaaaaaattttacacaactttttcccaatattttctttaaatcatcagcaaaaaatatgaaattacatttcgtttttaatattctatacttttctatggggatgcctgctttattttacaccaatttgcaaagataaaaatgattatatgaaatacataaaatttattcttaattgctctgaaaataaaccttaatatttataagcaatgtgatttgggcattatattttaaaagcttaagtcaacttgtcataaatttgcatccataaatctaatttagcattacacagttttttttttttacttttacattagattatgagagtacatatgcaagtttggtacctgggttatattgcatgatgctgaggtttggggtatgaatgatcccatcacccaggtatggagaatagtacccaaccgttaacttttcccactcttgcctccctccctccctccatgccctagtagtccccagtgtctattgttgctgtctttatgtccatgagtacccagtgtctagctcccacttataagtgaggacatgcagtatgtagttttatgttcctgtattaatttatttagaataatgttttccagctgaatccatgttgctgcaaaggacatgatttcatttttcatggctccatagtattccatggtgtatatgtatcatattttctttatccaggccatcgttgttggacatctaagttgattccatatctttgctattgtgaatagtattgcgatgaacatgtgagtgctgtccctttacggtagaactatttgtttacttttggatatacatccagtaatgggagtgttgggttgaatggtagttctattttaaggtctttgagaaatctccaaattgttttccaaagtggctgaattaatttacattcccaccaacagtgtataagcattctcttttctccacagcctcatcaacatctgttgttttttagctttttaataatagccattcttactggtgtgaggtaatatctcaatgtggtttcaatttgcattctctaatgattagtgatgatgaacattcttttatacatttgttggctactgtatatcttcttttgagaagtgtctatttatgtcttctgcccgctttttaatggggttatttgttttatgcttgttaagttgtttaagtttcttacagattctggatattagaactttgtttgatgcattgtttgcaaatattttctccagttctctaggttgtctgcttcttctgttgatagtttcttttgctgtgcagaagctctgtagtttaattaggtcccacttgtcaatttttgctttcattgcaattgtttttttcttatttgtttttgtttttgttttgttttgttttgttttttgagaacctaatcataaatttttttctcaaggcccatgtccagaatggtgtttctgaggttttttttttttttttccctaggattcttatagtttgaggtcttatatttaaatctttaatccaccttgagttagtgtttgtgtatggtgaaaggaaagggtccagtttcattcttctgcatatggctagacagctatcccagcaccatttattgaatacggagttctttccccactgtttatttttgatgactttgtttcagattagatgactgcaggtgtgtggctttatttctgagttatctattctgttccattggtctatgtgtctgtttttgtaccagtaccttatagtataggttatataggctaatgcatagtatagtatagtatagtataggtatagtatagtatagtatagtatagtatagtatagtatagtatagtatagtatagtatgtatagtttaggttacatactacattataatataagctaatttgtagccttgtagtataggttgaaattgggtaatgttatgcctccagctttgctctttttacttaggattgctttggctattcttggctctttgtttgttccatatgaattttagtataatgttttccaattctatgaaaaatgacattggtggtttgataggaatagcattgatctgttgattgctttgggcagtatggcctttttgacaatatagattcttgaatttcatgagtatgggatgtttttccatttgcctgtgtcatctatgattttttttagcagtgttttgtagttctccttttagagagctttcacttccttgattagatgtattcctagacactttattttattttttgtagcatttgtaaatgggattgtgttcttgatttggccctcagctagaatgttatcagtttatagaaatgctactgatttgagtacattgattttgtatcctgaaactctgctgaagttgtttatcagttccaggagttttctggcagagtcttttgagttttctaggtatagagtcatatcatccacaaagataagttgaattcttcctttcctatttggatgccttttatatctttatattccctgattgctctggctagcacttccagtactatgtttaataaggggtgctgagagagggcatccttgtcttgttccaggggaatgctttcagtttttgccctttcacttggctgtgtgtttaacatagatagctcttattattttgaggtatgttcttttgatgcctagtttatcgaggggctttaacatgaagggatgttggattttatcaaaagctttttctgcatctactgagatgatcatatggtttttgtttttaattttgtttatgtggtgaatcaatttattgatttgcatatattgaaccaaccttgcatcccaggaatgaagcctacttgatcatgataaattaactttttgatgtactgtggaatttagtttcctaatatttcttttaggatttttgcatctgtgttcaatggggatattgacctatagttttcttttatcattgtatctttggcaggtttggtatcagggtgatgctggcttcatagaatgagttgaggaggagtccccactactaaaatttttgaaatagtttcatatagaatattctcatcttttcctcttcttcttttcttctgacaatttctcacttgtcttctgcacctcatatttgttttgtctgatataagaatagctactcctgcttacttttggtgtccatttgcatgggatgtctttttccacccctttaccttaaatttatttgagtccctacgtgttaggtgagtctcttgagagcaacagatagttggttggtgaatttttatgcattctgcaattctgcatcttttaagtggagcatttagaccgtttacattcattgttagtattgatatgtgaggtactattccattcatcatgctatttgttgcctgtatacctttttttctttaattgtatttttgttttataggtattgtgagaattatggtttaaagaggttctgttttgatgcgtctccaggatttgtttcaagatttagagctccttttagcagttctcatagttctggcttggtagtggcagattctcagagcatttgtctgaaaaagattgtatctttttttcatttatgaagcttagttttgctggatccaaaattcgtgcctgataattgttctgtttaaagaggctgaagatagggtcccaatcccttctagcttgtagaatttctgctgagaaatctgctgttaatctgataggttttcctttgtaggttacctggtgcttttgcctcagctctcaatattctttccttcaccttgactttagataacctgaagacaatgtgctgaggcaatgatctttttgtgatgaatttcccaggtgttctttgtgcttcttgtatttggatgtctaggtctctggcaaggccagggaagttttcctttattattcccccagatatgttttccaaacttttacatttcccttcttcctcaggaataccagttattcttaggtttggttgtttaacgtagtcccaaacttcttggaggctttgttcattttttcttattcttttttctttgtcagattgggttaattggagaccctgtcttcaagctcagaagttctttattctgcttgctccagtctgttgctgagaatttccagagcattttgcatttctataagtgcatccattctttcctgaagttttaattttttttaatttatgctatctctttcattgaatatttttcccttcgcttcttgtatcttttttaaaattttcttagattgggctttgcctttctctgatgccttcctgattaacttagtaactgatcttctgaattctttttcaggtaaatcagggatttcttcttggtttgaatccattgctggtgagctagtatggtatttgggggatgttaaagaaccatgttttgtcatagtaccagaattgttttttctggttccttctcatttgggtggctatgtcagagggaagatctggggctgaaggctgctgttcagattcttttgtcccacggcatgttcccttgatgtagtactctctgtctcttcctagggatgtggcttcctgtgatccaagctgtagtgattgttatctctctctggatctagccacccagtaggtctaccaggctccaggctggtaccgggggttgtctgcacagagtcctgtgatgtgaaccatctgcaggtctcatagccatggatagcaacacctgctctggtggaggtggcaggggggtgaaatggactctgtgagggtccttggctttggttgcttaaggtattatttttgtacgagtgggcctcctgccaggagctgtagtagtatggggaggaagaagtggtgggcaaggccctagaactcccaagagtatatgccctttgtcttcagttaccagggttggtagggagggaccattaggtgagggcagggctaggcatgtctgagctcagcctctccttgggtgggtcttactgaggctgctgtggggatggcggtgaggttcccaggtcaatggaattatgttcctaggaggattatgcctgcctctactgtgtcatgaaggttgtcagggaagtgggggaaagccagcagtcacaggcctcacccagcacccacgcaacccaaaagtctcactcccactgtgccccctccaacagaaccgagtctgtttccaaacattgggagagcagggctgagaacttgtcccagactacctgcctgccagctatgagagcagttagggcttttgttcttccccggcctgtggagtcagcacactggatttgcacactcccccaagctctggccaggagatttcctcaatgggttgaaattgttaaaaaaaagttcgactggaaatttccttccttctgtggccttttcccagtgcctctggctgccctccccaagggcctctgagaggcagggaagaaatggcctgctaggggacccagcaagcccacagggcttttcctgcttcttcctctacttctgcatttcacttggttctctaatttgtttcagctctagggaaggtcaaaatcttcttccatgatctagaccttcaggttccccagtcagggtgtgtgttcaggggcagacaattcccctttctacttccacagtttgggcacccacattatttggggtgtctcccgggtcctacaggagcaatccacttccttcggagagtctgtgggttatctcggctcttctggtttattcctgccgaggttctagagcaaaacgtcacaatgtgagtctctacacactgctctgtctgcaaatgagctgcaatctagtcttgcctccagtccaccgtaatgttccccttttcccaagtctcatcttaatggaaagacgatgggccaggctgccacctcctaagcctttcagtgcccaggaagtcattgtctcccaactgggccctcagtttacagttttaacatgagatcattgcaactctgatgctgaactagtgtttagtgtttaaaaatagcctttttagtaaaatggtaaaagttaataagtgatcatgaaataatttcatcttttccttaatgaaatcaagtgtgcattcacaaaattcatttggtcagtgtaattactttcttgagttctatgtgcatggcaaatgaaaaataatgttgtacgaaacttaagaaccttccaaaaggtgcctgagtatgtgattttgtgtttaacacttcactgcaaggcccacaggtatcagacaaatataatcttaatgaaaaaattttgataggtgtttttaaacactcaaaacctctgcttatgaaagcttctctaatatttctcaattcaatgtttaagcactaccttatttgctcataaataaaaatattttgtctttgatattaacattttatgtatttctgggtaatttatttatctagtgataagtgtgatttctaagttctgtacagctttattcaggttgatgaaatacagtcatagagatcttatttcaggtcttgcctctaagaccttgggctctgttctgattagcacaagggagagtgggagcttagcaactataagtaggactttgagagagaagtataaaatgaatagggacagcattgtcctggacatccctttccaaattcagtctgagcatcccacatctgacatcttggtatgtttaaactctggcatcaccctaggaaataacatttcttgtccactgttatctacctttcaaatcaatagccctgaaagccactcttccttgacttgtgacaagagttaacacaagagtctttttccaccaaactacttatctgacactaaggacaagtccttctgtcagatgagacaataaaatactggtaatgttacagtgtaaatttgtggtgatttagccttcaataaaaactatggttttacaaagcatatttagaccacttccaattttattgttttatatatcatgaagtaattttacacacacacacacacacacacacacagagacacacaatcaaaatagaattttttacaatttcatgagaagggaatcaatcttcagattgttaaacactaaaagcacccctatgcttgcctgtaagctggaatcattttttaaaatttttggtaataatcacataatatgaaaaccaccttattaaaaaatgtttaagtaagtatacagtatggtatggttatctgtatgcatattgttgtacagcagatctctagatttcatcttgcataactgaaactctatagccattgcttggatgaaggagaaacaggaaattggtgtgcaatggtaatagagcttaataactttgtgttgatttttgtatatgatagggttctagtttcattcttatgaatgtggatatccaattttcccagcaacacttattgaaatgatagttcttttccaatgtgtgttcttagcccccttgttgaaaatcaattggctgtagatgtatggatttacttctgagctctctattctgttccactggtctatatgtctgtttttatgccagtatcatgttgttttggttactatagctttataagtttattttgaaatcagatagcatgatacctctaacattttttctgtttgctcatgattgcgttgactacttgagatcttttatggttccatatgacttttaagattcttttttctatttctgtgaagaacgtcattagtattctgataaaggttgtattgaatttgaagattgcttcaaattatttgtcttctattccattttttttcaccaatgttttatagttttcagtgtagagatcattcaccttcttggttaaatttattcctggcgatatttttttttgtagctattataaatgagattttttttgtgtgctatcagcatatagatacactactaatttctgtaggttaattttgtatcctgcaattttactgaattcactagttctaacagtttttttgatgcattatttagggatttctatatataaaatgatgtcatctgcaaaaaaaagataatttggctctcaccttttctatttggatgccttttatttctttttttctttttttttttttcttagacggagtctcgctctgtcacccaggatggagtgcagtggcgtgatctcggctcactgcaagctctgcctcccaggttcacaccattctcctgcctcagcctcccgagtagctgggactacaggtgcccaccaccatgtccggctaattttttttgtatttttagtagaggcggggtttcatcatgttagccaggatggtcttgatctcctgacctcgtgatccacccgccttggcctcccaaagtgctgggattacaggcggccttttatttctttatcttgtctaatagctctagctatgacttccagtactaagatgaataaaagtggtgaaagtaggcatccttgtcttgttccagatctttcaactttttcctgttctgtattatgtcacctgtggatttataatatatggtttttattgggttgaggtacatacttgctatccctaatttgttgagagtttttatcatgagaaaacatagaattttctcaaatgcttttctgcatttttgaaataattgtatgttttttgtcctttattctgttaatgtgatgagtcacacttgatttgcatatgtagaaccattattgtatccctagtgtaagtcccacttgttgtgggacttttttactgtgagtgactgtgactttttactgtgctatttaattcagtttgttagtattttgttgaggatttttgcatctgtgttcatcagaaataatgacctataattttcttgctttgttatgtccttgtctgattttggaatcaaagtaattcaaacctcatagaatgattcaggaagaatttcatcccttcaattatctgaaatagtttgggaagaattggtattagttctttaatgatttggtagaatacagcagtggaggtgtcagattctgggcttttcattgctggatgaattaattattgattcagtcttgttacttgtcattagtctgttccaaagttctacttcttcatgcttaaatcccggtagcttgtatgtgtccaggaatttatccatttcttgtctcttatgatcctttgtatttctattgcatcaatggtaatgtctcctttttaatctctggttctatttatttgtcttctcttttttcctagttactctggctaaacatttgtcaattttatcttctcaaaaaaaaaaaaaaaactcttttgttgatcttttgtattgtttttgtcatctttatttcttttactcttgctttgatatttactatttctttccttttagtaatttttggtttagtttgttcttgttttactagtttcttgaggtgtaatgttaacttggttgtttaagctcttcctggattttttgacattgatgcttgttgccatatacttccctttgagtactgcttttgctgtatcccataggttttgatatgttgtattttcattttaatttgtctctaaaattttaaaattttgcttttaatttcttagttgacccattggccgccaagagtgtgatgtttaatttccatgtgtttgtatagtttcctgcttttactgattctagtttcatacactgtgattggaaacaatacttaatatacttttaatttttaaaaattcattaagacttgtttagtagcctgtcgtatggtctattctggataatgttccatgtatatgagaggaatattctgatatatccctctctgctacttttggaattctattaggttcattttctctagagtgaagtttatttccagtattttaaaattaattttctgtctggttgacagtggaatactgaagttttctactattattgtgtagttatctttctttatatctattgatatttgctttatatatttaggtgcttcaatgttgagagcatatgtatttaaaagtgttatgtcttcttgattaattattccctttatcattaagtaatattctttctgtctcttgtgacagtttttaacttgtagtctgttttatctgacttcaatatagtcacccgtgctctcttttgattaccacttgcatgggttgtcttcttctatccttttactttcagcaaatatttggccttgaggctaaaatgggtcttttggaggcatcgtatagtttgatcttgtttttttaatccattctgcttttctgtgtctttgattggagaatttaatccatttattttcaaagtaattattgatatgtaaagagttactactgatgttaccgggtggtccttgctcccagagctcccaagatgttggcaggctgattccaaaatggcagcaggctgcttccaagatggtggcaagcctcgtgttctctgacctggggttcttggcctcatggattccaaggaatggaatcttgggccatgtggtgagtgttatagctctattagaagctgtgggtcacagaagagagctggggaacccagtgactagtgttcagctcgattaggacgaacccgggcacttagccgtgcaggaacaatggtaagcctttagcctgatcgggagcggcaatgggtgcctccccggatcaggagcacagtggacaccctgggacaacctgccagatctggagggatggaagtcaggggcgggtctgagatgtcagcaaacagcagtggtggacagcaagacaaaagctcagctccagccttaacaaacacagagcagaagagagtgcatttgcaagatttaatagagtgaaaacagagctcccatacaaagggaggggacccaaagagggtagccgttgctggctcgaatgcctaggtttatatcccgatcattgtccctctcccagtgctttcaggcaatagatgattggctatttctttacctcctgtttttgcctaattagcattttaatgagctctctttactacctgattggttgagtgtgagctaagttgcaagccccgcgtttaaaggtggatgcagtcaccttcccaggtaggcttagggattcttagtcagcctaagaaatccagctagtcctgtctctcactgacattttgtaatttgttttctggttggtttgttgctctttcccccctttattactctcttgttatttatctttttgatgtcctgattttatgtagtgctaagctttgattctttcatatttatcacttttgtatctgctatagtttttggctttgtggttgttatgaggcttacataaaatattctattgttttaacagactattttacactgataacaacttaacttaatttgcatacaaaacctctagatttttaccctccctcccacaatttatatttttgatgtcacaatttacatctttttatattatggaattttaaaaacttattgcagctatcattatttttgaatcttttgacttttaacatttatactaaagatatatatactatttatagagcaccataacagtcttggggattctgaatttgactgtatatttacctttacctgagaattttttactttctaaaatttttatgttatatctagtgttcttttgtttctacttgaagaacttccttaagaatttcttctagggaaaatctagtggtgatgaattatttgacctttgcttgtctgggagaaagactatttctccttcatttcttaaggatagctttgctggatatagtgttcccaagtggcagggttttttttgtttttgtttttgtttccagaacaatgaatatgtaatctcattctctactggcctgcagagtttctgctgaaaaatccactgatagtctgatggagattaccttatgcatccgacttgatgtgtttctcttgcttcttttaaaattccctgtttgtctttactttttgacagtttaattacaaatgccttgttgaggacaatttttggttgaatctgtttggcaacttttgtgtttcatgtatctggaaatccatatctctttgaagacttgggaagtttctagcaattacagcattaactaagcttactgccccatttttgacgctttcctttctggaaatcccataatattgtttgtttacttaatggtgtcccataagtcccacaggctgtcttaattctttttcattcttatttcatttttatcctctgactgggtaattttacatgatgtatcttcaagttcagatattctttcttctgattcacctagtctgctgttgaagctctatattgtattttttcatttcacttgttgaattcttcacctcttaatatttctgcttgtttcttttttatatccatctctttgctaaatttatcattcagataatgaattgttttctggatttcattaaattgtttatctgtactctcttgtatctcactgagtttccttaagatcatgattttgaattccctttctggaaatttgtagatttatttttccttggggtctgttgttggacagttactgtgttcctttggggtgtcatattttctttgtttctcatgttttttgtgtctccatgttgatgtctgaatcaggtctggaaattacttcttccaaattttactgagtggcttttgaagggaaagactttcacctgcagatgagtctaactgcgctgtttgggaagagtgtggtgactctggttctgagtaaatgcaatggtacagcctccagtgcagcttcttcaggtgcaattcacatcagtgatgactgtgggtgcctctgtggcctaggttgtagcagtttgtggtggcagtggtagcataggttattaagttccttcgtggcaagggctgttggggtcctcccattctcatttccttcaaaatagggatacttagcttaggggacctctcttggtgctggatctgacatggcatgcaagctgtgacatggcctacaatctgtagcagtgctgggttccagaatgcaggtgctcagaacagctgtagagccaaggtcctagactcagggtgtcaagaacctattgtggcacctgagtcttgggctgtagattccctctctgatgcagagttgaatgtagattcttcacagagccaaagtctctgactctaaggcaccccctggcagcttgggctcagaggaccaggttgtgtctatgacactgaaccctgaggaacagggcaacaactttggctcagttctggggaggaaagggagatttgggcccaaggagcaaggtgtagctgcaatttgtgtaccagagccaatagggctcagtggcaactcaggtctcagggaatgaggcactgtgtagtggtgactctgggccctaggatggtgggactgagcattatcccagactgtatgaagccaggtacaggaacagccaaggcatagaattgtggaacacaattgtggcttgggcccgggtggtagggagcagcacaataatgacttcactccctctcaggaggtgggtgtttctgcagcttagactctagggagataatacagctccagggaagctaagtactagaattgtttgaccttttgggtaaggtgtctcagctcagccactgctcttttcctgggaaataggcttccccagtagctcagccttgggatgtgtgactgcttgggttggccaaggcaccagttttctaagaggcaatgtgccacttcagcccaggctcaggggctatgacttctcagggtagccagggtattttccccagaggtacagtacagctttactcaggcacagggtagtgtgaatgctctttgcagccaaagcattgtttccccaggattcagggtaccacttcagctctagcaaaggggacagggcatagcagtgactgggaggggtacatggagcagctctgccaaggcactctttccccaggcagcactgtgcagctttacctctggccccaagggacagggcacagcagtgactgggaagggcataaagaggggctccacaaaggaatcatttttgcaagaggaagtatgcaatttcaactcagtcctgagggagcaggacaaagctgtgtctgggtggggagggtgggtgaagtacctctaaggctgcttgaccccatggatagggtgtagtaggagctggaggtttggctgggggatgtcaggccactgggccagggtagttcagcagtagctaagcctcaagggtagaagggtacaaaggccatacactgctacaacagaacacactccaacagtacttccaactctaagataatgtagaatagtagccacatgggctacagggaccagggggatggtgttggcttattctctcggggaggatagctatttgaacactaggaagggctctcagctcaccttagtgcctgaaaggactgcaggggtccccagtggttaggactgtaggcgtccaaggtgttaatgtgggctgatggtgtcctcttgcttaccatttccccacaagaagaagttccttctggttccaaactgaccctggcagggggatggggtggttgaggccaagtgttttattttattttatacatggctttcctttctctccagggtttctgatactcctttgatgtactccagtgctcttctttagttatttttattaaaacatagctgtttattcattgttttgactgtatttgtcaagggaacgaaagataagggcttctaatcaaccattttgctaatgtcacactctcttttccaggagtttttttatttcaagtcttatgtttaagtctttaattcattttgacttgatttttatgtatcgtgttaagataagggtccaattttttcttttgtatgtaaatatttagttttccagacactctttgttgaagacattatttttccacctttgtatagtctcggcactcttgttgaagatcatttgactatatatgcataagtctatttcaaccttccctattctgatccattgttctatatgtctgtctttatgccagtaccacactgattagattactttaacattgtaatatgatttgaaaccaggaattgtaaagcctccagcttttttgttctttctcaagacatatatatatatatatttttttgctagtctgtctgtttccattgtggttcctgatgagttttaagattttcttttttttttttttttgagatggagtcttgctctgtcaaccaggctggagtgcagtggcgcgatctcggctcactgcaagctccgcctcccgggttcacgccattctcctgcctcaggctcccgagcagctgggactccaggcacctgtcaccacgcccagctattgtttttgtatttttttttttttttgtatttttagtagagatggggttttactgtgttagccaggatggtctgaatctcctgacctcgtgatccgcctctcttagcctcccaaagtgctgggattacagatgtgagccaccgctccgggcacacttttttgtttttgtttttgttgttgttgttgttgttttgtatttctgaaaaaaatgccaagggattttcataggaattgtgaaccaaataagaaggaaccaaacacataacaagagtccttcatgttatatctttcatgaatacataagcccggacatcacttaatgcttggaagagtgagatttttaggaaaaatattctttagcgggattttactttatttctgcagatttttctcctcctttatacctgacatgggaaaagattttggcgaccatcatttagtatccatgctctctctcaacactcagaaatctatagctatcttttaaatgtagattaaagctttccaacattgacatatgaaaattaaaaaagcaaaacttataaggaccaattctgattggtttgttaaaagcctaagggccatcagctttttatctgttattaatttattgtttctcctacccttagagtacctctggtcacttttactgcttctacttctccacaccacgtcctactcctaaatttgtgctataaaatctgctacattctttaaatattatattctatagtagttctactctggaaacattgttttattacctaatgaattcttctaggaactaaccagctaatccttttataataaccttatctgaagcagttatactaactgcatgatgcaaacattttcttgctgctttttaacaaagccagattcttattttttgacaaagtctaagcaaatgtaaacatacattcaaaaatattaatagaaatctacttcacacataatcttaaatgagagattattaagaatcaaatatttcacttgaattttgctaaaaataacaaatagtgtaaaggcatactgtaatattttttctgttctgcaaaatttgagttgccatacaaagatgattagattctgtccacataggactggaaggtgacatatttgaaacagagaaacagaaaagttcaagtttggagagaatcaaacccatagtttattacagtggaaattgtgcagataaattactcttcaaaattgtttttttttaaggaaaaaatacaatatcaatacaaacttactgtatagttcactggcccaaaataaagcacttgctgaggaaaattaacaagctatacttgaatccatcccatatttattaactgatgttagtctgtgaaatacttcatcttaccattatgtaatgtgagtataataacattgcagaaaggatgttttcattaaaaacatgtggttatcttcaactgaagtagattacatgcaaggaaagttctatgtgctttattatattagtacaagtaaggttatatcaaaaaagtaatacataatgaaaaattttaattggatctactgcttttcaaatattcattttttaatcaatttgctttaactaataggctaccgtgataagctgctattctgctcatcacaaggagttagagtcctaattatttaaataaacagaaggaagaaaggaaggaaattaattttgacaaaggacctgaataatccataaaccagatgcctttaggtatgaaattataaaagttttattaatcctttagtgtaagttatatttttatttgtgtgggttgatttttctcacattcacttttttatagttgctttattattatgtaaattaatttttatgtttgaaaaaatacaatatttaaatatttataaacaggtacctattataaaatctataaacatattagcaatttgctatataaaatatttcttttactcagaaaaaaatattaatccttaatttttagatcaaatgtattaaaagcaattcagcaataactagaggaaaacattcaacttcagtgcctgaaaagattcatattcagttcttgtaaattgttgttttccagctattgaaatattttgaattttatatttacaggaacattagaactattaaatataaaacattaaggactaagtttaatagcattttgtgtaaatgtgaaaaattatgtaggcttggtacttgatttattaagatttcatttaaaacagctcatgttcattcgtctgaatacttattactgaacagatttcttggatcacgagttctctgtctacatttatgcattttacacaagctgttggctttgaacactaggaaatgtttataaaaaactaacaaaaataattatagttttaatgtcactgcatttttatttgaagttgactggatgatgttgaatagctctaagttttataaacgtactttttatcttttcaaaattaatattaacaaaataaatttaatctcagtgaaatgatttataaagttttatactattttatttatttaaaggctcctgaaattcattctgaatgtatcggcagaataaatacaattatatatgattattttcattgactttagaaagcaacagaataattattccttgcacattttaaatatgctacagacttcagacatatgttttaaataatcatcagtattatcattgtcaaaattaacttccttattattatcatcattttttctatcacctttgccacaattatgactgtggtagtagctattgcacattttagaccatataacaaaaaaattaatttcttcctaacacaattatgtatcatggctaatagctgttatgatgttgatgttctttatatatacacatatatatgcattgttaatagtgtatgtacatactctttaaaaatacaaaaggaaatttctgctcaaatacataaaatgtactgtcctatgttctttatatgcagatataaattacatgtccctaacttcagccacttcccgcttaatttctagcagggaagatatggtgttagaaagatttgtagttgtagctctttgattttctttagttaaatagttagatttttatttaaagtgtgagttaagcattttcatgtattaaagtgggaataaggggaggagagtttgaatataggagagaagaaaatgacaaggaaaaatcttgtagaatacaggaaggaataaagttcatagaagagaaactggtctaagtctgaaaagtacctgcctcccgaggagacttaatattggagtaataggaataaattaataaactgataagataattgagggagagcataatcagtatacaagggcaaaaaattgatgactttctatgtcatggtctttattttcttagtgaaaacgaagtaagatcagctctggatacctcctaactcttcccctccttctcctgatgagggagaagtggaggcccaaggaaaatgagcaagttttgtaacaacacgaatggggaaggatgggaaagagaacagaatcggtggaggtaaaaggtctagaaacttcactaaagacattgtacattaaaccttgatcttccattgtatccctgttaattgaaaattgaatttatgcaggaaaagtattctttttttaacttctatttttaagttcaggggtacatgtgcaggttcgttatataggtaaactcgtgtaatgggggtttgtggtgcagagtattttgtcacctaggtgttaagtctagtccccattagttatcaggaaatgtattcttaacctgtcatttgaatatgtcagagtttatagtatccaggttgccttacctacagggctaaatgatatttcttatttccaggatgtatgagaaggggaaaaagtaaaggaaggtgcaggaaattcagtaaagtacattttgagggcttcaatgaaataacttagaaatttgtctaagtttgtcacatattctggaatctgacatttgctgtgtcttaaggccagtactgtcttcgtattaacattatggtttttaaattgtgtgtgtgtgtgtgtgtgtgtgtgtgtgtataaatttttttaagagtctcactctgtcaccctaggctgaataacaatcatagctcactgtagtcttggattcctgtgttcaagcaatcctcttgcctcagcttccggagtggtatttaataatcttttctaggaacatttgattattatggtgatttgattctgaatgtggatggaaaggagatgaaataattcatcttatttagaaagtctccagtatattaaacatatagaactatcaaatgattgtgtttttttctctgggaaatctcactcatgagcatgttttttgtttcaaattaatacttcgcacaattctttcatctatttatttagctcagtactctaccacaagcttcagacttgcttttctcactcaaagcatagctttccaaaacaaaactacactttctctagtatttcttttcttaataaatggtaccactgaagctagaaagccattgccctccgtcttttcttaccctgctttgaatcaactatcaaatcgggttgaatttatctccaaatatgtaggttttcttcatctctcatttgtactactaagcttcctgaattatctctttatctgcaatctggattatgacttcaagttaccataatccaacttccttagcaggcagagtcatcttagctaaaatttatatttggccatattattccctagtttatagtccttaattgctttctacaacccttagggtaacataacttttcttaacatggttatcaaacactgcataatgtggcatctgcttaccctttggttttatttcttgtgacgcttctagtatgctaagctcttgctctactgatgtgtaaattcaataccaatgtttcagacacctgagtcctttctcatgctgaaccccctctgcttgatatattacttcctaatctttattttcacctacctggaccaacccttactttttcgataaatttaagtgttgtaaattcaaatgttacttccatcagaaggtctccttgactgctgatgttgttggatgtcccactttgcattcttacagagtactgtacttcccctatgactttgctaatcaaatattattgtgataatgtcctatttaattcactatttcttctatactgctctgtatgagaggacagatcaagtataccaccttcatctctatcatttattgctatgcctgacaatgtctctcaataagtggtcattaaatgaatgtctagaatgctgtgaattcaaatataataagataatagatatttttatttttactatttcagatttcaattttttctcggtgtgctgtttcaagatacttccttttaatattctcatttttagaacaagttattttcttatgcctctataaacaaatatatttataaattaatttataaaatcaattttggactgtctctctcatttaaaatattccacactgggctactttcaaatttcaaatcttatatccatgggttctatgtaaagctatttagaatttacttttgctaatttttcattacagaagacatcatcatgacttattgattctaaaaacacgaattattttagcttactgcttgagttttttattaatttaataataaatttggaattttatttgatattgagagcatagtaaacaacattatcaactttgtgcttgtttttcaaaatccatatgatgatttataagacaaataaggtaaaacctgtgcttccagttatgtttaataatgcacactcccagcttttcttccctttcataagcagatttgtatctgttgcttactgctggagacaggaatcaataatgatgaataacaatgtatgtaattcactcagaagaggcatattacatggactttagaagcgaattacatgaaaatcccccctgaaatgccacaggagtcattgataaatgggatccttagagcacaatatatgccagactggctttagacagcataatggttttgcccataagtaaataagtaaatctttgtcatcacacattgctatttctttttagacttgctcttcagttatgggcaactgtgtacaaatatgctatattaatttaatagccattaaagaagaaagaacgtatatactttcaaactgatgatatgtgtcaaaaatagaaattgtcatgaactttaattaaatgagagttaatcagagctcccatttattgagagtaagaattataatatacctaaaatttcttgggggaaaacaatgaataaaaatagccaagacaaaaaattaatagaaaagcttcactttgaaaataaatatgtacttaagatggaattttttctgtacttagagttcaaatttaaatgttcatgtaaaactgaagtgatataacctcaatgtcatagatgttgctacagacccacatcccttgcaaagatatgtacacttatttcttgaatgatatgttgccctttggtaagtattctctaattatcgacatgtgactttaataaacattgtgccagtctttaaaagtacataccttggccgggtgcggtggctcacacctgtcatcccagcactttgggaggccaaggcgggtggatcacgaggtcaggagattgaaaccatcctggctaacacagtgaaaccccgtctctactaaaaatacaaaaaattagccgggtgtggtggcgggtgcctgtagtcccagttactcgggaggctgagtcaggagaatggcgtgaacccagaaggcggggcttgcagtgagccgagatcgcgccactgcactccagcctgggtgacagagcgagactccgtctcaaaaaaaaaaaagtacataccttgacaacttataagaacaagaaataagagcaaggaaatattagaaaatctgtaatttgtgtatatatacaaaatatacttcatcttatgcttatttcccaacttggcattagaaataagtatccaaggtacttctgttttctctgttttgtcttgttttttctacttggaaactaatactcaaagaccttgagccttatttaaaggcgatctacttactatacactatatctaatggaaaggttaaaacatttgtgatgataaataacccaagctactagctacattcctttaaatcgttaagaaaacgagatacttcaaagttagtgtcttaaagaaaggttttttacaggtaactcccttccattatgagattatgccaacttatttttgaaattaaatccctatatagatacaaggaaaaattggaaaggttggattttaatatcataaagaaattttaaaatttctcattgtttatttacataaatctgtttgactattttcttttagtctctttcttccttcctttcttcttcaatgacttctaagtcagtattagaaggaaagggagatattgtgccaagagtctgaaatgatactttccatgagataatatatatgataaaaaacaagaactattgctgcagattgtttttatgcaaaaaaaattagaaatgacagactttgtaaaaaatacagacactgactttagatgatttatttaaaccataaatatttcaaactgatctttagatatcaactttgatttaaaaatagtttttttaatttgcaatgacaaagtgtaaatttgcaatctaatcttcagtgcatatatttttataaaacaagatgagtcaaagtataattatttttcaatttttattcaaaaacattgttttgtgtctttttcaatagaaatattttatgattttccattaacttaggctgaaccattcagttactcaacacttatgtattgaccatctactatgtcccagaaactgtaaaagacataggaacaaatgatgtacagtaaatttcctgtaaaccattaaccacgaattaatcatacagcatcacaactggcaggaacagtgacaacattctaaaagggaaacttgaaagcaaagcacactttttttaaaaaagaattaagatgaattattaattcagtttcagttaatatgtgtacatatctatatgcataaacaaatatatagactgaaatacaacatatataggtatggtatatttcaaatgattaaatttttctaaaccttgtaattgtgaatattctcaaaatcagtttatattgaaactttttttttattatactttatgttttagggtacacgtgcacaatgtgcaggttagttacatatgtatacatgtgccatgttggtgtgctacacccattaactcgtcatttaacattaggtatatctcctaatgctatccctcccccctccccccaccccacaccaggccctggtgtgtgatgttccccttcctgtgtccatgttttctcattgttcaattcccacctatgagtgagaacatgcggtgtttggtttttttgtccttgtgatagtttgctgagaatgatggtttccagcttcatccatgtccctacaaaagacatgaactcatcattttttatggctgcagagtattccatggtgtatggtgtatatgtgccacattttcttaatccagtctaccattgttggacatttgggttggttccaagtctttgctattgtgaatagtgccgcagtaaacatacatgtgcatgtgtctttatagcagcatgatttataatcctttgggtatatacccagtaatgggattgctaggtcaaatggtatttctagttctagatccctgaggaatcgccacactgacttccacaatggttgaactagtttacagtcccaccaacagcgtaaaagtgttcttatttctccacatcctctccagcacctgttgtttcctgactttttaatgatcgccattctaactggtgtgaaatgatatctcattatggttttgatttgcatttctctgatggccagtgatgatgagcattttttcacgtgtcttttggctgcataaatgtcttcttttaagaagtgtctgttcatatccttcacccactttttgatggggttgtttatttttttcttgtaaatttgtttgagttcattgtagattctggatgttagccctttgtcagatgagtagattgcaaaaattttctcccattctgtaggttgcctattcactctgatggtagtttcttttgctgtgcagaagctctttagtttaattagatcccatttgtcaattttggcttttgttgccattgcttttggttcaaagagaataaaatacctaggaatccaacttacaagggacgtgaaggacctcttcaaggagaactacaaaccactgctcaaagaaataaaggagaatacaaacaaatggaagagcattccatgctcatgggtaggaagaatcaatatcgtgaaaatggccatactgcccaaggtaatttatagattcaatgccatccccatcaagctaccaatgactttcttcacagaattggaaaaaactactctaaagttcatatggaaccaaaaaagagcccgcattgccaagtcaatcctaagccaaaagaacaaagctggagacatcacgctacctgacttcaaactatactacaaggctacagtaaccaaaacaggatggtactggtaccaaaacagagatatagatcaatgggacagaacagagccctcagaaataatgccacatatctacaaccatctgatctttgacaaacctgacaaaaacaagcaatggggaaaggattccctgtttaataaatggtgctgggaaaactggctagtcatatgcagaaagctgaaactggatcccttccttacaccttataccaaaattaattcaagttggattaaaagacttaaatgttagacctaaaaccataaaaaccctagaagaaaacctaggcaataccattcaggacataggcatgggcaaggacttcatgtctgaaacaccaaaagcaatggcaacaaaagccaaaattgacaaatatattgaaacatttaatgccatgtttctcagagtgtgacccacaaaatgttgctgatacaaaatgatataagtattttcttagctatctttcttctttttaaaacagaacagctgaaactgggtaatttataagagacaaaattcatttattatatttctggtgtctgggaagtccaaagtcaagggggtgcatctggtgagagctgaaggcagcacagtgtatcccatggcaaggagactgacagtgctaacatgctagctcaggtctctcttcctcttataaagccacgagttcccttcccgtgataacccattaatccattcatgagggcagagcctttatgatccaatcagctcttaaaccccccacctctcaatactgctacattagagattaagtttcaacatgagttttcaaggggacattaaaaccataccaagtttagaaactgaaagtaaggtgtttacaaacttttacaaaaatttaataaaatccttttatgtctgttgaagctaataacaaaaacagaaaactattctgtatgtttttgcttttaaattttatttctagaatttgtttgtattgtgtttaccaaaaaatggtttgtaatacatttattttttttaaattctgagaaaaactgagtttttaaaaagttttaaatgtgaattctaatgagaaattaaaggagattttgccttttattagtagaactctgtaaaatctgtgaatactaaaatccttcattaactggtgccaacatttttccaaaggagtttctaattcttaaatattgttcagtggattgagataatcaatcttaatcaacagtaaaaagaaaataaagtactgatttatttcagttctctaattcaaaataggattaatatatgcaaattttgttcaataagagttttatctcttatttctatttatatttataggaatgatgcaaacttgtagacattttaatatatatgagatagtccatgaagactttcagaaataagcaggtatgactttaaaaaattgaaggttatgtgagttgatgagagacaggtagaagaatatagcttcttcaactattagtatattatatacatattagtaattctcttttatttaaatgaccttacaatcatataaaaaagctcatgttaaaagagcactattgtatttttatttgtctgtgcagtgtttacaaaggagtctgtcctgttcaatgtgtttaagagtgaataattttgtttaaggtgaaatgttgctatccagctgttacagctttttacaaagcctttgtaggagcatgtgcattctgaagattgtaaagatttatcgaatagactcaaatatttttcagaatatatttgtctcttgtaatttctatttttttatggtgtccagcctgggagtttaaaaaatggaaagataggataatagttttaaaagcagtaaatattcttccagctgtctctaatcaattcacatacctccaattctttaaagtcacactttcttatttctaaaaagcttcagggactatcttatatattcttagaaatacatattgaatttttcattttcacttcattcattctttctccagtttctgtgctggcacttttagatgatgtgctggcacttttagatgatgttatatgctggggcttcaggaaccctgggaattcagaaatgcctgtgaaggtgtatttttgtttcactgttgttgccactactataactgataacagtagcaaatcctgtggatactacctgaagtcattttgtggcaaagctgaaccccctgaaacttctctaatcagtaagaactagaacactgtgccaaggacagcaggatgttttgcagagagaaatacccactgcactgagctaagaagggagaaatcctttctctgtgccacactgttgcagtggaacccaaattgtgttttctgttcctggtaggtaatcatgtgtattaaagaatcttattctgtttttaattttactctgtataggggtgtgtgtatgtgtgtgtttggttttgattttgtctgcttgtttatttttaattcacaagctttcattttcctgggaacacagcctaaactcactgaggattgggctagatgaagagggatgaacaatctgaataacaaacacaagacagccttttgctggggcagtttcagtgcactgtgcttgtgctttgactttccactggtttacttgttagtatcctgtaaattgaccatggaaggctaaacacattctgcatcttagggtgttcacacattaggtacaagatgaaattgttacacatgcaagcatttcttggaatatcatttgctaaaaggaacatgcatgacacctaaaacttgcttttatgctttacactgcagacatataaattatagatgataataaactttgccattgttccttttctctcctgtttctctgtagttgtcctttttctcctatgtccattgtttaggtctcctattatggtttctcctcactgaagaataataaagtaatcagacgtatttggccttaataaattgaagcgctaaaggagctggaattgaaaaatcatgttttaaatcattccttgaagttaactttactgtttttctaagtgtcagtgaattttcaacatttcatgaaactctattctcttgttgtctagtaatattcatggtcttatgattccatcattataccaaactactttgaaatatgtgactagaaacacattttaaatcatgagatgttccaaatccatgaggacttttttcttggaggtaagaaaataaaatctttggttttctatacacgggatagcaagttgaactgatctgattattcttcaattaaacttcattaggtaccattttagcacttattctgtaagtacttttgagttaatagcttagtgtaaagtgtaaaaggctattaagcagatttaaacagttttgtttaaaggaagaagccatgtttttgcatcccattagctgaaaggtattaataaaaggtatggcttattaggcagtgaagataaaaactggatgcatttacgtaaatgggaaagctccaggcttggcatgaagcctgtagacaaattacagttttaaattcaatgtaaaattttctattattttaaaaataatttttaaaacaaaaatttttaaacagaattatgaataagagcagattattttctcttcatgttattgctagaagggtagtgtttaaacaagtgttattagtaactacccatgtagaactgggcaagatcaaagagggctgccaggtaaaatggaggatgctccaagttaagttttaatttcagataaacaaataatattttaatataactatgtcccatagaagatagttatactgaaaatatccattggttgtctacaattctaatttagtcaccacatcttccatttttatttactagacacataatcctaaaattaggaataagggagataatcacataagtaatgactaatgaaccttgttagttaacttagttaattgggtttttttttacttttttcattaagaaaattgcaattattttcaagatatcataacaggtcgtgcatatgcagaataaaatgcatgttaaatgtctttgtgctctagtttttccatcaataaagacagtatatatgtttcaaaagactacttttatatctatactgatgaagtgaaatgtctttttggggcacagtaaatataatttgggctacctgtcattctcacagccctatttttaccctgaaggtgagataagcttcggtagcaatgttgtggcatttataactctccttcccactccaaacacagcattctcatttagccacagctggtggatcagggtttacttctaattttagtgaggcatattgcctttggagtttgctattgtattagaaggaaccaggccctgttttctttagtgattggacctgtgtttagtcctggaaagagtcaatatacatgtcaaaccacatacaagccaaattgtgcagagggagaaacaactatattgtcagaaatagcttgaatacattctgtccgttataactctgttgcaatgtcattctgctgaatatattctaatcattgtaattgcatccattatagttaggacatggaaaagaaaaaagaagagggggtaagagaaactacaatatgtataaattcagcaacaacacactaatgatgtattagagtaaactttataattgaacatacttgtatttgtcatagctaaaaccttcaacttctgtacttgtatatccaaaatttatatgtagtatgttttatgtacatataaaaatatagatacgtatttatgttaagatatacaatgtatatctacaataatcttgtatttaaaaaattaacatttcatatacttatcagaatggagtgctcttctcatccattatttagaaataaaatatactgcccttatatattggcattctaagttggctagagtttggagctgatgagatcaaatcatatgttcatgtgtttattaacctttgaaatgatcaagtttaaggggggaatattgctgaattagcatgttttactactggtgcaaaataactcaaaggacacatcttactgccgttagaccagttactatttgctaacaaaagagagagtaattttattatctgtggacattgatatgtaatacttaccaagcatgccaataaataatgttttgaatgaaatagagcatgacataatgaatattagcaatacaatttttattgagtcaaataatgctccactaatgaacaaaagtaatctacttgtttctttagagcttgttaacagttccttgattattcatgtgtccagaaaaaaaaaaattaatgctcgaagccctaaacctggtgaatataataagcatgactccccatggatctgaaaaaattaaattgttggtttgagacagatgcagtcataaccagagggaatgcttttgcatccacattacaatgtagcagaaacataatttagaagctttaatacatattaatactttgttcaagacaattataagcttcagcaaataaaaagtaaagatacaggagaagaatgaagttactttgaactaaaatctcctctaaagacagtcgtagtcgtacagtaattccaccattaattttagtatatgaactaaagctagaataaaattatatgtaaatgcattgaataaattcaaaacaagctcaggaaaaagagtatagagtgatcctcttcatagaaatcaaatgaaatgactgtgaatctgctagtcatagttatctgagtttttttctcattaaatagattcatatttctgctctcaaaagtaattatttccttggaatctgtttgatacataatagtaattctaatgcagtacttatcgttcggtttttttttttacataaaaatacatgaacgtgtaaaagatactttgttgatgaaattatatactcgaggcaaaactatgctacaagagaatcatttcaaaacaagtaagcacatgttaaatgctagatactagaaataatctacccaaatactttttgaaaagcagggggaatgagatctccattcagtgaatttactacatgctttctctatgctggtagtgtgttctaagggccttataacaaccatgaaagttatcctcattttaaaaacgggtgtgtccatgacctgcctaagtcttgtcatgatttgggattacatgacctgtttttcaaagtcatagaagaactaataattataaaggtcagagttagaacatcccagcctgctccttaatagttgtacattcttaagtaggttacctaatttatatttgcctcagtttttcattctgtaaagtaaaaataataattatgtctacatcaatgagctgttctggtgattaaatcaattaatatatatataaagcatttagaacagtactgtaagttctatttaaatggataagtctctagatccatgtttgttttaccacactgcaaaagcatgggcattaaattcacactgctaacaatgtacaaaatgtaccactaaaatattgtagctttatattgattgattcattgccttctgcaatatttactgtatttttgaacttgatatttcttatctattaatcattaattaaaaataataaaaacaagtcataaagggtataataattgttattatggtacaatcattattactgctacctgttttttcacataaaatgtaagccattaattgttgtaagcaacccaccagagaacacatagaaaattgcagaattgggaattacagtttatgaaatttttttttaaaaagccagaaaaccacattatcaatataatagggaaaaccaaagatgaaaaatgtaaattggttgaagaagttaatcgagatgccaacattgtccaaatgaacactggcgatgatggaaatattccatatttactgtattcaatataaaaactacaagcacacatagctattgagcacttgaaatgtgaatattgtgactaagggattgcattttgagtcttattctgttttaatttaaatctaactaactacctgtggctattggacagcacagctctggacagacagtaaaagagagctgatgccggcctggaggatgagagagctgtggaggcaggactcatgagagagggtctttggtcattcatttctgtggaaaataagtgaccttttcaatctatgatgaaaaagggaacaggagtttggtaaactaaaactaagaagaatttgcagaggtttcaaacaaattggttttgggccatattgggtccattgtacaatgcaaaaatgtatatagaaacctcaatttctagtttctctgattaaaaaaaaagaaccaaatggagcaaattaattcatctcttttttttcatctgtaaatccaaaagctgtgtgaaaagctgtataaattaaatttaaattaatattccattctgaaagtctactttagggtttatgatcacacattactctgttagacctcttttggtatctggttagtcacagtttttagagcagtggtctaataccttcatggtcacaccttctgtcttcagaaagttcatttagtttcagactgttagccagacatcttacaaatatttcccattgcttacagggaaaatgagaagcaaaagcatatttctatgtgaaagtgtttttgttttgggaaaagtgaagttgcggatatttttcactgtggctcattatatgatgttcacgtttaggcagtatacaaaataagtcggactattacagatgtcactgcctggatgagcttgattttgatataaaacctgtaattaatttttcacataattgttcatagccttaagcttacaaatttattaggttatcttgggataaagtcttcttctgatacaatgcctggaatactccctttgtcctacatggatgagtgctttactcctaaatagtactttatgatctgggtctactgtagcacaaggaaacacatgtttgaaaataaacatttagttaatgaatggattttattttcaaggtgtttattccctctggtgactgatatataacaaggacttacaaatgcttattcaataaaagctccctaaaacttagacataatgtttgcaataagcatagtaaatagcaaacctttcatataaaaatcgtctaagtttcactttggtttgactatatttttctgtggggcgcttaaaaatgtagatccattgaagtcttttaggccacttctctcttatggataatttcagcactatttttttcttcagaattacctggttttctgagaattaaattttcttttgcagttacataaattctgtaaggatttacaataccacagattgtttatagcagtattttgtaaatgactacattataacatagagatattttggtagtatataatatcaaataaatgaatcattaaaacatatgtctgctgtaaaaatttatctttcaccacaaattcattcatgtgtcatatagacattttttcctaatatttcctaatgttttttaatcttgattaatgttgcattctaagtaacagtgattacttctgagtcataaatattttaaaagctattttgtcacttcaaccagctctgacttcatactcccaccttaatgcactatattctagaacagtatttgttaaagaacaattgtctagaaaggaaaacaaaaatgtgcttttttgcataactttacatattgttttaataatatacttccattagttctcttgcctttatattacttacatgttatacatttcttcaaataattttactgtgggggcgaatatgttaacatgcattttttggtatcaacagcatttttgatgaatcagataatcctagaataatgtctaacccatctacattttatcatgctagaataaataattcaaggaaaattgaagcatcatttgtactctcaatagcattctagtagtctaggaaaactaagtgaaaactacaaaaaaggagaaaaaggaaacgatgtacatcacagtgttacaatgcagcactagcaacgtgtacgattgcagaaaaaggacagatttatcctgactttgaaaagcaagaaataatttaagggcaagtggcattcttgtcagacttcaattaacaaataggattttgatagataggaaggaacactgaccaagaagttaagtagagtcaactgctgaatgtttaaagtaataactggatttgattgcaggaaatagggagatactgaagatttttactttatggggaatagggattatatttcttaattgttattaagagttgtagtttctaagactttaatatgcagcagaattgcctggaaggcattttaaaatatagattacttgggcccaaccccagagtttctgattcagtaagtcttgaatggggcctgagaatttgcttttctaactggtttccagatgatgccagtgtaggtagcttgggaccacacttggtgaactactgatctagagcaagacttctttggtagttccttccacctccccgggaatggtgtcaaataatatttagctttcattttttagcagttaacttgtattttgaaacactctgtgagagacgaacataggagaaaatacatacaaataaacaaaaaaaaaactttaattaagtaaatgagacaaattaaggtaatactggaaactgtaagtaatactattctacctgtatcagtcagggtcctggcacgaaatagaatacacacagatggtttaaataaagatattctcatgaagacattgttacagaaatatggacagagttggggcagctggaagccagtgacacccagcgggcacagtgtaatcagagcccatgtggagctggagtcatggagaggctgaccagtgaaaaggagctggaattttcttagagggatgcagtgactttcagagaagtattgcagcagggaaaaagggtagaaggaaatatcccacttctctcttcctttgcactccagtctcctgctgttgcctccttctgtctgaaaccagcctgaagtcagtgtatatgtgggtgagacagccagcagtgtggtcagtgtctgggggcacagataacttcttggaaagatgaagattgtaaaggatggacctcattctactttttatcttgttcattttaagccctgctcccagttttctactcacgctatcatgacctgtcatttctactctgtgccacaggatagcaacaggctaagcatctagcagcacggagatgagatgagcaatctgttgtaatagcttacttactacggactcagaagtgtctttaaagcttcttcatcagtaggtcaaagaacttcaaatatttctgctacagcagcaccgtaaggagaagtacttgtaactcaaaagtgctattaaaagcctgatgtttgctctaaatataaggaatataatgattgaccaattcaagctgcacagagacaatttgctttttttgagttgcctctaagtccctggtgatgttattgtataaataccaacaaggcaataagagctcaattgtcccaccatcaaagaggaagcaccctttggaattggttttaaataactgtaggtagttcagtgctataaataccagcactattttataaatctcagtcacaaacatgagattgcctttactgtctcaatcattttaggatctcttcctgtagtctctgcagaatttctgaagcaagagcagaggctgtattcattgcctggcaatagcagtgaatgatgtcttacattcaagatgataggaggatcctaaatgtcttcctagccttaagtcctatgacttttcagtatgcaccgtcagttcaggctaactaagtaaatcactttttacccaaaatgccacttgtttacttcacgctgcacttttgttcatgtaatttgtttcattgagactacctttttaaattgttaaaatatgtaaagcttcatctcaaatactaatctttccacaaatcctagcttgattcttccaatgagaagcttgaatatccagagcacaagttgttacttttaaaccactttacacatccttaattatatttaaaaataactaaaaatttcatacaccccccccaattgaagcactttttactatttattggagcgaattatggagaaatatttgtatgagccttggccatggaatatcagaatagctgtgtgtgtctataagttacttaatttagaatcatttatatcactctagtttcatctgtaaaatgattagtatctaacttacatcaagatgttgatgttcaaatgtataaaggatgaggaaaacaagttgaaaagcaggctaaaaatgttagttacaattccttattattttttgtgtcttttacatggtaggaaatcaaaaagtttgtattatattgaactaaattggaagtccacagaaatctatactgggattaaaaatccttaattcttttaattgcatgaaaaagagaggggagaaatagcttgacattttcttcatgatgacaaagcctgggcaaaacacatgtatgtgcatgcatttatgtatgtgaggcttgtttcaaaaagggttttttaaatgttttctataagtgtataagaaatatcaaggtatactaacataagactgaagtgatgggacacagtggtcaaagataaaataagaaatagaagtgagataaaataagaatttcaattaatatacttcaaatatgtcataagaatgtcatcatttgctagaatttgaccaaaagattagtattaaacattcatggaactgaaataaagctttatttcagatctaggatcccccaaaatattatgggagtcacatacaagaaagaaaagatgaattggtcatgagaaacacaaatatttctggaactgagtccagagaaaaaaaatcatcctttggtctctttaagaaaatgatgtatcttaatgtggtgaacagtgacattcttagagtaaatgcacagtgtagttgaatattttcctccataaaactgaagggcactgtgccaaagcacagctctgaaagcttatgccactggggattattatcgcggaaatctctgtggtgtggattgttgggatggaggggctacagggtacttctctttttatttacagatttcatattttaaaaaatttttacaatataaaacatggcttctatctttttttaaaaaaagctagcaccccacatcaaatcaaaacaaaaaagcaaagtagtaggtaattttgggttttctaaacagccaactcaatgtttatacttgatcttagccaaaaggctgagaagcgatccaactcaatgtttaattgtgggtttcatattttcaggtatagatcactgattcccaaactgctgattacaactcactcctaaaacgccacaaaataaggatttaataataaaaacatttcagaaatgcaacctttgtatgttttcttggtaattctcattgcagagacatcaccacttggctggctattctagtagttctggcacctgtaaactgtggtggtaaaaagtcatttgggagtttaactcacaggagtcggatgtgggcaggatgccccttctaaggggtatctgaaaatatgtttgtgtgaagcagatgcttcattgtcaaagattcaataatcactgatatttagtgagctgaggacagagatgctaaaagtgctacagtatatgagacaatttcaagaaacaaaagatccaactgcataagataccaaccttccctcattgaaaaacattgttcataacaaacttacttggcatgaaacagtattttgtaacattcttatttacataggaatgtaagtaagattgtttcaaaattaatttgatgattaattttgtgattatttcaaaattaatatttttctttaaatctataaattctaatgttcatctttctttttgatattctgctcaatatcttaaagatatattaaagtcaatgtgtccaaagtagaactccagactcctactccctgccaaactgctacttccccaaatcagaatattgtacattttggtaaatggaactaccagccattcatttgttcaagacagaaaccacgatcctaaatttgtgtcattccaccttcaaaatatagtagtctcattttatttcccaaactgtgaaaggtaaaaacctaaagtgagggtataatataaacataaaaccagaaatattaaaaatagatacatttttcctttaaaggaacagaaaaatgtcttagaatggaaataaaaaataaggagttagataaatggagatcaaaatttaaagaaatggagggtgaactatagtgggaaaataggtcaggtgcaatggctcatgcctgtgattccaacactttgagagacccaggcaggtgggtcagttgaggtcaggagttcgagaccagtctggccaacatggtgaaacccgtgtctactaaaaatacaaaaattagccaggggtggtggtggaggcctgtaatctcgctactcaggaggctcaggtgggagaatcacttgaacccgggaaggggagtttgcagtgactggagatcgtgtcactgcaccccagcctgggcaacagagtgagactctgtctcaaaaataaataaatgaataactaaatagttggaaaataaactgatgcctgaactgctagaatagccagacaagtggtggtgtctctgcattgtcttttcatactgctcttcccttctgtcccccaacacacaatctttgtgtctttctatctctgtcacacacacacacacacacacacacatacatacacacacacacacacacatagatgctccttagcttagagtcaggcttctggccccacctgggatctgtgaccctgaagaaaagtagcagatacaaggttgtctctggtgagcaggagtctctcagcaaagcctttcccctgtcctccttctctaagaaatctcagatgtagctggagcaaattcaacttttgggattggaggacaaagcaatctattttctgatagattgtatttatttttaattgtgttccactttaacctttgttttagcactaatcttttcttatcgagcaccttgttatagatatttctacttttccttcttctctctccttcctactttgtaattcccctcttattttaacctatttcaacatttctgtgatgttttttgtatttgccataaaaatgaaagaaagataactccacggagaaagatttgtgtgcatatttaaatatgtatctatatatcttttaatctattcatttattttttaaaaatatttgatggaaataattataatttatttaataaataactacagaatatctatatttagtaggaaaatggaaattttagaatgatacttttataatgaatcaatttttctgaaacatacatatgcatatacaacagacatatctctggatagtaaaaatatgaaaaattttttttcttaaactattctgtatacatatcatatttacaatgaatatacattgcttttgtaattaagagaccaaatgaatatatttcaatacttcagctcttaatttgtgggcctgacaactatatcatagagataacgtcaattgaaaggtaccctgtccacaagagtttctttaccagccaggcagagacccaaatgctagcattgacataacagaggaattaattgcttctgtgtacatgagcagtaagtactgactgtccttgttaaacatctgaagtttattgctggtgtaataaattttcattacatttcatttatagtaaagaaatattagtcaagtatgaaacattgctaatttgaatcctctataaatgaaagatgacacaatgtttcctaaagtgcttgaaaaaaatatataattaagtgaggggttcaaaaccctagctaatgttccttaaccaaggctacaaataaacaattagcaaaatattttaaaaatacaaagaaataaaaagattcatgtgaaaacagtaaaattcttaaaaatatacccttggtttcagaggtggttgaagtaatttattgtccccattaagttggatgaataaagaacaaaatattgtaaacaacaattaattttaatgacatgaagatgatcacggatcctggacttgatattccaatctaagtatttcttttaatcttggattagcacttgatttggttaaaacattgttggattacctcacataaagtaagacagattcattcttgcatatttcccccctttttattcaaagtttattgtataaattctatgttcttcactcaaatcatgatatgaaatgaaaatgtagatgacataggagtcatattttattaagggagtgaagggaaaggtagaatttaaatatcttgcagtggccagaaagaggacacagtaaaactacaagtagaactggccaaaaggcaaccctgaagaaatgttaggttgatcagtgaaccctaaacaggctaattttaagaatgtttgcagccttaaaaattatgattcttagtttcttttgagaatcatttacatattccttttttgaattttttatcttttaaaacagggtctcactctgcacccaggctggagtgcagtggcacaatcatagctcactgcagcctcaaccacttggctcaagcaatcctcccacctaagcctcctgagtatctgggactaaggcatgtgccaccatgtccaactttttctttctttctttctttctttttttttttatggagacagggtctcactatgttgcccaggctggtctcaaactcttgtgctcaagtgatcctcccacctctgcctcccaaagtgctgagattatagtcatgagccactgcacccagctcatttccatattctttaagcccaacatgggatcatgttctgtgaaaaagttatagtagtatacaacattgtgttttttttcttattatgtgttctggctgtctctccaataccagtaaattatggctatctttccaatatcagtaaattaagcctaccttgttctttctaatagctgtgtaatagataattgaatggaaatggtaaaattgtatttgactggtcccttatttttgacaatttaggttgttgccatttggctactatattttaaatgctgaaaaaatgtatgtgtgtttatatacatacatacacatatatatttataatgagtatatgtatgtatagatctaaaatgtgtatatatatgagtatctttctgtaaaaaattttttaatgtagaattatatatgtatatataatatccacgtatgtgatatatatacacacacacacatacacgtaacatatttgagcaattgtatctataaggacagttattaaaggtggaactactatgctgaagagtatgcatacttcaaaatttggaaaatatttacatattcaatttagtcacctctgtttgttgtcatgtgtagaaaggcctgctttactcccaaaattcaaagaaataaacaaaaaactctattctaatatttaatgactccaatttatatgtttgattctttgaagcaggttgaatttattagagacaaagcaataagggagtaatacagatttacagtgagaaaatcaaggcttaaatagctacatactactttctcatggtcatgagtctccagataccttttaaggtaacataaatgctgtgtctgagaatatcttaagcacaaatgacatatttttaaaaataatagccttaatattttccatgaaatttctatgttctagatattttggttgttcatttatcctggccctttaatttaaaaatgtgaaataattcataaaagaaactttatctttttggaattaatgatttttgagacatagataataaagtgatagccaaataataatattccttaaaggagacaaagataactgatgatttgactcaccagaaacagctaatatttttgtaccaaacactctatactgagtgtatattgtgggaaaggatattatcctaaatcatattgaaaatattggcagagtctagaatctaaagaaggaaaaggcatcctatgtagaagggagagtcatagataatgtttgagacatttgcacaaaagatgtgcaagccaggctgtgttgaggctcatcagtgggatgtttagagcagacaactgataggccagtccagtagaataaaataacccaagattttcaaacaggaaaccaaacatattcaggagaaactgatttactgtcctgggagaaacagataattcacagaaggacataaaacaaggaactcaggatggagccacattcctgagagttttcactgatagttttgccctttctacctgggagctcctaaaggtatttaaaagagatgagagacatatttttaaaaagctttatttggaggggaataaagtgttatcaatgaagttcaaatgtataaaagatgatgaaacttagcaaatggaaaaattgactgtgtttgttacaaatctttattattatttttagcatcttttacagggtaggaaataaaaagttgtattatattaactaaattggaaattcacagaaatctatattggaatttaaaattcttaattttaaaagactaaaaatgtagtatcaggtggactaggggagatgagggggaggaatcaggaaagcaatgggctttgttacacaatttttcttttgtgtggcaccatcagtcatgacataagtcccaggttctcatccctgacttagaaggtttttacacatatcatttgaattttatttaaagagctgattgatgctttgtctgtactgttctcccacacattatccattttggtcagtgacagttcaaccatcttagaaatggcaaattatgtaagaaaatctcctgtgttctagattactttttgtttttcctctatgagctagcattgctttgtgggttacattagagaaagaaactctgaaaaacattttctttatttccgatactttgttttaactatggaaaagacatgcatcacttggagataattagaagcaaagaatccccgtgactgtacaacagatccccaggtatggacaatgccattgcctgcagtatttgaatttgacatgacagctaccaggtgttacaggcttaccggttttcaaagtaaaagaaaaaaaaatgtaagcaccttcacaaatgaaacagaacagattttgccagcataaaatacctggcttacatttcaacaaagtcaattccagcccttttaactaaggcacaacaacctgtttcagtacacatgaattataatgctgccaaatcttctgtcctcagaaataactcacatgtgcttcaggtacttgaaaagcattgtggatttttgccaagctcctgaggatgcgcagacattgtttgactgatcgcaatgtcacatctgaggtccacttgttagttcttagtttatcagaaactaagcttttgaaactatccatggtcttccttttgatgtgttcattaagctttttagtcattcagttataaaatctaacctggaagaatgaacaagatattgtctcgtttttatggtggtttttgtttgtgatatggtttggctgtgtccccacccaaaatctcatcttgaattgtaatccccaaaaaccccatgtgccaagggacagaccaggtggaggtaattgaatcattggtgtggttttccccatgatgttcttgttatagcaagtgagttctcacgaggtctgttggctttataagtgtttggtagtgcatccagcgttcattcgccttcctgctgccttgtgaaggaggtgccttcattccccttctaccaggattgtaagtttcctgaggcctccccagccattcggagttgaactgtgagtcaattaaacctctttccttaataaattgcccagtctcgggcggttctttatagcagtatgaaaacagactaatatagtttgcttttacaaagtattttttaagggtaaaattaattgtatgtctccttatttagtttatcaaagtaggtctgtgcatacattaatgaaggtatacaggtaattctggtctttcactaatattcagtacataatcttccatctaaaatctgcttttttcttctgtgttgctacgttagtaaatgttcccattttctaactagttgttctgcaagaaacaggattctcaggaattttttgttgataatacaactttttaaaatttttatcaccaatagaagaatgaatttccagcagtcaggaatctaacacattacaggggggaaaaagtacgtgaaaagtggtagggggaaattaacaaatgatcttgaaaaatctatggcggctagcaaagtattcttgaaaacaaagatctctgcattccggtattttagggatcctcaaaaacaaaatgaaaaccaaaccatctggttttgcccaatcatcagaaagcaaaataatcttgcctacattcagccacccccataatattatacagagctctcaagtagctttctgtggcataatcattaaatgtgttttggagtatcatccactatttgagatcagaaagcaacatgaaaacaaaagcccaaagaaataactttaaaaacaccaaaacgaacaaagagaaaaaaacaaagaaaataaaaataataacttaaaaacaacttttagttagtatttatctaattacagtcctgatgataaggcattcactaaaaaaagaaatgttattatgaaaataatcatagaaaaataaaaaatatcttaaaaatcaataataaaactccccaaattattctttagaaggttgaaagtgaaaaactctcctcctagaaagaacaaaagagaaagaagcaattagagataatacaaattaagcagaatataatccagcagggtccatttcttatccctagaattgacagtgttcagattgataggcccaaccaaatgcacagtccacatacaaatatataattttaaatttgcagaaagtaaaacatatagagcgtccataagagggaaaaattattcacctgaaaaaaacaaggataacgctaactagcatcagccttcttttttttttttttttttttttttgaggcggagtcttgctgtgtctctggaggctggagtgcagtggtgtgatctcagctcactgcaacctccacttcccgggttcatgcgattctcctgcctcagcctcccgagtaactgggatcacaggcatgtgccaccatgcccagctaattttatttttagtagagacggggttttgccctgttggccaggttagtctcaaacccctgacctcaggtgatctgccctcctcagcttcccaaagtgctgggatgacagtcgtgagcaaccacgcctggctcagacttcttatggaaaagctggattcaagaagacagtggacaagatggttaaagttctggggaaatattataactaatctagaattctatacccatgtaaactatcaatgtgtgagtcaaataaagactttatacatacaaagacccaggtgtttacctccaacacatgtttactaaagaaaccactagtgaaatgaaggataaaacaaggaaaaagtgtgtggggtctgggcaaaaatgaaactatttggttatgcaattctatctaaggtaaaatcccagcacttgccttaaaaaccatctaattcataatggaggcagagacttctggaaaggaggactccgggaaagaaacatgaatgatagaattgctacaattcaaagatatacagagaaaataggtgaaagcatttgaaatctactttagaaatattattctttgaatagcatagtagtcatgacagtgcctacagaggaggaaatataatcctacagatttttggctttgcagcgcacaaaatgttcataattacacttatccaacttttataattcatgtatagacaaatcaataaagacttaactatgatttatcttgacctacatgatcctgcagtttctagccttcccttcatccagcctcattttgtgcagactgctccactatcccaatacattttaattcaggttggtctgtcaatttctcatacacatccatttcatccacatcagtttctcatatcctccatctcagggccttttacacaagtttttctatttgcctggaattactttacctcatctcccaacctactcccaatccctgtcagatttttcagataaacctgccctactttacctcaccaggttagatccacctgtacatctcatcaaagcacctgagacataataagtaatcaagaagtctttgttcatcatatgaataagtgctatttttcttgcatataattctccctgtccgaaatgcttgatatttctttattaaagagttcaacatttaatttataaacttgcctatgtgtcttgtctgttttgtaatctttagtatcttgctcagaaaagaacttattggctctacctcttgatctgtagcatgtattatattactctttattggacatgcctaggttgtaggcaggggagacagagggttgtatcttatacatataaacctagaacagtgccctatagctagaaaataaccagctctagtttttggtaaaatacctatgtgggtattcacactcatcttgaaattattttaccacttgtaaatgcagcagtcactgagccagatcctttttaacttctaagtctgtcaagtaaaattcttgaataaattttaaaaatttagttgttaaaatagatttattaatatgtgaaaatgttctcttgatttaatgttatatactttatgaaataaataaaaattcctttgtgttttatgtaatctcaagtgtcttagaaaagatttggcatatttttgtagattttatgcattttcacaattaggtttctgtttttacaatagagatattgcctgcatacacaattcttcattatcccttaacaataactagtgtttattcatataaaatatcaaattaaaacttcattattctgcagacatggagcacctggaaaaaaatctgcatgacataaaaataaaaacagataaaacattattattatggaaatatttggtgtatctctattccataatcctccatagtatctacaattataatgagattctttgatagatataattctttttaaaactcctataaagtagcttttaatatattgggtcttttcaatttgttttcattatatagttagacaagataaaaataatgcaaaatcttggggtataattttcacatgcatccgtgtgaagagaccaccaaacaggctttgtgtgagcaataaagctttttaatcacctgggtgcaggtgggctgagtcagaaaagagagtcagcaaagggagataggggtggggctgttttacaggatttgggtagataatggaaaattacagtcaaagggggttctctggccggcaggggcaggggtcacaaggtgctcaatgggggagcttctgagccaggagaaggaatttcacaaggtaatgtcatcagttaaggcaggaaccggccattttcacttattttgtgattcttcacttgcttcaggccatctggatgtatatgtgcaggcttgggctcagaggcctgacaataataaaaactgacacttgcaaatggatgagaagtctagctaaaattttttcaataactgtttgattatgtttaattacaattcaaacctaatgttgtcatcctttaatattcagctactatagtctataattaagatggaggtcttctaagtgtaacaattaatttttctatgtatgtatagtttttcatttttagaaaattcttacacttttctatggcttcataatactaagagctttcttttatttttagtaattatcagaagttaaattgaaaaattttaagttttaatcattcaaattgaactactttctgttttggagtttcttgaaacaccatttactttcttttttattgtttctttacttagatgataagattcaaatctaagtattgtgttcctgaactcacacaagaaaggtttctttctcattcacactatggatgaaccagatctctttcatattgtagttatgacaatggatatatagcttccaaagttgtgtgatacaagagggagaggataatatgttttttgttgttgttgttgttgttgttgttttgttttgggagctttttttttagatggagtcttgctctgtctccaggctggagtgcagtggcacgatctcggctcactacaacccgcacctcccaggttcaagcaattcccctgcctcagcctcccgagtagctgggactacagatgtaaacaaacatgcccagctaattttttgtattttagtagagacaggctttcagcatgttggccaagatggtctcgatctcctgatcatgtgatctaccctcctcagcctcccaaagtgctgggattacagggtgatatgtttttaactgtcaaggctaagagttgtttatatcatttacatcctaatttccactgactaaaactcagttacattccccccaaccccctcgcaacaaagtgcaaggaatgctgggaaatggggaaaagcagaggctttaacaatcttggggaccattaagaagtgagagttgcagtgagctgacttacttttcagttttataattctcacagtttgatatccaaagcatatatatatacacacacacacacatatatatatttctcaaaagcatatgtataacacatacatatatattcacctcagaatgatttccacttagcttctagctcaccattttcaatacctatttatttagatatgtatgtaaaaataaataatgtgaaaccctgaaaaataatgcttccatctctccatctctctaccacaataaagaagccatatatcttgactcagcttgatcaccacaacaaagttaatgcaaaatttatgacaaattacctattttccctcccactcactcctgactttctaccaattggattccatttctgattacttgcaattcttggctctggtttttgtatgtgattctactgctgctcctttataattagtattgtcatttagatttcagattacctctatgaacttgaatttgattcattactgacattatgggtgagatttcagtttttgatggaaagtcactagttcttattctcagaggccattttcagacgtagcaggtgtccagtgaaagaggtatttaggcatattttgaggaagcaaccaaattctttttaagccatatataaatattcgccagaaaataagttcaaatcctcaagaatcttaaagtttcttaaagtaatgtatgattttttcttttcaattaatctaaatcatacttttagcaataaacatgtatgtgttaatttttattaataaatggtaagctcttattctggttctttgagtataaatttattgtcgtataaactcctatctcaaaaaaagtccttacaagtaaaaattctattattcactcaccccaactgaaaaatcactcatataatactttattaatgatataatgccaaatactgtgtagctatttaagaggtttcattatatttcatgaatattaatttccttccaaataattaaggtaactgccagaattacttagcaagatagatggcagtgactatactattttatgtatgaaatagacatcatataagatttatatatagttatatatacacacatatatttacacataaataaaatatcaataacaactaaacaaatttccttcccttcatttttttcctctgacatttaaaaatatatttttcttctttactttttgttcctcaatttgctataatttttaaaaaacccttccaatttagtgaaagagacagtattcaatttttaaataatgtgtttttgtttataaaagtgtttcaaaacggggacttcaaatatggtaattgcacctgaaatatgatttgtattatctgatggtagagaatctatattcccatggacaggctacaataagagagaaggtttataataaatttcatacatacaatgtacattatttaataatctgatatccttctgcagagtatgattatacacactccttcactcatgatcggcatatggcttccagaaaccctactcatgatgaaatctttctgtgtttctacaattaactggcagttcaaaataaaatcatctgtgaaataagcttacattggtagagaagcaaattttcatagttatccattccaaactctctgaatgaatctcaagtacacactgcattacagtcattgaaagatcaaataatgggcttccttatgattctctgcgagttcatcccatgcttaatgatccattattggcataacaagggattagataaaaactattaatgataagactctaatattaaactaaagtctgggatacttaaggcttttaacatacttacaggatgattttaaaagactaacaattgaccttaggtgcacacaacagtaaagacatgaacaccataattgtttttcttcatattaactaggggtgactgtaattaatatttatccatttaataaacttttaaatgagaaggccaacaaaataagcaatgaagatatgttttgtttattctagggtattagtcagttttcacaatttaaccatgaatttttacaatgataataaatagaggtagtacagaaattggatctcggaataataatgcaactagttgtatcagttcaatgcacctatttgaatcctttacatgtcacatgcttgtgaatttttgccaatgatgaagccaaaaattaatttactgagtgtcacacaacaaatggtgatatcaggaattcagccatggccattcaagtccagagcctcaatttagttgaagctagtggagaaacagggcaacaaatatgaaaaggaagatttttccattttcaaaaacacgtttggtggtcattcttattttttgtttattatttttaactgagtgaagagctaaacaaaataaagataatctcaaaactgaggcagatacataaactggtgagagaacagtaatcaaattgtgtcattctttgtgggaaaatctaaatgtaatcacatctctgcacaaatgacccaaagaactcaggaactagcactgaatcattgcaatgagaaatgcctactctgggtagatgattaacaagtatcaattttatgcaattttatgaaatacttcttttaaagaggcagcattacttcatttgtaattttagaaagattttccaattttacatttctatcataacttgatcatctttgacgggtagaacacagaatcagttatcagaagtctcgggcactggcccaggctactacttatttgttccttgaccctaatcagaatagttacttctctaaacttcaatattttccttccactgtgaaattaggcttttatcttctgctttccctacctcatggggttgttttcacaatcagttagagtatttcatatatacacatttgtgaataaatatacatatttaggattgtatgtatacaattgaaaattaaaaatgcatacactaggccaggagtggtggctccagcctgtagtctcagcactttgggaggctgaggtgggcggatcacctgaggtcaggagttcgaagtcagcctggccaatctggtgaaaccctgtctctattaaaaatacaaaaatgaaccgggcatggtggcagatgcctgtaatccccgctacttgggaggctggggcaggagactctcttgaacctgagaggcacaggttgcagtgagcagagattgcgccactgcactccattctgggtgatagagtgagactctgtctcaaaaaaaaaaaaaatgcatagactaaaccatttaataagctttctttgtgtaaatggtttaactccatttaaaatagtacttacactgaaataatgcctttccgtgtcacaaatccattgtattgataacataaattttgtatttatgcaaattaagataacaaaggaacaaagaccctgcttagcaaagtcactctgccaatgtaattagctttgtcttgtttcaactagtcgagcaggagcagttgcttcctttggaaggaagcctgaagaactatcatagaaatttagaatagaagacaaagcatcagaggccagtccagataacactgtatcttgtgatttatcttcccagtctctattaattcccttttggtgtcatagcacagatgactgttactctcttctttcaagtttctttgcctaattttgaatagctatctcgttgaaaacagacaagaaatttggaataccctctgtattattctcattttattcccttcttataatattttcaaacaggaggaaaaagcatggggattttccttgactgttgatattctctagctctgtgcttttttggaatttcatgccatatatgagtattttgtgttgggtatatatagagggcaacattcataaataggaaaacttcaagatttagaggtgttacttcatgtatttctgttctgagaatggaggttcttggacaaatgtatttgaagtacagagcacagagggttaatacatataatattcaaataactattaccaaatatcaaggagacaatgagcccaatgcaaattatatcaaaaaacaaatcaaacgcattcaagtggaaaatgaatatgaaaaaatatcagatttactagttgtcagaatgtaagttatatttacaattaattattttatagccattaaatttaacagaataattttaaaatcagtaacatcaattgctattggggatgcttgaaaaattcatatattgctgttagaaatgtgagttttcacaaaattttaaaaaccattgtaaatatctactaaaattaagataaataacactctttgactttcaaactgttcctaaaaatccaaaacaaccaatgcttaaagatttatgtacagttatttattttcagcattgtttaaaggggcaaaacactaaaaatggattgatggtccattaatattgtcatagctgggtaaattgtgctaggataaaatgcaccctagaaaggaaggaagcaggcacacaggcagtttgttttctgaggaatggacatttttcaaagagattcctgtgcattcacaaagtaatattgcttgattcattctatatcattactatagagtgaatattttaatttgtgcataatatcataaatgttgctcattgtgtacaaatattcaaaggctagtttttacaaatgtaagacaggcaaaacaacttactagcagtaatatcttatcattcatcttctgcattaatattatagttggatagtcatacttaaaaatctaccacagtaagggcagtaagctcaaaggaaaagacatgcaattgtattttcttcatgctttatctaaaatattttttaaaatttatatgagaaaatacaagataattatttgaaataattttttgatataattgttatggaaccctagttttttgtgggaaaaaatgccttttttacatacattgaatagaacaggaatgtactccttaattttaataatttatttgctatcgttatataatcagtgtctagaaagattaaaatggcagaattgattaaaacactttttccattctctactcaagttattggtttatgtctacaggctgagtgcctcggatatcaggatagaaattttatactgaaggaaaattactatatgataaaattgaaaaacttattaggttcatgatcattgtttgataacctatacttactctttaatagtaacttacataaagctttttaaaaatatataatctattgtatttattacacttatgtttggacataaagctttatgtcatcccgtctatgatctggaagttgaaacaaggtggtttcaactgaacactttgcatcctgttgtggatcacttgaagacctaaaatctgtttcttagatactttgatagcaaaagatgcaggagacttctagagataatatttaaaggaaaggaacttttgtactgtttcacataaacctgtatctctatctgtctgtctgtctatggatagagatagagatcaataactaatatcatactgtgaaaatagctattaacatttcttcctttccatatgaacatataccatattttgatgtaatggatttactctaaacagtatttaaaaacattattttgataggtaagtctttaagctccttaaaagacctgagattacatctttatgtagggcatgatttaagaaacctatgaagcttaataagataagaatagcctgtttacatagcttaaagtatttaaagtgtagtaaattggtggttgagctatgtaggtgttctcctctggtaaggttgtttagcatatataaaccactaaaatgatggaaaatacaccaagctgaagtgggatcaggatgactaaacaaaatagttttcaatttctgcaatgagtttggaccaaaattagtttgagaataaatttagggaaaaatgtccttgaaaaaaccataatctttcttaaaagtttttcctaattgtaaatttcactaagacttatgaagtcccatagattataatgaacaaaatttctatatacacctgctgtcactatgagcaacaacaggacaactctttccagcttggatttgtttgaactagacataccaaaatgagttggaaacacttctcgaaccttgccctcccattctgaaatgagaattccatgcaatgactgtacaagttttgtcaagctatggtggaacatggtatcacaaatacagatattccttaaacctaagtattcctggctggtcctaggctgacttaaccttttttattttctctcctaagtcccacagatttggttcatttagctttctattcttggctgccaccaactactttgcaatcctatgttcacagacctccagaggatagagtattttaaacttcccttcatgcttgggaatttatcaatttatttacatcttacaaaattcaaaaagcacccagtttccatccccagatgcaatcactgtccggattcctgggaaacatcccgaactattctatggataagtgagcctaaatgtaaatacatcttccctctttctatgcaattttagcattactgtgcatctttgttcacttaatagtgtatcttataaatttttatgcatttacacatcttgtactgtcttgttctttttctgttcatactgtaatgtcttgctcattttagctggatgtgtagtttcttgcagcatgaatgtgctaccatgtattaagccagtcccctatggagggacatgtggatcagtcctttgccattataacatagtgttgcaataaacatctgtatacattcatcctcttgcatgtgtatgagtgtaccttgaataaattgctacaagtggtatcactgggttataggggggcttgtaggcttgattttgagatatatgagaggttgccctcagacttgtaggatgagggtcctggtctttggccacatcatatacttgccagctatactctgccactgcctctggagctgtccgcaatcacagcttcacataacgtgggtgaggtgagggagcaccctagacccaggccaggcaccaatttaatctcagacattgagcagagaaatcaaatcgctcaaattcaccttgaaggctcaggtactcttttgttaaatcaacatcttttcagcttagcacttcttctattatttacctagttttcatttagatggaatcttttatttattttttgttatatcctcttggtttattgagccttttattaatataagctgtccttctttgtcttttttaatctttttttgatttaaagtctgtttgttcagctattaatatagtcacccttgctctcttttgattactatttgcatggaatatcttttccattctttcactttcaacctatttcaacctatttgtgttttgggatctaaagtgagtctcttttggatggcatgtgtaggttggatattccatatccaaaatgcttgggacaagcagtatctcagatttgagatttttttttggggcggtggggttggtgggggtggatttggaagtgtttgcattgtatttactaatccctaatctgaaattttgaaatctaaaatttgaatgctccaattagcattccctttgaacagcatgttggtgctcaaagagtttcagattttggagcatgtcagatttagaattttcaaatttgagatacttaacctgtagctggattctgtttttcaacccattttgccaatctctgtcattctatcttggaatttaatctatttacatttaaagactttactgataaaaaagaacttacttctgtcatattgtgatttgttttctatatttcttatagcttttgtgtccttcctttcctagcttactgtcttctttgtgtttagctgattttttataatgtttttattcctttctcatcccttttgtgtttatttctaaagcaaaattatatagctatttgctttatgggtaccatggggattacacttagtattttaaacttataaaactctaatttaaaattatgccattttaattgcaatcataaacaactctgctcccttatatctatatcttgatcctttttagttgttgatatcacaaaataacatttcaatacatgtgtatccgaaacatgaactaattgttgtttatttttaatgcattagtctcttaaattatgtaggataatttttccagatataggattcttggcttacaggtcttgtttttctttcagtattttagctatatcatcccactgctgcatggcctccaaagtttctgatgagagatctccaaataagcttattgagtatctctcagatgtgccaaattgtgtctctgtttatgcttgccaaattccctgtttgtcttttgatagtttgattataatgtgtctcaatgtgtgcttgagttcatcttacttggagtccattgagcttcttgaatgtttatattcatgtctttcatcttatttgggaaatttctggcctttatttctttgaatattctcttttcccttcccctctgcccctctccccctctccccttctccctctatacctctctccctccctccctccctccctttctttttggaactcctcagtgcatatgttggtctgcatgatagtatccacaggtcccttgtgctctgatcacttttcttcaatctttttccttctgttcctcatactcaataatttcaatggtcctgtcttcacattcatgcatcctttcttttagctgctcatgtctttggatacctcttatgcgtttttcatttttgtcattgtacttttcagctccagattttctctttggttactttttaagtttttatctccttattgatatttccattttgttcacatgtagttttcctgaaattcttcatgtctttagttctttgagcatctttaaggtaatagttttaaagcagttttttagtagctctgtcatcagcttcctctcagggaccatttttgttggtttgttttttcctttgagaggccatatttttaccatttgttatatgctatcttagtccattttgtgattctatgacagaatacctgagactgggtaatttataaaaaaaaagaagataatttatcatagttctggaggctaagaaatccaagaacaaatagctggcatctggtgagggctgctctctgcttccaagatggcaccttgaacgctgtgtcttccagaatggaggaacccaatttctttctttgccctgtccaaagagggaagggcaaaagaaaccaaattccctctggcaagaccttttataacagcatcaatctattcatgctctgtctgtatgacctaaacacctcctagaaggccctaattcccaacactgttgtcttgggtattaagttttccacacatgaatttgggtggagacattcagatcatagcataagcctgttgaattttttgtgaaaactgtgcgtctaaatccaataatgtggtaactctggaaatcagattaggctccttccctggggtttgatattttgttttgttttattgttttaggctgtctttgtgctaaggatcaggctgaggtgtaaagtaaaacctttttagatttcttccaagcctgtgtctttctttgggcatgtgtagtgactttctaatttctttcacatatgtagttgcttttgaatttctttgtctttagtgtgtggttctcaaaaggagaaagacaaaaatgaagggtggaaaaaatgggccagccctttaaatcaccaagaattcctttcagccagaggaggaaaggattgcaactatgagggagaggtacaacaacaatggctgttcacctctgtgtctgcacctccatgataagaagcagcaatcagcaagtagaacaaagatccctgatatttggaggacaaggtccttattgcccaccctggctcctgtaagctgtgtgcaagctgctccaggaacacatgcatagctgcctgtctcaggaatggagggtgggtaatgggtagctattgactagttaagagctgaaattgatgaaaattcatggttcaagctttcctcttgaagtaaaaggcttcagtacactccagagttccaaaatagctacatcagacagattctctcagtgtaattgttgtctgggtgggctgaaagattcctggtgttccccacccctttgtcgttccagaatcctcccttccctgctatttttaaattgacagtttttattgctagaagcatgagagaaacagtaaggaggctaacataattggacgataatttggaagttataatgttataaccaaagaaatcataagtagctgtttctagtcttcattgaaaagtaaatggagtttgaaaagctcctctttgctcaaggctgctctttcgttaatgtttgtgtagacaattgttgagttttgctctaagaacaagcttacccactctctggattgtcatttcatagagctattccaaatttaaacttaggtagattcaggttgagagccaatatcagtatgagagtggttataaaatgattatcattttatgcaattagaatgactactttttcaccatacatgtgtgtgaatttgtatgtttctccttttttccaactcctcaaacagttctgtgtgcataatttagcaagtaaattgagtgtcataaaacctatataaggttaccatcattactcattaaataaatggccaaggtaacacttatgacaaatctgtcttatggtaacatctgcaccctcttttctgctttatgtcaaaacccagattccttttatttaacttttatttttagttcagaggtacaagtgcaggcttgttacataggtaaacttgtgtcatgggggttttacagattatttcatcacccaggtgttaagcctagtgcctgttagttatttttcctgatcctctcccttctcccacccttcaccctctgagaagctccagtgtgtgttttttgcctctatgtgtccatgtgttctcatcatttggctccctaaagagaatgtggtacatattctctttacatggtgtattacatacaccatggaatactatgcagctttaaaaaacaacaagataatgttctttacaaggacatgggtagagctaaaggccattatccttagcaaactaaaacccatgttcttaaaatttaccttctcaatagaccaacatgttccctcttgtaatgttttctgctaaatagctaccatggtctggcactgaggcaagtatctcttatttctaaacaagttcttaatttaaaaaatagtaatcataatggcatttgtttttggccagattcccaatcttgtattctcattattatttactcaaaaataactttgtcatcttcatcctcaggagtcttatcctcctactattactcattctctggtcttctaaccacagaaagcacatttttatgttatcctttctggaaccctccttgactcaaggccttagaatccctaaacttatattattttatgaaaaactttaaagtttgatttttttatgtaatagataagaaaactgaaatttataaagtttaagtaacttgctcaggtttatatagctcttatggaagatctgagaaatgagctcaattctatatttaaccagtatgaattattgtctttcccaaacccacaagcatcatttgcactgaagactttagaaggctgatcaatcataatttgcatcctactctataattcttacagtctttttctccccaaagcacaagataccaaatctatttcccacgcaaaaataagaaatgttgtactactggtaaaaagtaatatgcagtttttaggaaaaaaatcatgacatttgaaagaatattatgtcactttagtattattttcagactgctaaacaaccacccttgataacatacttttattttgtgtcacattctaatttggtttatattctgtctatattattcatagcagattccaaaatctccttagttcttgacttgcttgtatataataaagttttttttttctgaaccacatcattaagctgaaatgtgtgtatatatatacgtgtatatatatatacatatagtgtatatatatgtgtatatatacacgtgtgtatgtgtgtgtgtgcgcatgcacacctgtgttggttattttgtggtttgtttttgttgtattaataaaagattttatttgtatgctttattaaggttatatatatatatatatataagtctccaaaataccagtcccgattttgaatactaaatttctttctatcatggtattctttgtttttaaatcaaaccagtataacaaaaatctaagcaagatagacaagagtaaacttagaagtcaataactaaaaggcacactcacacacaaacacacacacacaaacaccctagcgatctgtaattacagcaatctgtaagcccatcagtcatatttccattttttgtgaccatgtgaccacttcctagtttttagaaaaactaattccacctagcatgagtctgtatttggcacatttttttccaaaaacatttatgcaagatatgagcagtactatactgcaacatgtttgtatgctttggggcaatgattttcaaaaagtcctctatttccagcctctaaaaatctcctcattagtctgagtagtgacaggttcacacaaacctctctatcactgctgaaatgccaacaaaaatagtaactgcttttttctctaggatcaattctcttgtcataggtcaggctgctgagcaatcattcaatcagtcttttagtcatggtcctataacaaactccttttctccctgttgggatcagtatctgattcaggagaatttactaacatttgtttagctctgaaaaatttctccttttattcagtatctttaaaattcctcatgaactattgaaatgttaataaaaatattcaactagctattattatgatgttaaaactgatagcttttcatgtaatttggttgaaaagcactagacattatcaagtgtagctaagtaaataagaaataaaacatttattaggaaatactgataatttttagctttaataaacagaagaattggctagtcatttctgaaatcagtcatttttgaaaacataattatattctttacccagagcaaaactggggtaatttaatgagcaatataaataagatgccccttaaaagtagaagaatgcatttgcaaaactatgagaataaaaatgcaatcctgacattagaattatgtgtccactgggaaattctctgaagcaagttctttcaaaatgtcattgaataagtttttaacctctccagctttttccactacctagctgttctacttcatttattcttgtcttttatattgcacttcttcttcagggttagttagttgctctattctctaaagttaggttttctgtacccaaatctgaatgctaggccctgtgtcctcatccagatacttaatgtatttcctagttcaacattttaagtggggttgataatggtgtaaatatttataaatgctaacacctggttcattttaacaggaaaatgttcaactttattgaccatagtttttcacatattctctcagggactttgtttttcactggccaagccattgtgaaaatgttttgaaatgtccagttttcataaaaggtttagtgatattgttggtttttgatacacgtatgtaaaattggtaatttttaatttctgaattcttctacacaaaaaataatacctacatatatttttaccattttagtttgcacagccatgattgttagtgaaaatgaacttaaatcttaatactatttttatgctcatactcctaaataatgactttaaaatgtattgcactttataggttgctatacaatgacaaacatctcattagtatcgataataagcttctaatatccttagggatcatatagtaaatgaaaaaaatatattgtgatgttaaatgacttatgtaatactgtatccgttcagatactttcaaatgcaaattaaaaaaaaaaagaactgaaacttacataaataataaagcaatgtattagttaacatgaaagaggaggaaagcttcaaactgacttaatccggtggctccagctttgggtccacttccctaagatttttctcagccctctccaccaggtttttttgtctagtcattaggctgggaaggaaataactacaggagatactggctttagagttctttgaagaaatatccagctaggagaaaggtgttgtttttattttattttattttatttttttctgtctaacttaagattaaattcaaatttccctgaagctataacaagcttcatttcactcgattgcccaaatttagtctcatcctcagttctgatctaattcatgttgatggaggtgtgtcactgattgataggttctcctactacttctgtttcatagcaattattataatttgaataataagcaaataaagttgtgtgcagttaatttatttttttttcacctgtggtagggtagaggctttgcctattttgttcctcaatgtagcacagcatagacaagtccctagaacatggtatttgataattatttagttattaagtagagacaaagaaaattcatgtaattagtttcatatggaagttggtatttaggtggggtggtaactccaattctttctgaggacagaatttactatgggaaatatttaagctattatccttgccatccacaatcttagtacatttctgcatgctctctctctctctctagttttctactgtcagtgtagcatacataaatactacataaatacaccatatttactcattaaaaaaacaaggctgcaaacattgtctcatctttttcccaaattaactgcagttagcagaaagtttagtaactctgggttagtttgccttcctattaattattccagctacttcagagtttatagccctaaaagggatcagtttgattccctcacccatgcagagggaacactcaaactcccccttgcatccctgctaatgattccttctatcctgcagcgtgtatcattcatgcttagttatgcgagtccaacagatccttgatgttaccttgctgatctggctcattgtacagattcactctgtccctgaaggatggtgatacccaacttcagggctcatttcagacaatggcttctcagactatgtctgttaatattgcaacttttggtcctaaccttctttagtccctatacattttcctgaaatgaggtggtccctggagtgctgatttggactagctcgtaggtacaccacattaaaacactttccccttctcttgagcttacccacacctgcaagtcaagcagattaatattgtcattttagtcctcaaaacacaaataatttatgtaaagctcttttctgccatttgtttatggaagagcaaacttaaattattctactggtcctggactcttcatttggagatctctatcttcaataaaatgatttttttgtcatctcactaaagaagagaaaaagaaaacaatctacaaatatcatttctggtatagactctgaaatattacataccccttaatattgttgtaccttgttttattgttgttgtttacatatactaatgtatgtagacatggcaagggaattctgaaaagcaaaattcctggaataaccaatgatttatttgagcacagtttagtactctattagactatgttgagagatcaaataatattcacattcatattatgaaaaatacactattttaaaatgaaaaacagatacctaactatgtcatgaaaagttacattcaagtaaaatagaaaatcttgaagtttcgtgttcccaaccaaagacgagaagaagaaaatgctgtagtattagtcaagaattttgcttaaacagtgcccctctacttactttgcttaatccttgcttagatagagaccagttgcaactttgcaaggtttcattgcctcatctataaatatgggataataataatatctaatctctaacttgacacataggattaaatgagataaggcatgtgatgtaattagcagcttagtgcctggctcacgacacacacttaatagagattattgcaattactattgtcatcatcattctttaacacataaatttgggatgaaaaataaagagattcttgcatggtaataatcaaatgttttaagttgaagtagatgctccctaaagaggcttactggtgtattaaaaatatgtttatgatttattttcttattcttaggcagttgctatttatcttgactcattttcttatttgattttccttatattccccaaagtgagggtgaaggttggtatacttctaattttgcatggagatataggaatttaatagaactacactccctgattcttcctttgggtttctttaggcttaagcctaaaatctacaattagaatggaaataaatcctaagtaaatataataacgttcagctatatttcgcacaattgaatttacttgatctcagcatccttacaagagtggtggaaaagttttattattccattttacatactccgaattggttctcaatgacattaaatgatttccctaaggtctcatgtctgggaaatgtcaggatagtaagttgatcataaaatcctgtaatattttctttctactacattacctcacattatcttttgaaacataacttaatctttttaaaaatagttttcttatcttttctttcactctcccttcttttaactaggcaaaaccttgtttaaactatgccattgctgtgaacaagtaggaattgctgatagaggaattaaatgttagaagatacagggaaacattaattttttctgtgtaacattgggttattcagcttttgtgataatggtttcccaatgactggaagaagattgccaaaagaagtagtaagacagaatctaagtagttttctcccatatcatgagtcccaagaatacccacatgtttgcaaaaatcctggtggagagggcctctgataactcagaggcattgtactgtcagccatggcttattacagtgaaaggctacacaacaagctcagcaagagaaaagacacatccagcaaagtctggaggaattcatgcacagcattcagaaaaccctttctctcaggaggggccacacagaatgtgttctttcttccggcaattaaatacagcaacacttatgcagtgtttctgcccaggagagtctgctgttgactgagttcaagattttccctggggactggtcatgcaggcactctctgcctatgtgatcagccacaatcatagaaattccagactcccagaaggaaagcagctgtttactataaatcaggctgatacagctaattcagtgcctcaggcaaacaaaacagctttatcagtgtagggaacttcaaaagccacattgctggaaaccagccaagtaacagccctgcaagcaggcccttctaaagagtagtttaagacctcctgtggtaactgctctattttccagggacaatacgtaggggacagaggaacacagcagaattttgaaacaggatatacaatcacaataagagaaggagcaccaagtatcttctgttatcagtagaataatcctgatattctaaacctaggttttcaattttttttttcaggattttgcttatattgtaagtacagtaaaaaatcaagatggtgaaatacaactcaggaacacacatgtattaaggcaggtttgacagttccatcagtatactacaaaaaaaaaagtgctttgtaaacctaaagccacagtggccttagaccatgttaaatgctttaatacatgtccaaaggattaaggaagtataaggaaagagaatgtgagttctttttaggaagatttaagaaagctccaggaagaagtggcatttgagatccttcatccttaaagatttcaatgacaaaggtggtacagtgatattcttgttattgggaacaaatacaggaagctatgaatatagaaaatattgggaaatattgcgtaatttggtgtaatattgtacaaaacagtgatgtacattattgtataattaatataatggtaaaagttatattcatatcatactattacaattaattatttttgatattcgatatatacaaggttagaattgggaaattcataccaaagggatttgttcacctattttctatcaaaaaaaatcccattggatattaagcagcaaattatttatacaatgttgggaaataatgtggtaacacttgtttactttttaatgttccatatggatttaatttttgtgttattgtctgtagaataaaggacaataaaaaaattaccaagactttatctggttgttctggtatgtttaaacaaattccttggggattagtatttcatttactaataaaaacttttcaacttcagtggacagctattagttgatacacatacaggtatagaaattataaataatttttcaccgaatcatactgaaaaatttatagtcattgttttagaaatcatatttgaatatgacttctttcaataatatgacaattaaaatgttaggaaaacactgattcaatatgtactaatttattctaaatgccaagtgctaagtgtacttatatctataaaaatgaaattatatgaagtgtacaattactttatcaaacattcatccatttaattaaaattttctttgcgttttatacctaacttgtaatattttgtatattcccatcaagtttttctaattgctttcaattggaatgagatgtgcttgagatggtattagaaataattaagaagtcagacacagggagattgctttttccaggacattatttaggtaaactattttcaaaaatatcaaacagtcaccaaaatgggtcacattctataaataatagaattaagttttgaaacaaaggttgcatactttccttgttaaaatccaagccattctcagaaaaagctaattatcttaaggctgtgagtcaactgttgccaaatggtcgcacagttagcgacagaggagaaatgaagcacagagcagtaaaccttggggattcacctggcctccttcgcagccaagatttttcctatggtgttagacaacaattaaaaaatttgaaatggaaggtgactcagtaaagggcaaactgaaaagtgtaactctcaatcagatcatccatatcacagtaaaagaataaccagagaatagtgaaaaaataaggagaaagtaacattttccaaagccggtgtgaatagataattattcttctgcgtaactggagaagtagaacaaatactgacatcatatataatagggacctttaccaactagctgggaagtcttcagaaatcatattctctatctctaggtttcagtttttcaccaataaaataaagtggagtggactaaatgatttctgaggctgtttttccatgctaacattctatgtctttatataaaaggatctatttgtagaatagttgagtgtaagcagcaggagaaagaccttatctgttttgacccagcacatagaataggccctgtcccgctgggcgtggtggctcacacctgtaatcccagtactttggaaggctgaggcgggcagatcacgaggtcaggagatcaaaaccatcctggctaacacggtgaaaccctgtgtttactaaaaatacaaaaaattagccgggcatggtggcaggtgcctgtagtcccagctatttgggaggctaaagcaggaaatggcgtgaacccgggaggcggagcttgcagtgagcagagatcgcgccactgcactacagcctgggcgacagagccagacaacgtctcaaaaagaaaaaaaaaagaataggccctgtcccacagtcagcactcaaaacaacacttgttaaatgagtgaataagccagaaaataaaggctggtggattggtaaaatgacttttactggaaagactgtgtatgctgacacatacactggtacaataagatgtttgtctcatccttttttttttttcttttttttttgctgagacaggctctcactttgttgcccaagctgaagtgcagtggtgccatcatagcttactgcaagcttgaaactcctgggttcaaacagtcctccctcctcagcctcttgagtagctaggactacaggcctgccctaccacccctgggtaattttttattttttgcagaggctgagtctcactatgttgtctaggttggtctcaaactcctgggctcaagtgatgcttccacctcagtctcccacagtgctgggattacaggtatgagccactgcacccaccccatccttcttctttaaggtaaattacaccctttgtgatggtggagcaggtagataaaaacgaagtccctaaggagcctcagtgtttctcacaggtttctgtgctcctggttggaaaagctaaaaagtggtttgaagttagttatgaatattagagaataccttttgtaatgagttatctgctatagagagtaactagtcctctaagcagtggtcagattgctgtttcatgagaaacagtgactagcttttccatgttgaatgaatccaagtaatatcatttaagttaatatacagatttaatttcaaaatctatcttcttgactggtacatcctggctaacttgttagacatagccatggaatttatttaattagcttctccttactataacaaataaatgctagtttgaatgaaaatctaatgagagccaattatatatttaaagcatcacctgacttttgaaagatgttattaccagatagggagaactaaaatatactcaattagttataacattctcttctcaatgttcatggatttcctagtaggatccaattctcagaaattcatgatgcaaatgcagttaaattgaagtagatatcatagagaaataaaaatggtcattttattttcagttagttctttgggtttgagaggatattaagttacagtatgagacactgatctgtcaaaattatgaaacattgatctgtgagataaaaatgtaagccacggtacattttctgacttacagtctgagactgcacatttatttttctgttatgttttgctgttcctagaaattaataatgacagaaataaacacatttaataaagtaagatttccagcagtggattttaacacaatctgatttatttgtttaatattgagtcttcaatagagtttctcagatagtatgtagttttacattatgagtactacatttaaaagtgggaacttaatatggatatactgaaagcaatgccagtttacaagataataattattaaaaatgtaaagtacctacagcgcaggtgaaataatgcacgcgtagactaccactggttacttgtttaatattttggggtactcttaaaagaattgagggaaattttaaaagaaaagcattgagactccagtttgatataggtaaaggccacaacttttgtatactgatacacttatttagttgaaatcgtttaggtaacaatgctcaaatattaaaatggagacatttttaaaattttgatttttggccaggcatggtggctcatgcctgtaatcccagcactttgggaggctgaagcaggtggatcacctgaggtcaggagtttgagaccagcctggcaaaatcctgtctttacaaaaaatacaaaaattagctgggtgcggtggcatgcacctgtaaccccagctactagggaggctgaggcagaagaatcgcttgaaactaggaggcagaggttgcagtgagctgagatcgcgccactgcacagacagagtgagacatcatctcaaaaaaaataaataaaaaataaaaattttgattttctaaaagacaagaaaatcctagaattttatagccaatagagatattcaagattacctagttcagtttattaattttcctgaaaaagaaatgtagtctcagagtttttggtgatttgcccaaggttagcgagagaaaagaaacaatttattcatttcacttttttttttctgaatgaatttgaatggttaatattatactcaatatattaatggcatgtttatgttaaaaagggtaaataaatatcattttatagtaattatagagatttattcattcagttcatttaattaatattagtttagtatctactaagtgccagacactgttctaagtactggggatataaagttttaccagatggacatactgtcatggactttacgttctggtgagaagaatagtcagtacacaaaataataaatacattaatatgaaaaatattttccagtgttaaatcctgagcagaaacttaaaattgagtgatatgacaataagcaagttgatgtctattttagaatcaatgctcatgaaagtcctttgacacaggaaatttaaactgagatttgaagggcaaagggataaccctatgaccttgggaaggttgtggggagagatcattaaaagaagggaacagctggtacagaatctcttgagtagaaaagattcagaaacccattgaatgccatttagaatttattgtatataatcatatataattttaccattttaaatgtgttgttctcaatttataatatagagtcagactttcttaagtaaaccttttttaattttttttttttttccaagaaatagtcttgctctgtcacccaggctggagtgcagtggtgccatctcagctcactagaagctccgcctcccgagttcatgccattctcctgcctcagcctcccaagtagctgggattacaggtgcccaccaccacacctggctaaattttttgtatttttagtagagatggggtttcaccatgttgaccagactgtttagaactcttaaccttgtgatctgcctgccttggcctcccaaagtgctgggattacaggcatgagttcccaggaccttctttaattttaaaacattatgttaaaactaaatcattactcttggtattgtgctacttctaatccatcctctttattttagttgaactcagtttatatttctaaacattgcaagttagtttagttttcaccctgaaataaccattatcttgatagaatggggacactgtcctgtcaagaattgtgctctttggcaggggtccctaacccccaggccacggaccatgcttgtccatgacctgttaagaaccaggctgcccagctggagatgaccagtaggcaaatgagcattactgcctgacatctgcctcctgtgagatcagtggctgcattagattcttatgggagcacaaaccctattgtgaactgtgcatgcaagggatcttggttgggcactccttatgagaatctaatgcctgatgatctgaggttgaaaaatttcatcccaaaaccatcctcacccccagcggtggaaaaaatgccttccacaaaaccagttccaggtgccaaaaaggttgggaaccgccgctctacaagagagtctggtattaacaattttaaaaaataaagtctttgtcactgattattgtttagcatttaatagaaaaacatgatggcacactctctgtggtgttgtagatagtgtgataagaaaatgctgactctcttaaaattatagaagaaatactagatttttgttggcttaactttaataagaataaataaattaatatgatctccaaagtgaacactactgatattacttatggatctaaattaatatagtacaaatttggtaaaactatttagatacatggatgcttagaaaagtaaatattccattcattttgcaaatatttaagtacttatttagaacctagcatcatgcaccaagcactgtttgagcaactggtataatttagaaacataaaaacaaagatccctgtctttgaggtacttttattctaacatggaaagatgataacacacaataataataaatttatacagtgtgttaaaatgttttaagggtgccagaagtgaagtaggcagaagattgtaatattaaatagagtggtaaaagtagtgctcattgagaaggtgagatacaaacaaagacttgataagccatgggagttggctatgcagatatctaggtgaagagagttccaggcaggatgaacatctagtccaaaggcctatggtggaagaatgcttggcatgttaagaactatcaagagagtcataatgttgcaatggattgatgggtttggtgtatagagagatggggacagacataatagacagattcatatgcaaataatcataatctagctattaatactctctttttacctatttgagtgcattctctctttttatgatctacggtacaaatatgaaacgtagcttactagatagattgattcaataagcttagtatctcatcaaatagtttttcaaatagcaaaataattgccttatgatgtgacatatcacacattaagtgctagtccagttcttacatatttaaattcacggttagactgtttaccaccatgattgcatgctaaatcaacatgcctttcactgacaatatttagagttacttgttttctgaaagggtgtctttgacttcctatttaaggattagattaccaatcagaattgttagaaataataccccataaagtttatattggtgattagtctcatatctgaactggaaaacaccatcacaaacaaccactcaggtatgagcatcagacatgctataagtaatctagtttcaggataaactctactgtatgaaacctcataaaatatgatgacccaagtccctggagcagaaggaatttaacttatgcaatgtaccaagatgagaactgctagaaaactggggggcatggaagtgctaatctagtttaatattttagttagccttaagcaacaataatcacagacacactctatgaaatgttatttgtgcccatacagtaacattaattttcttttaatttttgtctgcctcaggaaatatttcaattgaatttcacattttttcccaaggaatcagggcttctggaattcaacgtcatttacttaactttttttccccacagttattttcaaatctaaatgaattcaaaaccaatcatttattattttgcatttacttcttcagttggtaaaaatgacatggtttagattgatctcttgaacattaatatagttctggaattaggcttactcatttaataggttactcaatcactgatttgctaaacatgtatccaaatcatgtcagttagttatctcaacacacataaaaataaagtattagttacttttggaggtagtatgtgtaatagttccaaaagtagctctgtaatgagatactctgggctcagtattcaactctgctttctttgatctgtatatccttaggaaagttaattaacctctccttccctcaatttttctatggcaaaatggggattagtaatggtaacatattgtaattgtgaggtataaaaaaagtatataaaatgatataaaaataatccatgtaacatgtactgcataatgcctggcacctagtcagactcaaaatgtaaatatttctgttacatacatatgtgtatatttagaagtatcctgtggtatggttacaatattgcttaaggtaataagtgaggattttccatttttacaaagacagaaccttaaaagtgaagcatggttaagtgcctgaaaataatgacatatattctttttttaaatgggacgtgaacaacaattcaaagcttccagtgaatggcttattacagtatagacattcaaagattaataggattaatttagaaaggagggaagaaaaaatatagtttgataaattttgacatttggctgttctttgtatttcaatagattttagcccaaatcatgataaactccataaaattttcaaacatgtgctttagaaatccctctgtgacttaaatttcaacatagcctagggggtgaatattttttcaataaatggctaaaaaagagataaaagaattacaaatctttaaactatgtttattaacttaaaaggaagactggatttatgtgtaagaatgaattagtgcagtttttaagtaggttaagttgccttaggaaatgttctgtgtttctaagtcaattctgtaaacctatgacactcctcgatattatcacttacaaaacgaatcctaagtaagactaacattagaagtccatatatgcaacaaaatatttttatcaacaatataattggaaattgaaactgaatcaaaaatttacacaacaaactgatagagtaaaatacagatatgtaagttaaaaaaatcagaaactacggaagcttaaataaggctgacaataggtgtgtaagctgtgttcaaagttttttggaattttttaacttcttgagtagtttaattagtttcactgagaggccatacaaaacagaaagacacagagtaagaacctgtaaaaggaccaatatacctgtcttaaaattaaaacataatacagatactagattttaccactctgcagagatcatccattacaactctctatatcctcctcccgataatcatcaattttttaccaggcaagcaaagacccagagacttaaacaatatccttatcatccaacaatgtgtttctgtcactaatatgatgctgccatataataaatgtggcagtgaaaagcaagcaggccagaagtgttttacgactcttgtcgttctttgggccacatgctgtagctgcaacgtgaaactaacaatagcaagaactaataaggggttgcattttattttgtctaaagagatcagttcaaaaacaaaacagaataactggtagatcattttcatttcagcccaatgggggaagaactattttgcaatataacatgtgataaggctatggtcagaattaaattaatccaggtaaaacacttggaatggtgcttggtacatagagaacatgcaacaaatattagttatttttataactgaaatagtaatgagtcttttatttagataatgccaataagggcagcaacatcttatgccactaacatcagtgcatgttgcagttaacgatggagtaggcactgtgctgcgttttataaagattctttcatttatactataaattatttcaattttatagctgtggaacctggcccatgaaatggttaaggaatgctctagaagttatacagtttttaagactatgatttatgatagaactgctgaaacaatttgtttaaacaaagataattctggattagggaccccgtggccagagttcaagtccccaaactgacacttataaattaagttccctggctgcaagcctcctcatctataaaatgaagaggttgagctacagttatctaaagttccttctagctctttcctgtgccttcacggctaaagctaaatgttaaaaagtcacacagttacttgaagccttttaaaaattattattttattcagttaaatcatggctactttctacatgttaagaaaaactgtcacaacgaaatctctgaagttctagaaataaaatatttattccatctgtccaatctatattttttcaatcagaaaaaataaatcaaccaaatctagggatattagatagtgatttctgcctttttgtttacagggaagcaggagaaatccttatgacatgatagaagttttagaagggtttctaatcattatgaaggggtagatctcttccctcacctccctgtgtaccttagacaaagtgggtctgtatgccagcgcagttaccaggggtgttcatgcagttactagaatgcaagacaaatttggtaggaagttctattttttttttttccagttaatagcctttctcccttcctgccgtactaaaccatcttaatttagcacactgcagaacatttgctttagggtaatttttttcctacctaaaatttataacattttggttttgtctcatgtgattaattttgatcaatgcagagatttcatattctatagtgagaaatatgtatactgagggaaatgaattttttccaaccacatcccccagagtatttttaaatatgctttgctcaagacatgctaggcaaatattacatttatatatggttgaagaataacaaagtggattttaaatcaattaaaattctgtgaatcttatattaatattaagaatcaacccatatgcatacatatatatgaataatttgactgttcgtgtgtacatcaagtcttttgaagagtcagacaaattgtctcagtgaatagaactaaaacatattcttctttctgaagtattttaatatgtgttttagtggaaatgatataaaagtataaaaatgcaaaggatttttttgttgtgtggtatatataagtgaacacaaataaaggtgtttgggttattttagattaatacttattttgaaagtatcccttgtgctaaatgttatttcttagttagttggggtgatattacagtatgattttttttaaagcaaatcaaccaaattactgtcaataagagtcagtaaaaatcaagattgtgcatgtttcctagcataggttgtaagtcacagttgatacttccctaacagttttccacattcaagccacctgaccttccaacttgaagacagtcttgctctagtactcaagagtaatttctgctatcagttaaggcttggcatctcccagatcatagaattaatgaatcttactataccttacttctcctttgaaacacaatcttgtctaaagccctagtatcatatggaaaatcctcttaagccattattttttgcccacacagctctcaaattcttgtcatcagatatactgcttcaggttttcaacctgaatcttggtctgtcaataatctagtgcctaaattataccaagctttttacattgtttatacagtacctcttatctactctggcaagcttgcctttcattccatattccaaccatgcagttttttttttttccactaaatgcttattcccagctccttttaatcactgtgttgctttgaagaatcatgatgattcatacatgagtttcatgttacaataaatttgtattgaaaagtatgtaatacattaaacattttgactgatggaagtttaaagcaatttgactaaggatgaaaggatgaacttggtattgaggctcttaaaatattggtttaagttttattttatgcttactagatctggaacttagtcacataatttaaattttgtaaactttaatttcctcctttgaaaaaataagctaaaataatatttaccttgacttctgtttctattcatgaaggagttacatctgtaagtcttgtcttccagctttcattgctagaaaactggactaaatacatagaaaggctatgatcttcaagagaagagaaacaaatgagatcaatccaacactggaatttctgactggaggcaatttttagaccatggtacatggtacatggaggaacagcctaaacataacttcatggtattcaaattttgtagttgagaagataagatctgagtttagagagaacaaaggagctagaatttgtggggcagattaccagagaggagggaaatacacaaagagctctagaaatccgcatagggcctccccagaatatttgtttgaatagcaatctacacatacataatgtgaaattccacatgaccaggcaaagaacaactgtgagaaaagaataattagagtgaactgtcagtagaattcccaggggtctcacaggtctggtaatcttttgatttcccatcagccagaatagggaacccccattaaatacagagggtattcagtagagagcacagagggaccaagccttaggaacagggataaattaacactaaagactacttcagactcaccctaaaaaatgtttaatgcaagcctcaaaggaatcagtatcactcacaggtaacttaactgcctgccaggaacaattctacatctaaatcaatgcacctaaatgtaacactaaataaaataaaatttataatatctggcaaccaataaaaaattactggacatgagaaaaaatagtaaaatgtgactcagatcaggagaaaattcagtcaatagaaacagacctggaaatgacagataatgaagttaacagaaaaagttgaaaacactattgcacagtgtgaatgacgaagaagacgggtgatttctgcatttccaactgaggtaccaggttcatctcactggggcttgccagacaaatgggtgcagcccacagagcagggtggggcatcacctcacctgggaagcacaagaggtcagggaattacctttcctagtaaagggaagccctgacagagggcacttggaaaattggggcactcccaccccaatactgcacttttccaatggtcttagcaaacagcacaccaggagattatatcccacacctggttcagagggccccatggccatggagcctcactaattgctagcacagcagtctgacatagaactgcaaggtggcagcgaggctggtggaggggcatctgccattgctgaggcttgagtaggtaaagcagccagggaagctcgaactgggtggagcccaccacagctcaaggaggcccgcctgcctctgtagactccacctctaggggcagggcatagccgaacaaaaggcagcagaaacttctgcagacttaaatgtccctgtctggcggctttgaagagaatagtggttcttccagcacagagtttgggatctgagaacagacagactgcctcctcaagcaggttcctgacccctgagtagcctaaataggagacacctcccagtaggggcctactaacacctcataaggctggttgcccctctgagacgaagcttccagaggaaggattaggcagcaacatttgctgttctgcagcctccgcaggtgatacccaggcaaacagggtctggagtggacttccagcaaactccaacagacctgcagctgaaggtcctgactgttagaaggaaaagtaacaaacagaaaggacatccacacaaaaaccccatctgtacgtcaccatcatcaaagaccaaaggtagataaaaccacaaagatgtggagaaaccagagcagaaaagctgaaaattctaaaaatcaaaagcctcttctcctccaaaggaacgcagctcctcgccagcaatggaacaaagctggacagagaatgactttgatgagtcgagagaagaaggcttcagaagactggtaataacaaacttctccgagctaaaggaggatgtacgaacccatcgcaagaagctaaaaaccttgaaaacagagtaaacaaatggcaaactagaaaaaacagtgtagagaagtccttaaatgacctgatggagctgaaaaccatggcacgagaactacgtgatgaatgcacaagcttcaatagcagatttaatcaaatggaagaaagggtatcagtgattgaagatcaaatgaatgaaatgtagcgacaagagaagtttagagaaaaagtaaaaagaaatgaacaaaccctccaagaaatatgggactatgtgaaaagaccaaatctacatctgattgatgtacctgaaagtgatggggagaatggaaccaagttggaaaacactcttcaggatatcatccaggagaacttccccaacatagcgaggcaggccaacattcaaattcaggaaatacagagaacgccacaaagatactcctcgagaagagcaaatccaagacacataattttcagattcaccaaagttgaaacaaaggaaaaaaggttaagggcagccagacaggtcaggttacccacaaagggaagcccatcagactaacagcagatctctcagcagaaactctacacaccagaagagagtgggggtcaatattcaacattcttaaagaaaagaattttcaaccaagaatttcatattcagccaaactaagcttcataagggaaggagaaataaaatcttttacagacaagcaaatgctgagagattttgtcaccatcaggcctgccttacaagagctctggaaggaagtactaaacatagaaaggaacatctggtaccagccactgcaaaaacatgccaaataaggccatcaatactaggaagaagttgcatcaactaatgagcaaaataaccagctaacatcataatgacaggatcaaattcacacataacaatatgaatcttaaatgtaaatgggctaaatgctccaaataaaagacacagactggcaaattggatacagtcaggacccatcagtgtgctgaattcaggagacccatctcacatgcagagacaaatataggctcaaaataaagggatgcaggaagatcaaccaagcaaatggagaacaaaacaaagcaggggttgccgtcctagtctctgataaaacagactttaaaccaacaaagatcaaaagagacaaagaagacctatgtaatggtaaagggatcaattcaacaaaaagagctaactattctaaatttataggcacccaatacaggagcacccagattcatgaagcaagccttgagagacctaaaaagggacttagactcccacacaataataatggcagactttaacaaccccctgtcaacattagacagatcaacaagacagaaagttaataaggatatccaggaattgaactcagctctgcaccaagcagacctcatagacatctacagaactctccaccccaaaacaacagaacatacattcttctaagcaccacatcacacttactccaatattgaccacatagtcagaaataaagcattcctcagcaaatgtagaagaacagaaattgtaacaaactgtctctcagacaacagggcaatcaaactagaactcaggattaagaaactcactcaaaaccactcaactacatggaaactgaacaacctgctcctgaatgactactgggtacataaagaaatgaaggtagaaatgaacatgctctttgaaaccaatgagaacaaagacacaacacaccagaatctctgggacacattcaaagcagtgtgtagaggtaaattaatagcactaaatgcccataagagaaagcaggagagatttaaaattgacaccctaacatcacaattaaaagaactagaaagcaagagcaaacacattcaaaagctagcagaaggcaagaaataactaagatcagagcagaactgaaggagatagaggcacaaaaaacccttcaaaaaatcaatgaatcctggagctggttttctgaaaagatcaacaaaattgatagaccactagcaagactaatatggaagaaaaaagagaagaatcaaatagatacaataaaaaatgataaaggggatatcaccaccgatcccacagaaatacaaactaccatcagagaatactataaacacctctatgcaaataaaccagaaaatctagaagaaatggataaattcctggacacatacaccctcccaagactaaagcaggaagaagttgaatcccaataacaggttctgaaattgaggtaataattaatagcctaccaaccaaaaaaagtccaggaccagacggattcacagccaaattctacccagaggtacaaagaggagctggttccatgccttctgaaattattccaatcaatagaaaaagagggaatcctccctaactcattttatgaggccaacatcatcctgataccaaagcctggcagagacacaacaaaaaaagggagttttagaccaatatccctcatgaacatcgatgcaaaaatcctcaataacatactggaaaaccgaattaggcagcaaatcaaaaagcttatccaccacgatcaagttggcttcatccctgggatgcaaggctggttcaacatatgcaaatcgataaacgtaatccatcatgtaaacagaaccaaagacaaaaaccacatgattatctcaatagatgcagaaaaggccttcgatgaataaaattcaacagcccttcatgcaaaaaactctcaataaattaggtattcatgggacatatctcaaaataataagagctatttatgacaaacccacagccaatatcatactgaatgggcaaaaactggaagcattccctttgaaaattggcacaaaacagggatgccctctctcaccactcctattcaacatagtgttggaagttctggccagggcaatcaggcaagagaaagaaataaagggtattcaattaggaaaagaggaagtcaaattgtccctgtttgcagatgacatgattgtatatttagaaaaccccatcatctgagcccaaaatctccttaagctgataagcaacttcagcaaagtctcaggatacaaaatcaatgtgcaaaaatcacaagcattcttatacaccaataacagacaaacagagtgccaaattatgagtgaactcccattcacaattgcttccaagagaataaaatacctaggaatccaacttacaagggacgtgaagaacctcttcaaggagaactacaaaccactgctcaatgaaacaaaagagaatacaaacaaatggaagaacattccatgctcatgggtaggaagaatcaatatcgtgaaaatggccatactgcccaaggtaatttatagattcaatgccatccccatcaagctaccaatgactttcttcacagaagtggaaaaaaactactttaaatttcatacggaaccacaaaagagccttcattgccaagacaatcctaagccaaaagaacaaagttggaggcatcatgctacctgacttcaaagtatactacaaggctacagtaaccaaaacggcatggtactggtaccaaaacagagatatagaccaatggaacagaaaagagccctcggaaataataccacacatctacaaccatctttgacaaacctgacaaaaacaagaaatggggaaaggattccctatttaataaatgcttctgggaaaactggctaaccatatgtagaaagctgaaactggatcccttccttacaccttatacaaaaattaattcaagatggattaaagacttaaatgtcagacctaaaaccattaaaaccctagaagaaaacctaggcaataccattcaggccataggcatgagcaaggactttgtgactaaaacaccaaaagcaatggcaacagaagccaaaattgacaaatgggatctaattaaactaaagagcttctgcacagcaaaagaaactaccatcagagtgaataggcaacctacagaatgggagaaaatttttacaatctacccatctgacaaagggctaatatccagaatctacaaagaacttaaacagatttacaagaaaaaatcaaacaaccccatcaaaaagtgggcgaaggatatgaacagacacttctcaaaagaagacatttatgcagccaaaagacacatgaaaaaatgctcatcatcactggtcatcagagaaatgcaaatcaaaaccacaatgagataccatctcacaccagttagaatgacgatcattaaaaagtcaggaaactacagatgctggagaggatgtggagaaatagggacacttctacactattagtgggactgtaaactagttcaaccattgtggaagacagtgtggcgattcctcaaggatctagaactaggaatagcatttgacccagccatcccattactgggcatatactcaaaatattataaatcatgctgctataaagacacatgaacacgtatgtttattgtggcactattcacaatagcaaagacttggaaccaacccaaatgtccatcaatgatagactggattaagaaaatgtggcacatatataccatggaatactatgcagccataaaaaatgatgagttcatgtcctttatagggacatggatgaagctggaaaccatccttctgagcaaactatggcaaggacagaaaaccaaacacctcatgttctcactcataggtgggaattgaacaataagaacacacagacacaaggtggggaacatcacacacaggagcctgccggggggttggcggggggaaggatagcattaggagatatacctaatgtaaatgatgagttaatgggtgcagcacaccaacatggcacatgtatacctatgtaacaaatctgcatgttgtgcatatgtaccctagaacttaacgtaaaataaagtaaaatgaaataaaataaaaacaaaaaaactattacaaataaaaatgtcaaggatttaatgagaagtataaagagaagtataatatgagagaaatagatagtaaaataatatcaaaattaaacttctagaaatgaaaactaagatagctgaaataaaaatttcactgaatgggattaaaagcagataagacactgcagaagaaaagatcaatgaacttgaaggtgtaacagtagaaaacatacaaaataccaagagaaaaggaggttttacaaaagtaaacagtgtcagtgattttggtgacattaacaagtcatttaatatataatttgagttccagaattagatggtaggaaaattgagggtcagaaaaactgtttaaagatgtaaggccaatgttttccccacaagctttatgaaaacaatactcccatgatctcgactcactgtaacctctgctttctgggttcaagctattctcctgcctcagcctcccgagtagctgggattatgggcacccaccaccacacccagctaatttttttgtatttttagtggagacagggtttccctatttggccaggctggtcttgagctcctgacctcaagtgatccacctgcctgtgcctcccaaagtgtagagattacaggcatgagccaccatacccagcctcaaattgatcttatatttagctaattatacatgtgtaataatgataaaaatgagaggaggcagaagagaagacagtaattactattttgggatatgctgtgcctggccctttgctaaatgctgttacatataatatctcatttaatcttcctagcaaatacatttggtagctactatatttattatcatttttcagtcacaaaagatgaaattgagagatattatgtaatttgttaaagggcatagagaagaaagtgacaaaccagagatttaaaattatgtcagtctgaattcaaagcatcccattatactatctcccagatgcaaaaatctataagcatgaatactacttcagaatttacttttagcataagctttacatttaagaaatgttctaattttttgttttatattctttgtcacatataatttagcctctttaaactgttctataaatttagataattttctataatcagaaaacaggctaccacctatatacaaaaataaatggtatgccatgttgatcctagaacattttctagggtcaagagagtagtaaagctactgtttaaaataaaatggtttagttaatatgtatgttcatgtgtttttatctaaacaatcaagaaatgatgatgaagagataacatgtttgaaaaaaccctgaaaattttttaaacataaatgctgtagccaaatgaaaaaaaagttatcatgtaactatgaaatacttaactacaatattgcactcccagcattattattgttgctacttaatggaataacaacagtaatagtatcttcttaaattcaaattcctaaatataaagctagaaacataataggtctagtgcatctttactacaggacacttttttttttttaccttatacattgatagtgcaatgtatgtgataaatgcattggtaatgcaaatatataattattattatgtgctattcaaattttcatcaaaaatagataaatactttgactttaatcaaaattcttaatgatagtgtgaacatttttaaatttgtgttctccaaagctttgttaaataatttatcagattagagcaaaagtaattgtagtttttgccattacttttaatgacaaaattgacttgctaagaaaaagaataactctttcttcttttaattaagtatagtgcttattaggaacttaaagtggatccttcttttatattgtggagatcaggtatgctaatagaagacagagaaagccctttgacaggaaataaaatcctgaatattttatagataatcagcagtactgcaagggcttctgctgtcttttatcaatctgactttgtttgggcgctgagatctgctggtaggtgaactagagtaggaggttaccatcatagaatatactgtacatactagttcaagtttaaacatctttggtttcaacaaagggtaggcaatcattgcttaaaatagatgtattaacattttatttttacttatgatgtaggggtcggcaggaaatgcattgggactacatttgaagacttacttagctacacacacatagacacatacacacccatgagatagtcatctatattcagatcttctttgttacgaataagtgaattatttcctttatttcaaaattattgcactaatatgaattattatttaattcttcgttgccaataataatatactttgcttttctttttcagggtttaaacttgaaaagactagagacagtacaaggagggagagaggtaagaatgtttaaagaagaggggtgggaaaaagaggaaacatggctatggtgttgcagtgatgtggtgatggtgattgacgataattacgttgataatggaaatggagatgcattgaagagaatgttgtctgcatatggctctgttcattctgccaaagcatattttacatgtttatgtaaatgtgttatttgtgcttgttcctctgaagctaaagaaaatgttgtttctctgattaggcaagcattgtttctgttataatggatttctgtagcagcaggtcctttcacagggggcagaaacattacaatgcaatttttaaaactgacttactgagaagttaacaaaattctaacaatgcaaatattttatgacatttgggattcctcattttcctgtcaaaggcttttggcatatgctactaggttggtatgcattattagagagtatgaagttgctctggtaaagctagtaattttaaaactaactgaatgtgaagacttaacatcacttaattttttttccctgctaaatgtataaatgctgtacttaactctgtgattcaggttgctgggagttgtgggaagggtggaatatttaattcagtaaatcaaaacattctaactgcacaaaaaaaatcatttttgatgatacttatattgcaatttttgtacaaaagtgaaggtattttgttctatacaaatgaggaaaaaaatcttactgtcctctccatttgtagcttcctttctgtataaacagatttcttccctatagtggtgcttgccagctttcctttatgttttaattccagttgcatgattttagtatttgacattttagttcctagtgaatttgtcatttaaggtctctttccattttctcagatattttccatccagaaaaatctatttttatttaggaacacataaagttggttcacattgatggaagagctagatgaagtgaaacatagataaatctttagatatttttcatgttgtaggagagcaagatgataagaatatggtcatcagtatgactggggaaaaaaggcacttcataaggaagatctcagaaccttttacagctttgtgagaatgactgctttcattcagatgtaaccaaaatggatctacttatagaaagaactaaactgatcacctcctaaagtgaaagttttcatccgagcagtactgctacaatttatttctgctgatttagtgcctttagggacatactaagtggagttactcggcttctccttgctgcttcctggtctaatagcaactttgtgtcaaaagaaggaaaactgaaatctatatatccgtacgatggcattgctaaatggtgccaaattctgcatttgttttactaagatttttatagtttttaatgttatttttaaatgcataatgattgggttttattgaaagagtggctcttaaatcatattgcttatttttctaacgtcctttgattttatttttattataagtgtacttataagtaaggaacatggtaaaatgtgtttaaattaattttagaagtatattgttctcaaaactattttgtgatttctctgaaggtcaaaattgtaataatttacaatttaatgtatacatctccatagaagggacaacactgattttggccttctccctcagggtagtggaataattgtaaaaagctaagatcatcaaattaaccataatccagtaatgtcttctgcacttgacatctctaattcatgaccagaaagtaaatgtcaactattaaaattcaaaacaactacttaacttccacttagggcagcactgggttacttaagcatatttctattcaatgtaactacttaccttaactttccctgtgactaagaggcctagtatgttctaagataagaaacttcagggaggtataagacaattaggtgaagtatgttgtaaaaactgttcttttcaagtctcaatggtagatgacctgtaaacaaagagtacaattactatgttaaggaccttgtgatctcacttgcttaagaaatgggacgtgtatgtatctaatttccatttgttatgttctaggatgtgtgtgcataacaagatgtacaatgtaattctgattatgttaaattgaaatgtgagggtttagaaaactcttactccaaatgatttcttagaatttctcattgtaatgctattatgattgataaatgacaataattgtttattatgatgaattaatttcttagttcaaatgacagctattccccataggtgttgatggatgcaatatcaagggcttattaccaaatatttataagaagatttaagaagtgtcatttaaaatattctatttacttattgaagtaatgaaaacagagtattcatagaaaatgaagtagacagtaatatgctatttagctaagtggtaaataccattaaaaaacgaattgccagacaggaaggctagatttgaaactatatgctgtataaaaatataagttaaggagaagtgattaaaatgtaaattacttttctgaaggaaatagagataggtaacacctaaattgctaaattgtgaaatatacaaaaatagttattagctgtatgaaataaccccatttatattggtatttttacatttttatacgtgcatattgtgtatacaatttgagggggctgattataatagataataaaaagcttgtttaaaaagggagattagtagaatgctatacaaaatgtgattgtttaacagatatttctaactgattataaacaattttcttgcatccagtgggattttgcaactcatagaaaaacctcagtgaaattcactgggtaagacacatagataagtcattttttttttcattaagtgtggataatactaagttactgtaatttttcttaaaagactttaaaatacctttgttattttaggtagtttttttgttttccaaaggccagtttttgtttaagtattaaagcttctgtgtgtgcctgtagcaggacgagccatggacaaaaccccacagacaccgaggtagtgaaggaagtagcttttaatcagctgaaagcatcagcagactagcatcctaaaatccgagcttgttgagtgcacaatttctgtcccttttgagggctcataacactaaagattttacatgaaagggccgtgattgattgaacaatctaggcggtatgtgacaggggctgcaagcaccagcaatcagagtgaaacagaacagaatgagaagcttcagagtgtccttccatacaatgtctggaatctgtggataatatcggttgctaggtcatgggttgaattttaactatcaggctaaggtcaggcaggcccaggcctggttttgggtctggtgcctggctctgggctgcctgcctttggtttcacttccttgtttcttcttaaagcaggtactgaatataaaacaatataaaacaatatggggggatctctttctctcttctttcatttcccacctttgagactctcactcattttattagtgggaattctcactttcattttcactacttatgtcttcccgtgcaatagattgatagtgattcatataatatacttgtgctgaagcattctggtgaactaaggtaatgatgaagctttttatcatttgaagaagtacaggtagcaaacaagggagtagtaagcaggttcctattactattataactcctatgataagagttttaaatcctcctattgctgggaaccaatttccaaacatggccccaggatcaaatccgtgccacacttgcatgggtacatgtgccagttttgttatatctttaaatatgtcttcaactacttgcccttgatcatctatgtggaaacagaaattagtaaggttaaattttccacaaactcctccttcagctgctagcaagtagttcagaactagtctattttggtagatagtattccttatctgagtctcttgctgggcaagaacagtcaagacttgacaggttttattagtaataatttctaaaacagcttgcaaccgtatgattcagttgagcatgaagatgggggtccgatatccccatgagccatcttgtgcccaagtggtgggtccacagtattgtataattctttcagggggccattcatcatctttccagttacctatggctatgcttcatttttcgcgggaagcatagacagggaatcctaggagtttgtctgtttttatgggcagtaggaagaaaggtggtgtaatagtgccaattacacagctacctgtccactgatcaggtggcttagcataggctctatgtccacatatccagtataacctgctgggggcaatccagtcctggcggaattctgggtgggctcaaacagtctgcaattttggaaatttactgaatggatttctttctgtgtaattggaactccaccatgtaactgtttttgtggtaccattatacagtttttgtccaagacacctaagccttactacaggatgagtgaattcttttccttctctagctatgcaatattgtccaataattgaggcttttagaacccagaaattgtcagggtggttcttttgggctgggaattcatcaggaactgggtctgcaggaactaattcttgggcttcccatggccactgatctcctgttacagttcctccacaaacataccattaagtgacttagacactgagctacatgctcggctaattgcaaaaacaaatttctagtttttcctggaatttcaggtactggcacatttagttcatcatagaaagtctgaaatactggctctggagagcattttcgaatctctccttttattaaaatatttacctcagggtctagtccttttccatcaatgcctggagatacgtactctccttttctccattttgggtccaaggggtttgtgattactaattcttaaaggttgcagcttccactcatgcaggaggggcttcctttccctttttggagccaaacaggatcttcttcatccttttcccaagtagcccaaatgacacatgaccagtacccacatttttttccacacaatcctacagatgtacttattttcggtcatgtatcttttttcccaattaaaagagccacatcctgctcctagcttatttctattaatgacagcacaagcgtcaaattataagattatgcgtttgggcacccctttttcttctgttctggctaatactttacttgtatcatttatgagtcctcactagtcttcagtccttaatctgatttcaaaaactatggaaatgggaggttcagaggggtcatagcacacgtcaggctggtcacttcctggattacagactttgtactgagtgttattatacaaacatgttccttttggaattactaggcattcataataactatagaacaaaaaaaattgtcttaacgtgttgtcctacctcagtgacctgatatatgcactgaaagcagtcctctgtgtgggaagaagcagtggaagcttttaccacaccagtccatgttataaggaaaataagtcccacgactattttcctcatgcttcagccatgcgtagaccagtcagcttccgggtgtgactggagcagggcttgtcgtcctcctcagggttactttgcagggattgtctaggcttggtttggcctcccaggttccagtggctgcgggctttatgtggctgtggtgaatccaggctggaattccttctaccttcacagctgtgggagtggtcaggataacggtcttgggtcccttccactgtggccgtaagggagctacatttcagtccttgatccacacacggtcacctggagaaaaagggtgaactggggagaataagctgactgagcacctctcatttacccaagttgagattgtctgggtaattttccccaaggcctgtaactgtctctgcaattcaatttcatccaactcttggggagtacctggaagtcctcgcggtataggaggaggcctatgatataatgtttcataaggggagtatcctgttttcttagagggggtgcacctaattttaaataataccataggaagggcctgtatccattttaatcctgtctcttgatatactttccctaaactatttttgatagtctgattcatttgctccacctttccggaactgtgaggttggtaggcggcatgtagcttccaagtgagtcccaatacctttgctgtcctctgtactaagtcagccacaaatgctggcccattttctgagccaatccgtagaggcagtccaaacctagggatgagatctcaaagaagcacatgggttacttcatgagctttttcagttcatgttggataagcctctacccacccagagtaagtacacactagaaccagtaaatacttgttacctctgcatttgggcatctctgtgaagtccatttgaagatcttcaaagggagctgctccataggcttgtatgccaggaggaacagaggggccttgctttgcattgtgctgtcgacaggtaacacattgctgtgctgctgttttagcaagagctggcaagtgtgagatgtagaaatactggctgaacagcttttcaagtgactcctggcctaaatgggtagtttcatgtacagccagcatgactgcagctcctagcagctgtggcacagctattcttccatctggtaactgtatccacccttcttttattgtttgtcctccctctgcctgaagaaagtctttttcctctttagaagaagtaggcaccagatcaggtgtttgagggagtaggggggctgtgactgatgcccggtaaggagtagatgctgcttttcctgcctctgtgtctgctcaggggtttccttggctcactgaggtggaagctcactggtgtcccttgcaatgcatgactgccaccttttggggtttccatactgcctctaataattgtagaatttcttgttgatattttatgtcctttcccccgaatttaataggcctttttctttatataatgctccatatacttgaatggttagaaaggcatatcaagagtcagtataaatgtttacagtcttaccttcactaagttctagagcccgagttaaagcaatgagttcttccttctgggctgaagtgccctgaggcaatggtttggcttcaataacatcatccaaagttaccaccgcatatcctgcgcatctttctcctcgtggactgatgaagctgctcccatccacgtataactcccagtccactgatgcccatgactggtctcgaagatcgagtctgctagaatacactgagtccaacacttccacacagttatgttcaacagggctgtctgatactgggagtaaggttgcaggattcagagcgttacagacctcaatggttatgcgggggttttcacatagcaagctttggtacttggttaatctagcatttgttagcccatggtgtcctttggtatttgttaaagtcaccaccacatgggggacctttatacttaagttttgcccaagggttagcttgtctgcttcttatgctaacaggactgtagctgccagggctctcagacgtggaggccagccttttgaagctccgtctagctgttttgagaggtaggccactggtcttggccagggccccacagtttgggttaaaactccaactgccattttttctctttctgacacatagagtgtaaagggctttgtcaaatctggtagtcctaaggctggggctgacataagtttttcctttaacttgcaaaagtcttgctgttgcagaggtccccattcaaaaggctcccagttgcccccctttgtaaccccatacaacggtttggctagcactgcaaagtttggaatccataatctgcaaaaccccacagatcctagaaattcccttacttgccttctggttttaggtttcggtaagctgcagatgacttgctttctttctgaccccaggctgtgcttctctttccgaatagtgaatcccaggtagcgtacctgctgtctgcagatctgagctttcttcttggacatcttatactcacagtcctccaggtgtcgaagcagggcatccgtccctttggcatacccatctgccgtggagtgtcctagcagaagattgtccacgtactggagcaagacacagcctaggtctttagcaggaaacttctggaggtctcgagccaacacctccccgaagatggtggggtaatttttaaacccctggggaagccgagtccaagtgtactgagtagtaacacctgaccccggatcttcccactgaaaggcaaacagcttttggctctcaggagctagtctgatgctaaagaaggcatccttcaagtccagacaagtgaaccagctgtcctcagctggcagcaatcctaacagtgtgtaagggttaggaactgttgggtgtagagtcactgtagtttggttaaccaagcgtaagtcctgtacagttcgatagtccttggtccctggcttggggacaggtaggaggggggtgttccatggagattgtcaaggaactataatcccaaaagctttcaagcatgtaagatgaacctgtattccttcaagatcttctctgggaaccggatactgcttttgtctaattggctgagccccaggcttaacttgtatgagtactggggcttgattgatcgtcagccctggaggattgtcctccgcccatactcagggccatcgcttagctagagccggttttatctcctgacctggctcggttagaaaaagtctccattcttcttctcaggggactgtaagggccatgataactcctgttcctggtaacttcagttgtaaagagccctgttttgtaaaggaaatggtgtctctcagcttactaagcaagtctctccctaaaaaggcaaggggcaatcaggtatatacagaaattgatgagtcactttatgtcctcccactgagcaggtccaaggtaggcagaaaacctgcttggcggagactcccgttgctccaattatatcaatggtttttttgataagagggccactggggtggttactactgagtgtccggcaccagtatcaaccgaaaacttaatgtccttgccccctattgtcatcctgaccatgggctccttggaggcatttgagcccggtccccttcagtctagtagcccttcgaacagattgaacaaagtcccttcgtctttatctgtggtcttttgctgtgcgtcaccttgcttctcctttagttggagacacttatctttccaatgtcctatttctttacagtaggcacactggttacactgcacatgtgagtgattggactgggcattcctcctggaacccccctttccctgccctttgggggggatccctctaattgccacagccagcaaatcagtgttctgcctggcctggccttcaccctccttatggctttctcagcggcttgttacatctctatttacaaatacttgatcagctatctcccgtaactgcgaggtattcatctctgcaaaaacagcctgtttttgcgatttcctccggatatcttccatgctttggctaactaaggccatgttaatcatatgctgattttcaggactatccggatcaaaaggagtgtacatacgataggcctcacactgtctttcatagaattggtctgggcttccctcctttccttggatgacttcagaaacttcatttacattggtggccttctgagccccttttttcagcccttcaattaatgcctcccagtatcgttttaacctctccatatctggtccttcatttggatcccattgagggtctgttcctggcagaacaattcttatgtattcctgaggattttggtaatcagctgggacatggtcctctagccatttagttgccacctggagtatccttcacctttcatctgtgttaaagatgtacatgagtagctggtggtgatcagcccaagtaggattatgagtctgtataatagtttggagcaagtcaattagagcttcaggcttttcagtgtaagatggaatattatttttccagttgaggaggtcagcagaggtgaaagggtaatataaaaagcacacctttccactgtatgtccatcctcatctatcccagcatattgctgctttctcaggggcatttggattccagtattgggccgtaaatgggccgccaagggaggagtttctcctgcagcttctcttcctttcttgtctactctgtgtggtctaggggctgtgggctcaggagtagggggcctttccacttggtaaaggtggggcactgttggtgccatctcctgccatgagtcttcaggctctgaatcagacagaactttaggggctggcttccctcggcaggtggagtgagaactttccttaactaactgtccctttgctactagtactgctgctgcctgtccccttaaccactatgggggatctaaaactagctgtaaccaggaatctatatatgggaactgatctgggtgtcctggcttgccagttactttatgccatacctttgaaaccagagacctgtccaggcttccttctgatggctaacttacctctaattcgggccaatctatttcacacaaagttcttagttttcctggagtcatagtgactccatagtctcctttgaatcctttcttgaaattatttaacatagttcccaatggagtgggcttacattttgcctggcccatgttttctgaagacaaaatatcatgctcacaccacacactcaccacaaaacaaagaacaggtaaagagggcacacacacacctttatcgtttataccaaaacaaaatcagagtaccaagaaattcaagccaagtcaaaaccaaaaccaaagtatcaggcaattcaagtcaagtcaaaaccagaacagaagtgccgacacaggcacaccgtgggtgatcaggccacgcttccacttaaatggagtgggcaagtttcaaagacatgtcttaccaagtttcagatgtccggactccaagtgccaggtccttcccagtgtccagccggtgcctgtgtgcacagttttttaatggcggattgtctttatttttaccctacctcaaaaatgcccaaccatcggtattctgaatattctgtatcacaggtctaaaatcacatgatatgtgactttatatcatgatgaagagaactaataattatggttgaatatctaaatcaggaataaatatttagcttctgaaattctattgaatgtgataagctaatatgaaagacactggctattggaacttttggattaaggctgttattggaagttacagaaactcaggaaccatagaggctatgcaaatgaagtacaaatgtgtagtgatcaaggatcacttttatataatttgcatgactcagatctcttaaagtgatgaacagtcttggcagggataatgttgatcttattaatctgaaattctgaaaaaaggttaatattggtacacttgaatattttagatagtttatactcttataaaactgattataaaaatgcttcttaaacatcagaaagagaattaacactttagataatttctagaagtatttagaaatatgatcaataactttatagacatactcattccattactgcaaaaatccccgcttgtgttttggaaatttttcagttgatgatatttgtgtgatcatgccattgatatttaaaaatcccacttttgtttgtgggattgcaagtacagatagattcttatagacacttaggaaaaaagtgtacattttaaattattaaaatagatgatttatgaatgtatcattctcaagaaaataatgagcatatcttataacctgttatctgttttagagtccagaatgcttcactaactttctctgctggattacagtgtgctgattctccattttctttgctgaaaaccataaataggaaattactgatgatacaaacctcagagacttaaagaaacataattagagacagttgaaaaaggcagattgaaaatcaatgtttagttaagtactcttttcccagccctgttttatatttacattcattaatcattgaaaataatacttcaagattctttattgatgtaaagtatcatttgaatatataacatcctaaagaaaggaattattttattctgatagtggactttatgcctttgctaatagacttggatagactttgcattgtttatcttttgaggaattaaatatttctacttgaaattgaaaatcattttaattctctccaaaagagaaaattctgagaatcagataaattatattctgaatttcaaagtaacttgccaacctgcaacattagcacaagaatgatttcaactggaacaaaataaaaatcacaaacaatttctctttccatttataacttaattagaattatgaatcagactactttaggactaggttattgcttgagttaagcaaagtcactcttttctcttgcccaaaagatcactggagataatttttttttttttttgagatggagtcttgctgtgttgcccaggctggagagcagtggtgtgatctctgctcactgcaagctccgcctcccgggttcatgccattctcctgcctcagccttctgagtagctgggactacaggcatgtaccaccacgcccagctaattttttgtatttttagtagagatggggtttcaccatgttagccagggtggtctggatctcctgatgtcgtgatctgcccgcctcggcctcccaaagtgctgggattacaggcgtgagccaccgcgcccagctgagaattgtttttttaaagggataaaagaagaaaaatacacaacttccaagactagaactaaaattgaagaaaatgtactattcttggaaataagagttagcaaaaatcattaagcactattgttcccttaaggtctagtattttgtataatttggaaattataggagataactatacttattttatagccttgtgcattgaataaaaagaatcttccataagaaattgatcatgattacaagttttctttgataatttttgtgcaaaacttgcttctacttgtatgttttctttatggtctaatatgcagaatacactatcttgaatttttctacttcagttcaactttagagatcccattcttagtttctgtatagtttagtagaataagaaaatcttgtataatatcagtgatgacaattttttgggaaatatatagaatttttcagtggtttggtgcctatagcccaccactaagatgtatctgatgaacagtgtgaatttaagatcaagagaccctttaaggactcagtaaaaaatatctcaaaactcagaattgataggcaataaggagagtaaacgatctttatacttattgtcaatgaaaagggtcaaactctgtaaaatatttgaagagatttattctgagccacatgagtgaccatggtccatgacatagccctcaggaggccctgagaacacatgtccaaggtagttggggcgcagcttggttttttacattttagagaggcatgagacatcaatcaaatacatttaagaaatacattggtttggtccagaaaggtgggacaactcaaagcagggggtggggtggggactgcttccaggctatgggtaaatttaaacattttctgtttgacaattggttgagcttatctaaagacctgggatgacagaaaggaagtgttcaggttaagataaaagactgtggagaccaaggttcttttgaggtcttatagtggctgctcttagagacaatagatgacaagggtttcctattcagatctttaaaaggtgcagacttagttaatctctttaggcttgggagggccaggaagaaaaaaaactagctatgttagtagagattctttacagatgctgattttcctccacaaaagacagctttgcagggccatttcaagacatggcaaagaaacatgttttggggtaaaatattttgattttcttccttgtcttgtaatgttatgccagagtcaggttggaaagtaagtcacaatatatagagttaaataaaacccatctgatgagaatttatgatttgtagggcatgactccccagaccctttatataggaatttgggcaagataaaaaaaaaatcagtttggtcctcattataaatcaacatttaattaaaagaactacacattacaagaccataataattgttcctgtttcaaaagtttgttgagaaaatgagttaatatgcataaagctctttgagtagtgtctggcacataggaagcacccaatacatggcaacagttactattattattattattatttatataatcaggtctttccttcatattttcttctgtcagagagtgtttgagtgtcatgctattcagagattttactgtctgcgttgactagtccacaccatgacaatcaatgatatcctatgccaggtctgatttttaaaggattttacattccaaatcggttctgaggtagcaaatcccaaatatggcaaaaaattctactttggaatctttatttaacctcaaatattctatttccacatgttatattacagatgagagaaaaaatatttaccttttctacttatggcattgtttattgaaggcagtgcttaaggactataggttttgtaagctgtttttcacatcctatatatgttctgggtcatcttcagattggattttgaagatctcttctatgtttgtagatcactgaccttccaagaaatgacctcaaagaaacctgttgatcaagcaaaactaagcttagtagatctacttcagtaagaaagatcacagtagtgtctcaaatggggaaaaaaataacagtacactcagtttaacttttttcttcttctttggaagtgtttgactggttatctggatcagatatatgcctagagtaggcacatagtgacagaaaaatactttgcaagacaaacaggaaaaaaaagagagaaaggaagggaaacaagtgagggggagccagcttctgacagacacaaaatcactgtgggatgataaaacagccttaaatataagaaatccattacatacatagacacgcacatgcatagaaagccacacaaaataatacttacaacaagattaagcagtaatttgagcactaatcaattacatgaagaaacagttcaaccatcatgtttccaagatagagttccccaaaagggacactaatttaaattgtacctggtaggattatgccagttggagacatacacacataagttaaacttaaaagtaagcaggaatttgacctgaaaggtcaaaagaactgataagagcacatgaaaattttgctggggcaacctcttaagaacctggtttaagaccaggttgagcatggtgaaaccctgtctctcctaaaatacaaaaattagctgggcatggtggcatgtgcctgtaatcacagctacttgggaggctgaggcaggggaatcacttgaactcgggaggcggaggttgcagtgagctgagatcgtgccactgcactccagcctggggacagagcaagactccgtctcaaaaaaaaaaaagaccaggttgggggcctgacaaaccctctacctccaagcaaaataaaactaagtggaacaaatgaagacaagattgagaaaggttttgaaaaggtaatcaaagtaatttgtctaaaggacatcaagaacttctgaactcctgagtctttagaactatacctcttagtgactcagagagtgacaaaaacaaacagtagtgtcctaagtaacagagcaggtttctcatcacggataagtggatttgaagttgattaaataatcaaaggattacttaaaaagcattctcattcctaagaggcagaaactttgtatttgagagactgacaaaaataaatttagacccaaagcaggattttcctcacttttgcagtcagacagacccctgaatgggggagacttatgaggcctcagagaaacatgtttcagacagaggagctcgtgcagatcggtttcaattcaccccgtgttatagctctacaattttttcactgttgatgccacaaaagaccagaatgaaaaaaatctgttgattgaacaaagctaggtatgttagatcccatgcaataaaaaaagaacactacattaacaaagtttctgtaagtctctaaatgggaaaattaagggaagatattttgtaagatgttaaaatccaggctgggttagttaaagagaggtattgcaaggttgagaataggcagggattaggcagattttatgacattgtagcttcgtacagcaaggttagagtttgtgatttcagggttctgaaatgaagcatatttttcttgtttatgtcttttctttttaatctggatataagtaagattttgtagctttacagcggattttacaaagagatgaggaccaagaaggattacagtagaaggattttgacttttgaatcaatatgcatttagatgtcgtttttataaggcacataagttatttttagaatcagttaaaccttggagatatttttatttgaaaaggcaaaaaacaaatgataatatttattttgcttcatcacatatttatttgaaagtatattcataaacaaacttacagtgtttttgtgtgtgcaactgatcatgtaattatttcttgctctttaactatgtcaattaatataaaagaaaatactactccagatggttgaactgattcagcctgcttttatcagaaaagtatttattcatatccaaatgaggttgaactcttatgattcccttcttaattacaaatagaagctaattgccacctcaaaaatatagagaagaaaacaaacattttcattatttgatacttatcatatcatagtaagattttttttctgttttggtttatattttcatattgaacaaataatccttgtgtaaactatctacactttttaatttttggcattgctgtgtaacgtatttagttcctgtaaacccacaacggaaaaacactgctcttctctggagaactttgctgcccttctctcagcttggaaatagatctccaaatttcttcccattccttagtcatctctccttcgaggtcatttatttgacattaggtccattctctgttcacatcctatcctccaagcactttgaaacaatctccagccattggtcgtcactcagccccatgaaagatgagcacttctgatgagtttttaccattgtcctttaatcataccaaaggggcccctcagttccttcccagtgatcaccacatcctcacctatatgtcatcggaaccttttaaataagattacctaataatgaaaaaaatgcatttctaattttttagctcctaagaaacattgtgttgtcaaactattatataaacaattgtctcaattagattaaaatccaagaattagagactgttgcaggaagtcagggaccccgaatggagggactggctggaactgtggcagaggaacataaatcatgataatttcatggacgtttatcagttcccaaataatacttttataatttcttatgcctgtctttaatctcttaatcctgttatcttcgtaagctgaggatgtatgtcacctcaggaccactgtgataattatgttaactgtacaaattgattgtaaaacgtgtgtttgaacaatatgaaatcagtgaaccttgaaaaagaagagaataacagcgatttttagggaacaaggaaagacaaccataaggtgtgactgcctgcggggtcgggcaaaaagagccatatttttcttgttgcagagagcctataaatggatatgcaagtaggagagatatcactaaattcttttcctagcaaggaatattaatattaataccctgggaaaggaatgcattcctggggggaggtctataaacggccgctctgggaatgtctgtcttatgcatttgagataaggactgagataagccctggtctcctgcagtacccttaggcttactagggttgggaaactctgccctggtaattttgtggtcagatcggttctctgcacttgaaccctgttttctgttgtttaaaatgtttatccagacaatatatgcaccactgaacatagccctttatcagtagttctgctttgccctttgctttgtgatttttgttggacccttatcggtagttctgctttttgccctttgaagcatgtgatatttgtacctactccgtgtgcttacactgcctccccttttcaaacccttaataaaaacttgctggttttgaggctcaggtgggcatcacggtcctaccgatatgtgatgtcacccctggcagcccagctgtaaaattcctctctttgtactatctctctttatttcccagctggccaacacttatggaaaatagacagaacctatgttgaaatattgggggtgggttcccccagtaagagactttcagtcttatacaagtcatagttgtgttcaaaataatagctttaagtagaattgctactatacactacatttgtctgctcaagctgctataacaaattaccaccaagtaggtgactttaacagcatcattttaatttttcacagttctggaggctagaaatcttttatgccagctcaaaatcagcaggtttagtttctcctcaagcctcccttcttggcttgcagatgaccaccttcttgctgtgttctcacatgctctttactctgcttatccctggtgtccctttgtgtgtctaaatttcctaataagggcaataatcagataggattagagcccagcctaacagcctcattttatttttctttttggtataaattcatgtggtacaggtgtaattttgttacatgcatagattgtgtggtggtgaagtcagggcttttagggtatccttcacctgaataatatacattgtacccattaagtaatttctcatcatccacctacctcctaccctcttacccttctgaatctccattgtctatcatttcactctttaccttcatatagagtttagctcccacttatatgatagaacatgaagtatttcttttctgtgtcagataattatccttcaaaagccttatccccaaatataaccacattaggaggtcctgggggatagggctttaccgtataaattaggggaggacataacatacactacaagtaatatgactacatcatctgtttccctcaaaaaaagggcttcctctttgccctctgctatttacccaagagcttcttgttctcttcaataactttgaaacttgatcacattcaaattccaaccactaacagtaaacaaaaaaaaaaaaaaataggccaggcacagtggctcatgcctgtaatcccagcactttgggaggcagaggtgggcggatcacaaggtcaggagtttgagaccagcctagccaatatggtgaaaccccatctctactaaaaatataaacattagccaggtgtggtggtggatgcctatagtcccagctactcaggaggcagaggcaggggaatcgcttgaacctgggaggaggaagttgcagtgagatgagatcacaccactacactccagcctgggtgacagagtgagaatccatctcaaaaaaataaataaaaataacaaaataaaaataaaataacccttgtaaacagttccctgtctgcaattatgatattccaagtgctctgaaaactggtttattttttcctcaaagggaggctcaagctagtttgatggtaaaaacctgtcctaaactaaaagacctacttacggtttttgtttttttttcacttcacatgaacatttatatgttttgctgcagaaacatcaaagtgttttgtacagcctgctgctccaaaccttactggggatatttttaaaatgtggtaaatgctctgtattattatctgataatcaaagtaattctgaattaccagatacatttgaccttcagaatgttagataaggaattgtaggactgtggcaagatacatttcactctgaacactagaaaaacagggtcctgtctcttcgccataaaaaatgagttagcatttactatgtgcttatcatgggccaggtgttgttgtaagcactttacacatattcaatcatttaattctccagtaaactttagaaatagtcacgattattctcattttaatacagaagaaatgaaatcagaaagtgtttgaataactttcccgaagtcatagttagtaagcccaggaagccagaattcaaagctagaaaatatgtctccagtgtaaaacttaaacaatacactatgacttataaggagagaaattaatagacataccacaactgaataattctggactaatggcattccttgagagcattaactaatctccacttaactaaacacttctattctctctccctctttttctactctttcccatggtctgtctatcttgcctacctattcattgcctataggtgttatctcatccaagacatgactataactactattttgatgtgctttggaattgttggattacaaagaatagaaacttatgtgtcaggtgcatccatttggtcttggtctctgtcttttggaaaatggacagttatttattctatttctcttttctcaaattccacaccactgtactctgtgcaagctagatagcctctttactttttttgtttgtactttgtcctccatgataacctccaaatgatggtatcagctatctactctatagatgaattataacttctaattattgacaatgtggtataattttcccaggttcagctacatgattcaatcaaatatagccgtgtgccacagaatgacattttgcccaaggatagactgcatagatgacagtggtttcataagactgtaatggggctaccctatactggtgtattttttttatctttgataacatattttcactgtagcttttctctgtttagatatgcttagatacacaaatatttaacactgtgttacagttgtctacagtattgagtctaataacatgctgtacatgtttgtagcctgagaacaataggctataccgcatagcctaggtgtatagtagcctatgccatctaggtttgtgtaagtcgaatctttgatgttcacacaataataaaatcacctgacaatgcatttcttttttcatttgagacagagccccgctctgtcacccaggctggagtgcagtggcgtgatcttggctcactgcaacctccacctcccaggttcaagtgattctcctgcctcagcctcctgagtatctgggactgcaggcgcatgctaccacgcctggctaatttttttgtatttttagtagagatggggtttcaccatgtgagtcaggatggtctgaatctcctgacctcgtgatccacccgccttggcctcccatagtgctgggattacaggcatcaatgcatttcttagaatgtattcccttggttaagcaatgcatgatggtaattatgctttagtaacaggaatttgtttaagaaaaaggcattttctttttctctttttttttttttttttgatgtttgaaaagaagaaaaaattcgaatgataaaagcaccatttagcctatcttttacatttaccaccagtaatataatagaagattctcatgatctggaaatattgtgtgtgggaaagacattaaggcactgtggttagggaagttatgtcagtaatagcccttctagaattaaggttgggcagtgctgggctaccatttccattttcttttgttattttttgatcagtagggattgagtgaggaaaataagaaatttgcctgaaacaagcagtttgtagactctatcagcttttccttttgattttctcttgatttctgccataccgatgtcctgaccatcattgaaaagttagcttctcagttatccaagtagacatccaagtctatttcagtgaagtgaggtgaaagtcttatctttcattgattaaaagcaactaaccctatgaagagagacaaatgttaacaatatagtaaattaaaacagttctctatatattactgatccaatgtatatctaatccattgtatttcttaaatcaaatcattgccaatatgtgattcctgattgtggcctgtaaatctcttttgtaagctatagagacagggatcagataatattctgcaaatgaaaattcacaatatatttgcttgtccatttctatatggcattggggtagatagtcacaaatagaactttgaagagtatcctctaaaatggttgagagaaaatatatggcttattcgaatttgtatttttatttgtaattactcagaatgttagattaaaaatgagcaagttaatgaaatacagcaattttaactcatctgcctattaactgataccattgtcaaaccaaatcataagtgttctcctatgctttatataaaaataaattgaaatgcagatttactttatactctgacgtatagtacttaaaaaatttaacatatttgttgaaacacaagcagtcaattttaaggttctgtgcatactgtatacaacctgttagcctcttttttatcaaaaatagacaagtgtttctttattcatttcttgcttccaatggtggcctatcaaaactgttgctttctcctctgacaagttatatttagtaactgtgatggttaattttaggtgtcaacttgactagatcaaggaatacgaagatagctggtaaagtattatttttgggtatgtctgcgagggtgtttctagagaagattggcatttgaatcagtagactgaataaggaagatctgccctcacccagtgtgggtgggcaccatcaaatcagctgaggactcagatagaatgaaaaggcagaagaaaggcagatttgctttctctgttccggagctggggcacccttcttctcttgccttggacatcagaactccagattctctggcccttggactctgacttgtagcaacacccccaccccattcttaggcatttagccttggactgagagttacagcatccatttccctagtcctgaggcctttggactaggactgagccatactattggcttcccttattctccaggtcacagacagactagcaagggtcttctcaagctcgatgatttcttcagctagttcccctaatatatcccctctcatctatctatctattgattgatgtatcaatctatcatgtatctacctacctacctttctacctacccaccaccttatctaacctgtctcctaaatgttctatctctccagagaaacctaactaatacagtaacttattagccctagtatattttctggaagcaaaggtcccaaagattattgagggtaggtagtcctaagttaaaaaaaaaaagtgtcaaaagtgtagagagatcaaaagcattaagtaaagcaaattatcttccaattttgccttgaaaagaatatgacttttttaatgaatgacttttgatggaataaaacaggtgatagtcatgttgaaaataatagttcaagagttggcaacaagaaaatgaatgtgaaaagtgtatttaagaatatggcaaataaaggaatttaaaacaactagatgctacctggagaatatagtaacttcaatattcatttcagagtaattcataaatgttttaatgtagaactccagtcaaataaaactgctaagatttaggcattaatggagcccatggtttcacaaagggtcataaaataatttattagaattttgtatatgttgtattgtttttcagacaaagacatctatgacacaaaaattcattaaattatctcaaaaccaaagaatgattatataatagaaggcaggatagtatattaaactttttatatagcacgtattttggagcttcttatacaagttctgccctttgcttagattaaaactaagcaaattaaagaaatttagcaattttaactcatctacctgttatctgacaccattgccaaaccatatcatcagtgttgtcctatgcttggttatgtaaaaacttagtgaaatgtagatttactttatattctagaaaaatggaatttaaaaaaaaattaacacatttgttgagacacatggagtcagtgagcaatgtgatgttgaacaagttgcctatcttttcatatttcagttgtttcttcactaggaaaaaaataaacttagtgcttgctccttataggattgttatgaatagataaaataaaattgcctataaaaatgatgacctcaatatctggtaccaataaaaatactcactaggaaagttttaaatactgttgtttctgttacttcactttgaattaataagacagtagacattctactcactaagtgtaaagccacttactcaacaccacatcccacactgaatagtggcctattcacggagaaacttctcaggaattactagttgcaaaaatagtacttgacacttatttctgtaatattgtgcttatcacattgtactgtgactttttgtttatctctgtcagtctgtcaaatagactatgagttcctagagaacaatgttttattcaacttatattcataaaacctagtatggcttctaatatgtagtaagtacccaataaatgtttgttgagttgaatgttgtttcttctttaagatcattaagagttgggtttacagcaaatgatactggtttctttctgcatacatagatcattcattcttcttttttttccttttgcctttcatatattatattttggggtcatttagaaataaatagagcagtaaaagttggtaagtatatttaatttaatttcttcccataatatcctacttaaatatatagatgatgataatagttggcacttcttaggtgtatttgagttattaaaattaaaatttgatatagtgagaaaaataagtatatagcctgattttatgggaaccatttttaaatgtggttgaattttttttaatttgacaagtttcataattttaaagctggtgattcaagtgaattttaaagcatgtttatgctgttgcattatggggcaaactcagctggttaaattacccgttatcctttgtcaaaattaaattatacaaggtctgcagacactcatcacttttatctaatgtgaccaccttgaactgtaattcccttttgaataaataaggctgattcaggtggaaagaagattaactgattgcctgaagttatgtaatgcatgtggatttagtacataggttttaaaatgacattgttaaatggtatttaaactaatgtgtaataattaaggaaggacactctttaaaatgacacaaaagtgatatatgaatatgaggaccaagaaactgtgcattggcatatagaaaatattagtcattggacaatacaattaattgatagaacaagtatttttcataatttctgctaacataggaggtgacataaaagggagtaatttgaattttaaaaataaaataaagattgtatatattttaggaggtcataaatttgtaggtattaagtagcatgaataactcttcttttccatcctgaaaactctaccaatgtagagttaatactctataattcatgaggtagtctgtaataataaaacattaaaccaactgggctcttttcccgggaatcactgaagcaagaaatactgtatcaggagaaaggaaaagagaaaaagagagaaagaagaagacaataaaacagaaaaaaaaaaaaaaggaaagaaaactagatggccaaatttaatagggtaaatggaaaagctgtccattttatatgcagtcaaataaaattttctttctaaccttggaagggctactcttaaagcataaaccagttttatgttatgaaaggacattcaaatatgccttatttcatgtaactgtggggaaagcactttatagctctgcctttaaaccttaaagtcagctttaacgtgtttctaaaagttatattccggtattgctgagatattcctatcacaaagctatttccaaagccatgtttgtggtctaagcatgtatctgtaacttactaagagatcgtcctgaaaaattgaggacaagtccagtttttatttttgctcattgaataatgacgtttcctaaagatctttgtcttgtaggccttccttttttgacacttttttttctttttctgagtaatctcataccttaagtgattataaagtttgactgtgttctgacggttcttaagtttttatctaatacagctttatctccagacctatgtatttatttacttgttggatattttgacctaactattctgtaagttttaaaaatttgtacagagacagtgaattgataatctttattatctttgttctttcctccttcatacacaagttctttctgcttagttttctatttcatttaatgtattactacttaagggtcactcattgcagaaaacattgaatcaaccatacttctttctctcttatactccctgttctcaaggtcattatgcagtctctacttcaatctcagttttatttcttcctgtttatctcaattcgtgttgaatgagtttgtgtcttcatcatctctgaaggaaattatgatcataacttcttaattgtttctccatcctctgtcctcttccatcttcagcctctcttctatattgttattggaatataattacaagacattttcatggaagaatattactaccttcccatcacacaaagataagggctaaacttcatcaactgagactttagcaaagaggccttaacttaccattttagaaatatccaaattttctcatctcttcttcagctaagacgtaatgagggaattttagtttttctttaagacccagtacaaatggcatctcattcagcagaagaagttacctattctgtggcatatttgcacttgttatagctgcggctatagaaattattacatttttaaatattaattgccttacatgtgtctgttttactaaatcaagagatcttctagggtagggattgtgtcttttatatctttacaatcttcagaacctgatttaagagacttaagtacaggaagtgtttattaaacatttgttgatacaacaaacgcatgacattgtgttgggaggctctgagttgcaagggagaccttcttgagatttgcaggaattaccactagatgtcactagcacatttctgatagcaatttctcaatcaagaacaactaacctttactgaggacctactgtgtgccaagactttttaaataattctgcaaagcaggtattatcatcacaaatccaccctggagacttacgttttgagtgattagtaggtcatacagctagtatgatgtagaggtgggatttaaatttctgccatcaagcccgtggttttcccacaatccaagctacattctgtttcttttgtgataactgagcctctggcctccgtatgataaatagcatatgctacctttcccaatggattaaatctttattgacaaaataagctattattgagctatctaggcactcacacataccctttgagttaagagtcagtgactttgtttctataagcttttactaaacataaagcaatttatcattcatagaaatcttttaaacatataaatatagattttgaaaaggagcagatagatttttattctcagttatttatgttttttgcaatttagcatttgatatctacatttttttttttttcttttttgatacggagtctcgctctgtcgctcaggctggagtgcagtggcgcgatctcggctcactgcaagctccgcctcctgagttcacgccgttctcctgcctcagcctcccgagtagttgggaccacaggcgcccactaccacgcccggctaattttttgtatttttagtagagacggggtttcatcgtgttagccaggatggtctcgatctcctgacctcgtgatccgcccgtctcggcctcccgaagtgctgggattacaggcttgagccaccatgcccagccaatagctactattaagatagagttgttaattagtgatggacatatccatgaaatacagacactacctccaagcagcttataagcttatgatgtttccttgattcaaagtcaagaaacatcataatactcttactgtagggtgtatttactctgagactttggaatccaaagagcatctatagataccaattatgttgataatgtgacttccattatcaacacttggatcttaaacacttagaagcacattcctaagtatgctaaaggcccactatgttcctgcctgctcagtcaagatgtcatcgtatttttagacctaactctgcttttggagagtcccaataaagacccagaacttgaggagaggtatcactgtagaaaccctttctaatcagaagaaaacactgtcagaaagaatgatgagagggtgcttaggcctgaatgcgtgcatttgaatggacctcatcctgcttcctgctctttgcagttggtggcacaaaagcagttagcaattatacaaatgaaagaaagatgagagggagggagacggctcccgcttctccttatattttacagcttctcttcagtttagtcaatttcagtatctcatcagactaacctttctgccaaactcattggttgttagtatttttgcttctgttattgttaattattaaaaggagttaaatctcattaactgatttaaaattgtacacttatatacaacatgataattttctccacagattttaaaatgtaagaaattaatgtagtcatggaaacagtttatctccttctcttaatattttatacatgccgtgagtttttattttatgggaaattaaattatataaattggaaagttagcaaaataaaagaataatatatttccagtttatttcaaaaattagaaatagttttaacttctaatattaaatatgtataaataatagcataatgtcaaagttgaagggccaattgaataataaattatgttatttctacaaagggatgtctttttagaaagtaagtgaaaatagttaccaactttgtcaatatttgcattgaattatgagttttcaactaagtgagatcattagcaatacatttctcaaataaaatgtacccagtttgtactcctgtcttatcagaaaagaacatcaaatctttttttctttcttttttttctttttgagatggagtcttgctctgttgcccaggctggagtgcagtggcctgatctcggctcaccgcaacctccatctcccacattcaagagattttcctgcctcagactaccaagtggttgggactacaggtgtgcgccaccatgcccggctaatttttgtatttttagtagagatggagtttcactatgttggccaggctggtctccaactcctgacctcgtgatctgcccgccttggtcaactctttttttatactgataaagactagagaaatgttctctgttatgtacgccttccatcttttgctttctacttttgcctggctcagggtacatactaaaaaaaatttcaatggaatgttgaatgcatgagtaaataagttggatatataacgaaagttggagaaagatttggtaatcactcagtggcttcctcctcttgctccctgcctatcctagctttttctttttttttttttttttttcaaatttccattcttttatatatatatatatatatttttttttattatactttaagttctagggtacatgtgcacaaagtgcaggcttattacatatgtatacatgtgccatcttggtgtgctgcagccattaacttgtcatttacattaggtatatctcctaatgctatccctcccccctgtccccaccccacaacaggccctggtgtgtgatgttctccttcctgtgtccaagtgttctcattgttcagttcccacctatgagtgagaatatgcagtgtttggttttttgcccttgcgacagtttgctgagaatgattcacaatagcaaagacttggaaccaacccaaatgttcaacaatgatagactggattaagaaaatgtggcacatacacaccatggaatactatgcagccataaaaaatgacgagttcatgtcctttgtagggacatggatgaagctggaaatccctggctttttctagtgagaaaccaccatggaaaatccaggaactcacagtgtgccgcttgcaagctctgatttagtaaaagagtaacaggagagcctagtgatgagagggcatgctctttggaaccagaatgcccgcgaacaaatccctgctaggtaatttactagctcttgtaataacaacagcaaagaattagaaacagtaatgagcctcagttttctcctccttaaaatgggagacagttgtggtatctacttcatagagttattatgagaattaaatgggccaaaatatgcaaagccattagaacatacataacattttgtaaatgctttggagatggtggttgttgttgctgctggtggtggtgctactgctgtttttgttgttaaagaaaattgcagtttaggaaggataggaataaactatctaacaggctgccttgtttggtctccaagtgataaacaaaaaacagggatcattttttttacttcaacctgcatgaagaattagttttaccgagtgggaagtttgggaattatatattttttctttcataattctaagagggaagaatgggtttaaaaattacttaaatgagagactggtgattttttaaatgttcatcatatttagtaggctactttactagtcaaatttttatatttgtttgctagaaataaatttgcatataaagcctgcttttgagcctctcaatgaatcatacctaaagaaacctccatgcaggttttgagccataaagaaggcaccacctaatggcagaatgttttaattgctagtacaaagctaaacagaaacaatcagcctttaatgttaagcttgcaaatggaaataaaaagatagcattcattacagcaacatccatttatatatgtaaaccttggttccatgtaaatgagccttgaggcttagcaggactagaaaacaattgcagattatgaatatgatcattgaatgtgaggaccttcctgagacatcatagtgttaataccagaatccagtctgccagggttcaaatctagactttacctcttattagctgttgagttggccttaagcaagctatctaactttatgccacacattccttgtctgggacctatgtcagggttattgtagattaagtagcttataacattcttagaatagtatctgatgtagaataagtactatgtaaatgcttattaagtggatgaatagaattactttatgtacttcaattcaatgaagttcataagaagaaaccaaaaccatcttttaaaaatgtattagtgatttactgcgtgtttcaaagtcaaggcttcgaaaggtacctcagttttgtacctttgcgttgtaaggtgtgactttatgttgtcccaaaagccaatgccataggcagaaaaaaaaatgattaagagcatcagttttgtggtgtcaaccacactttaaaaaccctggctttgctactcaacagttacatgaccatagacatattcttatgtttatatgttacttatattatttaaacctattttcttattttcattcatttgtaaacactggaaaatattatcccttactttaatcatccttttttactttctagcaaattcactgtcttcttttccattacccaagtgactaagtgttgccatctttgatattttaaaatataggcccaaaatctattgtaaattgttttgtattaaatagttctaaattttattatgtattaaacagcaaaatgctaacattatgtatgtctggtaaatattttattttcttgtttttgttatccctgattcaatattttcttctaatcgttgatactatgttaaggaaagatgcatgcaattttatgtaaaatgagtgctctaaaaacagaagtacaactttgagaaaatattaaataataatctaactctttttcaccttctttgtggtactctctttctggaagaagtaacaactgtagttatggagactttttttttttttttttttgagacgaggtctcgttctgttgctcaggctagagtgtaatggctcactacagcctcaaggtcccgggctcaagcaatcttcacacgtcagcctcctgagtacctaggactacaggtacacaccactgcacttggctaatttttaaattttctgtggagacaggggctcactatgttgccctggttggtctctaactcctggactcaagcattcctcctgccctggcctcctaacgtgctgggattacaagaatgagccactgtgcctggctgagcctagtcatgaagtctcatttagattggttaacttcataggaaattaaaacactgaagagaaagtaagcttttatgaataaacacatattttatacatcccaaaagaatgccttctgtttatatgaacaaaagcttcattcctaattatacttcagtgctctttctgtctcttttgcataatatctaacttgcaactttctcaatgacataagtgttagactgtgtcattttgaaaatgggtactatgatcaactcttaccagtagtttttgtagaagatgtttctgtggtgaaatttgggtaaattgttcaaatttagaaaccttgataatatagcctcatttcttccacaggcagtctgggtaaggaaaatctgctttgggattctcagtgaatgtgcaagttagtgtttaaaagacaacttaaatttccttccttaaaagaggtgtgaaggagtgagttattgaagttgcaatctgcagttttgatattcatgtataaaaaggggcagatgttcttttctggtaaatcattcccataatacatttgccctgtattcagagatgcatatgcttactgctaagtcatggcagagatttcaggaaaacattgattaaactccactggtgagcaaaggagaaaaaagattagtcacttagaatagagtattattctttcaatcttcttttagcctctcttcttttacaaactgtgtttaattcatactattaagcctaaaatgaactgccattgtaatgtgttttcagatatgcaaaattatatatatataaaatatatctaggaatgttcttagggatttgatacagacaaacccctgagaacatttctagaccacatttttaacatttaacttcactcatatttttagattctcataacttctatatactgtatatttctttgagatgttaaaaagaaaataatagttaacagattcaaaatatgcttttataaccaaaacacagttgagtcaattttttcaaactgaagttaactgtagatgtagtctgagaagtcatttgtactgattagctgtgtataaatagaaaaaaattgaaatgtagggctatttactatgtatataagtatatagggaattaacaggactgtcttcaaaatgaatagagattagtatattactaagtaggcatatgacaagtatgtagatagatgaatagataattgaaaaaattatgcatatattgtgtagtgtgcattttatatgtataaatatgtgtgtaaagcatattttttaaaagagaattcttattttgtataggattttaaaaagcagttaggaagatttgccatggatggggacagtttggaaaagtggagggtttacaaccctatggagttttataaattatctagttctacctccataattttaaagataataaaactgacatgtacaattgagttatatgtgatgactaaaatagtttgattttaatatagagctattaagccatagagagtggggtatggagattagaatacttcgattgtttaataataatttgcataatagtgatttgtatatctcatttaagagtcaatgatcataccagttcccattcattaattcaatattaagttcttgaaaagagctctaaaagagttaaataaactttgaaacatgatacttaactagaataaagcatagttggagcaaagtgtggctgtggtttatggaagtaattgcatgagacaaagagacagaggttctgctatataattacgtggtcttatatcagcatcatgatgatgatggatactgaaagacaatgaggtcagagttaatataaaggatgattttccacctcttagagattacttcagtattacttgaaagaaaaatcaaagattattgcaaggttttaagtctgagtggaagggctaactgtataagaataaggaatctcagaggaaagctaaaacatgggatgatactttagctttaaagttttttttgaaagattacaggttgagtacttgtgaaaattcttcctacttaattcatgagaggaatctatgtcatgaggcgtaaaaatttgagggattattctgggaagtcatctacagacagagggtagttgaatccaggagggaaaattatcttcaaggtgtagagaaaatgggccagattactttggctggggcctgggctatgtttataagtccgaggtgatcaagaagaggaatctgagatggaggtagaaaaatgatatccagaaactaacaaaataaaaccaggaaaatcaggggatgtgtttcaagaaagaggggatgacaagttgtcttacaaaggagtgaatgagtacttcaaaaacacctgctctttttcatattctagataaacacctctcttctctctccctcctgctttctattctgatttggaaaagggtcatatagaaatggatgtttaataaaaaacattttgacagtttcaattggaaaatttaggctttcttgagtaaattctttatatatgttacataaactgtttgctgacatctttttttttttctcatgtggggattttaaatattcatccctcccctgctccccattggagatttatattgtcgttgaactcagtcatataaagtatttcttgtaacattttccttctcttaccaatttaattattagtttcataatggcaaaataataatgaaaaatgatttatttttgtccctgattcacagttttgaatattaataatactgttagtatacttcaagagatttgtcaaagttctgacacttactgcagtttaccattaagaatctatctactgtgtaaggaaaagaagttgtctaagaggaaactgttcctattttctgttctttatagtagaagtgtatggccgttaattagtgatatcattgtaaagaaaaattacattgaggtaatgcccaatgtaaataaagtgaaaaattttacttcagtatgtgctatgttgttgttaattgaataacatatctcttccaggtttttcaaatatgcactattaacttagtatctaatcataaatatgtattttgggccaaaatattatttatttttgacttttagataaatctataccaagaaataattttttaaaatgtaatactttcctttaaaaagaaagtattataaaatagttaatgtatgctagcactatagttatcatttatttattgagaaacttttggttatagtgtctaccccacctaaaataatttctacttaatttcttttgacatccataatttctatagaaatatagataaatattgataaattatctatggatgtcaaaagaaattaagtagaaattatatatgtgtcactccattttaacatataaaaagtcattttgggcagaagattctgacttatttcagaatgaatgaagaagaaattacttttgtgatttgtttctcctccaaaaataattttgaagttatttggtgacatttttgaaatatccagctttggtacctgacatggaatatggattctaagggactaagcttgactcaggaaaagatgcttgtctttaaaagttattttaacaagtgatccctgattggtcaagatttgcattaaaaaatcaacagtaaatagtgatggttccttgatactatcaattattcttagcctactatctattaactttgtagactcgtagatacagaaataattcttggtcaaacctaagataatttactattgatactcatttgttgagcttaatagtcaataattctttgaaagtatatcattcattactcatgtataacatgtttcagcaacttgacattttttttctgacccttccacatattttgttgcctcagtaatatacaacctgaaaaactatatgcaaatatcaaacatgttttcccttcaacatgattctcccgcaaaatcctatttttaaaatgatgcaaacaaccaaaactagaaaaaggaaaaacctattaaatactgatccaaggcaaacaataaccccaactcatcactataaatatagatcatattccgttggaagtgttttttgctttatcattccaaagatatactagcacattgaactcattatgaagaaggtcaaaaacaaagaatactttttctaatgcctgcccttgacttagcatgttaggaaaatgagcctatacaaaagggatgaggagctgatcacaatgcctacctctcctgaaggcatacaaccaccaaatacaagagtggacatgtgaataaacaaatttcatcttgaaggaagacggtgttaattaacatcttacaatgtataattttctgaatcaattctattgcattacttcaaatgattttatttaaatgtgagcagaaaattcaggggacctaaccaaattttcatatagggcagaatactatttcattgaataaatattaggggaacagtgggataaaaatagagttgggcctttattatgctgcaatcatgcttgttcaatgataccttttttaaagaaagtgtatttcatctcagctattttattatatctgttccaaggagcatacccatgaagtttattaacaaattgattttctttcaaatagcatagttttcatttaatctttctcattttgtctcattatttgcagttcgattagtcagattcattatagcactgtaacttagaaacatgtttcattcaaagaaaagcttatgataagaaatacaaaagaatcagtaaaatatttacccaaatagtctactttttttccattctaagtgcttttcagggaatgagaaaattagtgtagtagtttctaatataggaaattatttaatattaaaaaagatagtcatctttgtatttaattgattaagatacttaaaggctccatgttatagctgctaaagcatggggtcaggaaacctaagccttaactcaaaagtctggaattacaaaacatgacgaaatatttctccattttgtaaattctgactttgattctgggcaaattgcttaacctctcagtgatggtggtttcttatcacttaccgcatttgtgtgaatagagactttcttttagaacaactatgtgatacccataattctaattctttacacttggttttgcattagttgaagggagtttaagttcagtatttaattttgtcactataacaatttacaagaaaaagaataatttttttctgtatgtaactgagacagatttatatatttatgaaattgaagttggtgttttggagctaacaatgatatagtgtcatcctaatttaattaaacctagtactagtctgctggcattctatcagtattttctgccatccattcttttgtttatctaattatatgtcattattaagagctcatatccactgtgagcaggacacactagcacaaattaagttcagtgatagaattgccttatatgattgtatgttttttatgacccctgtggattttattgctggactatgtgactaaagtataaaacttgtattaaaataaaattaatgtatttttccctgatgcataacctatatactaattgttaattattttttcttttctaaatattggtaaactatacaagaatattactgtcataaaaatttcaaatattgtcattagttctctttagaagagagttacatctgtgcaaccaaacatagtgtaaataaaacaagagaaattctgcattatattaaaaactacatctgatttgaaaaaccgatgcacatctttggttgagactctctacaaacctgaatatataatttctcatacctaatgcctttacatattatttttttcccaaagtgtagtgtatttatcctcatgaacagtttccatctagctaactctgaggaagacaggacttgattcaagcttccccatctccctcatcccattcagactgacttagctgctgcttctctgtgttcccaactcctctatactgttgtctcaattgtggtacctactacgatatatgaatgtacctgttttagtttattatcttttcataatttgataaactctttgaatatggaaccatgtcttattcatttttatattccagtgcctagaacaatgtttgctatagaagcagacactcattaaatgtgtgtgaaaggatgaatgaataaatcaacaaagatttttatggttgttttattaagtcttagtaatcagagtttggaagtgttagcatcatgagctgagagagtcaaagtctttttcctagatgaatttaaattttatgatattgaagcttgatctactttaatttttttcactgacttctcttaaacaagagagcagcttcttttgaactttctttccctacatgttacttgtgtaagtgaaagcaagattaacataccttttaacttcttggatgtaagtcctataaggattgaaaatatacatagaaataaatttatgattttatttcttttatactttaaaactattacatgggattaaaacttgcttctacttcaatcagtatatcaaatttgtatatatatttaggtatattttaaaaaatgaattacatcaggatttatgaaataattactacttgtatacaattagcatgacacatgttgtgtgataatgtatatatggggaataaattctcattaaaactgattaatatagagaagctcacttaacagtaaaatctaatataattgctactaaaaacattgcatggcaattttatttttagtagtatggaagatttttataaacattacatatcaagaattcccacagtgaatagtaaaatttatccctcattagagatccatgtctagtctgcattaaaaattggcagtatatgaacattcatgtttataaggcagattaattaagatgtgtttgctttacaagaggatgttttgtgctttagaagatatttcttacctatctaaattccctaatgcctttacaaaacacatggattttgtttgaaataccacacacaaaaatttcagatatccatctgttgtatcacaaagatgcatgatttaacatagcccaggagattcatccaaaataggcctattttatttcttgaaaatagatatgaagtagaaaaagggtatacattttcaactttaacaccgaaaaaaatgagaattattgtacataattgtaaaattttaaaactaccaacataaaccaaaaaaagtgtatttaacacaggcacaagaattagttttttaaaaaacttatttcaatttcacaggtttaataaatcactacaggcctagtgaaagactgggtttaatccaagaatatattaaatatacatctccatttaaaaaaatttgctttcatggaaattttatgtagcaaatatactgaatgtatattccaatatacggactcttgatttacactcattgttattactcacaggggaaaaaagttatagataagttagtatgagacttatgtatatatttctatctaagataaattttttgtatataaagttttaaggctgtcattttctaataataaaagtaatgtcaatttatcattcataagtttaggaaatgcataagatttaacaactaaagatgcctctgttaactccctgatgagtaggaggctacttttcaattttctattttacttacacaagaaaattagtaaatttagaagaggaaacacaaccataacctcaacaaacaaggcaaacttaatgactgtccacctttcagaaacttttatgctttcttctgtctctccatttgtctatgtatgtgtgtaatacaggctcataatatatggatttttatgattctctaatgataagaatttccaaatatgtgtcagtgttcacattaaattagaaaaaatatttctgcagcttatttatcataaaataaataatcatagaagtcagagaatgttgcaagaatgaagttatatggtctataaattagataaaattcatgtgatttgatttgttacaagatagtaatagtttagaatggcagcatataaattatttaaagatgttttacatattctgttaaagaatagagtagatgagaatagacattttcatgtgaattttattgaagaaaagcttagtcaattgaggtaagagcaactattctgtcacaagtttgggatgatcagatatgctacatttgttgtttactatgtaacactatgtacttaacagcaagcactcaacaaaaatctatattaaaataaagaaaaaaataaacctgggattgaagatacagggcctggatgcagaaacttgaagtggacaggattggtttttcaggattttttttttccacccaggaggcaagtagaaccacaaaagcaacaatgtctaagaaaatgccttatgacaaagacaatttattttctgttgggaaacagctctttgtatttgactcagtccctgtttctatcatcatccctggacagcaacaaacagaactatgtatcatcgcatacaaagtacaatcagagaaatatggttggccaaagagctctgtgctttagaatttgaatctgtaaatactccacaaatccctgtgatagtggtggaattctgaatgcctatgattcagaaattaccaagggcactatatggataaaataagtccaggaaatatgtgaaaaaaattgagagatcctgaaaaatataatcagttctactattcaggagattgtacttctacttcaaaacaggttcctgtaaccgtagagaccatgtgccaaataatcacctcccctcgtttgtcattctgctgcaggtgcatttcctcagaaaggccacaagcttaagtattatcattcacacagagatcaatttattttgacagcaaagtgttgcaggcacaaatttgcatttgcagtatggtaattttttaaaaactctatgaattggagattttgagtgccctcactatttttactaccttttatgcttgttgctcctgaaaaaataaaaaatacaagagaaatgtcctcaattcctttattaagtattatacagttatatttattttgcaaaattgctttatagttaatacaatattttccaactcagaatgtttctacctcctggaaggataaccaagaatgtactgactggtcatgactaatcgaagaattaggcacatttatttggttcaatctagcaaatagttattgcatgcctactgggtgtaaggcactgttatagatgagttggaatatggatgcatctcaaatggcaaaaatgctattgcttctggggacaaataaggtcacattagcatacatgctcaaatttccattgcactgggacactcccagatctcagtccttttcaaaagtcccctataatgtatttctggcatgctcaggggagtctaaagtgttcaaccatgaatcttatcctgttagtcctgctgctgctcccccacatgccactgtggatgtcagccatgccatgtctgttatcaggagtctgctgcaggaatttcacactctcattgttactttccacttaaatctgcttctacccaggcccacgtgttcttttctaatcttttccttcagtttctgcctctaactcctctctctgcagtgtcagcaaagacaaaacaaacaaactaaacccattacaccctccttttataatcattacagcttccctcattccaagtggttattacattaaatttcattctcttcttcaactttaaaaggaaataatttgcacagttttcaaagacagataggtgtaaacccctcattttatcagtcacttcttgaattttcttccctctcaactaaaacgacccccattaaacaaaaagaatttataatctagtggtctgattggagaacacaacaggtgtatgcatgatgtaattgctaagattatacatacatagtttgttttggaaattaatacaaaacaaaacaaaatcaggaaattatgattgttcctaatcctaacggcaaaatcagagaatatgggttggccaaagagctcggagtgaggaaagtgagttggcaggcatggttcactcaggttacaatacagaagacacatagaagtgaaagggcctgtgactctgagtttatgaatgttctctgtgacagcaggctaaggggaaagtggtcacgtgaaaatacagttagactagagcaaggctgatcattcaagatgacttacattctacgccaaatattgtgaattttctcaggtgggtaactagggacaacattgggaaatctgaatagtgtaatttatttatgcatcaactaacagaagacctaactgaaagaaaaattaggacatccattatctcacgtaacaagaaggtatagcgatataaggtggattcagggatggtgaattcaatcactcagtgaaagcatggctttaactctatttctctgcatttgtttctccttataatttctagatggccgaatttcaagcatcacattttcaaacagtacccaaaggaaggatcaaagcttttttcctgtgttttttattaagagctttgcctagaaattttacccagtaaaaaacttctgtctgtgttagtttgctgaggatactggcacctgtatcccaaaacttaaaaataataagtaaataaataagaaaatatatgtttcaatgaccgaaatccttccataaacccactcagaaatgaatcatgattcctagaatccccccaacatgaggctaccacctgatacctgaacaaaatcagggttgtgttagaaagaagttggggaaagagctagatagctaattctgacagaaagtaacaaggtaagatctgaaatttagatatttaactatgaaataggatttggcataagttagatggcataagatagagactgggagcaaagaaataagaaaaatttaatgcaataatatgtaagatataatggaaacttaaactaagccatgggaccaaaataagaatgtctatagagagagacgagttaaagaatttgaaatgaaacacagccattaccaaaggactcttggacacgaagagtgggaaaaagacagagataactacagtgttggaaacaaatttagcaacactattaactgagccaataaattattctattctgtaaaaatagaaattatttctatcagcacagtaatatgctggtgtttaccttgagaaaataaatgattttgtttcattccatccaggtggcaaaatgtacccaggccctgtattgattaggaattttcaagttctggacataaagttttctctaagaagtgaatttcttctgtatatgttgtccttttttcaacatgtctccaaattggttgaagaaatatgttatgaattactgtattaaaggctgtggatcacataaatagagctctgtctcttcttaggtatacattttaatatacaattttaaatatgtattatttaagaaaaacaagctctaatataaagggaatgtctgcagtaaggggtactgtagctgtgtccattatatttaaattcaatttcaatcaattaaaataattatcagaccctatgtcagcagatttggagaaaaagtatttaaaaaagtaaactctaaatgacttatttttatatattattttaaaaacattaattaatgtttcaggagcaaagtatagcttatttcaattgactatttttaagtgtaataaccaacatttacattatctttcaatttgaatttataaactctccaacttacacctaaatgtattgtattctctgtgtgtctggataatgaaggaaattgttttttacctgaccaggtccttctcagttctaagtatatgtgatagtgatctgttttattcaccactatactttgtagtttctctccttcttcatcctcatggtaatcttttcctctcttatatagcctttcttctttatatagtaaaatattttatgtaatgaaaagttacatatatggcatactagccacaaaatatatttgatatatttgatgatctcaattaactcatatgtctcagctccttttaagggcttgtgtggtttatgactaagtatctgattttttttaaaaaagtgttacatatagtgagagaagtaattaccaactgttccactatcaggaaggaaataaccaattatcttacataaaatgcaatgttaataataacgagttcaagatctgtacataagacaaattttgaattactttcacttatttttaattaaatatattatttaggttaaaatatttgtatatgtattttttcccattactacatctaaaactttgatacctagtaaaaacagctataggagttcacatactatatttataaaaataataaaaacatataattcatgtggatctgtatatgtttgcatgtatattagagaaaacttaaaaatataattctgtggatctcaatatgtatacacagattttagagaaaacagtgttccagagacacttattatttttgttctaaaaaacaattgtgtaaataatagatgactgatatctaatatgctacccatatttacattttcccaactgttctgaaaatgtcattcatagatggttttattttattttattccttcaatataggatcaaattaagggtgatgtactgtctttagttttcaggtaattttgtctcctttaatctagaacagttctcccctctttttttttttttttgattctatgatgttaatattttgcaagattccacactgttgttgtatagaacacacactgacctggttgtatctgatagtttcctcattgcttcaatcaggctaaacatttgtagcaagactgctacatgggtgatgtgtgtacaagcagtatataatacctttgtgatcaggagacacatactgcattatttaattgtgaagtgtcaaatgtgtaaaactaatttcagatagttcattaaaagaaaaaatctatgtgtatacatatttatatatattaatctattcatcaatctgttgatctagataggtagatagatagatagatagatcttgcattataaaaagaaacagatgcagagaaacagataaagcaaacagtatcaactggtgaatctagatgaagaatctatcaatactcattggactagtctttcaacttttctgatctatttcaaagtaaaaagctggggagaacaatggggtgaaatagtgaaaggcacgtgacacggagtttgatacacagaggtagagtagccattctactgcttgctggctgtatgattttggatgaatcatcgaaaatctctgagcttatacaccttaacttcaaaatgaagatgataatatctagattatatattgttttaaagattagaaaagataaaagttacctgaggttttcagacagcatagctagatttagaataacaaaacaactccagattcctctcaaattgaaggcccagtgcactctgatatcttacacatagacatggaaaatgaataaagaatatattcatcatttttgaaaatgacagaagtttaaattggcttgttgttctattaaagaaatgagtttttcatagttcagatgaccttggtgactataaataagatagagttcaagggtgactagtgcagagttaattaatttaggaaagcaataaaaacccatacaagtataagatgaataaggactgtgaaggtgtacaaaaggtcacagagggcattaacgtaaacacatgaaaaaatgcagcactgcatctaaattaggaaatcgacactgggatatgcaagtgctaatatcacagcattggaaaactctctctggaccccagatttatttcacaattgccctgcaattaaaatgagatctgaagaatgtattcgttaattctgcaggtacaattaccaagcatgttttattttccaagctctctgctggttgcaatacaaaaatgaatgagatgaacatccctcccttcaaggagttcacagtcaagtgaagcagacatatgtaagcaattacagtctgtcttcccttgggttaactactagatttggatgcttattttaaaacagcatctaaacatttatgaagtattagaaaagttttataaaagtagtaacatttaagctgaaacataactttcagtttagaagaaacaatttcaaatgtaagagaggaataaaaaacctatccttgatcttaaaatatatgacctcttagagacttatgattccttactctgcattttcataacgtcaacaagcaatatgaaatatttaccacaataatttttcttcctaacagactgtagatctgacttcttggggatataatccttgctacttgattttgtcagggctttatttatgtttgaaacaaattcattagcatagggaagctaaatgacacatttttgcttagtatttaaaagactgaagagtcttgaacgttgttttccaactaagactttgttttagtgtgttcttttccttgtcttttattctcaccttctcttctttaaataatattcattggttcccttctcttctcttttcttcccttcccttctcttcctaccccctcctcttccctttcctttactttcttttgctttttcttgttttctttcctttttctttcattcctttgaagtagggtctggcgaggcaggaacagaagaattcaggtgtcagaaagtgctaagattgtctgtgggacagaggagtcattcgggtgaggaagcggttcatgaagtcagatattgatcacataggaagtcagcgaatgagtaaatatatttaccataatgggcatctgattactccctgttagagaagaaattttaaaatatggaagtagtgaaggtagattgacgcctctggtattgaactggacttagaggcattggtataaacttttgatttttgatagatgataggtagatagatgagataatgtgtatgtgtgggtgctcataacacatatatttcctaaccatgtcttttgagagggacaagaagcaatatcatcccagaaacagtgattccaccaagcacccaaattttaaagaccattatttactaaaaaacaacagggctcttggaataatttctggttacagggatggggcaatgaaagtttaagataagcctgaagtattttgttttataaagtagtgcttgccgggcatgctggctcactcctgtaatctcagccctttgggaggccgaggcaggcggatcatgaggtcaggagttcaagaccagcctgaccaacatagtgaaaccccgtctctactaaaaatacaaaaattagccaggcaaggtggcgcatgcctataatcccagctactctggaggctggggcagaagaattgcttgaacccgggaggcagagtttgcagtgagccgagatcgtgccactgcactccagcctgggtgacagagcaagattctgtctcaaaaaaagagtagtgctcaaaaaattaaacttggaatccagctttcagaatcttcacccagagttaggaggatcccttgaggccaggagttagagaccagcctgggtagcatagccagatgctgtctctacaaaagaaatttaaaaagattattggggtgtagtggcccatgcctgtagtcctagctacttgggaggctgaggtgaaaggatcacttgagcccaggattctaggttacagtgagctttgatcatgccactcacaccactgcactcctgcaacatttcactccagtcagggcaacacagcaagaccctgtctacaaaaaaaaaacaaaaacaaacaaaaaaacaaaataatcttcagataatctgggataatttgagcatcaagttaaatactggcaataacaaattaaacagattctaacatactgaataaaataggaattcttgagttcctactgatacaaagagacaaatattaggcaaataaatggggagattggaaaattattccttatagtaaagtttcaactaataaatgtagaaacaagaaaatcaccatttagcagtcatcacaacaataattgatgcagacaacaatcttcaatgaatgttaaaattagacactgaaaatttgttgagaaaggaatattttcagtcttaaaatactcctcctggccaggcgcggtggctcacgcctgtaatcccagcactttgggaggccggggcagacagaccacaaggtcaagagattgagaccatcctggccaacatggtgaaaccccatctctactaaaaatacaaaaattagctggatgtggtggcgcatgcttgtagtcccagctactcgggaggctgaggcaggagaatcgcgtgaacccaggaggcagagcttgcactgagctgagattgcaccactccactccagcctggcgacagagagagactctgtctcaaagaaaaaaaaaaaaactattcttacttaattttccccccacttactgactacaaaagaaaaaacagtaactttgcagtgatggttgaagccataatcttaatgaaatatcactagtaattggacaagtcaacatatttttaatatctgtgatgaagtacagaatctaaaactaattgtaaagaaatattagataaatctaaactgaagggcattctgtaaactaactggccatgctcttaaagaagtattacagtcacaaaggaaaggtaagatttaggaactgcttacagttgaaaaaggctaaaaagacatgaccaaaaaagtggatcctagaccagaagaaaaaactgtccacaaagggaattattggaataattgttaaaatttgaatggagtcaatgtgataaatggtattctagatggtggaattgtttttgatgttcatttgctgatttagatgatttattgcagtatggcagagtatccttttaacttaggaaattcacacaaatttttaggggtggtacgaacttatctgcaacttacattcaactgattcattaagaaatattagatgcacagacacctacacatgcacacacatgaagacatatacacaaaagaaaaagcagagagacagaagaagaaaagttgggtgagagagagggaaggaaaggaaaaatgttaaacatacatggctaagatattcacaagtagggaacctgggtgcagcatgaagggagttggttgtattattttcacaacttcgctataagtttattttttaaaaatatcttctaactaatctatatttgatggtcctgtgaatcatgagtatatttgtataaacctgaatcatatatgcaaataattgaatgacttaactgctggggtaatgacatacatacattatgttgccagacatgaaaattttattcttatcacctgtatttattgacgtacaaaagtatgtggtgttatactggtcacagtaaaaaattttagtttccaaatccttattttcttgcatatcaaatccaaatgttttgtcatccaaaattcctcatctgatgtccctgaaccttccagtccagtcacctacctctatctcacatcaacttctcacagcagctacaccaaacatcttgcagttcatcaattaaaacactactcttcacacctcatacatttgccagtgttttttcctttatctacaatgtcctctccttcctcatcctcatcctaccgtctttattggggttgtttccttcaaagatgtgtggactgacagttaatattctgtgtttacctctgttagcaattacagtcatctgttttaattgcctgtttactttgctgtgttatcatcaacctgtgagcatctgtaaattcttttacccagaattctactctaatcttttccatctcccatcctgacctacaatggataccctaaagtctttcttttcaatactatttaatttataagtatatataaaaagtaagctccccaacattgggagaattctttgtgttttccgaatgtaatggatatcttatatttaaactgtgagatagtataagatgtatgtagaaaaaatgaaaagtatgaatttattcaaactttacccaatatgaaatatcactgataattgataaagataggttttatcaaaatctatttattcattttgagttattttatttttacgaaactacttgtgaatcatggttcttatttttttgtaactgtgtcaacttatacaatatgagaaaaactgaggttccctcttcatttttactggctatgacacacacatttgtgctgaaataatttgattttataatataaaaatttaaacttggtagctttctctaaaactaaaaaccctaacttaatagggaattcaaaaattcactttagtgattatagaaatgtttataaaaattctttttttttttattatactttaagttttagggtacatgtgcacattgtgcaggttagttacatatgtatacatgggccatgctggtgcgctgcacccactaactcgtcatctagccttaggtatatctcccaatgctatccctcccccctccccccaccccaccacagtccccagagtgtgatattccccttcatgtgtccatgtgatctcattgttcaattcccacctatgagtgagaatatgcggtgtttggttttttgttcttgcgatagtttactgagaatgatgatttccaatttcatccatgtccctacaaaggacatgaaatcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtcaaagtgttcctatttctccacatcctctccagcacctgttgtttcctgactttttaatgattgccattctaactggtgtgagatgatatctcatagtggttttgatttgcacaaaatcaatgtacaaaaatcacaagcattcttatacaccaacaacagacaaacagagagccaaatcatgagtgaaatcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgccgaaggtaatttacagattcagtgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacaccgcatacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaaggtggattaaagatttaaacgttaaacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagaaaaattctttttaaaaaaataagttctacctttattttagattctggggttacattgcaggtttgttacatgggcatatggcatgatgctgaggtttgggctatgaatgatctgtcacccaggtggtgagcatagtacatcataggtagcttttcaaaccttgcccctctcccttcctctttgctcaagcagtccctagtgtctgttgttgccatctttatgtccctgagtactcagtgtttagctcctgcttacaagtaaaaacatgtggtatttggttttctgctcttgggttaattcatttagaagaatgaattcctgctgaatccatgttgctgtaaggtacatgatgttttcattcttttttatggctgcatagtattccaaggtgtatatgtaccacattttttttttatccagtctccagtccaccattgatgggaaactagattggttccctatctttactatttaaataccacttatcgtctattttgtgctgagcattgtgctacatccttcttcagaacaacaatttgaggactcatttttctcaatttataaaagaatcatattagaataagaggctttattatttctaagtgcgctgcgatttgcatttttctcttagcagatattgaacaaaaagaaaaaagatacaagaggtagtgtgatgcagagaaggggacaaatgtagtcattgtagttaggaactttgcaggaatagagtgttggagtcctgaagtgttctgattaataaaagctatctttcaagacccatagcaaaatgcatataaaatatcataaatatttgtgttaacatttaagagtagagctgatatgtgaaatctagaaaattaaattttggaaattatgttaaacacttatctagtgtctaatatacatttgtaatcaacaaaaagaacagtgtttaaaaataagagcaataccaattgcttctctgaaaaccttttgtatagatatgccaagtactttttttcagccagtccattgagactagtttgctttacagcttcttattttgaaaaagtacaaagaaagtacttgttcatgagaaaaagttaactgaggagaaattacatgtaccttgggagtaagttaaatatttcttgtttaattttcttagatgattcttattaaatagttcttttatagatgcacagaaataatgaaaaatgatctcattgacattgtgctttattcctaatgactggttagataattattaggaataaaggtagagtgtatgaaattatttttagatttaaacttcaggctcttaatatatattagaaaaattgttcccttccttgaaccacaccatttatatttggtaatatagtataatgatgagaaaaagataatagaaaagcagaaaataaaaggattttaattcatttttgtgtgattattatagctgcataaattatactaaaatattaaatatattttacttttaagatatcaatttattggtaatattgcttaataatagtcctttaaaactccaattataaaactgttttctaagctcttggtcttccagatttagaataacttttaaaagctgttttttaaaaaatacttaatattttggctattagaatatatttacattcttcttttctgagtctataaaaagtataaaacacaatctttaccatttggaattcaagaaagtattaattcattatgttttattaaaaaggaaatttcttccatacaacctgtacatttctcctagtaaaaattaattactcagctggagtgacatgatttttgcaataaaaattagtagttggaaatcatgttttttcactgattgcttttgatgcctaaattccattcccacatggtatttgaatatagcctgatattaaggaagacatctgattcagttttcttgtcttttcttttattactttttaaatttcaactttattttggcttcagggggtacttgtccagttttgatgcaggcatatattgcacaatgctgaggtttgtgatatgattggacctgtcacccaagtagtgagaagagcatccaataggtagtttctcaaccctggcacccctccttccctcccagtttttatagtacccagtgtctactgttgccatgtttatggtcatgtatgtccaatgtttagctcccacttaaaagtgaaaatgtggtatttggttttctgtttctacattaatttactttttacttaggataatggcctccagctccatccatgttgctgcaaaggatatgatttcattcttttttttttttttctttttgagacagagtctcactgtcacccaggctggagtgaagtggcacaatctcggctcactgcaacctctacctcttgagttcaagtgattctcctgcctcagcctcctgagtagttggaattacaggcacctgccaccacctgactaatttttgtatttttaatagagactggttttcaccatgttggccagggtggtctcgaactcctgacctcaggtgatctgcccgccttggcctcccaaagtgctgggattataggcatgaaccaccatgcctggcccaatttcattctttttttatgatggtgtagtgtctcatggtgtatatgtaccacattttctttatccaatccactactgatgagcacctacgttgattccatgtctttgctattgtgaatagtgctgcaatggacatatgagtgcttgtgtctttttggtagaacaatttttttttcctttgggtaaatactgagtaatgtgactgctgggttgagtggtagttctatttttagttctttgagaaatctctaaactgctttctacagtggctgaattaagttacatcccaaccaacagtgtataagcattcccatttctctgcagcctcaccaacagttgtttttggcccttttaataaaagccattctgactcagatggtatttcattgttgttttgatttgcatttatttgattagagattttgagcattttttcctatgtttgttagctgcttgcatgtcttcttttgagaagtgtctgttcatatcttttaatgatgttacttgttttttatttgttgatttaagttccttatagattctggatattagacctttgtcagattcaaaatttgtgaatattttctccaattctgcagattgtctgcttaccctgtgatatggttttgttgtgtccccacccatatttcaccttgaattgtaataatccccacgtgtcaagggtgggggacaggtggagataattgaatcatgggggcaatttcccccatactgttcttgtggtagtgaataagtgtcacaagatctcatggttttataaaggagagttcccctgaacaagctctctcttgcctgccaccatgtaagatgtgcctttgactgtctcttgctttctgccatgattgtgaggtctccctagccatgtggaactgtgaatccattaaacctctttcctttataaattacccagtgttgggtatgtctttattagcaacatgagaacagactaatatactctgttagtttcttttgctgtgcaaaactctatactttaattagatccacttggtaatttttgtttttgttgtgattgcttttgaggacttaatcatcaattatttgccaaggctgatgtccaacatggtgtttcctcagttttcttacaggattttcatagttcaaggtcctgcttttaaatctttaatccacctagagttaattcttgtatatgtacaagtatacgagaattgaaaagtaggagtttagtttctttcttctgcatgtagttagccagttattgcaacatcatttattgaatcgagagtcctttccttatagtgtatttctgtagactttgtaagagattaggtggctgtagttgtgtggcttttttctgcattctctattctcttccattggactttgtgtctgtttttttaccagcaccatgctattttggttactgtaactttgtagggtagtttgaatttgggtaatgtaatccctcctgctttgttctttttgcttagggttaatttggctatttgaactcttttttggttctatctgaattttagaatagtttttcttaatactgtgaaaaatgatgtcgctaattttataggaacagtgttgaatctgtagattgctttgggcagtagggccattttaaggacattgattcttccaatccatgaacatggagtatttttttcatttgtttatgtcatcactgatctctttcagcagttttttgtagttttccttgtagagatctttcacctccttggttagatgtgtttctaggtatttttttgtgtgtgcggctattgtgaatttgattttttttttttatttggctctcaacttgaacattattggcgtatagaaatgttaaagatttttgtatatttactttgtatcctgaaactttactgaagttgtttatcagctctgggtaccttttggcagattatgtagcattttctaggtataagattatgtcatcagtgaagagagataatttgacttctttttctatttgtatgctttttatttatttatcttgcctgattgctctaattaggacttccagtactatgttgaataggagtgatgtgagtgggcatctttgtcttatcccagggggaatgcctctagcttttgcccattcagtataaagttggctaagggtttgtcatagatggctcttattattttaaagtatgttacttcaatgcctagtttctttagtatttttttaatcatgaagtggtgttgtattttattgaaagctttttcttcatctattgagattatcatatggtttttgttttcaattctgtttatgtggtaaatcacacttattgatttgtgcatgttgaacccacattgcatcccaggaataaagcctacttgattgtgttgaattaactgctttatgtgctgctgggtttggcttggcagtattttattaaggctttttgtatctatgttcatcagggatattagcctatagtttcctttttttattgtgtctttgtcagattttggtatcaagacaatgctaactttgtacaatgtgttagagataagtccctcctttttggtttttttggaatagtctcagtagcttttgtaccagctcttctttgtttatctggcagaatatacaaagggtttttattctttggtaggtattttaaatcactgactcaattttagaactcattattggtctgttcagggttttaatttcttcttgattcaatatttgttggtcatgtgtttccaggaatttatccattttttttctagattttctagttgatgtgcatataggtgttcataatggtctctgaggatcttttgcatttctatgggattgattatagtgtcatttttgttgtttctgatttgcatatttggatctctctttttttctctgtgagtctagataacattctatagacctcatttattctttcaaagaaccaatttttatttttgttgatcttttgtatgaatttttgggtctcaatttcgtttagttctatttggattttagttatttattttcttatggtacctttggggctagtttgttgtcattttctctagtttccaggttgatgttcttttcttaatttgacatctttctatcttcttgatgtaagcatttagcactataacctgtcctcttaaagcttttttttaatgcattctggagattttggtatattgtgtctttgttttttttttatttccaacaagttttggatttctgccttaatttcattgtttttacaaagggcattcagaaacaagttatttagtttctgtgtaattgcatggtttttcagatgctcttcatattgatttctagttttttttctactgtggttctagaacatgcttgataggattttgatttttaaaaaatttgttgagacttgctttatggcccagactgttgtcagtcttaaagtatgtactgtgtgcagatgagaacatacattgtttgattttaggtggaatactctgttgatgtctattaggtctaattggtcaagttttgaatttaagttcagtatttctttgttagttttctgccttgatgatctgtctaacactgttagtggggtgtcaaaatatcccctattattctgtgtctgtctaagtctttttgtaggtctggaaatacttgtttatgaatctgggtcctccaaaactgggtacatatgtgtataaaatagttcagtctttttgttcaattgaaactaatatcgttatgtaatgctcttcattgtcttttgttattgccattggtttaaagtatgttttatctaatacatgaatagtgttccctactctttttttgttatccatttgcataatagttcttctctgtccctttactttgagcctattggtgtcataacatgtgagatgttctcttgaaggcagaaaaaggttaggtcttgttttctttccagcttgtcactctgccttttaagtagggtgtttagaccattcacatttaagcttaatattgatatgtgaggttttgatcctgctgtcgtgttgttagctggttgctttgaagtcttgatagtgtagttacattttagggtctgtgggctatgtacttaagtgtgtttctgtggtagtgagtatttttctttcatttctatctttaaatctctcttcggcgtcactgtaatgcttgtatagtggtaatagactctcttattgcttgcatgcctgacaaatattttatttctcctttgcttatgcagcttagtttggcaggatatgaaattgttgtttgggatgttttttctttaaggatactggaaatggactcctaatctcttctggcttttaaggttcaagccaaggtgtcaactgttagcctaatatgtttccctttgaaagtgatatgacccttttgtttagcttcaattaacattttttcttgcacattgaccttcaaaagtctgatgactatgtgtcttggggatgttcgtctgatataatatcttgcaaatattctctgaatttcttgaatttgcatgctatcctctctagaaaatatgttttccaagtggcctactactctctcctcttctctctcaggaatgccaatgaatcatagatttggtctctctgtacaatcacatatttcttggaggctttgttcattttttaaaattattatttttatgttcatctaactgtactgattcaaagaactggtctttgagttcttaaattctttcctcagcttggtctattctgttgctaagacttccaaatatattttgaaatttctgtagtgaatttttcaattccagaatttcagtgggttccttcttaatatggtgatattggctttccagtctggattcattttttggctttctttcgatttcagcgtttggatttcaacattctcttgaatcttgttgatcttctttgtcaccctgattctgaattttatgtctgtcatttcagacatttcaatctggttaggatccaccagggagctaatgcaatttttgcaggtaaggaatcactcaggctttttgaactgttggcgtttttgtgctgattctttctcatctgagggtgccagtgtttctttgtttctttctttatcttcttcttttttttttgaaattgctgttgtttgtatagggcttttgtttttatattctttttttcccttgagattttcattgtggtgtatgttgtttatagtcaattggctttatttcttcgagctttcagagggccaaggctctgtatgggttttttacgttgatagtttccttcatgggctttcacaggtgttgtaggtgaaggaatttatttttgtttggtggtgtagtttagactgtgacttagtaaatggcacttaagagtaagggtaggctcttagctgcgtgcctgttttgcatttcagtgtgtatgcagcaatgctctgggaaagggagacagagggcaggagaggactccttcaccaagtctgttcctgggccttggtggagcccctttcaattactggcactgtgcttatgtttccttagcctcaaggcaggctttggcaggctgtgcttttctctccattaagaacagttcaagatgaaagtcaggtaaccaggagacccataattccccagggttccactggtcctttgagcttggcagaatcagtgagttttgggatatgtctgcagttggtctggtgatgcggtaggtcaagagtgagggaacgccaggcagggcggtggtttcatgggtgtgcaactggtgtggcactaacagcctggtatttttagcccagttgacagctgtggggcttgcccagctcattctcccccaatccagtgagtctctccagcacctgccccaggagccggcccagccagctacgtttttccacagacttctcttgccagatggctgtgctcttccaggtgttcagagccatggggctgtctgggtaaaaagctgttgctggctaacacgcataccctcctgcaccagtctttcagagggagagattccccgctcccatgccagcacatgaacccactccacattcttgtcagttttctgatagtgggggctcctcctccaatagagatcagctcaatactcttaggcagtgtgcttgaattccctcggggttggagccaggtctacagttttattttctggccccttagggtggagcaccagctgtgctgggagtgatgggggcgggctctctcctgctcccaggcagccagcaaaactctattttaattgttcaccaaaaattcaaatgaaaattaggtaatgtaccatgaaatagttaaatatattcatgataaaaatgtactgtctgttaggagagaaaaaatgatacacttaaaacactgaaaacattaattgaaggaatattttaagattttacagctacagtaactgcctaggcaggaaattctcacatacaacttcttcatttcttaagatgtaatgtttttaatatgctctatatatttctttagtagatatagattttatttaagaatacaaacaaaaatgtatctacctagaattcaagattattttatttgcttgattttaccatagataggttgactagagtagtaacatggaatagagaatcaaaacggctcctatagtgtctttcataatttaagaaaatttatgataatgcaatatatgtagtgcaaaacctttatcatagcaacccttaaagataatttttacattagtgatgggacattgcatcttacaatgcggtctaatccatttttatatacctttaattgttctaaattactctcttcaattgagactcatttattcattgaacaaaagttcattgagctcttaagatataccacgcagagttttcgaagctggaactctattaatgagacaaacggacttgattcttgtgggaatagattaaaaaaataaaataaattccctccttcatttaattagtatttcttgaaagcttactaagtaccagacattcttatttatttatttatttatttttattattatactttaagttccagggttcatgtgcgcaacgtgcaggtttgttacatatgtatacatatgccatgttggtgtgctgcacccattaactcatcatttacattaggtatatctcctgatgctatccatcccccatcccaccaccccatgacaggccccggtgtgtgatgttccgcatcctgtgtccaaatgttctcattgttcaaatcccacctatgagtgagaacatgtggtgtttggttttctattcttacgatagtttgctgagaatgatggtttctagcttcatccatgtccctacaaaggacatgaactcatccttttttatggctgcatagtattccatggtgcatatgtgccacattttcttaatccagtctatcattgatggacatttgggttggttccaaatctttgctattgtgaatagtgccacaataaacatacgtgtgcatgtgtctttatagcagcatgatttataatcctttgggtatatacccagcagtgggatggctgggtcaaatatttctagatctagatccttgaggaattgccacactgccttccacaatggttgaactagtttacagtcccaccaacagtgcaaaagtgttcctattcctccacatcctctccagcacctgttgtttcctgactttttaatgatcaccattctaactggtgtgagatggtgtctcattatggttttgatttgcatttctctgatggccagtgatgatgagcatttgttcatgtgtctgttggctgcataaatgtcttctttggagaagtgtctgttcatatcctttgctcacttgttgatggggttgattttttctcataaatttgtttaagttctttgtagattctggaaattagccctttgtcagatgggtagattgcaaaaattttctcccattctgtaggttgcctattcactctgatggtagtttcttttgctgtgcagaagctctttagtataattagatcccatttgtcaattctggcttttgttgccattgcttttggtgttttagacatgaagaccttgcccatgcctatgtcctgaatggtattgcctaggttttctgctagagtttttatcgttttaggtctgacattgaagtctttaattcatcttgaattaatttttgtataaggtgtaaggaagggatccagtttcagctttctgcatatgactagccagttttcccagcagctttttaaaaatagggaatcctttccccatttcttgtttttgtcagatttgtcaaagatcaggtggtagtagatgtgtgatatgatttctgagggctctgttctgttccattggtctatatctctgttttggtaccagtaccatgctgttttggttactgtagccttgtagtatagtttgaagtcaggtagcatgatgcctccagctttgttcttgtggcttaggattgtcttggcaatgcaggcttttttttggttccatgtgaactttaaagtagttttttccaattctgtggagaaagtcattggtagcttgatggggatggcattgaatctataaattaccttgggcagtatgaccattttcatgatattgattcttcctatccatgagcatggaatgttcctccatttgtttgtatcctcttttatttcgttgagcagtggtttgtaattctccttgaagaagtccttcacatcccttgtaagttggattcctaagtattttattctctgtgaagaaattgtgattgagagttcacttatgatttggctctctgtttgtctgttgttgctgtataaaaatgcctgtgatttttgcacattgattttgtatcctgagactttgctgaagttgcttatcagcttaaagagactttgggctgggatgatggggttttctaaatatacaatcatgtcatctgcaaacagggacaatttgactccctcttttcctaattgaatacgctttatttctttctcctgcctgattgccctggctagaacatccaacactatgttgaataggagtggtgagagagggcatccctgtcttgtgtgccagttttcaaagggagtgattccagtttttgcccattcagtatgttactggctgtgggtttgtcataaaatagctcttattattttgagatatgtcccatcaatacctaatttattgagagtttttagcatgaagggttgttgaattttgtagaaggccttttctgcatcatgtggtttttgtctttggttctgtttatatgatggattacatttattgatttgcatatgttgaaccagccttgcatctcagagatgaagcccacttgatcatggtggataagctttttgatgtgccgctggatttgatttgccagtattttattgaggaattttgcattgatgttcatcagggatattggtctaaaattctctttttttgttgtgtctctgccaggctttggtatcaggatgatgctggcctcccaaaatgagttagggaggattccctctttttttattgattgaatagtttcagaaggaatggtagcagctcctctttgtacctctggtagaattttgctgtgaatctatctggtcctggactttttttggttggtaggctattaattattgcctcaatttcagagtctgttagtgatctactcagggattcaacttcttcctggtttagtcttgggagggtgcatttgtcgaggaatttatccatttcttctagattttctagtttatttgcatagaggtgcttatagtattctctgatggtagtttgtatctctgtgggatcagtggtgatatccactctatcattttttattgcatctattttgttcttctcttttttcttcttcattagtcttgctagtggcctatcaattttgttgatcttttcaaaaaaccagctcctggattcattgattttttgaagggtttcttgtgtctctatttccttcagttctgctctgatcttagttaactatttcttaccttctgctcgcttttgaatgtatttgctcttgcttctctagttgttttaattgtgatgttagggtgtcaattttagatcttccctgctttctcttgtgggcatttagtgctataaatttccctctacacactgctttaactgtgtcccagagattctggtatgttgtgtctttgttctcattggtttcaaagaacgtctttgtttctgccttaatttctttatgtacccagtagtcattcaagagcaggttgttcagtttccatgtagttgaggggttttgagttagtttctcaatcttgagttctaatttgattccactgtggtctgagaaacagtttgttataatttctgttcttttccatttgctgaggagtgcttcacttccacctatgtggtcaattttggaataagtgtgatgtggtgctgagaagaatgtatattctgttgatttgggatggagagttctgtagatgtctattaggtccacttagtgcagagctgagttcaattcctggatatctttgttaaccttctgtctcgttgatctgtctcatgttgacagtggggtgttaaagtttcccattactattgtgtaggagtctaagtctctttgtaggtctctaaggacttcctttatgaatctgggtgctcctgtattaggttcatatatatttaggatagttagctcttcttgttgaattgatccctttaccattatgtaatagcctcccttgtctcttttgatctttgttcttttaaagtctgttttattagagactaggattgcaacccctgctcccctttgttttccatttgcttggcagatcttcctccatccccttattttgagcctatgtgtgtctctgcacatgagataggtctcctgaatacagcacactgatgggtcttgactctttatccaatctttatctttacctttacctttatgtttatctttatctttctctttgccagtctgtatcttttaattggagcattcagcccatttacatttaaggttaatattgttatgtgtgaatttgatcctgtcattacaatgtcagctggtcattttgctcattagttgatgcagtttcttcctagcatcaatggtcttcacaatttggcatgtttttgcagtggctggtaccagttgttcctttccatgtttagtgcttccttcaggagctcctgtaaggcaggccttgtagtgacaaaatctctcagcatttgcttgtctgtaaaggattttgtttctccttcccttatgaagcttagtttggctggttatgaaattctgagttgaagattcttttctttaagaatgttgaatattagcccccactctcttctggcttgtagagtttctgccgagggatccgctgttaggcttccctatttgggtaacccatcctttctctctcattgccctcaacattttttccttcatttctactttggtgaatctaacaattatgtgtcttggagttgctcttctcaaggagtatctttgtggcgttctctgtatttcctgaatttgaatgttggcctgcttgctaatttggggaagttctcctggataatatcccgcagagtgttttccaacttggttccattctccccatcactttcagatataccaatcagatgtagatttagtcttttcacatagtcccatatttcttagaggctttgttcatttcttgttactgttttttctctaaacctctcttctcacttcatttcattcatttgatcttcaattactgataccctttcttccacttgatcgaatcggctcttgaagcttgtgcatgcatcacgtagttctcatgccatggttttcagctccatcaggtcatttaaggtcttctctacgctgtttattctagttagccatcgtctaatcttttttcaatgtttttagcttctttgcaatgggttcagacatcttcctttagcttagagaagtttgttattaccgatcttctgaagccttcttctctcaacttgtcaaagtcattctccatccagctttgtcctgttgctggcaaggagctgcattcctttgaaggcactctgatttttagagttttcagcttttttgctctggtttctccccatctttgtggttttatctaccattggtctttgatgattgtgacataccgatggtgttttggtgtggatgtcctttctgtttgttgattttccttctaacagtgaagaccgtcagctgcaggtctgttggagtttgctggaggtccactccagaccctgtttgcctgggtatcaccagcggaggctgcagaactgcaaatattacagaacggcatatattgctgcctgatgcttcctctggaagctttgtctcagaggggcccccggctgtatgaggtgtcagtcggcccctactgggaggtgcctcccagttaggctactcatgggtcagggacccacttgaggaggcagtctgtccatcctcagatctcaaactctgtgctgggagaaccactactctcttcaaagctgtcagactgggacatttaagtctgcagaagtttctgctaccttttgttcagctatgccctgcccccagaggtggagtctacagaggcaggcaggcctccttgagctgtggtgggctccacccagttgaagcttccctggctgctttgtttacctactcaagcctcaggtatggcaaacgcccctcccccagccttgctgccaccttgcagtttgatctcagactgctgtgctagcagtgagcaaggctccatgggtgtgggaccctctgagccaggcacgggatataatctcctggtatgccatttgctaagaccgtgggaaaagtgcagtattactgtgggagtgacctgaatttcctggtgccatttgttacggcttcccttggtttggaaagggaattccctgaccacttgcgcttcctgggtgaggcaatgccaatgcgttgccctgctcctgctcctgctcctggtccttgggttgcacccactgtcctgcacccactgtccaacaagctccagtgagatgaacctggtacctcagttgaaaatgcaggaatcacccatcttctgcatcactcacgctgggagctgtagactggagctcttcctatttggccatcttggaacctttttcccagacattctttttaaaatgatagaaagaagtaaaccagtaactatgcatatgagatgaatactggataatgataagagctttacagaaaattaaaattgggtcatttaaaaatattgatgcctgattttatgttactctatatcaggcgcagttttaagtgctcatttaatcttttgaactgctacatgtactatattaaggcaatctcccatttacagatgaggaagtaggggcacagagaaggatgccacctttctaaaatcacatagctattaagtagaaaaggcagaattcaatctcaagcaattttcttccaaggccaatgtttattattaaagtaacataggcttttctggccttaaaaaaaaaaatcctaaaacctagaggcttaaaagaatatcccataattctttgggcttgtcataatgattttgagatgcctattaggtatctatttggaaatgtgatatggtttggctctgtgtctccaaccaaatctcaccttgaattgtaataatccccacgtttcatgggagggacctgctaggaggtaattgaattataggggtagattttgcccatgctgttcttgtgatactgaatggttttataagggggagttcccctgcatatgccctcttccctgctgccatgtaagatggctttttgctctttcttcatcttcctccatgattgtgagccctccccagccatgtggaactgtgagtccattaaacctctttcctttataaattacccagtgttgagtatgtctttattagcagcatgagaacggactaatacaagatatcaagaagaactttggaaataggagcctgtagctctattgagatgtcagaaataaaatacaatttgggagtcatgaacaagtagagagggtcaactttccatatcattttcatctaatgattctaattttgtcttatgaatgatatagaatgaattacttctctcttttacttgctatatcttcacatatttgaaaatacatggttaattatatctccctttattctattaatctcttgcagaaactatcaaaaaaattgtaagatagaaaagataacaggatattgaaggggatggagaaacagtaaaaattaatgtaacatcgatatatacagtttagaatggttgacagttttccattaaagggattcaagaacaagaccatatttggttagaatcatagaaacttgtgttttatcacatccttaaaaactgaacactgatattaagaaatactaagtattttaatataatttacattattattattttaactgtggcaagaaaagtgttattaagaccctatgttttagaaataatgctgagatattcatggatgagtgaatgtaatatctgagacttgcttcaaaatagagggggtagatacttggggacataagtatataatattgtttatgttgataatatatgatattgataattgttgaagggaggtgatggccaaataggggttcattatatctactattgtatgtacttgaagtatcccattacaataattagagtatattacagataaaacactaacaaataataaatgaaataatccttggactttacctagtgtggtcaaccattagatgcttatttctactccacaaaatcactattacaccatcatttgctctgtccttcactttaataatgaaaaactccctacttttaaaaaaattttacaactgttctgatccttagaaatttactttttatgttgtcataaatgttgtctccccagaatttctcatatttattctccttgtttttcaaataacttttagggtcatcaaaagaattaaattattagaattaaattattaaattaaaaattaaaattattaagttaaaagaattaaattttaatttaagaaaagctttaaaatattcaaaaattttgagcaatgatgagggtccaactgagatgactaaccataaataaaagctgtaaaacaggaacttcttcatctttctgaaatcaaatccgtaaatctttcttcatttgcatgttttctgtcttctctccttttaaatgccagacaccttccttctcttgtcacaacagtttcttcacttatgccctagatttcatttgctgccaccttttctgggatgtattttgggttattattccttttcctgcattttcaccttattcctgctaataatttcttctcattgggacatactcttatagcagtgatacttacaaaaaaagaaatccttccatctctatattttcttccatgtacgacgttactgatggtcaatttactcttcaatctcattgatctggcttcagtttcaattgtttattgtagtggattctttcaaggacatttaatctgtgctagagtcttgtgcagttaacctaacactagctcagatctctctataattattgtataatttgccctctagaaaaataaactactctagatagaatgatcctaaattcatctgtttgtgttgatgtctttcagcagccaaaacttatgttgttgttattcgaaatcagacttatttaccagaacttaaatactaatagtcattttaagaaaattttgagaaagtgcttaatactgtaagttgaaattaagaagtaacaacataggaggaaaagtaacaagaagaggaaaatggttttattcttcttttcagatgagtaagacagccttataaggcatttctctttatctaattattttgttattagagtcacaatttttccaatagtatctttcttttattttctcttaggatttaaatgtgttatttgatatataatgatactttctttttgtactttgatattcaatgtgcggaaatcttaaactgtctgaacatcaaatacaatgtgattcaacaagtgatagtatgcttcatgtatatttatatctccatctatatggtaatgccagggacagcacttagagtacctgttcctacttggctggatcttgtctttccagaatttgtaagttttattgcaaatgaaatgtcaaacctgatgccctaagtacagcagcgaatctgggaaccctatccccctggcatattaatgttctcctttacaggtagcataataaatggccaaacatctttttgattgtccatgctcctttttcaaagtcttcttatgtttagtagagaataggcaaaggagatctcctaaagttgttaaatcatttcttcaggcaataagagggtcttattcttcatttctacatggatttgtactaaattacagagtaggggttgaaagcagtatattctacttctcagaaagccaaatttggtaaaacaaaatgttgattctgatacttatatctaatgagcctactgtctttgtgatttgaaaggatttgtgctacatcagatgaagtttcagtgttagatttcatggcatcagtattgaatgcttctcactcaaagcaggaaaagaacagtattttgcactttcagatcacttgaatatctctcagttagtattaaatatgctatttgaaggttaaaatataccaatagcactattttatgctttctttttgcctaatcatataaatgtttttacttcatgagggttattcttgttggcatggagtgccctgcaaggcagcatccttttgaggctcaagggaaaaggattatagccctggaatccttctcagaaaaatcagcaactattgtcttcaaatttattcactttatccctattccaaaaatgttttccctcttttgtcattaaaggaaattttgctccactatcataaaatcatatactatatcctctctactgtatggcgcatagtataattttgtggttagtttacaaaaacttttctacgatattcaatgggaaaattgggaaatttaaaacatttctctctccctctctttctgtgtgtgtgtgtgtgtgtgtgtgtgtctcactgggatggacacacaaacgtgcaggcaaacgcacatgcacgcacacacacacggccttgtaagactttagttttgttcactaagggtctcagtaagtctagtttgcacctcaaagtggaacagtgacttccttatttctggctcaatcaggtgaatcacacaaaataacaaataccattgaaacaatgaattggagagtcagaagataattaggacataggcattaccagaagcgaatccatattggcttgctatctcaaaaacatcactccctttaaacatcttaccaaaagtacagcttttaacttttcttattgcctccttattctctcactctaggtcttcctgcaatttaagctttctacagtacagctcggatcatatttctcccctccttaagatttccagtgatttcccattgctcattaaattaaggacttatctgaattttaacatttgagatgttactaacatgcccctcactatctttaattttgtctttttccccacatgttctccgggcttcagcaacttatagttttcatactttggataatactatttcttctgattagaatgagtcctcttataactccgtctgtcaaaatctcaaccattgttaatgcctatattaaatcaatgccatgctgaaaacttttgaccccagtagattggaaaccatattaattatttcattctgtgttccatattgacacttgccttactctcctatattcttgtcatagtgttttccgataaaaatatctccaaaaattagataaatgccagtattaaaaacaagatggcattatgtctgttagtagtatacatgtccttttaagataaatttggaaacataaatattaattattaatatacattaggtattattggatcacagttgagaagcatttttgtcctttaagagtggaaggattcttcccattaatattattttctaattgggaataaatattttccttacattctttagtagtttgtcagaaagaatgtgcagcagataattatttttaaaaattagaatcagtgaatacattcagaaatttactgttgtgtgtgaatataaacagaatttcaaatgcaactgagaaaatttttgatgaacaaaaacataattttaaatataactcaaaatttttgaggatacctaatcaaattctaagatatttttaataccatgaataaatatattatgaaatcatgatttttaggcaataactaaagctaacttttttttattatactttaagttctagggtacaagtgcacaatgtgcaggtttgttacctaggtatacatgtgccatgttggtttgctgcacccattaactcatcatttacattacgtatttctcctaatgctatccctccccctgcccccaccccatgacaggcccccatgtgtgatgtttccaccctgtgtccaagtgttctcattgttcagttcccacctatgagtgagaacatgtggtgtttggttttctgtcgttgtgacagtttgctcagaatgatggtttccagcttcatccatgtccctacaaaggacatgaactcatccattttcatggctgcatagtattccatgatgtatatgtgccacattttcttaatccagtctgtaattgatggacatttcagttggttccaagtttttgctattgtgaatagtgccacagtaaacatacttgtacatgtgtctttatagtaccatgatttataatcctttgggtatataccaggcaatgacatggctgggtcaaatggtatttctagttctagatcattgaggaattgccacactgtcttctacagtggttgaactagtttacagtcccaccaacagtgcaaaagtgttcctatttctccacatcctctccagcacctgttgtgtcctgactttttaatgatctccattctaactggtgtgagatggtatctcattgtggttttgatttgcatttctctgatgaccagtgatgatgagcatgttttcatatgtcgattggctgcataaatgccttcttttgagaagtgtctgtacatatcctttgcccactttttgatgttgttgttgttgttgttgttttttttgtaaatttgtttaagttctttgtagattctggatattagccctttgtcagatgggtagattgccaaaatattttccaattctgtaggttgcctattcactctgatggtagtttcttttgctgtgcaggagccctttagtttaattaaatcccatttatctattttggtttctgttgccattgcttttggtgttttagtcatgaagttctttcccatgcctatgtcttgaatggtattgcctaggttttcttctagggtttttatgattttaggtttaacatttaactctttaatccatcttgaattaattttagtataaggtgtaaggaagggatccagtttcagctttccacatatggctaaccagttttcccagcaccatttattaaatagggaatcctttccccacttcttctttttgtcagatttgtcaaaaatcagatggtactagatgtgtggtgttatttccaaggcctctgtttagttgcattggtctatatctctgttttggtactagtaccctgctgttttgattactgtagccttgtagtatagtttgaagtcaggtagggtgatgcttccagctttgttctttttgcttagggttgtcttggcaatgtgggctcttttttggttccatatgaactttaaagtagttttttccaattctgtgaggaaagtcattggtagcttggtggggatggcattgaatctataaattaccttgggcagtatggccattttcatgatattgattcttgctgtacatgagcatggaatattcttccatttgtttgtgtcctcttttatttcgttgagcagtagtttgtagttctctttgaagaggtccttcacatcccttgtaagttggattcctaggtattttattttctttgtagcaattgtgaaagggagttcactcatgatttggctctctgtttgtctgttattggtgtgtaggaatgcgtgtgatttttgcacattgattttctatcctgagacataataagcaacatgaagcaataagacataagcaacatgaagttgcttatcagcttaaggagattttgggctgagatgatggggttttctaaatacacaatcatgtcatctgcaaacagtgacaatttgacttcctcttttgctaattgaataccctgtatttttttcttttcctgattgccctggcgagaacttccaacactatgttgaataggagtggtgagagaggcatccttgtctggtgccagatttcaaagggaatgcttgcagtttttgcccattcagtatgttattggctgtgggtttgtcataaatatctcttattttgagatacattccatcaatacctagtttattgagagtttttagcatgaagcactgttgaattttgtcaaaggccttttctgcatctactgagataatcatgtggtttttgtctttggttctgtttatgtgatggattatgtttattgatttgcatatgttgaaacagccttgcatcccagggatgaagtcgacttcatagtggtggataagcttttagatgtgctgcctgattcggtttccagtattttattgaggatttttagattaatgttcatcagggatactcatctaaaattctcttttttggttgtggctctgtcaggctttggtatcaggatgatgctggcctcataaaatgagttagagaggaattcctctttttctattgattggaatattttcagaaggaatggtaccagctcctccttgtacctctggtagaatttggctgtgaatccgtctggtcccggactttttttggttgctaggctcttaattattgcctcaatttcagagcctgttactggtctattcagatattcaacttcttcctggtttagtcttgggagggtgtatgtgtccaggaatctatccatttcttctaggttttgtagtttatttgcatagaggtgtttatagtatcctctgatggtagtttgtatttctgtgggattggtggtcatatcccctttatcattttttattgtgtctatttgattattctcttttttcttctttattagtctggctagtggactatcaattttgttgatcttttcaaaaaaccagctcctggattcattgatttttttgaagggttttttgtgtctctatctccttcagttctgctctgatcttagttattttttgccttctgctcgcttttgaatgtgtttgctcttgcctctctacttctttttattgtgatgttaggctgtcaattttacatattccctgctttctcttgtgggcatttagtgctataaatttccctttacacacagttttaaatgtgtcccagagattctggtatgttgtgtctttgttctcattggtttcaaagaacatctttatttctgccttcatttattatttaaccaatagtcattcaagagcagattgttcagtttccatgtacttgagtggttttgagtgagtttcttaatcctgagttctagtttgagtacactatggtcttagagacagtttgttgtgatgtctgttcttttacattggctgaggagtgctttacttccacctatgtggtcaattttggaataagtgtgatgtggtgctgacaagaatgtatattctgttgatttggggtggagagttctgtagatgtctattaggtctgcttggtgcagagctgagttcaattcctggatatccttgttaaccttctgtcttgttgatctgcctaatagtgacagtggggtgttaaagtttcccattattattgtttgggagtctaagtctctttgtaggtctctaaggacttggtttatgaatctagatgcttctgtgttgggtacatatatatttaggatagttagctcttctcgttgaattgattcctttacccttatgtaatggccttccttgtctcttttgatctttgttggtttaaagtctgttttttcagagactaggattgcaatccctgcttttttttgctttgcatttgcttggtagatcttcctctatccctttattttgagcctatgtgtgtctctgcaagtgagatgggtttcctgaatacagcacactgatgggtcttgactctatccaatttgggagtctgtgtcttttaatcagggcatttagcccatttacatttaaggttaatattgttatgtgtgaatttgatcctgtcattatgatgttagctgattattttgctcgttagttgatgcagtttcttccaagcatcgatggcctttaccttttggcatgtttttgcagtggctggtaccagttgttcctttccatatttagtgcttccttcaggagctcttgtaaggcaggcctggtggtgacaaaatctctcagcatttgcttgtctgtaaagaattttatttctccttcacttatgaagcttagtttggctggatatgaaattctgggttgaaaattctttcctttaagaatgttgaatattgacccccacttttttctggcttgcagggtttctgctgagggatctactgttagtctgatgggcttccctttgtgggtaacccgacctttctctctggctgcccttaatattttttccttcatttcaaccttggtgaatctgacaattatgtgtcttggggttgctcttcttgaggaggatctttgtggtattctctgtatttcctgaatttgaatgttggcctaccttgctaggttggggaagttctcctggataatatcctggagagtgtttttcaacttggttccattctccccgtcactttgaagtataccaatcaaatgtagacttggtcttttcacatagtcccatatttcttgtaggctttgttcatttctttctattcttttttctctaaacttctcttctcacttcatttcattcatttgatcttccatcactgataccctttcttccacttgattgaattggcttttgaaggttgtgcatgcatcatgtatttcttgcgccatgattttcagctccatcaggtcatttaaggtcttctccacactgttcattctagttagccattcgtctaattattttcaatgtttttagcttctttgcaatgggttcaaacgtcttcctttagctcgaagaagtttgttattaccgaccttctgaagtctacttctgtcagctcgtcaaagtcattctccgtccaccttttttccattgctggcgaggagctgtgatcctttgaaggagaagaggtgctctaatttttagaattttcagcttttctgctctggtttctccccatctttgtggttttatctacctttggtctttgatgctggtgtcctacagatgtggttttggttcggatgtcctttttgttgatcttgatgctattcctttctgtttgttagttttccttctaagagtcaggtccctcagctgcaggtctgttgcagtttgctggaggtccactccagaccctgtttgcctgggtatgaccagcggaggttgcagaacagcaaatatttcagaacagcaaatactgctgcctgatccttcctctggaagctttgtcccagaggggtgcctgcctgtatcaggtgtcagttggcccctactgggaagtgtcagggacccacttgaggagtcagtctgtccttcttagagctcaaacactgagctgggtgaactactgctctcttcagaactgtcagacagggacgtttaagtctgcagaagtttctgctgcctcttgttcagccatgccctgctcccagtggtggggtctacagaggcagcaggccttgcagagctgaggtgggctccatccagtgtgagcttcccaggctgctttgtttacctactcaagcctcagcaatggcagacgcccctccccctgccaggctgctgcctcgcaagtcaatctcagactgctgcgctagcagtcagcaaggctccatgggcatggcacccgccaaaccaggcgtgggatataatctcctggtatgtcatttgctaagaccattggaagagtgcattatttgtgcaggattgtcccaatgttccagatatcatctgtcatggcttcccttggctcggaaagggaaatcccccaacccattgtgcttcctgggagaggtggtatcctgcccagctttggctcaccctccatgggctgcacctactgttcaaccagtcccagtgagatgaaccaggtacctcagtaggaaatgcagaaatcaccgttttctgcgttgatcacgctgggatctgtagatcggatctgttcctatttggccatcttgaaatggaatgcaattatagctaacattttaagatttttaaaaagttacagttttatgagttacatcagatacagaagtgaggcaatctttaataattaaatgtaataatgaaatttggttgtatctaattgataaatgatatttcaagaggcatattggttgacacaagaattactaaatttttaaaaatctaaattttgtcttataagttgtcatttattattccatttgttcattaattcagcaaatatttgttgaacaccaactatgtgtcagtcactgtactatatactggtgattaaaaaaaagtgatccaaatagatgtgctctttcccattacccaaatgttcattttaaccaatgttagttgctctaatcaagaagatagccaaatagaaagtctaattacctgtcaatgggccatgagtaaataagtaataatgacaccgtctaagcatctactttttaaaatgttgtttaagatgaggcttataaaacaatataccaagcaaacttaattgagcattctgatttataagtcagtttttatatttcagaataatatgtttagatattttaactttttcctctctttattttgtggcaagtcattagtagtataaagttagatgagaaaatatttttagtgaaaatgtagttgttgttgtttttttaaccacaaaactagctccaagtaaagagaactttgaaagatttacgtgtaaacaattaatgctttcatttatttgctttaatttttcatttttgttctcacttcattctactgggcagaaataattttttttaaacctggaaaaccctgttttgaatagttttctgatagaatttacaaagataagctaaaatgttaaagcagaggaaattatagatattaaatggtgcaaataaaaaatgacagataataaaatagtgttaagaatacttgtatggtatgttaagatagcttttactccctaaagtacaaagacaaatatctatgaaatacatattgtcccctaagtaaatgtatttttgccattacttttaatttactaatatattgtttattgtttatcagatttgaataagtataaaaattaaatacatgacaagaattgcaatactttttttttttttttttttgagacggcttctcacgctgtcacacagactagagtgcattggcgcgatctcggctcactgtaacctttgcctcgtgggttcaagcaattccctgcctcagcctcccgagtagctgggattacaagtgcctgccaccatgcccagctaatttttgtattttcagtagagacagggtttcaccatcttggccaggctggtcttgaactcctgacctagtgatccacccgtctcagcctcccaaagtgctgggattacaggcatgagccactgcacccggccaagaattgcaatacttaaacttaagtgcaatatcttatttttgtgttattaaacacaaagcaatctgtaatatacaacttactttatgtaaatccgtaaattgaattgtgattacacatgcatttttttggacagtttgagtgtgttttcaattatgcaactgtttgcttaatgtttataggtagaaggggtgacttctagaactgaggaaactgtggctcagggaatatatatgatttacctaaatttacacagctgatttacagtggagcctaggttaaaatttgagtctctttctaccttgccatgtttatcattatgtgtttaataacataatataacctaacaaataaataatacgcttttacaaacaaattatggctgctcaccccatctgggaactgaggagtgcctctgcccggccgccaccccgtctgggaagtcgggagcacctctgcccggccaccaccccgtctgggaagtggggagcgcctctgcccggctgccccatttgggaagtggggagcgcctctgcccggccgccccatctgggaagtgaggggcacctctgcccagccgccctgtctgggaggaagtgaggagcgcctctgcccagcccccccgtctgggaggtgaggaacgtctctgcccggccgccccatctgggaattgaggagcgcctctgcccggccgcccatcgtctgggaagtgagtagcgcctctgcccggccgccccgtctgggaggtgaggagtgcctctgcccggctgcccatcatctgggaagtgaggagcgcctctgcccggccgccccttctgggatgtgaggagcgcctctgcccggccaccccctctgggaagtgaggagcgcctctgcccagccaccccatctgggatgtgaggagtgcctctgcctggccgccccgtctgggaagtggggagtgcctctgcccggccgccctgtctgggaagcagggagcacctctgcccagcagccgccccgtctgggaagcagggagtgcttctgcctggccgccccatctgggaggtgaggagtgcctctgcccggctgcccatcatctgggaattgaggagcgcctctgcccggccaccccatctgggaagtgaggagcatctctgcccacctgcccatcttctgggaagtgaggagtgcctctgcccgaccgccccatctgggaggtgtacccaacagctccgaagagacagcgaccatcgagaatgggccatgatgacgatggtggttttgttgaaaagaaaagggggaaatgtggggaaaagaaagagagatcagattgttactgtgtctgtgtagaaagaagtagacataggagactccattttgttctgtagtaagaaaaattcttctgccttgggatgctgttaatctataaccttacccccaaccccgtgctctctgaaacgtgctgtgtcaactcagggttaaatggattaagggcggtgcaagatgtgctttgttaaacagatgcttgaaggcagcatgctccttaagagtcatcaccactccctaatctcaagtacctagggacacaaacactgtggaaggccacagggacctctgcctaggaaaaccagagacctttgttcatgtgtttatctgctgaccttgtctccactattatcctatgaccctgccacatccccctctccgagaaacacccaagaatgatcaataaatactaaaaaaaaaaaaaaaaaaagattggtcactgagatgagttgttgctagcccaatccacatgtcctctaatttctcttttcacctagttacttccttcagtttttgctttatatattttgaagactaaacttgtatttggccaggcatggtgtctcacgcctataatcccagcactttgggaggccgaggcgggtggatcatttgaggtcaggagtttgaaaccagcctggccaccgtggcgaagcccattctgtactaaaaatacaaaaattagccaggcatggtggcgggtgcctgtaatcccagctactcaggaggctgaggcacaagaattgcttgaacccaggatgcagacattgcagttagttgagatcacaccactgcactctagcctggggaatagaatgagtctccatttcaaaaaataaataagtaaacttgtatttaaatacaagtattcaaaacttgtattagacagtgttaagtttagaattgttaaaatgctacattttcttggtgcattaagctgtatatcaacaagaaataaaactttctggtaattaaaaaaaaaaaattatggctgctcttcttgcaaacttacctgttcatagttggtcctgtggcagaaactgctagttgcctatcccattttcttgcatgatagaattcaattgtattgataaagtcaatatgctcaatgaaaaattccatatctaggcctactttcaattagtgttggatttgtcccactgttgtagtcactatgggtcaaatacaagttgaaacctcttttaaaaagaaagcacatttcactgactgacctgtgtcctttttgactttcatatatccatctgcttctgtaggaagcagacataatgtctaaagctgcaggagctgtcttaaaaatataaaagctgggaggagctaaaagatctgacatcttaagtcattaccttagacctaaatgcctacttcctgatgtaaggttatgtaagagaaaaaaatacctctattatgtgtgataccctgttatttgaatattttgttacatcaagacaaacccaatccttaaattaatccttaaattaaatatgcagctactcatacttataacagatgcatgataaatcatgcactgtatacaaatctaataaaaaggagcaggaaaagcatatgccaatgaagcaaaaaatgacagagacaaagaaatgcagaagaagttgtacttcttctgaaaacacgtgactgtgttatttgttactaaaatgagaaacatcatgaataacctctcatagaaagggagataagtgtgactgggtgtgaaattttcttgagggtaatagaacccgattcaaggcagctctaggcttgaaccacttttgacagtttatgtaaattgatattttgaagtttattattcatgttttctccttaaaagtagaagaaactcaaaaatcatttttagtagaaactcattgtataagattacacacccactatattatccataaatgacctttattagtgagttggagaaattcataccacttaattgtcccctgattttgcaacacatgcctggaacctaccaaccagcaaggaacccaccatattattatctgggaaatgattaaccattttctaaggcagctgctgatactatacagcttattgtacatggtaaagttatatgatctttatcttcctatgcacaacccagcctcagcacccttggatgccatgcctgagcaaaatgagaagctgctggccacatgtcctctcctgattcataaatgatttctgagtactgctatataaacatgcacatgttgtagtctttgcaagagtggatatcaaatctatttatgtctaggacaaactttttttttccaaaatagaatagaaacatatttgcaaagtaatcagtataataacattatcacattcaaaacagggctctaaagctagaaagaaactctaaatatggacatatattaaatattttttcatccctaagtagttcctcttttcctctgacaggaaaatagggctgcatgtttcagctataaaattatgcctagaaatctaaaagtctaagttattgtttacacaaattcaactaattgtttgttataaataattacttagcaaacgatatcagcagacatctgtttgcttaattttagagaggtttctcttgagtagtctagcttcctaaattaatgctgaaacttggctgagtcacaaagtaagcattgagtcagaagtcacagaaatattaaaagtcacagaaatgtttctgaaatggactttaattatcagcataacttatgttttacatactcaacatataaatacacagtatcctgcaatttccatttccatagttttgtctaaactattatagtaccccaggcctcacataatttgattccattgagctcaatttttcattcctaggaatatgacacttctctatactatttttttacctaaattgtgtatctcatataaaagagtggaatatctaggcaaaatttgaatgtgatattcacctgacaattggatataataaaataatctagtatacataattattttgttaacctatgattcataaaactgtcaccatgaaaaataataattttgaataggacaggtttcatgcatgctaatattgttttttattatttcaatctatttaaacttttatgatgttctcttttaaatattcagggtccaactttagctatttggttcatttttccccaaagatattctgatcttctttatattcaataaaaaaaatcctattattcaataacattatacattgcaaagcaccttgcattgttttaccttttataaaagcccattgatataaatggatattaatataaaatcccatataaaatgatgatataagaaaacctatgacccttgcaacgtcatatcacatattactaataaatgggagtttagaaatcagaactctagattctatcatcttatttcattatgtaatctcttaaagtgtcaaaataaactggaagagtagggatatacatattgttaaaagaaattttgttcaaccagagtgttacagagagaaaaaaggagagcttaataataaaactgtgtcttcatggaatttttcatgtggatgcattgatggaaaggcattctaggaaaaggcaacaacatgagtgaaggcccagaaacctgaaagctctgggaaatgttgcttagtccatgtctagaggctaggtaggtgaaaggatgaagacatgagactatgaaagaaggctctggctcgctctccaaggactttggaagcaatgattaatattcattctacatcatctcacatgccgggtgctttgctgagtgcagtatacgtgatgcctcattttgtcatcacaccaccctagtcagactcttctgatcaacagacacataacacgcgaggcagaagcaatatttctacacttccaggctactttattttcatccaggggttttcctcctagaagagtagtgggggatgaagaaaataaaatctttatgtgacacatctttgattggtttgggcttaatgcaatctaacataataaataaactgtgttaatgtaaaaaaatacaaatattgctaatctaaactcatagaagaaacatattaaacatactgatatctaaaaatatatttaaaatacaaaagtggaaaaaaaagttgttttatctttaaatctccagaatgcactttgcatgtcattaatagcacatttgatgtgctattctagtattacatttagactattgaaaaaccatagtgattaaatcgaaagaacatctgatttacatttatcttttggccctgttgatcatcaagatgaaatgtttatggaatcaacatatacttattgacttttgactatgtttaagagctatgctaagtaattatatgtgaggttaagatgaagattttgattaatttattcagaatgtctttaaaacaatagagcaaatgtttgcccaaatgatttcagtcttgtaggtcatagaaattagtaaaggaaaaattcagaaagacattaagaaaagtcataagaggggccaggcgcagtggttcacaccggtaatcccagcactttgggagacccaggtgtgcggatcacgaggtcaggagatcgagaccatcttggctaacacggtgaaaccccgtctctactgaaaatacaaaaaattagctgggcgtggtggcatgcgcctatagccccagctactcaggaggctgaggcaggagaattgcttgaacccgggaggtggaggttgaagtgatcctagatcatgccactgcactccagcctgggcgacagagtgagactccgtctcaaaaaaaaaaaaaaaaaaaaaaaaaagtgataagagtctctcagaggcattcagagattttgctacattccaggaaaagactggagtatgcatgtcactactctctccaggaagcctggaattagccattttaatgctctacttcctgagtgtatgagaggctacctctactttaactttttattttgtttcttcactaaaaaaggatgaaaacagaagaacaaatgggagaaaataacccaatagacctatgttatattcactattctccaacagacctttaatgaattagagccaataagcaaaacaaggatagctaaatgtacattggattttgtcaattttccaatagtcttaaaaattgtagtttttatatatatatttgaacaaactttacataagtacacatatctattgaagataaattagaagaataaacaagacaaaactacctttaatgacaaatatatttcccattaactgaagggatcttgaagcttaagaatttgaaaagagtaagtactattgagaattctgaacaacattaacatcccatcactttgaaaaactgtttaaagagttaaatcaactgacagcttaaataacacattctattttggatggcagtcttttctttccttcttattttttaaacatagtttgaaggctatgctcctcatattttaagacatttattttgtattattataatattaatatactgtacatttttaacacctcagtatgctattcctgatttgtgatatagatttcttgatgcaagagtataattataactaatttccaaaaaacatgacagagattttgatggacaaacattttttaatataaattttaatttttattttactataagttctgggaagcatgtgcaggacatgcaggtttgttacataggtatacatgtgccatggtgctttgctgcacccatcaacccgtaatctaggttttcagccccacatgcattaggtatttggacaaacatttttaccaagctactatactttaaaatttgcataatttgtactactaaaaataaatgttttaaaaagattatccaactatctaatgtttaatgtgttataccattgataaaaatcagatcatctgagttaatttctatgatgattcttcaagtatgtattcatttcatattatttattaagctcctcctaggccccatgctagttttctttgtttttcttttctttttttttttttattatactttaatttctagggtacatgtgcacgacatgcagatttgttacatatgtatacatgtgccatgttggagtgccatacacattaactagtcatttacaataggtatatctcctaatgctatctctccctgctccccccaccccacaacaggccccagtgtgtgatgttccccatcctgtgtccgagtgttctcattggtcaattcccacctatgagtgagaacatgtggtgtttggttttctgtccttgtgatagtttgctgagaatgatggtttccagcttcatccatgtccctataaaggacatgaactcatccttttttatggctgtatagtgttccatggtgtatatgtaccatattttcttaatccagtctattgttgatggacatttgggttggttccaggtctttgctattgtgaatagtgccgtaataaacatatgtatgcatgtgactttatagcagcatgatttataatcctttgggtgtatatccagtaatgggatcactggctcaaatggtatttctagttccagatccttgaggaatcgccacactgccttccacaatggttgaactagtttacagtcccaccaacagtgcaaaagtgtttctatttctccacaccctctccagcacctgttgtttcctgactttttaatgatcaccattctaactggtgtgagatggtatctcattgtggttttgatttgcatttctctgatgggcagtgatgatgagcattttttcatgtgtctgttggctgcataaatgtcttcttttgagaagtgtctgttcatatcctttgcctgctttttgatggcgttgtttcatttttttcttgtaaatttgcttaagttctttgtagattctggatattagccctttgtcagatgggtagatggtaaaaattttctcccattctgtaggttgcctattcactctgatggtggtttcttttgctgtgcagaagctctttagtttaattagatcccatttgtcaattttggcttttgttgccattgcttttggtgttttagtcatgaagttcttgcccatgcctatgtcctgaatgttattgcctaggttttacttctggggtttttatggcttaggtctaacatttaatctttaatccatcttgaattaatttttgtttaaggtgtaaggaagggatccagtttcagctttctacatatggctagccagttttcccagcaccatttgtttagatagggaatcctttccccatttctgatttttgacaggtttgtcacagatcagatggttgtagatgtgtggtattacttatgagggctctgttctgttccattggtctatatctctgttttggtaccagtacctgctgttttggttactgtagtcttgcagtacagtttgaagtcaggtagcgtgatgcctccagctttgttcttttggcttaggattttcttggcaatgtggtctcttttttggttccatatgtactttgaagtatttttttccaattctgtgaagaaagtcattggtagcttgatggagatggcatttaatctataaattaccttgggcagtgtggccattttcacgatattgattcttcctatccataattatgtaacattcttccatttgtttgtgtcctctttaatttcattgagcagtggtttgtaatttgaagaggtccttcacatcccttgtaagttggattcctaggtattttattctctttgaagcaattgtgaaagggagttcactcatgatttggctctctgtttgtctgttattggtgtataagaatgcttgtgatttttgcacattgattttgtatcctgagactttgctgaagttgcttatcagcttaaggagattttgggctgagacaatgggattttctaaatatacaatcatatcatctgcaaacagggacaatttgacttcctcttttcctaattgaataccctttatttctttctcctgcctgattgccctggccagaacttccaacactatgttgaatagaagtggtgagagagggcatcccggtcttgtgccagttttcaaagggaatctttccagtttttgcctatttagtatgatattggctgtgggtttgtcataaatagctcttattattttgagatacgtcccatcaatactagtttattgagagtttttagcatgaagggctgttgaattttgtcgaaggccttttctgcatctattgagataatcatgtggtttttgtcttcggttctgtttatatgatggattatgtttattgatttgcatatgttgaaccagccttgcatcccagggatgaagccaacttgatcatggtggataagctttttgatgtgctgctggattcggtttgccagtattttattgaggaattttgcattgatgttcatcagggatattggtctaaaattctctttttctgctgtgtctctgccaggctttggtatcaggatgatgctggcctcataaaatgagtaatggaggattccctctttttctgttcattggaatagtttcagaaggaatggcacaagctcctctttgtacgtctggtagaatttggctgtgaatccatctggtcctggactttttttggttggtaggctaccaattgttgcctcaatttcagagcctgttattggtctattcagggattcaacttcttcctggtttagtcttgggagggtgtatgtgtccaggaatttttccatttcttttagattttctagtttatttacgtagaggtgtttctagtattctctgatagtagtttgtatttctgtcagatcagtggtgatatcccctttaacatttttaatacatctatttgattcttctctcttttcttctttattagtcttagcagtctgtcgattttgttgatcttttcaaaaaacaatctcctggattcattgattttttgaagtgtttcttgcatctctatctccttcagttctgctctgatgttatttcttgccttctcctagcttttgaaggtgtttgctcttgcttctctagttctttaattgtgatgttagggtgtcaattttagatctttcctgccttctgttgtgggcatttagtgctataaatttccctctacataccgctttaaatgtgtcccagagattctggtatgttgtgtctttgttctcattggtttcaaagaacatctttatatctgccttccttttgttatgtacccagtagtcattcaggagcaggttgttcagtttccatgtagttgagcggttttgagtgagtttcttaatcttgagttctagtttgtttgccctgtggtctcagacacaatttgttataatttctgttattttacatttgctgaggagtgctttacctccaactatgtggtcggttttggaataggtgtggtgtggtgctgagaagaatgtagattctgttgatttggggtggagagttctgtagatgtctattaggtctgcttggtgcagagctgagttcaattcctggatatccttgttaacattctgtctcgttgatctgtctaatgttgacagtggggtaaagtctcccattattattgtgtgagagtctaagtctctttgtaggtcactaaggacttgctttatgaatctgggtgctcctgtattgggtgcatatatatttaggatagttagctcttcttgttgaattgatccctttaccattatgtaatggccttccttctcttttgatctttgttggtttaaagtctgttgtatcagagactaggattgcaaaccctacctttttttattttccatttgcttggttgatcttcctccatccctttattttgagcctatgtgtgtctctgcatgtgagatgggtctcctgtatacagctcactgatgggtcttgactctttatctaatttgccagtctgtttcttttaatgagggcatttagtccatttaaggttaatattgttatgtgtgaatttgatcctgtcattatgatgttagctggatattttgctcattatttgatgcagtttcttccttgcattgatggtttttacaatttgtcatgtttttgcagtggctggtaccagttgttcctttccatttttagtgcttccttaaggagctcttgcaaggcaggcctggtggtgacaaaatctctcagcatttgcttgtctgtaaagaattttatttctccttcttttatgaagcttagtttggctggacatgaaattctgggctgaaaattcttttctttatgaatggtgaatattggcccccactctcttctggctttatagagtttctgccaagagatacactgttggtctgattggcttccctttgtgggtaacccaacctttctgtctggctgcccttaaaattttttccttcatttcaactttggtgaatctgacagttatgtgtcttggggttactcttcttgaggagtatctttgtggcattctctgcatttcctgaatttgaatgttggcctaccttgctaggttggggaagttctcatggataatatcctgaagagtgttttccaacttggttccattctccccgccactttcaggtacaccagtcagacataagtttggtcttttcacatagtcccatatttcttggaggctttgttcatttctttttactgttttttctctaaacttctcctctcgcttcatttcattcatttggtcttcgttcattgatacactttcttccacttgatcgaatcagctactgaagcttgtgcatgcatcaggtaattctcatgccatggctttcagctccacgaggtcatttaatgtcttctgtatgctttttattctagttagccattcatctaatctttttcaaggtttttagcttctttgcgatgggtttgaacatcctcctttagcacggagaagtttgttattacagattgtctgaagccttcttctctgaactcgtcaaagtcattctctgtctagccttgttccattgctggcgaggagctacattcctttggaggagaagaggcgctctgatttttagaattttcagcttttctgctctggtttctcctcatctttttggttttatctacctttggtgtttgatgatggtgatgtacagatggggttttggtgtggatgtcctttctgtttattagttttccttctaatagtcaggatccccagctgcaggtctattggagtttgctggaggtccactctagaccctctttgcctgggtatcaccagtggagcctgcagaacagcgaatattgcagaacagcagttgttgctgcctcatccttcctctgaaagcttcgtctcagaggggcacccggctgtatgaggtgtcagtcagctgctactgggagttgtctcccagttaggctactcaggggtcagggactgacttgaggaggcaatctgtccattctcagatttcagactctgtgctaggagaaccactactctcttcaaagctgtcagacagggacgttgaagtctgcagaagtttctgctgccttttgttcagttatgtcctgcccccagaggtggagtctacagaggcaggcaggccttcttgagctgtggtgggctccacctagttcgagcttccttgccactttgtctacctactcaagcctcagcaatggcggacgccccttccccagcctggctgctgccttgcagtttgacctcagactgctgtgctagtagtgagtgaggctctgtgggcttgggaccatctgagccaggcacaggatttaatctcctggtgtgccatttgctaagaccattggaaaagtgcagtattagggtgttagtgtgctgagaggagctcagtcagggagaccctaactcagcggcactagaggaattaaagacacacacacagaaatatagaggtgtgaaatgggaaatcaggggtctcacaaccttcagagctgagagcccctaacagggatttacccacatatttattaacagcaaaccagtcattagcattgtttctatagatattaaattaactgaaagtatcccttaagggaaacaagagatgggccaaattaaagcaatagattgggctagttaactgcagcaggagcatgtccttaaggcacagatcactcatgcaattgtttgtggcttaagaatgactttaagtggttttccgccctgggagggccagatgttcattgccctcattcccataaacccacagtcttccagcatgggcattagggccattatgaacatgttacagtgctgcagagattttgtttatggtcagttttggggccagtttatggccagattttggggggcctgctcccaccatgtcccccttctttgatttgcaaattgataaatgcaaaggcaactttgtcacagtgagctacttctcacaggagtcaggatccacatctgcagactacccaaagacaatacagattaaaagcacaatcatcattgaaatcacagaacttccaggtgtttttatctattttaatgggttactagctgctaatctgtctgtaactccttcaagcactccagttcctggcattaaggtcaggtgtgcctgggatgctttaaatatttgttcttttaattttaaatccttatgtcaagctcctagagtaggccatatcatttgaggttgaggtgccactataccacagtggttccagataataggaacttttgccatacttctcatcatttctaccatctgaccatttttctcagatcatctgaacatagtgtggccatggcacgcagactgagaggtgcaagtcaagctaaacatccccttaggggaccaattaataatgattccataggaattgttgtgcagcacctctgtctgttctgcaatgcgatcttcctaaacaagtacgttcattttttctaactgggtccaagcctgtttacaaataggtttttgagggcgatatgcctcaattataggagcagatttattatggtaaatactgagatcagaaagcatgtgtaactgtgtcatagagtgattgcatccaggcattattgccagccaagattgatcaatatgcccgataagtataattgttctctgtgtcagtccttattgaaggaatactcatggcagtggtgataaccgctgtcatagctaccattaaattattcattgtgactggttgtcccacttttgttaggttgtctttcaccatctgtgacagcttcttgatctgtccccagatgggtggctgtgttcgatgggtgttgctcatgacagttggggtcctcctcagtgtcagtctcaacatgctgcaaccgaagggtccttgggatccttctggaatctcttcctcagcatctggctcatgataagttttcaggtgtcttgatggtatccaaattggctgttgattttggcctggagaaatacaagcataatctctaccccaagttattattttacctatttcccaaattttgttaacggatctctccaccaaatcagttgttctgcttctgtctttgcagttggtttctgtacgtgctgtacagctgctgataacatctggcctttgggcaggctcaaaaaatttaaagttaataatgctagattcagttgcatctgcggtcttccatattttatctccccctttctgcttttgcaactgctgttttagggagagattcattctttcctctgtggcttgtccttgagaattgtatgggataccagtaatgtgtttaatattccacatagagaaaaatatagctagagcttggctattatagcctggggcattatctgttttaatagaagctggaatgcccatcaccacaaaactgcaaaagatgacacttaacacaggcggaagactctcctatttgatgtgtagcccaaagtgagaaaaggtgtccacacattacatgtacataaactagtctcccaaatgagggaacatgtgtgacatccatttgccaaagtgtgttaggttccagtcctcgaggattaactcctcctgtaaaagatgaggcatgtaccatttggtaagttgggcatccctgtataatagctttagcttctttccaggtaatgctgtatctgtgtttgagaccagaggcattaacatgggttaaattgtgaaagtgtctagcattagatattgcattagcaactaggtggtcagccttttgaatccctttagtcaaaggtcctggaagagatgtatgagccctaatgtgagtgatgtaaaatgggtgcattctacttctaactgctgtttgcaattcggtaaataaagtcatcagttgttcatctgtatgtaatagtaactgagcattttcaattaactgtgtgggatgaaccacatatgaagaatcagaaatcacattaataggcatagcaaaagaagtcaatatctcaattacagctacaagctccgtttttgagctgaaggataggacgtctggaaaactttactttttgagccagaataagaagctttaccattactagacctatctgtaaaaaacattttcagcaccttcaattggtttaaatttagttattttagggagaatccaattagttaatttcaaaaactgaaacagcttcgttttaggaaaattatcagcaatacccacaaagctttataaaagctttctgtatttatgccttcgtgagagggacaataatttttccaggatcatatccatgtaatttaacaatccgagttctcccaatccctatcatagtagcgatttgatataaataaggagttagagtccgtgaattagtatgtggaagaaaaagctactctactaagtcctgttcttggacaataacaccagtaggtgaatgctgagttgaaaaaattagcaaatctggagtctgctctggatctattctatttatttgaggcttatggacttgcttttcaattggttgtaacttgacctcagcctcctttgttaattgccgagggctagtaaggctaggatttcctctaaggatagaaagcagattactcatggcataggcaggaatgcctagagcaggtcatatccaattaatgtcccctactaatttttgaaagtcatttaatgtttttaattgatccctacgtatggttactttctgtggcacaatggtagtgtcatttactaaggtccccaagtaggagtaaggagtgcagcagtatgaattttgtcaggagctataattaaaccagcacaagaaatcgaattttgcaagtgatcataacattggagtaatatttcttgagtggggcagcacaaaatatatcatccatatagtgaataatgtaacactgtgaaaattttttaggagtaggttcaattgcttggcccacatacgactggcaaattgtgggactgtttaacatgccctgtggcaacactttccaatgataacacttagcaggctgcaggttgtttactgcaggaattgtaaatgcaaaccattcacagtcttgctcagctaaaggggtagtaaagaaacagtcttttaaatctatgactattaaaggccaattttttggaattatagcaggagaaggcaatcctggctttaatgctcccataggttgtataactgaattgatagctcttaaatcagttagcattctccatttacttgatttttcttaggaaaactggagaattccaagggaaaatgttggagctatgtgcccattttctaatttttcagtaactaatttctctaaagcctccagtttctctttacttagcagccattgttctatccaaattggcttatctgttaaccattttaaaggtataggttctggaggcttaacaatggccgccatcaaaaattatttcctaatctttggcaggaactttgtttttccccttgacttggttttttcaaatcttgcaaatttttttctagttccataccagggacatacctcatttcatgcattgtatgttgatttttagggctatataattgttctgggattagaacttgtgctcctcattgttgtaataaatctcttccccataaatttataggtacagaagttataattggttgaatagtaccaggttgtccatcgggcccttcacaatgcaaaatataacttctttgatatacttcagggcctttaccaactccaactatgttaaattgagcaggttgaattgtccatgtggacagccagtgctgtagagaaatgattgaaatgtccactcctgtatctaccaaacctctaaatttctttccctgaatagttattgcacaggtagggtgtttatcagtaatttgatttacccaataagctgctttgccttgtttatttgtgcttccaaatcctcctgtgtgtttaatttcactttttcccatttccacatatggcacaattaggagctgtgccatgtgctctcctggctctgctttccagggaacagaagtagatataacgatttgaatttccccattataatctgaatcaatgactcctgtatgtatttgtacactttttaaacttaaactagaccttcctaaaagtaatcctattgtccctgctggcaagggtcctccacagactcctgttagggaccttttgtgggggttccccaggcagaaggctcacagcttttgtgcagcataaatctactgcagtgctaccggctgtggcgggagacagacattgtatggggatgagggaatggcctgagctggaaatgcccaggtttagaatggggcccaggacaggcccctcatggcatttcccaaaatcaggttcccttctttatcaaacttagggtgacattgattagcccaatgttttccttttctacattttggacatatttcaggatcagcagttttcttttttcccctatctggcggcctgactctctgaatttttctacattcctttttagtatgaccatgcttcccacagttaaaacaagctccaggaaatggagtatttcctttatccactctcagtcttgccattgcctgtactagccaagtagctttatgcagattacctctgataccatcacaggccttgatataataaactaaatgtgctttcctgaatttaaaagcaataggctcaaatgtagccataatatttccctgttgatctggggggtgtattctaacatggaactgccaagcctctaaatcaccctctcgtctagcttgctgaattcctgcctgaatagaactaagagcgatcgctcgaggcgctgcttgaacagtcactggggcaactacttttcacccagtgtcctccagaaaagaaagatctggagggtctttttcttcaaaataataaggaggggttacagaagggtagggatgaacctctccttcctttgctgctttagctggtaaataaacatgctctgtaacctcttctgttacttcactatactctccttcctcctcctcatcagtgtgaaaaagttccatggtagaatggaccagaccccacacttgtcccatgattaacctgatgcttccgagctccccttcttactcaccacagggattgctttaagagtacttgggtgtcctccagcttagttttccattccaaccatcgctccggcaatccttcgacctggattcgagcccccgtgatggacgccacttgctgagaccagctcagtcagggagaccctaactcagcggcgctagaggaattaaagacacacacacagaaatatagaggtgcgcagtgggaaatcaggggtctcacaaccttcagagctgagagccccaaacagagatttacccacatatttattaacaacaaaccagtcattagcattgtttctatagatattaaattaactaaaagtatcccttatgggaaatgaagggatgggctgaattaaaggaataggttgggctagttaactgcagcaggtgcatctccttaaggcacagattgctcatgctattgtttgtggcttaagaatgcctttaagcagttttctgccctgggagggccaggtgttccttgccctcattcctgtaaacccacaatcttccagcatgggcattagggccattatgaacatgttacagtgctgcagagattttgtttatggccagttttggagctagtttatggccagattttggggggcctgctcccaacaggagtgtcctgattttccaggtagcatctgtcacagcttcccttggctaggaaagggaattctctgaccccttgtgcttcccaggtgaggtgatgccccaccttgctttggctcacactctgtgggctgcacccactgtctgacaagccccagtgaaatgaaacccgtacctcagttggaaatgcagaaatcacccacttctgcgttgctcacactggaagctgtagactggagctgttcctattcggccatcttggcacctctctctgctagttttcttactgaatacatatctgtccatttctttttacctgggtagtattaatcataggattttaagtctggaagagattttcaaaattgccgtccaaataaaatttctcattttttaaataaacataagtaagtaaataaaaacaaagtatgaaataacttaagatgtttccccagagggttgtttggtaatacaaactctgtgaaataaaagtaaattatgaatgtagaaatcaataaatttgttttttttttaattttttatttttgagacggagttttgctcttatcgcccatgctggagtgcagtgatgcgatctcggctcactgcaacctctgcctcttgggttcaagagattctccttcctcagcctcatgagaagctggtgttacaagcgtgctgctaccatgaccggctaatttttgtgtttttagtagagctgtggtttcaccacattggccaggctggtctcaaactcctgacctcaagtgatgcacccgccttggcctcccaaagtgctgggattacaggcgtgagtcaccgtgcccagctgaaatttggttatttttataaaattaaaatgaaatttatccaagtaggcaaaggaaggaaaattttatgtaatagatgttttgaatcatgagaagtttttttttgttaaatgttgctatgatagtaaccttatgatttcccaatgcagaattatcttagtatatttacagcagttccagagtccaagattaaaagaaaattgtttagctaagctttaaaaaggaacaattataaataatatttataaaaattttattaaaaatatctaccacgattcttcatctgtagctaccagctagggtaaactttgcataaaacttatcacttgtctcctatttcaagtgctttgtaaaacttgaaaatgttctgttttaatacttcaattataggacttaccaatgtctattctcttctcagttttcaggaaacattgtctataacaatactatatgaggttcatagtagtagtcatttttcagtattgatgttacggcgttttaattttcttgggcaattgtatcctaaatttattttaaactaagttattcaaaacttctgctactgttattattttattttgcgaaatttttcaaagctgtaagatcttgtttggaagcactgagggcaaatatgataaagttgacctcttacaattattacacattttcaggaatagctagtgctcagtaaattgttattattgtgcttttcataattagtgataaatattttttaatgccatttagtgtaccctggaacttaatgtagaatagcagcaggtctcagtcatgttcgctggtatgtcctaggtcattagctgatgttgagtaggtattctggaaatactctaaaaatattacttaaccaaatgaatgatctgactacttgtatgcttgatacttttgtgattcaagcattatactcatactgagaaaatgtagacatagcaaaatgttaactgggctatatgcctgtcagaaaaatcataatatacccataattattaagattgtgatagttagtgctagcatacctatttatatgtcctccagaaagaaagatctgttacttaatcatgacaaaaagagtctaggaattaccagagaaatagaaaaaaagagttataaatagaattaattctaatctgctagaattctaatatgttaaaatttcaattttctaggtctctgcaaacctcccgaacggtatatataatgattttagacttataggtagggtttctagagagcctaaatgttaatggatttttttttaaagaaagtaaacattttggtaatttgcaggtaaaaggtggttcctaaaacttaccatagccttagctcaatatcaggtcattcattacaatttgtcttcatcatcaaaaaatgtttatgtttataactgttaccttttctttatttgatttaggtagaatccaagtattctaagaggtattgtgccctggatctaaaaaatcaggtttagagtacatgaatgtacttattttgatgctggtgtattcattcttaattaggacaggagatgctgaaaatttacttagtgataaagctaataattctcctcctgtagcatctggtctccagtggcctggagtcattgtctaacctgaatttgggaatagttgagaaagttattctgtatgacctcatttgaattaaagttgttggtgtaggaagtgtttaaattcaactgaaaattttctgaatatcctggtgtccttggcccaatatttctgtgaaaccaaatgaaatatctgagaaccatggagaaatacaatctggctagtactgttttgtttttcttttttcaacttataatttgtttcttcccaaaggattatatatatattgtatataaaggcatatatattacatatataaccttaccatttataggtatatggatttttttaatgtatggaaaacaaattgaacatttatttgaattttaatttttgaataataatttaacatttgcatttaattgagagatttgagtttataaatttaaattattttgattattaaaacagtgagtatttcttatagcagcagaggagtctgctgcaaggattttactcttctgtcctatgagcaagtcactgagttgctaatgcagtcagtgcatgttgcagtacctgtctagtcttgtggatttctctttggcaccactgttgaaatctgtagccctggctatagccttaatttactagatgcctgcactccatgatttccttatcctaatccaaatcctcttcctgcccattggttcatgtagaacatgtttccctcaccaggatctcttagatgactaggatggacaagcggtacaatctcagggaaactttctcagttagatacaaaaccagatacatgttatttggttttatctccaattattaggtttcttttttagagttttagttaccccagagaatctagcagcatcttatccctgctctaatgtcttccaattctcagcaatctctttcaaaccaaagtggcttttcctcttcccatgtggcaaaagcttacttatcttcttatatatcatatcctctatcctttctatactgtgtcttataacaaaactgcaaatgcagacaatctaagccttgctcttgatatgtaaaggaaattttttgaacttaagaatttttttttccacaaagcctgactttcaggatgatgtattttaaggactttaaaaaagaatcaaatttggaggaagaattcagattcaaagctaaggaatgacctctctgagactgtatgcatatgcctttcctacagaaataaatgccattgtgttaaaaggtgagaaagtgtaggtcaatgtgatttacagagaataaaaagtacattgtcttacggtttcaaaatattattcccctgaattgtctattagtagcttattttcacagcttccatttcctctaaatgtctgttaatttacttattattttatccttaaaaggaatcttggaattaggtaaaacttggtttgaacttaacttcatggatatgtaggaagactttactacctcagttttctcacctgtaaaatgtcaataacactgcccacctggttgttatcaggattaaatgagttaatcagaataatgtctgaaacataatggatgctttataacatatgctattaacattttaatttggatagtatgtaatgtctaatacttaatagtattgtttgatgaataaatgtaaaactataggtaaatgccaagcatcatagttcatttagaaagctctgtacaaaagttaattacccttctcttgctttcctttcttttcaaagctaactgccttacctgtgctctgagtagcataatttcctgattatacataggcccagtgtcattaactatctgctatttctgttgtatcttcaatttctccctttccactgactgttcttatatttaaaccttctctgttctaaagaaattgttgatttctgcatcaagctttcttctttctggggccaaactgttggatgaatattgaacatgtgtatacttataactgcccaaccttcgaacctgcttattaacttttcagaattaccttactttatgaattttgataagtgatgctctatgtattagagcatctcccattttcactagataagctgaaaatgccagatactcactttcctagcctcctttattactagggtggggacacatgacccagtctccatcaatctgatgtacattttccagagacacagtcggttccaaggcaggttccacagtttcagggaaattcaggggcagctgtgacaatagtaataacagtgctatcccttgttcagagctggctggcttgaaagtgctaactttattatctggtgctgaaatgtgatggcagtgtgtctttgttgcatccgtaccatggtgtgcgtggccctgaactggttacccagtcttttcaattctgataactactcaatcttcttttagtaaattccttttctacttcaatcagccagagttgctttccattgcttgcagcctagaaccttggctgaaataagaaaaagtagcctattttcactgcttcatctcctctccttctgttctgcctttaacttggtgccatctaggtttcttctgcacttgaagctgttttcttctacagcaaattgacttaactataccaaataaaaaagcttactgctaatcctgctgagaccctttgtgacacaggacattggtcattctttcctgtgagacattatctttctctcctgaatcttttcctacctctgactactgccttccagttttatgcccccacttttccccccatggacttgccttttaattgtggttgttttccttgattcttcctttggctattttctcaccataatcttacaatattccttaagaaaattcccctacttccacatatttaatttcttcagatttccaacatcaaatctcaagccatgtttgtttgttttttaagtttgataccatgctcagatttcaaagtccttgcaggataactctgtcgattgaatgtacccttgagacttagtatgtaaattgagcttgtccaccctacctgctccacctaggaaattatctattttacttgatgttatgttctcatttactgagagttgtcaaatgctctctttccttttttgcccacacatcttattagtaacaaaacttgtttctgtctctgaaatctcccatatcatttcctctttgcccctctccttggaagaaccttgatttagccctcattatatttggattgcttctgttgacaaagattctgtcttcttttaatccatttattttctttctaaagcaaagctgtgctgattttttttcctagtcaaaattttggtttttacaaaataaaatccagattatttattttttaatttctaaccttaatttttgtaatgtctacaatagactcagtgtctctgctatattggtaaaatttatatcctaaaaatgatattgctatctagccctcatcttttgatcaagctgtttttcctgactgaaatgtcatttccctcatgtcaacctcccacagcctttacatttccaaaagcttagctaacttcctcctttgtctacgatccttcctcaaactatacatgcaaaactcccattttctttccctgtactgacatgtgttttgtaatgaatatttgtgtcttttttttcaaccctactgcattttatccttagctcatctataatacctaaaacagagccttttacctcagtgttgcttggttatttgaatctaagtaagtttctgtccagagaggcatatgcctcttttccttgctgccctatctttgcaaaaagttataatccacagcaaaagtttcccacaatgatttggttccatggtaactaaattctccttaaaatgttggaagtaggacctatgttgtatatcacttattcacaggaaattaaaattaactttgttcctgttcataatattgtgaacatcataaaggctggatgaaaagggaaaatgaagagttccacttcccagtattgaaagaaccctggattagtcctagctgtgcactctgttataatcttagataaattacgtaatctcctcatactaaatatatttataataataatgggggcatatttatcagcattactgtaaagtacaaaaatactaaaagcaaaagcactatgaaagctacacaaatattacatgaatataaaatacaacacttattgtggttattattgttcgatcttgtcatttccaccagtcaaagcttgtaaagattcttctaagtccctattttaaactctatgtcattcttttcatgtcctgactcttatatggacacaatgaatgcccattgcttatatgtctttacttctaattcaaatcttcctgtttgttttattgattttttttttcaaatgctatggcctgatgtcccttatgattgctatgttttgggtaagaggggttttaaaattgtgttttagtttgagacaatatttcgttgactcaacaagaacccacatatatgattcctattcttatttatttatttatatttattgtttttgagacgtagtctcactctgttgcccaggctggagtacagtggcatgatctcagctcactgcaacccctgtctcccgaatccaagtgattctcctgcctcagcctcccaagtagctgggattgcaggcatgcaccaccacaccgagctaatttttgtatttttagtagagacggagtttcaccacatggctcaggcttgtctcgaactcccgacctcaggtgatctgcctgccttggcctcctagagtgcatgagccactgcacctggaccctattcttattttaaagtaatgttgactctaaatcaatttatacagtacatattaaaattaacatcatgaaaggttttattctaggcactgtagatgacagtccttataaaattaaggataagccaaaatataattctagttcaaaggagaatttagtagatgccaataagaagtaaaaatagatacaataatggttcagagtagaagaatttcaaatctgagttaataataacattcataaaagttttcatatgaaagaggtggcatttgggatgggaaaattgagaaaaaaaattattgattgtcatagcattgctccacagtcaatcatgtcacataaatgtgaaacagaaataaatttcaccaacattccaagtttcctttgtttcattataccaaatgcacatggtagagaacacacacacacacacacacaaatgcacgcagaaagagagaggttgtttgcaaatggactacagtttcatggtgaaaagtaatttgtgatgcatcatattatgaggtttcatgatatttgtcaggataaggtcaaatgtgcaatccacactgtaaaaagcatagcttacttctatttatgtaattaattggagtctttaacagaggaaaatctttaagtgtttttgttgccttaaaaaatagctcacatgccctatttacaaaaagtaattgggttatctgagaacttacaacacttgagtatcattatatgaaggaagaaagtgatcctgaagaagctatatttattttctttattataaaacttgaactattttaaaataaattgttagctgttgaagtctgtgtttttgagcatcagtaaatggccagtagtaataatgattttcacgaatagaaataggttgtccatgctgagagctagtaacacttcactttgatgcaaatgtttaagtgattcaaaacattgaaatgccaattagtaaaaatggagttcaaatttttacaaaatgtgtgcatggggaggcagctatcattggatgtgctctgccgaaacttgtagtcaacattaaaatgttttaaaaacatttgagagctcctgttggtaaattctaatttgtgtataagtctaatgtataaagtattggtaatttagaaaccacaatgctggattaagagacctgttaggagacgggaggtaagcaaactttgctaacttaatgggaaattttgtggaatagtgttatgacattacagaaccttcctcagggtctacttgaatcataccaatataattcgcaattaactgatggaaggaattggtttcatgagacgctgtattctgaaatcagaagaggcttaaccttcttgaaactgcttttatttgccatgtgccctgctactcaagattttcataatgcttcaattttagttattcttattagtttaaaaaaacaaaactacttttaatcttcatacttaatataagaaaaatattcaaagattgtctttctcatatctatctctcacatcattctgcgtggattactgagggccacacgatcatgcagtcttcagacgcctttgttgctccactgcagactttttttcttactctgcagtgattcacaccgttccctttcttacaactcttcatgactccaccttgccattaagacaaagcccccgtgttagccaggatggtctcgatctcctgacctcgtgatccgcccacctcggcctcccaaggtgctaggattacaggcgtgacacggtgaaaccccgtctctactaaaaataaaaaaattagtcgggttcggtggcgggcgcctgtagtcccagctacgcgggaggctgaggcaggagaatggcatgaacccgggaggcggagcttgcagtgagcagagattgctccacagcagtccggcctgggccaaacagcgagacaaaaaaaaaaaaaaaaaaagacaaagccccatttctttaaatggatcctcaaagactgcatttctcttctagcccaagaaggtcaatgcagcttcagaatgaatgttccaattttctaaattcaccaaatttgccaatttactaaaaacttaagagacactcttcttgattatagttgatgtattcaataaggaagagtaaaaaaaaaatgctcaatttgttaaacaaaacagaacaccacaagagtcagaaattgaatttgtttctttaaaaacagcatgttctttttatgaatatgttctttgtaaaaagaaaggaaagcaggaaaaagataattaaattctgtaaagaaaaatccgcagtcatgacaacccccctgcccatactctgttaatccatgtattaggcattactgtaagctttataaattactacaagaaacagatgttggtaagtatataaatttgataaattgatcatttggtgatttgttcctttcagtgaattgctcattttgtgaggtggctttcaatgcattgagctagagtcatcgaattcaggttgatctcaccatttccttgctattctaaccatacataactcttttggctcctgtaaccagcattcactcttacttagcagcatacctaaatatttcctgttatctaaaatctactgcctatcactattctacagacaactattactctttagatataggcttaaagttagttatctgagaagacttctttagtgcctatattggtcagggagctagctccaaaagagaaatctactcctacaattttacacagaaacagatttattaaagtagtaataaccctttaaaatgtgggatttgctgaagttgctgactctagactgaccttttgaggatacctcccagaaacacatgaaagaactacattgccaagggggcagtgtcgttcagcaatattgaaaaatctgtattatcaggaaacaccaccaaagctgctggcctcagaaccacacaacctctcccatgatccatgacagctaaacatctgccagatgcccttgctttctccccatataaggcttttctcaattgaagccttatgtgaatatatctaattggtaggacccatcctagcatcttggaagacatggaaatagaattttaagctttttcacttctgctttacagaaaggcattctggaacggatttaagatatttaattcaaagaatcccctgaacctgccctatatgttagtagtgtggagccgcatgtgactgttgggcacttaaatgtagctcgtgtgcctgagaaactgaatttcttactttatttagttttagtttgtttaaatttaaaagctgaagtagtgtaaaaatttttgttaactacaactgtactgccttggaagactatatttcatttcagctgttgaattgtataagatgttactgcttaatcctagtatgtatttacattttactttttaaaatttggctactataaatttaaaaattacaaatatattacatattctatttctattggacagcagcactctaacccctagattgggctagacctcactatacgtgcccccatggtatctcatcttttcttagtcttgacattcacacagctttttggttataattgcttctgtatttgacttttctcctagcttgtaaaattaatgaatggaaatgctatatcttttttttttgtcaccattgttttccatagcacaatgctcacatattataggcaataaaattatactaaataaatgagtgaataattcttaaaaatggacgttaaagagctaatattccgtaaagcttagtctaaactgtctttacaatttcattttaaaagatcaattcaagccattacttttaaataagttattgagttttaccattaattttcatagttccttaatttacaaatgacagataattgaacatatttttactttatacattatttcattttgcattactttcctttcttaagcagagacagtgaaaagaaaaagagcttcttgggattttttattagagatgacacaccagaaatataattttaaaaatagattttcacataggtgcaacaatgtgacataactcactgccacacactgtgtctcagtgagtttgaaataaaattttctgtttcaataaaaaaaaagtatggtgttaattttagaacaaatgagattaaagcagttatttcatcagggttgcaaaacataaagattaaaaaatgatttattcaaatggaaagttgcaataaatgagagggttctgtagaatatagtatttcagagttttcatgcttcaatgaaaatgagggaagaggctatttcttagaaacttaggaaagagtagtaacggggatagaatctgtgatatatacatcacataatcatagagctgcatgatccatagggatgaaaaaagaaagtagggatgtcagaagtcaggggatacatatagtactaaaagatgtatcaatttatttttcaaagttttgaggacgtggtggaaaattagccccagatataaaataaatccacttaaaatgagatgccaattaagacttttagtttacaagaactctagcctgagtttaagcaaaagggtttttatttgctgacgtaataatgaaaaagcccagagataatgctgatttcagttgtgaacgtgtatttaagtgtgctaatgatcttatcaaaagtttctctttccctttctctttctattctgttttccattggctccatcttcatacacactcttccctccgaagagcaagacggctgcagcatctccagtctcacagcctacaaagtttaagttgaaaaagaattgccatgaaattctgaaattcactctaattagatccatttggttgtaagccaaaccctcaaccaatcactgaggccagaggaataacaagtgtttattagctctagcctatatcacatgttccacacttgcaggaaatgatggcttgtcacccaaagcacagaaactgaaaatgaaagtcgcatagatactcccttctcctgaaaaaataattgaagctgttactggaagcatggtaattagaaggtggccagttaaaaagaaatgtccgttgcaaacagggagcaaaatttaagtataaagatgtaaatatatttgactgtattttatcttgaaaagtgaatctaatgtagatgactatatttcttagtttctaatttcaagaaagtgttaattcttagaataagcagttagcacgaatgcatttttgaccttgtatttctgacaaaactgtaggattatatgattgacattaaaggtaaaattaaaattaatatataaaataaaactcaaaattttcaagccatttggagcttgtcttgagctaatgaggtaaagctcatgtcctcaagaaaaatgttttactctgctgtttttaagggtgcttctatagaaagagtttgagaatcattaatatggattatagaaaattaataatgcttcatttaaaaataaatgtatttaatcctaaagattagctttacttaaaatgtttattgttgcagacaagaaatctatcttatttgaaaaatcagaaattggacatgtcagtgattataggtttttttttaaaatctgaacatgaaaaagttttccacagttttaagataatttaccatgctattcaagtcagcctaaaatcttaaaaagctgctacataataaggtagggattgaaaaaagaaatatttcagattcagagaattgtctttttttagtactaattaaaacattcaaaaaactatatttaatgatgtcattctaaattgactcaataatattaagtgaggaatttatgttccagcaaacagtggatgaatgtgtctatggagagcattgtttcaaaatgttttgacaaatatatccttgaagttcttgctattttattcagtttcagccactattctttttagttgattttttttgtcaatcttaaattttcaaaagaaagattgttttcaaattattttatatttaacaaataaagttatatgttattgattatttaaattgactgttaccacaaattttttttggatggatcatttggacaatatacctttgtgaagtgaataaaacacatttctacagaaacaattcagaagccattccctttccattcaaagtggtattcacctttcaactttacccagacctaggtggcagaaaagaatgcattttggaaaaaccaatagctgacttgtagtggggggccacatcttagaagtcttcagcatttacgtggatttgtaactcaatacatagaagccttcaaagctagagttttaattaaaaattgttactgaaaacttggtactttaatgtattaaaattgaccaattaaagaaaagtttattttttgcaatcagtaagtaatctatgatacgtaattttactatcctgatgtgaaacaagtagagtggatgatttgtacgcgtttggaacagaggcaaggaataagcatttaacagactccaatgccaaataaaaagcctctatatagatgttaaattctctttaataccagattcatattgtggttatgtagatacattaattatactcatatctataatgtatttgattgtgtttaattgtgtaataaatgatgcatatttcataaagttatgttgtttattaatctattattgtagtcttttacaaaatctagttgaaaaatctctcaggtatttagaaatatctggttggctaaatggagaggaaaagtagtatcaagaacaatttacaaccaacattttctgacagtttactatgtatctgactgtgttaaaccctataggtaccagtctcatggaatctttatcacaatttcctcatgtggctgttctccagcatcctcatatataatggtgctccctacataactatttctatttggacatgacacacattgcaagaattcaacttatttgtatttctagggaaatgctaagcaagttactatttaatagtactggagctggctggcttaggcctgcatcttgatcacaactgagtgagaatagatcttccactttgtatgtagaaataacctataagctcagtttccatgaataaatgaatgaaagaagcctataagctcaacttctatgaataaatgaatgaaagattcatgttaacatgctgaagtatatgggattgaaggctgggtcacacaacctacaactatttcagatgtaaatgaaggagatgaattaaatgaattaaatgaacatttatacaggtcttaaattcaggtttaaatttacagattgcactagggtgtcaaatcttggagtacaataaatactagaattgtattttacactgcaaaaatatatccagtgtttactattagttggactattgttgtaaacctcagaaaggcaatatcgtgggattacagatgtgattacgtctgaatttctgatattcttagtgtattggttggtggcatatgtatgtaaggggaatggtattgttgactggtataagtgctatgatgcaaataagtatttcttttcaaaatgacatcagtagaataagcactttctttaggataatgaaattccagcatagttgtcataatgactcaaatataaaaacaataaggagccaaatatggttattaacaataggccattatggtttatcaaatcatgaatttataatttttaatgatacattacactctgctaaagttgctgaagttggtcttcacaagttatacttcatttggttcatcaggacacagttccaatgctattccaatatcacttttagcacttttttgtctcataaatgcaatcaatagaaatatgcctaatgtagatattaatctttataggtgcctacttacattaattaggttatttgtttggctgttctgacagtgatctaaaataactgtcaaaaaaaaaaaaaaaggccaaagtgttggggagaatctgccctataaaataatcaagcttcgtatttcttatcttgctactctgctgggctgagggattgcccccatttgcatggtgcaagatggcattgtagcacactcacacaaaagggaagttaaacacgtcctttccacctccctcttttagtccacgtcttagaatcatggccactccttgctgcaatggaagctaggaaatgtagtctttactctgtacctctaggaacctctatgaaaaagtatatattccatgactctaagacaggacagtatggctaatgggaagcaactagtagcctttgtcacaatgtcaaggatttttattgattgccgaaagaggcaggatagtatttaaagattttatgttgttgttaaagaatatcttaaaatctcaaagcattattaccagaaagggcaatggaccttgaatttgatgttgaccttcataaaaatgtagtcactgtccgtagaccaagaaatcaaagaaattgagagtatgttaaataatacaaacacacacacatatatgcacgtacacatatacacactcatatatatgtgtgcatatatatgtgtgtgtgtatagatatacacactgtctttttattcattataaattctgttttcattggcaattagcacttgtgatgaaacatccaacattgtttttcaggatttatgatttctttttcatcttattaatatgttctttaaagtatttaaagattttatgttgttgttaaagaatatcttaaaatctcaaagcattattacaagaaagggcaatggaccttgaatttgatgttgaccttcataaaaatgtagtcactgtccgtagaccaagaaatcaaagaaattgattgaaatatggttgaactagtttacagtcccaccaacagtgtaaaagtgttcctatttctccacatcctctccagcacctgttgtttcctgactttttaatgatccccattctaactggtgtgagatggtatctcaatgtggttttgatttccatttctctgatggccagtgatgctgagctttttttcatgtggcagactactatcttttatcaaataaggaaagattttttttcaaagagttttaaaaataaatgttgctaggaaatattactgtttgaaacaaatttaaaagtttattgtaaccagtatttatttaacaaatgtgtattgattgcctaatactactcttctgttccaggtattggactatagcaagaaaaaaaatggcctcatggaggttatattctagaggaattagatagataataaacacacacacacacatacatgtgtctgtatgtgtatatgtaaaacatagattagtaaaatagatctgtatatacatgcataaacacacatgtatacacacaggaatgctctgctaaagcatgaatgcatatatactatgttaaaaaaaaacagggtaaaaggagaaccaagtttctgggtggaagagtaaagacctttgtgataaagtgatatctgagaagaaacctgatgaaaatgtagatattttgaatcaagtggcatatttggtgagattctgaagaatcaatactagtttctatagtctacagtgttttgaccatactgattactgtctgttgaatctacagttcattagatctgagagtttaatagtgattagtagtaaaagattagtgtctaatcatagaatatatgtttatgaagtaatagtgtttgataactttaaactgcatagaaagccttctgggcattttataatattttaatatatagttagtgactcaggacattaaatgtttcctgagatataatttttataactattgttagataactaaatatttgaaccagaaataacatggttgccaagacaggtttattattaccactctctacaacataagacaatttagtcatttattgtttttataaagcttaggaatggtctctgtcctcaacggggtgacttaaaaaataagtgcagtaaagcattgctacaataacaatagaaggctgtacagggcacaatgtagacacaaatgtgggggaatgtaattctgtctgggagaggtgatcagagaccttttggctgacttttgacctcatcaaggagcttgcataaatggcgaatgaaattgattaagccatgaaagaacataaagcccttaacttcagcatgctttgctatatgttctggagtttcattttgatgtgctactttggggaaatcccaccccccaaaatatgtatgtatttgttactgtcttttcaactgaaaccaaatataacaatttcagttagtatctcaaacatctactctggctaatttcctcttaatcaagcctttaaaactatcttgcaagatataaatgttttgctttatactaggtttttgtgcaagtaaataaactgaaaaaaaatcactattttaatcattaacatgttcccttaaaattaagacattatgctgtttgtagaatttactttttcttcaactgaacatcatttaaccatataccttctcctgcaatatttcttattattagttgccagaaatattttcttaatgaaaaaggttagcatgggttgtcttgatacaaatcataactaaagaaaaatattgaaattacatattaatattttctttggaaataacttgcttttgtgaatgaaattaaacatttttatgatctttaagtaacaataaaatgcagcacttaaaaagttatatatggatgtaacatttctttatattgcttactctattattattaactcattaaattttccacacagataaattaaaacaatagttattattatacataaacatgtttcaaaattaactgtgatttataagatcatttactttgaaatccaatatgcaaatatttattaataatgaaatttgaagactcttaaataggttattgagatattctgaatatacttgacatgagttagtaattaaattttttcttcaatattaaatcaatatcaaattaaaatctttagctcacagttttggtcattaaaaagtatttaagctgtgtactgtctaatgaacacacacattgtttcaggacgaaatacgtgacctcaattattgttaataagtatcagtttctttgatatatttcaagtaccactagaaatacttataaatattatctttaattacagacaattcatgtctctttaacctggggtcagtaaaatttaagttcattttacatgagtgatgtttaaaacagctagtgacaagaaccctcatcattaccatgtaaattgatgatgggacattgaagagagtctcagttttcttcttaaattttcactaatacttttcctttaccaaaatctataccttgactgctttcttttccttcctccttccctcccttcttccctatcttccttgctttcctccctccctccctcctaccctcccttcattttctttcctccttcccttcctcattcccacctggcctccctttctactgactcatgttacattctctattttttgtcattttgaggctctggacatataaaaataaacgttttttaaaagatcattagacattttactattcaatattcaataaataacaaatatttattgagcacagctctgtacaagacgctgtgaaaagtactgagaatagagcaagaaacaagatcaacaggagccctagcaataaagacagtctttaaataaataataaaagtaaagtaacatcttacaatatgagaagtgcagagagctaagggaaaataaagcaaagatgcgtaagctaatacagacatccaagtaaagtaccttgtggaagttatgtttaaactgaaacgtgaaaaagatgaatccagaatgttcggggaagtgaacaacatatgaaaatatggaatgaagagagagcattgtccattgaataaataagataatttttctgttgctttttaacactccttgaagattaaatggtatatttttgtgtttgctccatcaagagaagaaaagactcacaagtttataaccacatccacccaagggattcagtaggcattcttgtatgcttaacaacatcctgacctctaatgaataacttggtctttgtgtttctgaaatgcaattagcctcctctgccttcaaggcgctgaaaagcgaggaaaatgttctttggagatggggtttttgtagagtaaaaaggcacagcaggttaaggccaaatctcactctcaaggccttggccagtatagagatatttgtttatttttcaaaaaatatgtattgaatacaattacaacaatatagagaaggccttgccctcttggaactgaaattctaatagtaaaacagtgtaaggggccagaagggctggggattagcaggtaactttggcagattgaaaggcactctgaaagactctagctcctgtttcaggaagccacctgcacaggtatatctatctggtcacaatgataccccatgaggcaagaaatattggtaacaaaggccatagtagacagccagactctgtcctgtttcacaagagatacgagaagtacctctactttactctgcatataccttgagagattgctgaattatttttgatttggtatatgttttgtacatgaatctctggaatcaactatttgggcattatttatatcctatcttagacattgtagtactcacctttaagttccaaacaattaattgcttgtaagaaattctggtcattcagctgtctctgtccagaaaggaaaattaggtaactgcatggatgcttacttgaaagatataagatggaccatggaaaggatgctctaaataaaggaaacaacgttatgtaaagcatggtggcataatgagtattaggaatgtaaatagtttgatatatcattggatagaagaaggtgagacagcattgactattaattatgagagaaggaacaattaagagtttcctttaaaatattttaacttttattttatgttcaggtgtacatgtgcaggtttgtaaacttgtgactcgtggacttggtgtacgaattatttcatcacccaggcattaagcataattaagcatagtacccaacagttgcttttcttttctttttttttggaacatctccatcctcctaacttcctctctgaagtaggccccattgtctgttgttcccctctttctgtccatgtgttttcgttatttagctcccacttttaagtgagaacacatggtatttggttttctcttcctgcgttactttgctaaggataatggcctccagttccatacatgttcttgtaaatgacatgatctcattctgctttatggcttcagagtattccatggtgtatatgtaccacattttctttatccagtctactaatgatgggcatttaggttgatgacatgtctttgctactgtgaatagtgctgcggtgaacatacatgtgcatgtggcttcatgggagaacaatttctattcctttgggtatatacccagtagtggtattgctgggtcaaatggtagttctgcttttaattctttgaagaattgccacactgctttccccaatggttgaactaatttccactcccaccagcagtgcataagtgttcctttttctctgaagtttgctaacatctgatatttttgactttttaataacagccgttctgactggtgcgagatggtatgtcattgtggttttgatttgcatttttctaatgatcagtgatgttgtttgtatttccatatgcttgttgaccacatgtatgtcttctttttaaaagtgtctgttcatgtcctctgttcactatttaatggggttgtgtgttttttgcttatacatttgtctaagtttcttgcagattctgggtattagaccttggtcagatatagagttcacaacaaatattttctccaattctgtaggttgcctgtttactctgttaatagtttattttgctgtgcagaagcgctttaattaggccccatttgtcaattttgcttttgttgacgattgcttttgatggttttgtcatgaaatctttgccagttcctatgtccaaaatggtatttcctagattatcttccagggtttttatacttctaggttttacatttaggtttttaatctatcctgagttgatttttgtatttggtgtaaggaagtggtcctattttactcttctacatatgatagccagttttctgagcaccacttatcgaatagggagtcttttccctattgcttgcttttgctagttttgtcaaacatcagatggttgtaggtatgtggctttatttttgggctctccattttgttccattcatctgcgtgcctgtttttgtactagtaccatgctgtttcggttactgtagtatagtttgaaatcaggtaatgtgattcctccagctttgttctttttgctaaggcgttccttagctattcaggctcttttttgttctgtatgaattttagaatagatttcttctagttctgtgaagaatggtagtttgataggcatagcattaaatctataaattgctttgggcagtatgaccattttaatgatattgattcttcctatcaatgagcatggaatgtttttccatttgtttgtgtcatctctgatttctttgagcagtgtcttgtaattgttattgtagatatttttccccttcctagtttgctgtattcctaggtattttattctttttgtggcaattgtaatggagttgcatttctcatttggctcttgccttgggtgctgttagtgtataggaatgctactaatttttgtacattaattttgtatcccaaaaccttgttgaagttgtttatcagctcacggatctttttggcagagactatggggttttctaaacatagaatcatgtcatctgcaaacagtgacagtttgactttctttatttctctttgggtgccttttatttctttcatttgcctgattgctctggccaggacttccaatactacattgattaggagtggtgagagtgggcatccttgtcttgtgccagttttcaaggggattctttcagcctttttctattcagtatgatgttggctgtgggtttttcatagatggctcttattattttgaggtatgttccttcagtgcctagtttattgaagacttttaacatgaaggtatgttgaattttattgaaagcctttcctgcatttattgagataattatgtggtttttgtctttaattctgtttatgcgatgaatcacatttattgatttgcatatattgaacccaccttgcatcccagggataaagcctacttgatcatggtggattagctttttgatgtgcagctggatttggttttctgatactttgtcaaggatattcgcatctacgttaatcaagaatattagcctgaagttttctttctttgttgtgtctctcccataacttcgtatcaggatgatgctggcctcgtagaatgaattggggaggagtcaatttcagagctcattattggtctgttcatggattcattttttttccccaattcagtctagggaggatgtatgcttccaagcaaaatatttatatagatgtgtatgtgtacaaatacacatacctacatacatatactctatattctgcctactgagaatgattagaaacagcgtgcctcagtgcaatgagcatacctaccacccagatcttagcttctaaattctattctctactaaaataaacaagggcttactgaggaaatgggctactctagggctagggtagggaaagtacgagatgaatctggaatatcttattatgtcaccaagtgaagatgtgctcaaaggatgatgaagacatatcagatgacctaaaaacctgcttgaaaagattcccacttgccaaatacggaatacattgtgcacctaaacaaatgctatttataacattataaattatatatcttcaatgggttatagtgttatatgtaaagtcctgttattatattatatataacattatttatatatataacattataacccattgaagatatgggaaaccatgaatctatgctgctatcagtaaataaaggaataaattaaaagtttgatgggggatgtcatatttacatagctttaaagtatctcccaataaaatacttattaattggacaattaataaaaaaagagttacagtactatgaagaagttaattaaatgatcaaactgacacaattggaagtgagacaaatcaaaattacctgactggatgcaggtgacagtacactgtgatttttttttttaatactccttccaaataagcataatatgaatacaataaaacataattcaaacccaaataaagggacattttacaaaataatttcaaaatcttcaaaaatgttaaggatataaaattcaagtaaaaactgaggatctactgtagattgaagaagataaaagacaaatgacaattatatgcactacaatttcctcagctgaatccatttgctgtaaagaacattatttagacagtctgtataacttgaagaggtctgaggattaggtgatagtaatgccgatgtcacataagaagttgttaatattgatgattttattgtagttacataggataatgtcttttttctgcattagaaatacacactaagtattcgggtgtgatcgggcatcaggttgacaacttattctaaaatggtttaggaaaaatattattcttagtattggacttgaagattttatgtaagtttaagtttgtttcaaaatgaataaaaaacaaattatattgggaaatgattcatgattttgctcaagtgattaaatgatctcccttatgtttgcaaacgaacacggtggctgatatgtagacaaggtactcggagtgaagatagagaatgggcaaaggtaaaaaaccaagagacaaattgagatgccatagcaataattcagaggaagatgatggtggcttgaactagggatataacggagcaagtggtgagaatctgttggatttgagttatattttgaaatgataacccacaatacttgctggatgtcgagtgtgtaggaaagacagtgtttggcttgggatgactttaagctttgagaaaggttcttagacctagaggcattgattaatatagttgtctttaacttgtacattttcctcttctggtattactgctttcatcttaatggcatgataatactgcaaaagtgttctgaaaataatctaaattattgagaaataaactattcatgagttataggactatgtcttttataaaaaccttgacaattttattacagtttacattctgtcagtacgcatgtgggaagcaacatagcatagtggttggagtaagtactatggtattagaaatgactttagctttagcttgggcaatgataattttggacaagttactttctcaatatcctcatataaaatgagggataataatatctacttcatagaattgtgaaaggattaatttaaaacaaagtgattagcactgagctaaatattgttgtagtcactattatcagtagtaaatagtgatagaaaaaacattgtgtgatacctccaaagatctctaacaaactcttaaagaaattattagtttaaaaaaatttgtggaagagaaatggaagaaatatataaaatgccaccaaggattaccattgaaatttgtggcagtggctaacaggtttttcaaatttcatcagttatgcacatttgacatagtttgcttgcattcaaaacatgaaaaaacagtaaaaatttttaatacctccttggtctgggaacattgccttaaattatgaccgtgtttctaaaattttagataaaagcatttggtacagtattcacctcagagaggtgagtgttcttgttgcttagaacagaacatactttttcaatgccttccttcctaatccaactttatattccctatttagtatgcctaatcattattctagggctcgtttgaaaacagttgttcttaattgtaaaattgagctgtgctccattaagctcctgccgagctgcttttgagatccttggtggtttggaatgtggagatgcatccacattctccccttgccagtccttttcatctttcctctctaatgccatccctcagtgtttcagctgctaagtggttctagcgtatgtctgatataattttctggtgactgatgcactgttctcactactgatatgtcagcaggaatgccacctgtgtctgggaattcaaaaccatcaggacagtgtattttaatggagcaagagggaaaaatgtagaattaaatggaaagaagcattccagttctaacttctaatatttaattttggagaaactgtgagggtaaaagaaaaagtgaatgttacatgagcttttaaattaacccacaaagaaactgaagtattttttatgaaatttttattccttttttaaataatttaaacttctattttagatgcaggaggtacatgtgcaggtttgttacatgggtatattgaatgatgctgaggtttggggatatgaatgatcccataacacaggtagtaagcatagtacccaataggtagtttttcagcccttgcccacctccttctctccctactcttatagcccccagtgtctattgttgctatctttatgtccatgtgtattcaatatttagctcccacttataagtgagaacacgtggtagtttgttttctgtttctgtgttaattttcttactataatggcctccagttgcatccatgttattgcaaatgacatgatttcattcttttttatggctacatagtattacatggcatatacgcaccacttttttaaatctaatccactgtttatgggcaccttggttgattccatgtctttgaatggaactggagatcattacgtcaagtgaatttttttttaatgtaatgtctcaacttttgatatggatgtttgtacatttatttattcactatttgtgaatatctaactttgttttgttctagggacttgtctgggtactgggaaaaacagagatgtagtgctgctttcacagaacctagagtctactttggagcatacaattttaccaaaataggtctcccagcttcaagtctacaaagttgttttatggtgatatagtaaaaaaaagttaatggtaacatccattcatgtaaacattccaaatgaactctttgctaaataatgaagaatgcttgtcctctggctaaataatgaagtatgtttgtcctctgtaaagtagacattgcactttaagtggcaggcttctagaagtccacaaggcttttgtggggaggagaatggacaaatttgatttaaggatcaactttcaactgcaaaatcaaagaagtataaaaattgtagaatgaatttacaacttggatttacaaaattaatttgacaataaagtcattgtagcaatagacacgggatcctttaataaagtcaagaaactcaagtttctaaacctgatgttgagcttcacccctattccctatatcactggtgggttggtatgtcatgttttctccaccctctggaccacgacattgttgtggattcttccatggaaaagccctaactgttattactgtgcttgttatgttgtctcatgcaacaacattcctatatttatggaaatgccagacaagttttgtctgtttgggttataaataaaacctttcctctacttagagaactagaccttatatgtgggttgaataggggtcttttctctggaattagaaaagagaacataaatttcactcctgtgccttttgcctccctcctgtcaccaaaaagattgccagagttattaaagaagagcaggtaacaaggcaagagtcagtgagaaaccacacttgaatttcttcttattcaaattattctatctgcctaaccaatgtatgaaacaatagttatctccagttcgataatctttactccacagagattaaagtgcccacataaatatgtaggtatttaatgaactcacaatttgtttttgtaataggttactttttgagatataattttaaaaaccctagacgaacaccctatatgtgatcacttaatttcagtaccttttgcccataaagagaccatcaaccaattattgtgattccttccctactttattattctctaacatattagtctgttatattatcttgatattcccgaatgctacttaaaattcttttatttctctacctattcatagttcatatttccttctctactttcactagactagaaactacttgtgagcagactctatttttcttgttcatgttgaaacaactctggttaaaacagagcttggaaaatagcatatttactattctgaatgagtaaaaaagtcagtctccataaatggaacaagattatctgttctagaagtaatcgtttttaaaagaaaatgagacatttcttcacctaccacttgctataacaagggcttattggaaagactatttatatatcaaaagtaattgtttttaaaattgttaattaaatttcagatgtcatgtcaattaaatccttttacttgaaatttcatgaattgagatattcagttaactggaactccatatgtataatatgatggaaatttaaattcacaatggaaatattgagaaattacaagactctgaaatatcttcttgtctacagaaaatgaatattgatttaataaagttttagaagttaagggatctattgttttttctttaattatcaacaacccatttatatataaagggtatccagtgtactttaattagaatatttaactaattagtagatgccatttattatgataaaatatacctttgtacctatatatggtgagccttgataaacattaccgattttctaaagttattgttattcagacacttaagagtaagactactttgaaagaaataatgatagctgataaatagtgtttgtatttttatttttccttgaaaaagtccagtggaattgataaagtacatatgcctttaaaaaagatactatacatatttattaatgtattagggttctctagagggacagaactaataggatagatgtatatataaaggggagtttattaaggagcattgactcacatgatcacaaggtgaggtcccacaatagtctgtctgcaagctaaagagcaagatagccagtctgagtcccatagctgaagaacttggagtcccatgttcaagggtaggaagcaaccagcacaggagagagatggaggccagcagactaagccagcctaatctttccatgttctactgcctgctttattctagctgtgctggcagctgattagatggtgccacgcagatttgagggtgggtctgcctttcacagtccactgacccaaatgttaatttcctttggcaacatcctcaaagacacacccaggaacaatactttgcatccttcaatccaatcaaattgacactcaatatcaaccatcatattaagtacattaattctgaagaacccaatgatgatctatgctattattaaaatccaatgataagtaaaaaacaggatttttgtgtgtgtgccttgaggatctgcaaagtggccaaactccctgaggacttgaaaactgcttaattttcccaccaccaaaatttcaaatatgagttcatctgttttgatcctctccctcttgtaacaaaagcggtctgtgttctgaatctcatacactttgtccttctcaaaacttttgcttattgggttaccaacctttatttgacatctcacctcattcccagattttctgcttgaatatttcaaacaagatgtcaacactgagcttcccaactgatgtaatttgtcagacctgcagctggtcaagaagaacctcccatacctgcctcctccaggcctgcctctgggagctggctctcttgtcagtttatcacagtgcgcataaaatgttaatcactttcttatgagtaacatgatgcattaagtagggaaacactgactttatagcatttttttgtttgtttgagacagagtctcgctctgtcgcccagtctggagtgcagtggcacgatctcggctcactgcaagctctgcctcctgggttcacgccattctcctgcctcagcctcccgaatagctgggactacaggtgcgtgccaccacacccggctaatttttttgtgtttttagtagagacggggtttcaccgtgttagccaggatggtctccatctcctgacttcgtgatccacccatctcggcctcccaaagtgctgggattacaggcgtgagccactgcgccaggcctatagcatcttattgttatttttttatgtttaagagactttcccttagcagtctttcttacacataggatacatactttcctatattattttaccctgttacattttcatagtactttttatacttcgtaactaaatctttacatgttaatttatgttaatttacccacttgtccattttaccaatgagtgaaaggggcaaataaaactgatacgcttggatttcatcttattatcttcttgctattgtttggaacacaaacaatattgatatgagaaagggagggagaaggaaattgattaagccaagatttagggggtattgtgtccggaattggtgggttcttggtctcactgacttcaagaatgaagccgcggaccctcgcggtgagtgttacagctcttaaggtggcgcgtcgcgagtctgtcccttctgatgttcagatgtgttcgtagtttcttccttctggtgggttcgtggtctcgctggctcaggagtgaagctgcagaccttcacggtgagtgttacagctcttaaaagcagcgtggacccaaagagtaagcagtagcaagagggaaagaacaaagcttccacagtgtggaaagggacccgagcgggttgccaatgctggctcaggcagcctgctttcattctcttatctggccccacccacatcctgctgattggtagagcccagtggcctgttttgtcagggcgctgattggtgcgtttacaatccctgagctagatacaaaggttctccacctccccatcagattagttagatgcagagtctcaacacacaggttctccaaggccccaccagagcagctagatacagagtgtggattggtgcattcacaaaccttgagctaaacacagggtgctgattgttgtgtttacaaaccttgagctagatacagagtgccgattggtgtatttacaatccctgagctagacataaaggttctccaaggccccaccagagcagctagatacagagtgtcgattggtgcactcacaaaccttgagttaaacacagggtgctgattggcatatttacaaaccctgagctagatacagagtgccgattggtgtatttacaatccctgagctagacataaaggttctccacatcctcaccagagcagctagatacagagtgtccattggtgcactcacaaaccttgagctaaacacagggtgctgattggtgtatttacaatccctgaactagatataaagactctccactccccaccagactcaggagcccagctggcttcacctagtggatcccgcaccggggctgcaggtggagctgcctgccagtcctgcgctgtgagctcgcattcctcagcccttgggtggtcgatgggactgggcgccgtggagcagggggtggtgcttgtcggggaggctccggccgcacaggagcccatggagtgggtgggaggctcaggcatggagggctgcaggtcccgagccctgccccgtgggaaggcagctaaggcccagcgagaaatcgagcacagcacggtgggccggcactgctgggggactcagtacacccttggcagccactggcccgggtgctaagtcccccattgcccggggccagaagggttggctggctgctccgagagcggggcccaccaagcccacacccacccggaactccagctggcccgcaagggccgcacgcagccccggttcctgctcgtgcctctccctccacacctccctgcaagctgagggagtgggctccagccttggccagcccagaaaggggctcccacagtgcagtgggggcactgaagggctcctcaaatgccgccaaagtgggagcccaggcaggggaggtgccgagagcaagtgagggctctgacgactgccagcatgctgtcacctctcagtatgactaaaagttgatgaaactgatttttatagaagcttactatttagaacttaatgatacataacactagtgtactttgaggaaatttcattgaattgttgggcacaactgttgttcttgtatacttagcactttcccctttgttgtgaagacagagcccttctcttgctttaggacactatactttgcatcgatccttcacccacagtaagaatatcgataatattgccttgcttatattaccataagtgaccaacactggcctatctgtttatcacctactcctggaaactgtgattgattcagaactaacaggtataccaaccagggtgattagaatcctattcttggtaattgacgtaatgtcaacactaaatacgatacaaacctaaagcaactgtggccattttgctaccacaaagagaacacctgattaagtattaaacatacacagagaaagacaaaagacagaacatggagggagaaagagttccaataatctcctccccacacatagattcaggcaagcctaaatattcctgaatttttcagtagtataaatatttttggtttaagctaatttgaattgatgggctgtaatacaaagtttcttaaatttattctaatcattcctcaaaaacacatctcaaaattcattttcaaatataattgttataaaagccagtatgtgtccaatctcacagatgatttttacactggccaattttctttgggcaaataaaagtgaatagtcaatatttacagtttggcttttttttttttttttttttttttaaaacagtctctctctgtcaccccagctggagtgcagtggtgcaatctcggctcactgcaacttctgcctcctgggatcaaatgattctcctgcctcagcctctcaaatagctgggtctgcagtcgcctgccaccacacctggctatttttgtagagatggggtttcaccatgttggccaggctggtctcgaactcctgacctcaagtgatctgaccaccttggcctcccagagttctgggattacaggcataagccaccatgcccagcccagtttgaatttaaattgtaacatttatgtatttaagcttttggtagaaggaagttaggaagagattcacaagaactttctctgagctacattcacttagggcaaaagattcctgttggtaacatgatatttttatcaggattactgcttctaaaatagtacaatatatttataaaaattatggagaatatatatttttaccaacctaaatccattaattttaatcacaaacctatgattgttaggattagtatctgtctctcatatctgtcttaaagaaacaaatttatatagatagaaatttctatgtagagtatttcccatactttcatttgaccagtgtttttagaacctctcttaaaatgtaaatttactcaaaacgtcatatataaatcagttaaacctagagttcttctagttcaagtgagaatgggagatccacagtttatcccttttgaccacttccctcccgagtcacttttgggaagagcatagggtttaatgaaactgttgaactatactgggcatgttaaaacgtaggccaaaggtagcaagtgacagatagattattattgtacacaggtagtgtatttttatccccatcacattgcttgttaactactgtctttttaaatgtcataaattgagaagaagtttttgttttgttattctagtaagaattgcccctggaaatgtatgctcgtttcttgcatgctgctgtgctcgttgaaaaggtggcaatgacctgacagatgggacaaggaatttattttgcctgaacaatcatatagttaatggaacatttaaaaattgactttttatgattatgtgattaacaggaataattcctttaaatacactgtttgctaagagctagaatacaatgaaggtttggaatagctgtcttctgtgtcaaaaagagtgacaattcagaaacagctgaaataagtgatatgggttaaagggaattggtacatggaattttctttgtgtaagtagtttactgttcagtgagcaatttactagttcaacaacggtagcagtgtctttctctttttttatttttggcctacttcacataaccctgcaagcagttgtgctgagggatgtgctgaaaatagatttgccaaaagagtaggttttaggtacacttactgaaaaaaaaggaaagaaaagaaggaaaatttaaaaagataactatatgagatgatacatatgttaatttgcttgactgtagtaagcacttcactatatatacatatatatcaaaatatcatgttttacaccttaaatacatacaatttaaaaaacaaaatgtgaaaaagtcatatgtacggaaaatgtaggataaatggtgtagttgaaaaattaactgacgtattcaatacagatatattaatttagttaaataaactaaaatctctagggattaagctacctttatgataatttagaatcctaaaattctgtgagataaaaatatataacattttggaaggatggcctcatgttattttacatagcatcatatataacctttcaaactcatatcagtctttagtaattaccttaccagtagttcttatttatatttgtcttgtattttttctatcataacatagttgttttcctctaacatctcactatccacaaaatgcagtcaatttatttgattatgtgtaagaaataagtaaatgctattttactataaatatgatttctttaaataagttatcatgaatttccttattgaaaacagtctaatcctctgtttggctgtgcatagttagtaactcagattttcctgtatttctattattatagtacatagatagtattgatcaagatacacatttattaaagagtgttataatattaagagctttaaaaggttatgcacattttctgagaaaaattaatatttgtgtattttcaatggaatgaataacccataggcatggattggaaaataaaaaatatgcttatctgttaataaaattataataacttcatcaggtcaaacacatatagttcgaactgatctttaaagtaattactcccttttaataggtatttcagtcataagtttaaaattgaggttaaaagatgttcaggttcactgccaagcattgtgggtatagagatgagcaagttgtacacagtcccggcactcatatatatgctctaatgctggaaacagtccattaataaatagctagagtccagtgtgataaggttatgctcagaaaaatggggtatactatggataattacttataagagcaaattatggcaaaaacatattgtccgaaagggaaattgttaaataaataaattataatgaataattgtgttttactataactgaatattctgaatctattaaatatattctctaatgcatgttctatgaagaaaatatgcacaataatgttgttacaaagaaaaggaggaaaaatacattaattctgtgttatctccatcacatatacacatatataaagagagagagagaaaatgtgggggagggaaagtgtggctgctactgtgaactgattttcagggctgaatgaagaagcacggattatgctctgcaagacaagcagaaggaggcagcatatgcaggaaggtgagcacagccgagagaggcgtattccagactgaaacaaagtctgagagtgtagtaggcatccaacagccataatcgccacccttgagttctgtaaaacctctttgaatcttaaaatgccccccttttacttagctcaatttattttctataatttgtagccaaaagagctttaagtaagagaggtaaaaatgttcaataaatacaagattagaaattagtattctataagaacttatctattcctcatactataccttttggtgcctgagaattgtgtgcagatgagcttgcttaacgatctcaaataagcttcccattataatatttatgctttcccaggtaaggcctccctttctatattcaactttaaagccaaattactgggtttttttagtatctaagatggctgaagtaataggtgttaggggaaactgccttgcattgcagaaccattcattgagcactgctgtccaacaaaattgtatgtgataatggaaatattcattctgtgctgtccagtatgatagccattagacatcagtgactattgggcactggaaatgtagttagtacaactgggaaactgactttaaatgttaattaattttaatgaatataaaataaatagccacatgtggctggtggctactatatcagagagcaaagccttagagtgtacctatgaaaaatagagatattatcaatgttatcttggtgtaaaaaaatcacaactatctcttattttcttatggacactggatatcttcctgatttataagatattagttgacatcactaactgaatctttaaaataatgtttttttcttattttattgaatactcaaaaaaatggaaaacttaaaaaaattcaaattatgccttcagtctcaaatcttatgagttttgctaaacaaaacaaaatgaaagaaaaagcaagcaaacaggaaagaaaatgtaaaaatatatcaaggagcaggcaatagatagtgagttcgtattatttccttagagaaatattatttgtttagaaatcaaataaattttgaagacatgtctgaaaagtgcattgtagacaatacactatcatcgtcaaaacacataaacatgtagacactttgagccaatgtatctacagaaaaaaaaacatgtaggcaatctttttggtctctagaagtcggtttaaaaggtacataagtataataaagaattaataattttagcatatgataggaagaaatcagtaagtgcttaaaaatgagtaagtgctgtaataattccaaagggggaaaaatcactctggcacagatggcctcagaatacataactgaaatttaggtagggcccagataatttgcaaggtgaaaaaatagtttttaggagggaaaacatagctgaggatgggtagtgagaaggtatataggtctatacaagggcaaatggtgggaagatttgagaaggaagattggagacacataatggatttattgaggatgtccaaagagtttggatttcattattaataaaataggataaatctgactgagttatagagaaaatccttaagaaactcataatatagacaccaatcacgtctgcatctgttaaatgagcaaccacagatgtattggctaattcaatctatcattttctggaacgcactttgtctatgcaatgaagttcatcctttcaaaaatgaaatatttattgagtataaaaattaatagtaaggtacctttttataactaaaagattatttccaaacaatattcatatttggaaggaaggcttaaattcaggcacttcagaagttgctcaaagtggctttttttttttttggcagaaatagtgcggtgactgagctgttcttgaaaatattaataactcccgcgcttaatgtgagaggaaaagcaaaccaaaaccttacttggcttagaaagcaaattcgctaaagcatgcaagttagcattgctgcaaatccactcgcatcggtctacctttatctactgtgctgcttacatatatttaacgaaatggtaatttatacaaaagtatgcagcactttaacaagaagaaagaaaacaaaattgtaagtaaactgtgggaggcaaagagatgaggtccttgtttaatgttcattctttaagtctgtgactaaaagcaaaaacgaaaacatttttccatattcttcttagatttgtccaatgtctttgtgtgacaatggaaatattttatatctgcacttttcgtatgtgctattagtcatatgtggttactgagcacttgaaatatgactacgtgactaactgaaattttaattttattgtttgaattaaatttaataaggcaggttatttaatcttatctatatggacagctaattcatatcacataggacaaaaatatcaataattaggaaacctaaagggtcaagtgtaagttttgaacattacattccaaatatacactaacatctccctttataaatgtgtccagcctatgctaaaataatttgggcattaaacatgagaatatttcctttccaaattcctatcatttcttctcattgttactattttttttaaccatgaataaattccttgtgagagactacagtgagaaaacaaatttaacaatagatttgatgttgactcacagggattaagaatgaaaaaatgtgtattaggtaaatgttagaagaggcaatattaaatatctgcaaatttatccattgaattccaatttaacaagatgctacccctgaaaatactttttatatcaaatcaatattttaaacatatataaaatttcataattttatttataaaaatagcaatgttttagaatttcttatcacagtaaggtagaattcttgaaataaaatgttactgtgatagagttttacctggaaacaagaaatatgatatatatatgtgtgtgtgtatatatgtatataattatatataatatatataatatataattgtatacagttatatacatgtataattatatacatatacatgtatataattatatacattttatatatgtaatatatatgtatatatattatatatgtaatatatatgtatatatattatatatgtaatatatatgtatatatattatatatgtaatatatatgatataatatatatattcatatatattatatatatgaaaatatacagtatttcttaaatttaagactgcaaattataaactcaggtgtaattatgatggatagatacctacatattttttccataggaataaaaggacaggtaatatattcctggatgtgaaaagagtaaacagattattcaattttaaaaatatttttgatgtagattaaaaccttttaactaaatattgttaagaacccacaaaggaaggcagaatttgtgtattctgtttctctatgccattgacctgctgcatgttttgttgccataaccttaattttcagtctctcatgtattcatgcacaacctttatcctcagagtttggtttaaatcctgattttgatggtttcaatctgtgcgacattgggtaaattgtcttacattgcatactcagaaaaaacctttaaaaggggttagaatgggttaggagcagaggtgattcttatggtagaatctgagtaactaaacctgagctcagactgctattgcaagcatgccacaaaagggaggtaacatatggtctgaataagggaagtagaaataatttgtaagttgacagacaaaaacattagcagaattaaattcctttttttaaaattatactttaagttttagggtacatgtacacaatgtgcaggttagttacatatgtatacaagtgcgatgttggtgtgctgcacccattaactcgtcatttaacattaggtatatctcctaagcagaattaaattcctaaaattaatgactcagagaaaaggactaaaagaagacaatgaaagatatattaaagaagtggtcaaggaaaaatgcaaggcagcaaatgatggtgattcagaaagagatttgataaaacatatggaaaggtagatcagttaatttggaagaatatatttattggtgtttattacatttgaatttctaagatacttatttgtgcaacacagctatgataaatcattggaatttgcaagaaaaataagagtttgaaaatctgaaaatgagtaacagagaaagttttatgctaatgatttaaatgaaaagttatcttcttaaatacaaatagggcagaattttatagcgtttaatatatctttatgggggcatgtgaagtgaatggataaatctaaagacatttggattggactctggaaagtgtctctttaatggaatcgtatatgctaaataattttgtagtgattaaagatgtgggtgtactttgaagtaagacgcttaaatattatttcagcacttacgtattatgaaacttcaagtaaaattctatgcatttgtctctttctctttttcttagggtggggttgttggataaacttgtacatttcatttgcacaatggagtttgctctttaaatacaggaaatcattgtgtggtccaatggtttagagcattatatactttcagttgagattatttcagtttgaatatcacttcaatagttactagccatgtgagtttaagtaaatatatcacagtctcagttgcatcatctgtaaaatggtcataaattatcataatatttagagttaaaggattatgaggattacatgaattgatccacatctattagcacagtgcctgacataactgcacactcaaaagctgttctctatcattattacgtaatatatagctagttacccaatagtttatctttgtattattagttagctatgtcattgcataagaaaccttgacttattaatgaactgcttcctacaatttaattttagttagttatctaaaacatataatgcattaatgctagttttatataatagttcataaatattcttataccataaaggagttgaaaaatagctacaacttaaaacaacagacaatatttagttaaaaaaaaaggaaaccagcaaataaaggagatcagcaagcataaaatagagtacaaaaatgacactcagtgatttctcttggctggaatctacacattgactcatagaaaccgtcaagagcattctaattttaataacattataatgtgtgtgtgtgtttgtgtgtgtgtatgtgtatgaagacaaaactattttgcaatgatatttagcaaagaaacagtgtttattttaatttttttttagattcatggggtacatgtactggtttttttttttacccaagtatattgcataatgctggggtttgggtatctagtgaaaccatcacccaaatattgaacatagtatacaataagatagtttttcaattcttttcccctccctcccttccccttttggagtccacagtgtccattgtttccatcttcatgtccacgtgtacccatttaggtctcacttatatgtgaaaacaggaaaggcattacataacatttaaattatgaattaccaaatagggtccatgaaattttgtgtttggttctttaagttgaaattttgtcagttttgagaaaaaatatctcaattgcctctgtgtcaaaaagtgcaggctgtttgtaagtgaagaaaaagaaataaaaagagaatttgtagattcatcctctatttggtttttattttttgcatgtaaatattgagccagtcagaattctcctctcagcatgcagttctgtgactttattttatttcattgctttaaccactcttgtacttgaccacatttactcacctaccaagggaaattttctgcttcttctcccattattaaagaaatcctagattgagtgaggaaaggaacagaaaatattttgagaagaccgacaattgtcatgatttgagtaaacatatgtatcctgctactcggtttcttaaagtacaattttgaatataataattattcagtgttcttgaaaactaacaaacacatttttctaaagaagtacgtatctagtttttagaagcagacacctgtttctttggtgaagaaaacatattttcaagattgtttataaggaagcacatacacataaatactaaaaaatttaaatataattttcaatttcttgcataagttataccaacattaaattttacagaaatgcagaatgagattagttacatatatcaatctgaaaataaacaaaaaaattttaaagaaatatactcttattttaaatatattctattagtgttatatttccagcataaaacacatatataatccattaaacagcagaaagaataagatcattttgaaatttaaatttaaagaagtattttgatcttaatctatttcatgaaattaaagcctggactataaacacttttgtattgtttgatttctgattacagatggaataaatggaatctgccaccttcacctcatagcaaaaaaataagaacaagaaaaaatatttacaaatatgtataaaatatagtctgtgtgtatcaatgaaccagaacatacgaggaaggctgagaaatgccttgatagttacacagggttctggggatagcattcagctggccccaggatactgatcacagataaaactaccagagcacagttatataatatatgttacatatcttgtaacggaaagacaacaatcctttatttgtaacatcagtaatctgagcaagatagctttgggagcattctataaccagtttggcaacagcaagctgtagagcgggccaatgataaatcacattgaatcatcatttgtgtggccaatgcaaggagtctgcagtatgagcagcatgcagctgccaatttgtgatgaacgaggaaaggtaaaggttaaaagaacacattcgcacacaaaaccttgtgttttacaggcaacttcaaaataaattaggaagatgggctgctaatgggcaatatgactctaacctgagacctctatcaaaaaaaccccaaaaaacaaaaacctgcaaaaaaaaaaaaaaggtactcaagtgaagaaacataagtatattacttctagatatgttttgaattaaaaaaaaaacagagtactctttggggaatttgcggagaattctccagtcatctgagggataaaaaattatgttagtcttaaacttctcccaatgacattaaattctagaactcagaggattaattcttgcaaagtttaaaaaatttgatttctcattctactgtaaagacacatgcacatgtatgtttattgcggcactattcacaatagcaaagactcagaaccaacccaaatgcccatcaatgatagactagataaagaaaatgtggcacatatacaccatggaatactatgcacctgtaaaaaagaatgagttcatttcctgtgcagggacatggatgaagctggaagcctcattctcagcaaactaacacaggaacaggaaaccaaacaccgcatgttctcactcattagtgggagttaaacaatgagaacgcatggacacaggcaggggaacatcacatactggggcttgtcgggggttgaggggaaaagggagggagagcattagacaaaatacctaatgcacacagggctcaaagcctagatgattggttgacaggcgcagcaaaccaccatggcatatgtatacctatgtaacaaatttgcccattctgcacatgaatcccagaacttaaagttaaaaaaaattaatttcttttgtaccccaccaaatattcattcgagtactaaagcaacagataagagtttttgaacattaaaaattcaaggaattatttgctatgagatgaaacaaaagtcctccaaaataaactttagccacaaactttagccataaacttttctatatatagaaaaactataccacataaccgaataaatggcacaaaagttgaatccatttaactgtagagtaaggattacaacaattatgtaattataaaatactcataaatacacagatacttcagtgaaaaaattataccactagcaagagtttggaaagaaagggacgaggaaagttggaggcagctccttcctttacaatcaaaataaataactgcatagataaaatataagggttgattgagtttgcttatagatgtaaggtcgacactaacaaaactatatgctcaactaaaaacaagtgtatgatgaggtagaccagaataggatagttggaaataaatgaacactaattagagatttttaattgctcattgtagagatttttaaaattactttttaagaaatagaagtcataatatatacatgatttgtgcctatctatttctgtgtcatgggtgtggaggaaaaaaaacacacaaaacaaaggaaagcaagcacagcccattaggtaaaagataatacaatatttttatattattcaaaatttaaaatatagatttaagatcaaatttcgaatattaaatgaataaaatccttaatcagaagacaatgaatcacaagttaaaacacaattataactctttaaaatatacaaaataatgatcaaatgaccaaaaattatacttaaagtcattaggtttcgaataaaacacataaacaatgaaattttaccacaaatccatcagattggcagaaattcaaaagaattttagaataatgttagtaatataatattaatatgtctgttagggtacaaagaaaataaaacactcacatattcctagtaagaatataaggtgttttagcctttttggaaaaattctggcaatatcttataaaataaagatttgatttagctaccatattaatgagaatccttatcaaaattaaaaacacatattcataaatatatacgcacgacggtattcattgtggcattaatcacaatggcatacataaaataaggggaaacaaagtgaatggtcgttgaaagggatatagttgaataaaagatggcttagctccacaatggaatataattaacagtattttaaaaattaattcatagatatgtccattgactcaaggtcatgagatattttgtgggaaaattaaaagataaaaaatgtgagtataggataattccatttgtaaaacaatggtcaaaaatgaaacacctacacacacatacacatatgttttttcatatacatatgaaacacagagaggtgtggtgggggaattaacatgtttgagtaatatggaagaaaatccattatacgtataggttgttcacacagatgacttaagagtagagaaggtgttgtagatgaaatttattgtgaggaaaagatagatgacaggaaattcaattaaaaagaaaaaagataaagactcctctttcaaagacattttgcatgatacatcatttatgaattcatgtaaagttatatatggatagttatatatataaagttacgtatatttatgaattcatgtaaaagacatatgtatctgtatttaacattaaaatcacaataatatccaggtatcaaagtcataccaagcagatacaaacgaaaaagaaggcaggacttctagttcaatatacttcagtaggagaccatgatggtactgaactggactttatgcaggtaaaatccaaatcaatattcacaaatgtaaataaatgcatcctaagttgagggactgttgaatttagagcaaaaacatttgggactttacaaatagatctaaatatatcagaaattgccaacttcacatgcaattaaaacaaatgacaaaaatatggagagaaatagcactttagttcaggttagcaaaaactaaaaagttttataatttactattttggcaaggatatagaacacactataaaagcttaaattgctacaacttatacagagggcaagtaaataatatttttcaaaattaaaaatgcccctgccattcaattcagcaattacatttctaggactttatacttcaggaattgtttcacacctgtgaaataatgtatatataagaatattcagtgttgtgtttatctacaatagcgaaagcttaaaaacaatctcaatatccactgacaggggactttttcaacaaattgtgtttatatctatacagtagaattccctgagttgttagaacaaatcagatgactcatatatattgatgtgaaactatccataagatatattaaggggaaaagatacagcatagtgtatataatatactatcatttggatagaaagtaaacaaacggaaatacaactatgcctataataactagttgctcagaatatgaaacgtttgtggctggagaacaggaataggaaagaaacatatttttcatggtatgtaaatttataactgttgaattttatatcacatatatacaatgtataaattatataatctgtatttatattgaattacttagaacccaaataaaatacttgtataaagacaaaattttaatgttaaaattaaaatgtatctctgtgtgtattccaatatttggatatatctgagcacttgtccttttaagaaaggattgcttttaaagtggaattttatttggtgttagaaaattgaggtaaaactctattaccgatatggggaaaaaattaagatgcagaagggaaggcagggttttgtgctgtgtgaaaatgtagacatatacatgggtagatatgtataaaagcttcaagaagggtactcaagaaagtattaacaatggcaatctctggggagtggaactcttagctacttaggattgaggggattggagagatcatttactggttactttatatgcttctctgtttggagttttaaaaaatgggccttattttatgaaagagaaagagagaaagagaggaagggaggaagggaaaggggcaataaatgatcctgctccaaaacaatgagaaagcactcttctccaagcgactagagttctgaaagagattaattttgtactcacttattgattaaactctctcagtagtctttgttaaagaaaaaaatcattttattttaataaaaatgtgccatagagataacacctttggaaagtgaagtgaaagtgaaagacctaatgagataataatttgcagatacgtaccttcactacaggacatctccttggaattcaagaagagtcactgagtgtgaattttatttaagttattgaatagaacacactcctccagtctctcaggcacaaaacctaatgcctaatttaaaagataagtttctgtaaaatgctgattaggtcattaacaagataaaccattaaattgctactaaggtttttctgtttgcttactttcccttttactaatttgaaacatccaacaatattgtcttacacaaaggttgataatttgaacttcagctttttattcaagtagtaaaataaaaatctatcctacaaactaaacaaaggaaaaattagaaaatatatctctgctcacaacagatggtctatttagtatataaattcagtttaatgaccagcatgcatcatttaaagtacatgttaaggatttttttttaaccttcctttatagatgtgacatttggcaactacaaacgaataaaaaatataagtcttcaacaacagtgtataatttagtaaagcaattactaatatattcaaaataaaccatgtcaattacctgcattttgggtttatcatttacttctgtcaggcatttagtgaactcttctagaaatgcaaatatagtatgttttctcacttatgttactaaaaaagtatttcccaacagtagacaaaaagtattaagattagaagcattatataagaagataatagaatgaaaatctaaacaaaaatggaaaacaccttgaatttttgattgcgtaaaatccatttgtcagaagagccctcagagtttcaactttgcattagttttccagtcaggtctccttgttcgcttcagtctcatctttcttcttccattagctttgataaacaagcattgtaaacctttaaaattcaatcttgccattcaacatttactctgattctaatgtaattctttgaagatactcatcaatttgctttttttccccttcttattccaccatggctctaatagatgtttcaattaaaataaatcctggggtctgagcagatagctcaattagaggttaactaacaaaaccgaacaattttaaccccagaggaaagattgtagaatgacctaaaagccagaaatatttatattttgcagaatgcaggatagaatttatcttgttagaaagcataaactaaatttgaataccataaaataatatgtgggatatgagactatacagttttgtaggtataacttgcactttttgccatttatagtccagatggaaatttgagaatttatagcaagaaaatgaaaatatttattgtagtgacatttcactttgagtaaatctaatctttcttctactattctttcttcaaatttgtgaaagctttaaataatttctccctggggttcttcctttataaatctacatgttcccatttctttgactatgcagttgtcatggtttctagactttttagcacacatctttagaaactcacgttatcattgcctcttgttaaattatggaacatggaattcaacaatcatttgtggtatgattagtttcatcaaagcagtctattcctttgagaggcaatatagcctagaggttaagagtgccaactctccagtcaggctttgaatcttggttccgtcctatctagttgtgccttattaatgtgcaaaatgaaaaaaacaaagaacacccttgtgattcaacataagtcaagcacttagaacaatatatagtacagagaaagcactatataaattcttattttcctcttttgtctgagatattgtattcctaaaatctaggttaacataatgttacttgtttccccctattggaagagaggtatacatagcaaattcatatggattcatgagacacttgtaataaggaaggtaaaattgttagtatagttttatgtaagttactggcaaaccaagtatcctttcttcaactgtatacaggagttcttgaaaatacactaaagttatattttttaatgcactcagaagaaatagaaaaccttcaatttatattcacttagagtgcctgaggcatttttactctagcctaaatttgataattatgcatttttgaatttttataaaattgtggacaaagtaaattttattttgtttgttcttatttgtctagcaccattctatcttcatgatatattagatttaaattgggacaaaaatcaacgtatctttttatagtttaaaatcaagttttatgttctgtacttatccaaaatagggcagcctcatttttttttaaataggagacaggccttgtgtaggagctacgtaaggtcaattagaagtaatcaggccaattagaaggcgttcttttgaattctgtgtgaatgtgtgttcatttgatgactaggtaatatttaactatagaaaataaatataattatgttttccctaagtatagaatgatcagaaatattagaaaagagattctttcaggtgctgctggattaaaaaataactgaattatatggtgagtgaatcataattactattaataggatgattacttctgttgccatgacagcaattatcagctttaactgagttagacacattttgattggcattattaaaccaaggatcaaaacaatcaaaatgggttaaattttttattaaaatcatatttagaggtgttgagaattgatgcaagtactcttcaagtaatgcacacgtctcttacaaatatcacttagaattagcacatttcatactaatttctactttgtccaaatggctaattgtcatctatcccagcctcattgtacatataaaaaaatactttcagccgggcgcagtggctcacgcctgtaatcccagcactttgggaggccgaggcaggtggatcatgaggtcaagagatcaagaccatcctggccaacatggtgaaaccccgtctctactaaaaatacaaaaattagctgggtgtggcggccacttgtagtctcagctactcgggaggctgaggcaaaagaatcgcttgaacccgggaggtggaggttgcagtgagccgagatcacaccactgcactccagcctgggtgacagagcaagactccgtctcagaaacaaaacaaaaagaaaaaaaaattggtaactttgtgggtaaatgttagcctatgcagtgttctataattttgaggtcaaggaaatggaatactgtatttaaaattttatttcatacctaataaatggtggctccttaatatctatttgtatgatcaatgcataaataaaatattaagacatactctctaattttctagtttccaagaaacaaagcatagacaaatacttaaatttaaaaagcttatatatggttcttatttcagaggcaagataaaaactgatatagaagttcaaagaataggagaaggcttctaactcagtagacattgggaaggttttgtgaaagcagtggatagaagctagattgaaatccagtgttgtgtttaaataaaggagtgaatactccagataatcagctgtaccttttcaatgtcactgacatgagcaagaccagacatattaggcccaattttgtaggatattgaatgtggagttaaagatttttaactttattctggaatatttttatttggacctaaacatactattcaatctttgtaaagttatcactgaatctgttttaaattcaaggtttttactttctttgtaggttatatgcccattatatttatacaatcaatcatcttttttcattgcaataaaatcaatgaatattatatgtccattctttctttcctgactatttttatacctgtcaattcttgtgcatgaactaatttatttatatttcaacataaattagatgttttttagagtttaagaaagatacttagacatctgttataatcagtgaaagaagggttactgatttattacttatttatctcaaaaaaacaaaaacttgagaatgcattaccaaagataaaatttgcctttatatatatatataaagtttatatatattgtcatatatataaacttggtttactcacccccatgcaagtcctgtcctgcagtcagaaattttgtcaaaatcaggcaaaaagagcctaattttttaacttctttttctctcaaaattatttcaacctctaaaaatatgtagcatgtaatatctcactgatatctactttatttcacttaactcattcgtctctattcttatttggggttttgaaggtagagactaagatagaacaaatttatttgtcagtaaaggtatttgaaggttcagggcaaactctagattggggagagagagagagacagagactgacagaggagagagaaagagagcacaagtgccaagggaaatgtagaaagaaattttaagtggttcactgtaaagtgtgaaataaaaatggtctctttcttctctccctagaatctttagtaaattcgagtttgctgagcagtgcttgtctgtgagtgaatttatttgagagcactaaaagtattccaaaaggaaccaactaacatttgagtggattttaatatgatcaaaaattctcttttgaatttatattatgtgtcaggaagcctctggggatagagagtccattaaaatgagcagtgtgctcttttgcatagtgggataggcagagtttaaagatgacccccaatgacccattctttatatcattccgctcttctttagtgtcaacaggatttcactcccttgattgggttactaatcagttgactttgacgttatcaaaagagacataattctgggtggatcttacccaatcagaagaacgtttaaaagagatgaagcacttcctaaaagagattcaaagcataaaaaggtccatggaggaaccacatagtaagtgcctgagagtggcatgtcagagctaagagcagttctgggacaatagatagagaagaaatggggacctcagtcatgtcgctgcaaaaaaaaatgaattttcccaaagacatgaggatgtaaatgcacttggctgatattttgatttcagctgtgtgaaaaccttagcagagaacccaatatactatagccagactcttgatctatggaaactgtgagataataacttttttattttataagcctctaaaatggtggtagtttgttcacagaaataaaaatctaacacaaggagtccactgccttctcttagtgtctttgtttatctgtgttgttactcttattattattattattttaatttaaggtcatcaatgaagataatccaattggttggccagtaattatccagtattgagtacccattagtggatctctgcagccatgccatttcaaaagctggtgatctatagttaggtagaccagaaaattcataaaaacggtttgcatttactcagtattactaagtgttagatactattttaagcatttttttttttttgagacggagtctcgcatggtcacccaggctagagtgcagtggcaggacctcagctcaccgcaacctctgcctccagagttcaagcaattctcctgcctcagcctcccaagtagctgggactacaggtgcccaccaccgtgcctggctaatttttttgtatttttagtagagacaggttttcaccactttagccaggatggtctcgatcttctgaccacgtgatcccccccacctcagcctcccaaagtgctggtattacaagcgtgagccactgcgcccggcctattttaagcatttgtaatgcattaattcatctaatcatcacaaccattataatcaacttcatcttatggatgggataactcaagtataaggaagttaaataatttcccctagatcacacagctagtaagcaacaaaactagggttcgaatatctaggcagtctcattttagaatgtgcgaatttaactacatactgcctcttctgacagaccgttgacgactattacctgtgaaggtcccagccacatttgcacatgtcatattgtgaagtcatagcttccttagttttctgataagttgcagaggttgcaatgtgggagattttcttgctacttaagaaatactttgtaaatctcacaatgattaagaagtctgagaagctctgacagctctcagcaaaattttagaaatccaggtgaaaaatcagtgtttttgaaaatgtatgtttatattacagatgactataaaaaattgcaaatccttaaattatgaatgaccaatatctaaaatttcacatcaacaagaagaaatatattaaacattcagatggattggctttttacaagattttcaatatttggaatttttgtcataagtaaaatctaatgttaatacgtatgtgattcatggtagttcctattttagaactttctaacctgtcattatgagatatttttatctgtcttgctcccatgcttttctgtgcatgtcactgactaaaataatttacataagaaaaaattcaatttgtaaagaaaggacacattcagagaataatttttattaatattatcttcatgataacatatcaatttgtttataaataaagccgtgtggcctcattactgacttagagaatacttggcaggtactcatttttgtctctcttggctaatggttaatgcagtgcacctgttttagaacactgaaatctctactcataaaatacattttttttttttttttttgagacagagtcttgctctgtcgcccaggctggagtgcagtggcacgatcttggctcactgcaagctccgcctcccaggttcacgccattctcttgcctcagcctcccgagtagctgggactacatacgccagccaccacgcccggctaatttttctgtatttttaatagagacggggtttccctgtgttagccaggatggtctcgatcttctgaccacgtgatcccccccacctcagcctcccaaagtgctggtattacaagcgtgagccactgcgcccggcctattttaagcatttgtaatgcattaattcatctaatcatcacaaccattataatcaacttcatcttatggatgggataactcaagtataaggaagttaaataatttcccctagatcacacagctagtaagcaacaaaactagggttcgaatatctaggcagtctcattttagaatgtgcgaatttaactacatactgcctcttctgacagaccgttgacgactattacctgtgaaggtcccagccacatttgcacatgtcatattgtgaagtcatagcttccttagttttctgataagttgcagaggttgcaatgtgggagattttcttgctacttaagaaatactttgtaaatctcacaatgattaagaagtctgagaagctctgacagctctcagcaaaattttagaaatccaggtgaaaaatcagtgtttttgaaaatgtatgtttatattacagatgactataaaaaattgcaaatccttaaattatgaatgaccaatatctaaaatttcacatcaacaagaagaaatatattaaacattcagatggattggctttttacaagattttcaatatttggaatttttgtcataagtaaaatctaatgttaatacgtatgtgattcatggtagttcctattttagaactttctaacctgtcattatgagatatttttatctgtcttgctcccatgcttttctgtgcatgtcactgactaaaataatttacataagaaaaaattcaatttgtaaagaaaggacacattcagagaataatttttattaatattatcttcatgataacatatcaatttgtttataaataaagccgtgtggcctcattactgacttagagaatacttggcaggtactcatttttgtctctcttggctaatggttaatgcagtgcacctgttttagaacactgaaatctctactcataaaatacattttttttttttttttgagacggagtcttgctctgtcgcccaggctggagtgcagtggcacgatcttggctcactgcaagctccgcctcccaggttcacgccattctcttgcctcagcctcccgagtagctgggactacatacgccagccaccacgcccggctaatttttctgtatttttaatagagacggggtttccctgtgttagccaggatggtctcgatctcctgacctcttgatccacccgcctcagcctcccaaagtgctgggattacagacatgaggcaccgtgcctggccagccataaaatactttttatatattttggtataattactattataactatacatgtgttttcatatccatttaatatccataatctgtcaccacattttacttttaaaattttatttacacattaatgttccatttacattttgtaaaataagatgcaaattaactaaagtattataccaaaatgaattgcagctctagcatgtgttagatattgtgctaaggaggggatatatggtaataaaaatgcttaatccataacaccatgcatattttaacttaaaaaccctaatatctctatatatttttgtttctgcatatattacacacacaactgtgtgcgtatatatatatatttatgtgcatatatatgtatgcaattttacattttggtaaatgacaaaagaaaaacaacaaagttaatgaaagatagtaagaggaaaacctctttaaactaaagggtagaaggttaggggagatctttaagcagaggtaaaaatttaacatgaaaccagatatttggaaaaaaaaaggaaatgtgtttgagaaagaagatatggaatgtgccaagattctgaggtgggaaactcctggagcctagtaaagtggacggtgtgattggaagggagtaatgaacaaggcagagaataccaggaaatagacatggagaggtaggaaatcccattcatggagaatgcactgtacctgttgtagtacaggttttagaggctttattttcattattgtagaaaagcaaacactaaaatgactcaagtttctcttctatctaataattaccttcatctgagtttacttctaaaattgtgttatagtgttctgcacagaccttacatctttcataaaaattatctcaaaatggattataagtataaatgtaaaatgcagaactttaaaaattctgcaagaaaacatatgagaaaatatacatgaccttaaatttgttgatgagttttagatacaataccaaaaaccttattcatgaaagaaaaatcttgacaagttggacttcattgaaattaaaaatatctactctgcaaaataaagttaaataataaaaatattagccatggactgggataaaatattcataaaatacatacttgaaaagcacttatatccaaactacataaaagaactcttaaaactcaagaaaacaacccagttgaaaaatggacaaaagatctaaaggttgggggtcaaagcaagacggtggaatagaagcctacgttgtttgtccctgccactggaacaccaaattttataaattctctgcacacagagaagctctaccacaagaataaaaaatcagataaccaatcacagtacctgattttaacttcatatggctaaaagaggcagtgaagagggtcagagacagtcttgaattcccagtgcctctcccctctcccagtggtagccatgtagcatggagagagaatctgtgtactttggagagggagactgtggtgaccagaggactttacattgaactcagtgctgccctgtcacagtggaaaataaagccaagctgggcttagccagtgcccgcacctggagggagcatttcaaccagccctaaccagaggggaatttcccactccagcattcagaacttgagtttgttggcaagcctcaccactttgggctgaagtgctctgtgttcctagattaacttgaaaggcagtctagcacgcaagaactgcaatttctaggcaacttgtagtgctagtctgggattagagccagtggactggggtagcactgacctagggagacaccagctgctggcacagctaagggagtgcttgtgccatccatccatcaactccaggcagtccagctcacagcaatgaaagtgactcattccttctgattaaggagaggaggtcaaagagtaaagaggactttgtcttatgtgttagataccagctcagcggtagtaggacggggcactgggtagaatagggaggcccccattccaaaccctagctcccagatgacatttctagacattccctgggtcaaaagcaacctctgctttgaagggaagaacccattctctccaggattcatcatatactgactaaagagcccttggtccctgaataaccagcagtaatacccacggagtatgtggtgggcctttgcctctgagacatgctggcttcaagggtgacctagcacgttcccacctgtgggcactatggtgaaagactccttctgtttaagaaaagcagagggaaaagtaaagaggactttgtcttgaaccttatgtaccagcttggctatagtagggtagagcaataagcaagctcttggggtccctaagtccaggcctaggctcttagaaagcatttcctgaccttccctgggctacaggagagtccactgccctgaagggtgagtcccagacatggctgcattcaccgcaaactgatagaagagtccttgagttttaaatgaacatttgtggtggcctggcagaacccccatggagtggttttggtgatggccccaaagagaggctcctatgcctgtggaaaggggaaggaaaagtgggaaggacttcgtattgtagtgtaagtgccagcttagccactgtagtctagaacatcaggtatactgttaaggttacagactctaagccctggttcacagacagcatctctggacatgctccaagcctgggggaacttactaccttgaagggaagggccttgggcagcacccagtgctgtgttggcttcaggtctgacccagcacagtcccagtagtggtggtcacaggggtgcttgcatcaccacatccccaggtccaggtgtctaagtgcagagagagaaagtctctgcttatttgggagaaagtcagagaaaagaacaaaagtctctgcctggtaatccagagaattattctggatcttatccatgtccaccaaggtggtacctctacaagtctgcaaaattcacagcattatagggcttggtacccaagtcccttcaactcctggaaagccttcccaaggagggcaagcccagaatgtgaagatgataataaatatctaactcttcaatgcccagataccaatgaacatctacaagtatcagcatcatccaggaaaatatggcctcacaaaaagaattaaataaggcaccaaggaccaatgctggagaaacagagataaatgacctttaagacagataattcaaaatggctgttttgaggaaactcaaggaaattcaagataacacagagaaaatttcagtatcctatcagataaatttaacaaggagattgaaataatttaaaagaatcaagcataaattttggagttgaaaaatgcaattggcatactgaagaatgcattagagtctcttaatagcagaaatgatcaagcagaagaaagaattcgtgagctttgaccacaggccatttggaaatacatggtcagaggaggcaaaagaaaaaagaatagaaaacaataaagcacacctgcaagatctggaaaatagcctcaaacaggcaaatgtaagagtaattggttttaaagaggaggtagagaaagatatagtggtataaagcttgttcaaagggataataacagagaacttttgaaacctagaaaaagatatcaacattcaagtgtaagaagattataaaacacaaagcaggtttaactcgaagaagactacctctaggcattgaataatcaaactcccaaaggtcaaggataaagaaatgatactaaaaacagcaagagaaaataaacaaataacgtacaatgaaactccaaaacatctaatagcagacttttagtggaaaccttacaggccaggagagagtgatatgacatgttaaaattgctgaaggaaaaaactgttaccctagaatgatacaaccaatggaaatatactcaagaagaaagagaaataaaggtcttcccaagacaaacaaaaacttagggatttcatcaacaggagacctgtcctacaataaatgctaaagggagtatttcaatctgaaagaaaactatatatacacgtgtatatatatatattttgtttgtttgtttgagatggagtttcgctcttgttgcccaggctggagtgcaatggcatgatctcagctcactgtaacctctgcctcccaggttcaaacgattctcctgcctcagcctcctgagtagctgggattacaggcatgtgccacgacgtccggttagttttgtatttttagtagagatggggtttcttcatgttggtcaggctggtctggaactcccaacctcaggtgatccacccacctcggcctcccaaagtgttgggattacaggtgtgagccaccatgcctggccagaaaatgatattaatgagcaagaagaaatcatctgaaggtacaaaactaattggtagtagtaagcacatagaaaagcactggaccagtggtgtgtaggctattcttacctgaagtagaaaaactaactgaataataaatcaaaaataaccacaacaacatttcaagacataaacagtacaattaaaatataaagagagaaaacagaaagttaaaaagcagggtgacaaagttaaagtgtagattttcaattagttttctttttgcatgtctgtttgtatacagaatcagtgttgtcatcagtttaaaataatgggttataaggaggtatttgcaagcctcattttagcctcaaattgagaaacgtacaacagatacacaaaaaattaaaaagcgagaaattaaagcatatcacctgagaaaataatcttcactgaagggaagacaggacggaaggaaggaaagacaggcaagaagactggagattcctcaaaaaaactaaaaagtgagctaccatatgatccagcaatcccaatgctgggtatatacccaaaagaaaggaaatcagtatatcaaacagatatctgcactcctatgtttgttgcagcactgtttacaatagctaagatctggaagcaacctaagtgtccatcaacaacaaatgaatggataaagaaaatgtggtacatatacaaaatggagtagcattccatgatgcggttattacatattgcatgtctatattaaaatatctcatgtaccccattagtatatacaactactgtgtactcagaaaatttaaaaaaaggcatctcatacacacatacacacatacacacacacacacacacacacacacacacggatagcaagtaagcatatgaagagactcaacaatatttgcattagggccatacaaattcaacaataattacatatctctcagcacctattagaatggctaaagtccaaaacctgatagtacaatagctgacaagaatatagagtttaaaaatactggaattggcccggtgcagtggctcacacctgtaatcccagcactttgggaggccgaggcgggtggatcacgaggtcaggagatcaagactatcctggctaacacggtgaaaccctgtctctattaaaaatacaaaaatattagccgggtgtggtggtgggcgcctgtagtcccagctactcaggaggctgaggcaggagaatggcatgaacccgggaggcggagcttgcagtgagccgagattgtgccactgcactccagcctgggcgacagagcaagactccgtctcaaaaaaaaaaaaaaagcctggaattaaagaattaagtagatggttggttaatgatggaagccaggattgaaatgataggccagggatgatcctggaacaatccaggtatttacagattagagttaggacagcactatgaatttatgtttagctaagtgggttattagacacacatatatttcctcggtctctcaactgagaggacctagaggcaatgacacactaacaagcacactagagctcaggtcttggtttttaatattattctccaatgaaaggaaccagggccgggcatggtggctcatgcctgtaatcccggcactttgggaggttgaggccagtgatcacttgaggccaggagttcgagatcagcatggccaacatggcgaaaccctgtctctactgaaaatataaaaaattagccgggtgtggtggtgcgtgtctgcagtcccagctacttgggagctgagacaggagaatcactcaaacctggcagttggaggttgcagtgagttgagatcacacaactgtgctccagcctaggcgacagagtgagactctgtctcaaaaaaaacaacaacagaaaacaaaacaataacaacaaaaaacacgaaccgggactccttggataaatgtctgattctaagacttaggcaggaagtatacaagataatcttggagcattatgtgttatagtgccagaaactaagggcgtgttctgagagacaacagcaagaaaaaagaaaagaaaacaaaacaacacacatattgtagtaagtcaaaaaggcaactgaaagagctccagtgttcaatgctagaacaatttaaacaacaagataaacaaaatagtattggattataatccaaagtataagataaatacccacatatgcactcatatataaaggaataaacaaataaatgaggcaaatctcagcataaaattgcaactaatttatttaggtatttatccctcaaggagatacaacataatccctacaccttaggtttaagtataagctgcacacagggattttctcctagagtgtggcaagaggagaaaaactaactttatagcagagaaactggaaaaacactacctcagtcaggtgagcaatgtcaacataaacaacgttgagtcatgttgatagtgtgaatccttggataagattggcacttcacctcgatggtttttctcagaaaaactcataacttcagaatctaatcttataaaaacatcatataaatcccaagtaagctacaatctgcaaaatacctcaacagtacccctcaaaactatcaaagtcattcaaaaacaaggattgtctgagaaactgtcacagcttaagaggaccttaggagacatgatggtcaaatgtaatgtggtatcctggatgggtttctgaaacagaaaaaggatattaggtaaaaactaagaaaaatatgaaaaaagatatcgactttagttaataatgtatcaatattaattattattacaaatgcactatacaaatataagatattattgtggatactggaactggtatgcatggggattctatactacctttacaattttttggtaactctattctaaaataaaaattattagaaaaaattaagtgcttaatgaaaatgaaaaggttccctgacattctctgtagaggtgggtacacactttgccatagagctctttatgatatcaattttctcttttgctcttgcttctgtctactctatagaattttaaaagctgggttgaatttaatcactgtataaatcacataaatcaagtagaaattattgctaaaatttttctgtgaatcagaaactattctaaaataaaacatctgaaaattcggggtgtagttttatattttttctaaaatttgaaggcttgatttggttcacattttaagccatttctatgtttttagttgtcacatgttttgaaagactgtgacagtactattattttaaccaagggggaggaaaaagtcctttttcttttcccaatagtttaagtttacttactaagaagggctacgagagatgtgactacaaaagaaaatacgttttcagtttaatcttagaaagtttcaagaacaaaagttggaggaaccctagagctctaggattcactttcgatgaccattcctagaaggttcacttttttggatcacctgactttcaatattgcctcactttctgtctctaaagggataacagctttattctacctcacacttatcactgttagcagaccaatcagcttattgtaggttttctgttctaggcctttacttaagttactccttaagtctagaaatctcttcttttctttaaaaatcagttttcatcttttccagaaagtcttttctgagtcctaaagtttgtttataatactttctgctgtcttggtagtttccatataaccaacattcattaagtaagaaaatatctattaagtttctcctgggtatcagatactcaatatgctgggcacctattcatggtttctcagctggaactgtcagctccttgagggcagagatcatttcctattaatcttaactccaagaacttggcaaattcttgacacatagtaagtgttctggggggaaagaaaagattgtagtcctgaataataaaaaaaaaaaacagctttctcagaatgcaagatgttcaaaactaaaatgtcgttcagggatttattcatttccatgatttcatgacatgtaattttctttaggactatgatttcccttaaactctttctgcttagaaatgtccttcaccggctcctgaaggacctttagatgaatttgacttatgtgatagaataagtggttgcccacacctttcacacatctgtgaactgatcaagaattcagattatttctatcatctgtccagatggcttgaaaaaaaaatgcaaatttctttcttattgttttaaatggattggatttctgtttcttaaaggcagtttacaacagatactactctgtgttttattatatggagcacttatttatgcaagtatgtgtgtgtatatgtatgtttattgctttacttagcagagctaaaaaagaacattaaataaaattaaaatgtagttaagatatgattttcctaacatttcctgtttaattttacagatattataattgtgagaggtagagaaatgactaggcaaataggtatatttcattcatttggattcccctaaatttagaattgtgttttaggcatgcatgcaaattaaaaaatatatatatatttgtattgtatagtgtggctttgtaaagtttctttcaatagatggcaaactaggcattacttgcatcctagatatttaaatgatgccttttttttggtagttctgttctcagagtatcttccaaagtgataaaattgaacttgaagaatttttttaaaaaacacaatgcaaacctatgttggtgagtggtattggaaattattaatattgcttttcttccaaaatctctagcaattctaaagtattgtgtttttaaaaaaacagaaggaaatatcaagtaaaccaccagcaggatactccaaaattccatttataactcagaaaatctaaataaaaatatataatatctcattaaaaattacgacaatagtgacatagagaatgaactgtgttgtgcataatgctgagcattttacacatagatttgctccttttactttcccaacaaacctctgaagtaggtatacccattgtcctcactatagagaggaagaacactgaaacaatgagaatctgtcaaaggtcactgtcgttgctcaggctgttataacaaataccatagactaggtagcttaaaacccagaaatttattttgtacagttttggaggctagaagtccaagatcagggtgccagcatggttgggttctagtgagggccttgctcctggcttgttgattgccactttcttgctgtatcttcacatggtggagagaaagatcatttcccttattatgcaggcactaattctattcatgaaggctctaccctcatgacctaattacctcccaaagtctccacctccaaataccaaaacactagggataaaggacttaatatttaaatttgtggggaggggacacaagtattcagtctatagtagtcacatagcagataatgagggcagaattcaatcctggaagtgctatacttcctcaagagataaagttaatcatgtagttatctggcatatatatatatgtaaaataatctgcatgtcctatgcctacacacatttgtgggttctcacataacagtttagtaatatttgaaattagtggttatgtccaattatctaatttaagcaagcatatttacgacataaaagtttctcaattacatttgttcatttaaatcaattaaaattatggaatattacatacgtatatagaatagggccatatgcacatatatgccacataataatatgttaaacataatggtcctattttcagttgtaattaatgagagtttttaatatagttggcgttgtcactcagcagttgccatcgaatctgtgtgagtaacagaagaggtatggttagggtagagagaatatttgaggaaagaatgggtgaaaatttctcaaatttgatgaaggacatgaatataaccatccaagaagctcaataaactacaagtaagaagaactcaaagacacatacacattataatcaaacttttcgaagacagacaaaatcttgaaagcatcaagagaaaagcaatttattacatatgtgggatcttcaataaaattatcaacagatttctcatcagaatctttgggagacagaggacagtgggccaatatattcaaagtgctgaaaggaaaaaaaaattgttgtcaacaaataattctatatctggcaaaactatccttcaaaagtgagggaggaaatttagacattcccagataaaaactgagggagtttcttatcactatacctacttactctgtgagaaatactcagtgaagtcctgcatagtaaaatagaaggacacaaaataataacttaaaaataagatgtgtgaaaaaataaagatttaaataaagataagtacatggacaatcataaaaagtggtattattgtaacaatggtttgtaactccacttttgtttgctacatgatttcagagactacatagattcagaaataccaatgtgaaaactaacattattgtaactttggtttgcagctccacgttttatttctacataagtttaatgactaatgcatttagaagaattattttttaatatgttggtcatgtaatgcataaagacacaattctgtgaccttgccaaccaaaatggatgtgaatgtagctgaaaagaagcagggtttgtgtatgttattgaagtttagctagaataaattcaaattagaatgatataactttaggacattaaatgtatacaaaaaaggaaatgagaaatttctttctcattttaaaaaaaatgtttcactaccaaaacccaactgaacacaaaggaagatagtaatgcaggaaatgagggacaagtaagcataaggcatatcaaaagatacaaatagtaaaatgacataaagaaatacctccttattagtaactatgttaagtgtaaatgaattaaacacctgaatcaaaggagagattggcagaatggactaaaaaaaaaaagagggtgatcgagctacagttgacccttgaacagcatgggcttgaactgcatgggttcacttacatgcagattttcttctacctctgccacttctgagacagcaagaccaactgttcctctttctcctcctgctcagcctactcaaaagtgaagacaatgaggataaagacctatatgatgatctactgccactcaaagagtggtaaatgttttctcttctttatgattttctgaataacgttttcttttctctggcttactttaagaatacattatataatttatataatatacaaaatatgtgttaatcaattgtctgtgctattggtaaactttcgtcaaaagtaagctattagttaagtgtgtggggagtcaagattcatatgcagattttcaactgtgtggggttcagcacccctataccctgcactgttcgtgggtaaaatgtatatgctatctataaaggaatcactttagaaccaaagacacaaatagatacttatgaaagtcaaaggattaaaaatatattctaaggatttagtacccaaaagggagcaggggtggctgctatactaatattagacaaaatagacttaacaataagatataaaaatttaaacaagatataacaattataagcatttatgcacatagtaactgtattagttcattgtttcattgctataaagaaatacacctcatggttcttcaggcctataggaagcatagcagcttctgcttctggggaggcctcaggaaacctccagtcatggcagaaggcaaagtgggagtgagacgtcacacatggtgcaagaaggagcaagagaggagtggggggaggtgctacacactttaaaataaccagatctcatgagaactcactatcacgaggacagtattaagggggacggtgctaaaccatttgtgagaaactgcccccatgatccaatcacctcccaccaggccccacctccaacattggggattgcaattcaacatgagatttggtcagggacacagattgaaactatatcagtaacagactatcaaaatatatgaaacaaaaacacagaatttaagggagaaataaatacttcagtactcttctctcaatcaaggatagaacaaccaaacagaagataagcagggaaatgttagaatcaacacaataaaccaaatagatctaacagacgtatacacagaagactttactcgacaacagcaaacacattcttctcaattgcacatgggatattttccaagatagactacaaatctatccttagaatacaaattaagtcaaattttggtgtatatatgtatacgatggaatattattcagatatatagagaaattctgatgtgcttcagcatggatcaatctagacaacatcatgctatgtgaaataagccaatcataaaatgacaagtactatctgattctacttatattagatacttggagtaaaattataaaggctggaaacagaatggtggttgtaagagactgaatgaaaagggaaaagagggagttgttcttcaatggctacaaatcttcagttttacaagattcattatggagttggatgggggcaatagttgtacaacattatgaatgtatttaatagcactgaactgcatactcaaaagtggtaaagatgctaaattttatgtcatgtgtaccttaacagtattttttttaattttgggggaaaacatagttaactttttgagctttctgcattttaaaatgttataggtaataattccaagaataatttaaaaatcatttctattttctaataatttcaatatttgactggaagtagcatattatagcatcgctagaacacagatacattactaagtaatgtaaaaacaatattttccttctttccctcagtctctggcaaccatcattctattatctctatgatttttactactgtgattacttcatataagtagaattttacagtatttgtcatttagtgaccagcctattcatatctgccttgttttaaagcaaacactgtcaagcagaaagataaaatagtctgtaatattaatgttgatgttaataagcattgtggaatattaatggtcatattgataagttctctgtaagcattctggcacatagaggtcaagggcatagtttctgggacagaatacctaggcttgatgacagcctttaccatttatttttctgagtcaatttcttcacctgaaaaaagaatataataaaaatatataactcacagacctcttataaccatagagtgtattaaaagtgcttacaataatgtctcacatgttagatctatatgtgtctaataaccttattactattattattgagggaatgtcacagttgatagtgagttttcaaaagtgcagtgtctaaccattagcattacagaatgataaactacttttagcattttaagagcaaatccatcacccttgtgggcagactcacaaaaactgagttcatgagactgaggtataaattcaggattctgatttattcaagttattagaacaatactacaccagagtgttgcaggaagtcagggacaccgaaaggagggacctgctgaagctgtgacagaagaacataaattgtgaagatttcatggacatttgttagttctccaaattaatacttttataatttcttatgcctgtctttactgcaatctctgaacataaattgtgaagatttcatggacatttatcacttccccaatcaatactcttatatttcctatgcctgtctttactttaatctcttaatcccattatcttcataaactgaggatgtatgtcacctcaggaccctgtgatgattgtgttaactgcacaaattgttcgtaaagcatgtgtgtttgaacaatatgagatctgggcaccttgaaaaaggaacaggataacagagatgttcagggaacaagggagataaccattaagtctgacttcctgggagcagtaacaagagtcatatttctcttattaccaaaaatgagtaagagaaatatcgctcaattctttccccagtaaggaatattaataattaacagccttgggaaaagaatgcattcctggttgggtgggggggccctctaaaatggccgctcttggagtgtctgccttatgcagttgcagatagggatgaaagaagccctggtctcctgcagggcccccagccttgctaggattaggaaattccagcctggcgaattctagtcagaccggttctctgctctcgaaccctgttaagatgtttatcaatgacaatgcatacacagtgggacatgaagcttcatcagcaattctagttttgccctggcctagtgaccttgtcctacccatttgccttgtgatattttattgcccttgaagcatgtgatctctgtgacccacaccctattcatacactccctcccctttgaaaatcgctaataaaaacttgctggttttgtggctcagggggcatcacagaacctgctgacatgtgatgtctcccaaggctttaaaatttctcccttttttagtctttccctttatttctcagaccggccgacacttagggaaatagaaaagaacctgtgctgaaatattaggggctggttcccctgataccagagaagcagttaaattattcaactttattgccatgtaggtggcacaaaaaaagccacattataataaaattggcatagcaagcatgttaattagtgaaataatcagttgtttcattttgatgttaagtaacattataatgaaaataaacctacaaggcaatattcttgaaacagaacctcttcttcttgggaagaaatcatatctttcctcatgtcatgcttcttgggttaaacaagctcccttctggctgacatattctttctttagttatgctaatagtatcgtcattcataacatactcctaaaagcctagaaattattctgtcactttatgaagacttgtcattatttttttatacattttaagagataaatcttgtttcactctttctaaattcatgtgtgggtagaaagcatcactgtcacccccaaatactaacagaatttaccttagatgaaatgaggagtggcattgttagtaaaaacatagaataagaaaatgtattagcatatgtttagatatgttacgttagaaaacaaacgatttctcattggcttttattttattctaataagttatatcacgtcccaaagtagtccactaacaaagtaaagttcacaagatacaatgaaatatttgttttatttttcaaaaagaaagttcagacagtaattaatcctaattttttttaatatcaagctaaactcaacatgaaaaaatacattttaatattcatggtttgacttgcgtactctgtttaaattatgtgtattcagtaaagttggaatacatacctacacacacacacacacacacacacacacacccatttctgtatatctagaaacatatcctaatgtaaaatgggcaactaactgtttattccaaagcgtttaaatggcttcttaaaattaaacaaaggaacaaaaattttgttaaaaattatcttaattaagaatgaaaaatactaagggcacataatgaaaataaacttgtttattgttgtaaccactcaatgaacttaaatttagttatttgtgaagaaaacattcagcatgttctgaattagaatggttcaccttagtattaaatgccctctgtggaaaaggatatgcagatgtttcttccacatgagctacaaatgtgccaagagaccacaagttaaatatttaatgttaacattaagatggaaatatgtcttccttattgagctataactttactcataaatatttgtgggaagaaaagatttattttaatacttaagcatttaactggaggctgttaacgattaacgacttcactttagtaagacatcattctccacaagtaagagaaagagcaaagaaatagatgaaattttcagtgggaagtgagacttcatacccaatattttaaatatatacatgtcaataatctagttattttatgctgaacaaatgctgtggttgtttaattagttttacaaatttagatttcactaattcagaatttgtgatcatttcgagtcagctgagtagaaatgtatttttttcacaatgtgagaatcaaaggtagactacacacaaaattttaatgcactaaaaattacttaaggcaacccttttaaaaactggatggctaatattttgtgtgcaataagatacaataggatccaatttttcaaattatcagcaatattttcagaaatttccttggtacagaacaccctcttcctgggaagagctcatatctttcccaaagctatgcttcctgcattaagcaaactcttttctgcttgacacataaaaatacattatcagataagttgagttagtgtcaatatttcataacctgcattagtaaagcactttaaacatcagttgactgattgtcactgcaattctgtgacacaaactaagttttattatctttgtgtttaaggctaagttatgaagcttaaagatattgtgattatttgagtttgtacaaataattagttgtgaatataactgagtgatttcagatttattcatttcctgcttattagatgtcaagtcctatgctaatatgcaaaaataaatccattatgcttatttttatagacttactaaataccagacaataatctaaatgctttataaatattattcatttaatcaatttgcaggtgaaaaatgaagcagagagaatttaagtaacttgtccatggtcatcaatgtactgaaggtggggccagaaaaatagtacttaattacagtactatgtttcttccttttcatacatctatgaagtaggaacctgagagcgattgctcaaaaatgactttaaattctgataatagtataaaaatgaaatctaaattcagcttgccacaaaaacaattgtacactgtaggaaagagatttggaaaaataaagaaaaaacttttaaataaatacaaacataaggataattgaaaaataaaatgacattgaaaaagagtctagatagaagcaagatttgaaagcatcttaatggaagtgaaatgctccatatgaaagttgccttaaagatgcatattcaggggatttagcagatttgtcgcttcattccattctttataaaccaaaacattagtttcatgaattattttaacaaaatattttgtatgaaatgggatgcatatttgttctcaaagcattagtgtgaacctgttttctgacattcattttccttatagttctaaaagaagctgaaataatcatgaaaggatatcaactcatacaaacatgaacaagaccttggtagtcatatatatatatatacacacttctggggtacatgtgcagaacatgcaggtttgttacatagatatacacgtgccatggtggtttgctgcacccatcaacctgccatcttcattaggtatttctcctaatgctctccctcccctagccccccaccctccaacaggccccaatatgtgatgttcccctccctgtgtccatgtgttctcattgttcaactcccacttatgagtgagaacatgcagtgtttgattttctgtccctgtgttagtttgctgagaatgaaggcttccagcttcatccatgtccctgcagaggacattaactcatcttttttatggccgcatagcattccatggtgtatatgtgccacattttctttattcatctctcattgatgggcatttgggttggttccaagtctttgctattgtgaatagtgctgcaataaacatacatgtgcatgtaagaccttggtattcttacaaaagaaagtttgttcaatttgggaaaggaatctgttgcaataagattaaaaacaaagaacaatgatagctgaatgtttgagtatgtttatactttcctgttattattgcctgttggattcacagagggacaaaagtcaaaattaattcaattcacagcagtattaacattcggggttactgtggatatatagctgggtgcttataaccttggattctctatactattaattttaattaccttggtgagcttacactttctccttaaaaataatagcacactgattaagcaatagaaagctgaggagaaaaagaagacagtaattatccaacagcataacacactgttcttcccatacaccacttccccaatatacacatacacacccatgcatgggcttggagataggggaaaaagtgctccacagtactttctacctcactggaattaatcatacaagtaataactactgtttcatagatgttgtgcctgatcttttattaatcctcttaactagcctgtaaggggagaaatgttagtatcccactgtatagatgaagcaaccaaaccatagacagattagctggcagacacagaattacattctgtttgatcccaaatatgtaaactactgtgtgatggaagatggtcttctgttaaacaccaatttccaaaaccgctgttgttcgtggttctatgaaatttgagtcttcttacggcaaaagactctaaagagtgatatacactttacaggacttattgtcttgttgtcaaattttgctaaatgttagaaccacttacctaggaagttttttatttatttatttatttatttttttattttttttgagagggagtctcactcagtcgcccaggctagcgtgcaatggcgcgatctcggctcactgcaagctccacctcccgggttcacgccattctcctgcctcagcctcctgagtagctgggactacaggcgcccgctaccacgccaggctaatttctttttgtatttttagtagagacagggtttcatcatgttagccatgatggtctcgatctcctgacctggtgatccgccctcctcagcctcccaaagtgctgagattacaggcgtgggccaccacgcccggcttccctaggaagttttaaaatatcctcttgccttggctgcaccttataccaatttagtcagaatagatggaagtggtaccaacacatggcaatttttttctaatttttcagatgatatccaaatatagccatggttgagagccagtgttctaaatgccttgctccttaccattagtgcttgtatagtctttccatcatccccagtggtgactcagtctctacccaaacacacctagcattagctttgactgtcgatcaagttcttaggtcaattccaaatctgtcacttttctcttcagaataatctctttatttcttttaattgcttctcttatgacatgattttaaatctcctcattatcccagtagcattcttctaactagactagttgtcaatatggtatcttggaaagaatctggattttggagtcatagtacctttcatttacacttcatatctgctgtgtacgtaataatcttgtgaactcgagcaaactattcaatattctcagcttccctccttccacaaataatgctacctcttgtaacttttgtgaatattaaatgagatatacagaataggagtaagacttttagaagctctgagcatggaaaactgtagtgtcttatcactgccacttcacccctccacatgtaactcaaatgaaaacaacaacagtgaaccagataaaaggaacaaaggaatacaattatgttatagtttttgtcttcactatgttgatttttaaaattattaagcagcaaatatactatttttgaagtacatatgtccattttttgtacctttatttggctactgtccaaaatatatgcttaatcttctcctgagtaatctagtagtaaacagcctgaatataactgtgcatggtagatttgagagtaagacagaaatgtataacttgagacaaatttttaacctctttcataagcttcaatttcctgaattataaaatgaaggtaatatttgccccggatgattaaagtaaaaattgtaataaataatatataaaaagtacttataagttataaaaaagtagatacagtgtgtggtgaagaacaagggtctgttaccaaactatttgggttcgaatcttagcttacaggttgtggctctgaaaccttgggctctcaaaccttggaagatgaggataaaaataaatctacctcttaagtttcttgtgagtttacaataattaatgttctttatacatttaggacaaaatagactctcaatacatgttagtaactatcattattattgaaataataatttttattagacacgaaaatgtctggtacctcataggcactcaaggtatgtggtataattttcttttctttttaactgagttgcccatagctgaatatgttactgaaatatagaatggtgcctgaaaatactcatagatactcaatgaatatatactaaattaacaaataaatgaataagtatggtctgattacaaagtatagaaggggattatagctttataactttcctcaatataggtttagattcatagtaaaaacacatttctattacattcttaccaaaggacctaaattccaattaaatttagaatttttaaaagatcataaagctctttaattatttttgatgagtttctagccagtgacatttttaccatacctgaataggacaatactgaaggagataattttcaaaaatatgtataatctaactcaacattatacgagtataattacatttcgatctctgtgatttaaacatgaggctcttatcatatgaaaaaaaaaacaaacatattcagaagcacttaattgctcagcttaactcaggttagcgcagcctgactcactttacctttagattcccttgctctggtaattaacacttaggtcttctccaaattatgtaaccattctgggccttaatatcatcatctgtaaaataggagtaatattacctagcccacgggaattttgtaagaagcaaataaaatgggatatgtgaaaatatactgaaacatgcatatatatgacaactgtttatgtgtgtatagttaaatttgctgcttgctcaagcatatcctagaaaaaagcaatcaaaatagctatgcctggtgttcagagatttgcctcaataaactcgactaaccatctagcagtgactattttaaatgcttattttgctagaaatgtaacaagtatgagaataaagtgcttacgttttctacttgatatggttctgaagaggttaattttaatcacgacattctgcacttaaatttttgtagcctactgccaaattttaacattcaagtttattcatttttctttatctgtctacagaaagatctcaaattattgattttcctaaatatatatcacttgaaagttacattacaaaatgagcacacggactgcaaattcagaggatgctgagttctataaaataactgacccacattttcctagctattaccctagcctacatctctgacagagtcctttagatatctaaggcaaaatttgcttccaattttctgctttatatgccaagatgatgacatttgatatatattgaaattattttaaatattgggcattaggagatttcaaagccagtatccataaagagaaagtaaaaaacctgggatagtgtgatctatagagcaacattttatggaaaaataataataattaaaattggaaaatcttttttaaataaatggatgctggaaaaattctcctacttcaatattaagagtttccaaagatgtaagctacttttttgctttgccataatatgtataagatatgtaaccaatatttaaaaatctatgtggtttgtcaaaataaaaagacaacttgaagtttcttccaaaactacccatttcacaagaatattgcttattcacaataagattatatttctatgttttaaatgttgacaaaagaaggaaacagagaaataattacactaccatgtacccgaaccataaatatgtgttctgctgacttttaacaaaccaggatgaaacatttatgatgaatgaggaagagactgttgtaatttttctaaagcacttttatattgcatgaatgactatcttcctcaggagagcacaaattaatttttattaacaaagaactgtaaagaagtgctgccatctttgcttgagtttaaatgtttcccacaattttatcattttaatggataatgggaaaataaatagttgcttgcacaataaaaaaatcatggttgtagttagtattaggtaggtacttcataatctttctcatttctaatattttagatatagggcattttctccataagtggctttgtattgttgtttccctaaagtcattccaaattagcttgttctttaataaaacagagaatttttggaaaagaattatccaactcttctctgatgcttaaagcttcctttatgttttctttttaagagcacaatcctggatatttttcccatgaaacactctcgcactacaattgtgagacctatattttataaagcataatgaatttttaaaattttacattaccactgttatgtgtggagaacactaaaaacagtttttaagtttaaggcattccatccaagtactaaccaagtctgaccctgcttagcttctgagatagagatcaggtgcattcagggtagtatggctatagactaaaaagatttcttaactagttttatctctgtcctcatgattgtggtttgtgaaagaaaaatctgattataagtaggagggtaaatccctgattaagaaataattttattaaaatattatgaagatattaaaatatttatctgattatatatgactaatgaatagatttcaaatattatttgtctacatttgtttttctttctgttgtttggctaaaatgacttaaggcacaattagcattcattgtgtataaagaattttttatattgattttataaaccataagaaagaaatatctgaagtaactcaattacatttccttagatatctcactagaattttcaatagccaatgacttcaacttttagcctatgagagaaattatagactaatgtcccttaccaaatactaaaatttgatatcagtatttgaaatcattctttggaactttgattaatttagaactgtttcagtaaacaatttaattaaaaattaagctcctgaataaagtatgatttatacaatcataaactattatatattaatacaaaaccccattaagttaacaacataagggtgtgagctatagtgaattaggttaattttctggataactgaagattatcatataaatataagaaaataatttttgataacatatgttcctgtcaaactttaggcctatattaaaaaaataagctctgaacaaagtgtaacattcatttgattattacagattataggaaaactctagttaaccttctcactggattaattcaaatgccagttgtattctgtagagccatgatgctgaaggtgataggtaccacttccattggtctgttcacttctgttccattaattgtttccttcatactttttttattgtagttgtaatggttattttaaattgtattgttattaagtgaactagttcaatattaggtaaagagataaaataagcaagtggaaagaatgagcaaaactatgttgaatactttaggaagtattttgaacactgaaaaattttgggaaaacgagtaaatacaaagaaagtgttttagtgcattttcacactactgataaagacatacccaagactgggaagaaaagtaggtttaatggtctcacagtttcacgtggctggggaggccttacaatcatgagggaaggcaaaaggcacttcttacatggcagcagcaagagggaaagagaaagaagagaaagtagaagccccttgtaaaaccatgagatcttatgagatttattcactaccatgagaacagtatgggggaaactgccctcatgatgcaattatctcccactgggtccctgctacaacacgtggaaattatggaaactacaatgcaagatgagatttgggtggggacacagagcaaaaccatgtaagattgttttgcaaggaattttaagccctaagaccactttaacttaagctggttgttttttttgtttgttggtttgttttgttttttttttgagacagagtctcactctgttggcccaggctggtgtgcagtggcatgatctcggctcactgcaagctccgcctcctgggttcacgccattctcctgcctcagcctccgagtagctgggactacaggtgcccgccaccatgccctgctaattttttgtatttttagtagagacggggtttcaccatgttagccaggatggtctcgatctcctgatgtcgtgatctgcccacctcggcctcccaaagtgctgggattacagacgtgagccacagcgcccggccttaagctggaatttgaggaagacgctttcctgtgtgactatgcaagaaagaggaagagaggcagaagacactaactcaaagaaaagggcttggtctcatgttaaaatacgcatgactgaatggatttccacttattttaagttaaaatgaaatgcttaacatatggaaatatattattaaaaattatttctggttttgcatactttagtagctggctgatccttatcttaccggataagtggacactgattgaatatattttattatatatctggcctaaggaaggctatattctatgactatggaatatttggtattatcattcttactacttttgaaccatttcactttcagtttcacgtttttttcctgctcctgaatattttgcatgcctgattccagataattggaaaattgctgcaccttcaatataaaacttactcaaatatagttgagatttaaccggtcaagacaaactttgcagatttatctccttccttcccacatcccacattctacctatttttccattttctatttaacaaccagtctgaatgttaattggagaagtggtaggtaaagttaaaaagtaggtaaaggcaggcttgtagcacacctgtggatccagcaaatcttgaattctgccatttttggggaattattgatggatatttctatatgtcaggtgtgtgttttagaatgattcaattcatctcttagttctttgttttttattagttttttgggggggttcttttctctgtcctttttctctgaaaagtatatcataatcataatttatcataattggcatatctatatcaaataggaaaaaaataactttaagaaaaatgtttctctctgcttttacagaaaaaagagtcctcaatagacattgcttagtattaacttattttccctgcttctgtagtgtggagtactgacatttaaaagactttaatttctattgataataaatgaatgcacagccagagaagagaactctaaaataattagagggatgcatgtcaagtctttcaggccctcatattaatacacagtgcatgctgcttcttattgttgcaaatgtcaaccttcttttagataagtgtcttttgggaaatggtttactacacttcaaagggatataataaaagaaaagggcttggggcaatatttaagcaatgaaagaaacacaggacatttatgactagctgagaggaactgattgcctttggctgtgccttgggaaatccccaggaaacacagtaagttgtgattactattgtaagttaaaatgatataaagcatgcagaggaatttgtgtttttcttatgggtgatactgcatttcatattctcagcataccatcagagttcatatctacctctgtgtttcttactgaagtactagcaggagatgtattattgaaaattgccaaagaataattttcaagaggatcaatttaagaaaatgaaaagaatgtaaagctaagtctatctcagaaaacatatgtgttttcgcatacctcaattaaatgtttctcattaaactagacattttgaaattaatcataccaaaatttgtactgagaatgtttgttaaaatttgcatggtaaatttctactatgtgtataactatggcaaataacattagaggtaaataaaaaagaagggcatacatttaattttatcagtgcatgttcacagtggttatttccttaatagacatagaaatgtttagatctggcagcattattggggggatgtgaggatgtgatttattattacccttataggttttcacttctgagtttctaccaggctgttgagaatataaaggaaattatctcacaaatctgttatttttttctttattcatttcatgtagtttcccttttctggtagttaagagatctaacaccaaattttaatcactttatggtctcagttttcactgcactaccttcaaattcaaaacatggctgaagaattatgtcacgcgcttcccagtgaagacaccaccaaacaggctttgtgtgagcaacaaggctgtttatttcacctgggtgcaggctggctgagtccgtaaagacagtcagcaaagggagataggggtggggctgttttataggatttgggtgggtagtggaaaattacagtcaaagggggtttttctcttacaggcaggggcggggtcacaaggtgctcagcaggggaggttctgagccaggagaaggaatttcacaaggttaatcaatcagttaaggtggggcaggaacaaatcacaatggtggaatgtcatcagttaaggcaggaaccagccattttcacttcttttgtgattcttcacttgcttcaggccatctggacgtatacgtgcaggcttgggctcagaggcctgacaaattattcttgaaatgaggtctgaaatgctaacaataaaattcagcctgattatcactatttttggtcatgcaaagataacaaactgggtaaaaaattgtagtctatttaaaggcactttggccttgcaaattctgtacactgtctggtttgattaatgagcaagtgactttatcactgtatgtcaaccaaagcaacagattgaaggcatgccttgggcaggtctatgctccaaaagggattttaagagagctaatactttaatgtgtttaatttggatgttttaattaagggttaatataaatatcaaagcaaaaatctaaataagcacaaaactagtagccatttcttgtataagtacctaaaatgcacacatctgaatactttcaaatttcggggaatcgccaagcattttacagactacgtgtttcctgaactgttaacccaggtcttctaattaacccttgaagatagttctgggtgctacataaaagcttgaaggattactcatataagcttaaatagaaattccaccaaaatgcattaaagaatatgagaatacttatatgtttatcagaaatatcttgttattatttaaaattttatcattctacaacatttacaatgattatattaactaaatcctacatttccacatgtatataccatgatgggaccaaggtcaaatttttattttacttgtgaatgataatttcagaagttgagcattcttctgtaaatgctgctcttatataactcagatattttcttgaacgactgcttcttaaactatttaaatatcaagagaactttaacttccagagggtgtaagataatacaattaaaactctacttaaaaaaaattcatacccctttagattccaattgtgtacttttaaaataatattacagctctttagtcacacacttatctgcaattctgagatccaaaacacaaataagcaaaccaaatcccctgataagtgaaagttcttttatgaattatatggtaacaaaatcttacctgaattgaaaagaagctatttacagtttttaaaaatcaaagtgtgattatacttttgccgcagagatattaatgtctttgattacaccagctccagatgtagctaagggtgctttttgtaaattctgaataattctgaattctgaaaaatcacttggcctcaagcttttggataaagagttacttaagaattttcttatgtttatatttccattccatgtctaacactgttttgctttttgatgtgtgtgcctgaggccagggaataagtgctgaattcttattcaattatagttcaggtattattttaacatttttcctaggtaaaaatggtgttgactcttactctaacaagatggtatgttactcttttctatacctatgttctgagctacaccaagaatctctctttagtaaccacttccagaggagtaggaaggtattaacaacgttcatcacatttttttttgttctttttaaggcatttctttttcctttctttcatggatttctgttctttacattcattctctgtgacagactcatgtgcttattacaggtctaatttacagtgaagacagtttataacagaaatcacaatactcataattcacaaagcagtctctaattggctcagtcctcatactcatcctgattatacagactcagaatctggtggagaagctcctgggatgcagaggccaaaagaattcagttcaaggctgtcagtgccactttccagctttgtagccatggaaatttactttgctacttctccctctttcctatttgtggtaatggaaggctattatatagtatggagataatatatgcttcagataattttgtcattgctaatataataaagcattttaaataagtacatggtgtgctatgaaacactgaaaaaaatagttaaataaatgtaatgatattcatgaactacaggttgtgtgtggggaaaaaagcccagaagtgcaggagttctctactggatttattaagctcctatggttaagctgaacactaacttattcttaaatatgtcttgcatgaataagttctatatctggatttagatatattaatatattaaatattgttgttttaattcattgtcttaagtaatagatagattttttaaaatcaatattttagaaagaaaacagtagaaggaaaattatgtgggtaaattgaataatctaggctttgtcatcatatctccttaaatgttttcttttaactggtcataagttacttatgctaagcagttttctgtagcatagtactttttttttccccataggttattggggaacaggtggtgtttggttacaataataagttctttagtggtgatttgtgagattttggtgcattcatcacccaagcagtttacactgcacccagtttgtagtctttcatctctcacccccttcccaccctttcctcctgagtccctgaggtccattgtgtcattcttatgcctttgcatcctcatagcttagctcccacttatgagtgagaacatatgaacatacaatgtttggttttccattcctgagttacttcacttagaatagcagtctccaatctcatccaggtcgctgcaaatgccatttactaattcccttttatggctgagtagtattccatcatatatatgatatacatatatacacacatatatatatgatatatatacacacacatatatatgatatacatatatacatacacatatacatatgatacacatatatatatcacagtttccttttgtttgtttttgagacggagtttcgctcttgttgcccaggcttgagtgcaatggcaccatctcagctaactgcaacctctgcctcctgggttcaagtgattctcctgcctcatcctcccgagtagccaggattacaggcacatgccaccactcctggctaattttgtatttttagtaaagacagggtttcaccatgttggccaagctggtctcaaactcctgataccacagtttctttatctacacattgattgactggcagttgggttggttccacatttttgcaattgcaaattgtgctgctataaacgtgtgtacaagtatctttttcatataatgacttatttttctctgggtagatagccaatactgggatcaaatgatagttctacttttagttctttaaggattctccacactgttttccatagtggttgtactagtttacattcccaccagcagtgtaaaaatgtttcctgttcactgcattcacaccaatatctattatgttttgattttttgattatggccattcttgcaggataaggtggtgtcccattgtgattctgatgttcatttccctggtcattagtgatgagcattttttcatatatttattagccatttgtatatcttcttttgagaattgtctattcatgtccttagcccactttttgatggaattggttttttttcttgctaataagtttgagtttgttgtagattctgggtatttgtcctttgtcagatatatagattgtgaagattttctcccactctgtgggttgtctgtttactctgctggcagttccttttgctgtgcaaaacctctttagtttaattaagtcccggctatttatctttgtttttattgcatttggttttgtgtcttggtcatgaactctttgcctaagccatgcccgaagggtttttccaatgttatcttctagaatttttatagtttcaggtcttagatttaagtccttgattcatcttgagtttatttttgaataaggtgaaagatgaggatccagtttcattctcctacatgtggcttgccaattatcccaacaccattttttgaatagtgtgtgctttgcccactttatattcttgtttgctttgtcaaggattggttggctgtaagtatttggttttatttctgggttctctattctgttccttccatctgtgtgcctatttttatatcagtatcatgctgttttggtgactatggccttatagtatagtttgaaatcgggtaatgtgatgcctccagatatgttctttttgcttagtcttgctttggctatgctggctctttttttggttctatatgaattttaggattttttttttctaattctgtgaagactgattgtggtatttttatgggaattgtgctgaatttgtagattgcttttgacagtatagtcattttcacaatattgattctacccatccgtgagcataggatgggtttccatttgtttgggtcatctgtgatttctttcagcagtgttttgtagttttccttgtagaggtcttttaactccttggttaggtgtaatcctaagtgtttgtttgtttttttgttttttcagctattgtaaaaggggttgagttcttgatttgattctctgcttggttgctgtttgtgtatagaagatctactgatttgtgtgcattaattttgtatccggaaactttgctgaattcttttatcagttctaggagttttctggaggagtctttagggttttctaggaaaacaatcatatcatcagcagacagtgacagtttgacttcctctttaccgatttgaatgccctttatttcattttcttgtctgattgctctggctaggacttccagtactgtattgaagaggagtggtgagagtgggcatccttgtcttgccagctctcagatggagtgctttaaacttttctctattcagtattatgttggctgtgggtttgtcatagatggcttttattacactgaggtatgtccctatatgccaattttgctgagagttttaatcataaaaggatgctagattttgttgaatgccttgtcttcatctattgagatgatcatgtgatttttgtttttgattctgtttctgtggtgtatcaccaaagcacagtacttttaaaagcaataattaggcttcttatggtaatatctgattatttgtcactccaacacaagtatcacttggaaaaaaatagttaggttaactctcctttatttttaactaatatacatattataccaataagaaagtctaaaataaagtttataaagtctgggttcagtaaatgagcactttggtaatacactatcttagatttggcatcttattaaaaaataaatttggctattttgtctttatgctgatgtgatgactttttaattttttttatttttattgatacatactatttttacatatgtatggggtacatgtgatattttattacatgcatagaatgtgtaatgatcaagccagagtgtttaagatatccttgccttaagtatttatcctttccttgtgtcagaacatttccagtcctttctttcagctattttaaaatatacgaaacactgttgtttactatagtcaccctactctgctattgaacattagggcttatttcttctttctaactgtatgtttatacccattaaccaccctctgttcatcacaccacccacccacccatttttcccaggccctagtatttatcattctactctctacctccatgagattaatgtttttagctcccacatgagtgagaacatgcactatttgtttttctgtgcctggcttatttcacctgaaataatgacctctagttcatccatcttgctgcaaatgacatgagttattcttttttatggccaaatagtattctcttgtgtatgtataccacttttctttattcgtttgaccattaatggacactgaggtccattccatatttttgctattgtgaataatgctgcaataaacatatgggtgcaagtatctttttgaaatactaatttattggcctggcgcagtggctcatgcctgtaatcccagcactttgggaggctgaggcgggcggatcacgaggtcaggagatcgagaccatcctggctaacacagtgaaaccccgtccctactaaaaatacaaaaaaaatagctgggagtggtggcaggcgcttgtagtcccagctacttgggaggctgaggcaggagaatggtgtgagcccgggaggcagagcttgcagtgagccgagatcgcgccactgcactccagcctgggtgacagagcgagactccgtctaaaaaaaaaaaagaaacactaatttattttcctctgcctaagtgcccagtaggggattgctgcatcatgtggtagttctatttatcgtttttcaagaaatattcatactgttttccatagtgcatgtattaatttacatttccacccacaatgtataagagttcccttttctttgcatccttgccagcatctgtttttttttgtttgtttttgttttttgtttttgtttttgtttttgtctttttaataatagctactctaactgggttaaaatgatatttcaatttgtttttgatttgcacctccctgatgattcgtgatgttgagcattttttcaactacctgttggccatttttatgtcttcttctgacaaatgtatattaagataatttgtccaacttttagtgggtttatttagcttttcttttccgttaaattgtttaggttctttgtatattctgcatattagtttcttgtttgatgaatagtttgcaaatattttctctcattctataggttgtctcttcagtctgttgactgtttcttttgctgtgcagaagctttttagtgtaatagaatctcatttgcctacttgtgtttttgaggtcttagccataaaacctttgcccagagcaatgtcctgaattgtttcttctatgttttcttttagcagttttatagtttcagcttttagatttaagtctttaaaccgtcttgagttgatttttgtagatggtgagagatacggtttcagtttcattctgttgcatatagatgtccaatttacccagcaccatttattgaagggactcctttactccaatttatttttttggtgtttttgtcaaaattagttaactataaaaacatggatttatctggggttctctattctattccatcagtctatgtgtcttgtttttgtaccaataccattctattgttattactctaggcttgtaataaattttgaaatcagttagtatgttgcctctggtttcattcttttggttcagaattgccttgtctattccagctcttttttggttccatacacattttaggatttttttttctatttctgtgaaaaatgacattggtattttattaaggattgcactgaatttgtagatttctttgggtagtatagttacattaatgatgttaattctgctgggatgtctttccttttttttttttttttttgtcctcaacttctttcatcagaattttgtagttttccttgagtaggtctttcatctccttgaatacatttatttctaggtaatttttgtagctattgaaaaatgagattaccttcttcatttctttttcaaccagtttatgattagtatataacactactgatttttgtatgttggtttttgtatccttcaactttactgaatttatttatcaaatctaagagtttttggtggagtctttagctctttctgtaatagaaataagatcatgtcatctccaaacagggataattttacttccattttttcaatttggaatgccttttctttctttctcttacctgattgttctggctatgtctgccagtactgtgttgagtaggagagataaaagtggatatccttgttttgttccagttcttagagaaaagattttccagtttttcccattgtgtccaaggttagctgtaggtttatcatatatggcatttgttatcttaaggtatgttccttttatgcctataaggcagtttttttgagtttttatcataaaggaatgttgaatttttccaaatgcttttttacaactattgagatgatcatatggtttctattcttcatactgttgaggtgatacatgacatttattgatttgcataggttgaactagtcttgcactgctgggataaatgtcacttgatcatggtgtattatatttttgatatactcttagatttgatttgctggtattttgttgaggatttttgcatctatgtttatcagggatattggactgtagttttcttgttgcacttttttctgcctttggtatcagggtaatactgccctcatagaatgagttagcaagaattcccttcttgtaaatatttttgaatagtttcagaagaattggtataagttcttagaaagtttcgtacatttcaccagtgaagctattggatcctgacttcatgagactgatgtattcaattctggacttcttttggcggggcttggcggagactttttattactgcttcaatcttattatgtgttactgatctgttcagattttctatttcttcctgtttcagtcttgttaggttgtatgtgtcctggtatttatccattttgtttaagttttccagtttgttagtatatatttgtccataatagtctctgattattttttgttattgtggtatccattttgtccttttttttttttttttggcttctgattttatttgttttttttcctctttttcttggttagtctagctagtggtttatctatttacttatcttttttaaaaaacaactttttgtttcattgatcctttatatatattttttgagtctcaattttgtttagttctgctatgacttttattatttcatttttctctactaattttgggtttggtttgttcttgcttttctaatttcttgaggtgcatcattgcatgcttagaaatctttctatttttttgatctagggttttgttgttacaaacttgcattttaacattgcttttgctgtattccataggttttgatatgttgtgtctcaattttcatcttttcaataaattattttatttctttcttaattgcttccttgacccaatggttattcaggagcatgttgtttaatttccatttatttgtacagcttctaaagttcctatagttattgatttctagttttattctatggtggcctgagaggatacttgatatatttcaatttttaaaaatttgttggggcttgttttgtgtcctaacatatggcctggagaatgttccatatgctaaggagaagaacgtttattctgctgttctcagatgaaataatccgtaaatgtctgctaggtccatttggtctaaaatgcagtttaaatccaatgtttctttgttgattttctgtgtagatgattggtctaatgctgacagtagggcgttgaagtccctaactattactattattgtattggaatctgttcttccctttacatctggtaatgtttgctttatgtatctggtgctcctctatcaggtgcatatatgtttagaaatgtaataccctctcactgaattgatcctttaatcattatataatgagcctttttgtcttgactgaaaagtctgttttacctgaagtaagtatagctactcctgatcattttggtttctgtttgcatggagtatctttttccgtctctttattttctgtctgtatgtgtctttgtagatgcagtgagtttcttacaggcattgtatagttgggtcctgtttgtgttttgttttgttttgtttttgcctttagccagtctatatcttttaagtggaaagtttaatccatttaccttcaaggttaatgttgatatgtgaggtttttttcttgtcattttattaattagtttctcatttctctatccttatttatttctccttcttattgtttatcattcatgttgggtggttttctgtggtggtaatatttgagtcctttgtttttctcatttgtgtgtgtactgtaccactgagtttcatatttttgtgtgtttgcctgatggtagatattatattttcattcccacgtgtagaactcccttaagcatttcctgtatgaccagtctagtggttatgaattccctcagcttttgctgacctgggaaagactatctcttcttcgtttatgaaggataaatttgctgtatagcatgtccttggccgccaggtttatttttttttttttctttcagcactgaatatatcactccattctctcctggcctgtgaggtttctgttaagaaatctgctgttagtctgatggaattgccttagaagtgagtcgatgcttttctgttgctgtttttaaaaatccctttgtctttgacttttgacaatttgactataatgtcttgggaaggcctttttgagcttcctgtatctgaatgtctcaatctcttgctagagttggaaagttttcagttattatttcaataagtgtgttttgtattccttttattttccctccacctttgagagacccccaaaattagaatatttggtggacttatggtatcctatatgtctcatagattttgttcatttatttttattttttttcctttatctttgtctgactgagttatttcaaaagaactgtcttcaagttctgaaactttttcttctgcttgatctagtcctttgtcaaagctttgagcattttgtatttcattcaaggaattcatcagtttaacagtttctatttggttcttttttgtgatatctatctctttggtaaattgctcattcatatcctgaattgcttttctgatttctttgtattgattttctgaattatcttgtttctaagtgagcttcttaaataacactactttgaattatttttctggaatttcacaaatttcttcattggaattgttgcttgagaatgattgtgttttttgggaggtgtcttctttccttgctttttcatgtctcttgtgcccttatattgatatttgcacacctggtgtactagtcacttctttctattttttgaatattttttaataagaaaggacttttttcctgaagatgtatctgtggtgttcgttggataaggtgctttggctttaattctggtcatgtgccgtagtatagtctctatatgatttattggctgtaaacagtgtcagtagtgtctatgatttccacactggctgagagtgtgtttgtttgtgcagactgtggtaaagttttactggagatgaagacattaaacaggccagtcatttggccacagtacaggagtggcaggacaagcatgcctgtccttgagccccaaagcagtaatgctggcaccagtgttagtgggtttaggcagagtgattcttgggcctccagtcagcttgcttgagtgctggtagtgacaacaatgggtcaggtaggtgggaagtttcttgggcctctggagaccacccaagttggtattgcatgggtgatagcagtagcagtggtgagacaatcatctggcccccaagaagtccactccactgttagtggtgattgcagtggactggatggattagttccaatgctctcaagtggcacatacaggtgggtgccagctgtgatggtagttatcaggttgtgtttgcccatcctcaggcctctggaataagtacacaggtgctgagagaggtggataggacagggcgatccccagaaccctggtgaaatgcttgggtgggggcagcagtgattacactgtggctctgctgctgtagagagtggcgttgttttcctttgcagcagacataaacaagtggtttaggagtgagagcatcggccacaggtggtgtctataagtggggtataatatttcctcagggcatttttaaatgaacagagaccctgctactgaaggagactgggttgctgccaatggctcacacttgggctctgacagcagccagcagcagtacctggctgtgggaagggaatgtcagtggtgctccagagatgtggagatgcagggactgttgcttcccagggaaggatgcagttggtgggtcgttaggctctcaaaatggtgtggtgctatatttgcttaggactcagggcaagtgtggccccagtgtgagctccctctatgaagcaatgtcattgggtggtctctgaaaatctctgtatgttagtcttagggcttgtgtgagttgaggggctcttctgtggctagaattgcagaaatccaccatggaaatgtagaccactggtagtcagtaacttacccttcccttgttttggggaatctctccaggctcccagctgttcccagttgagctggctgcctcacattcctttccttccatgtcttaggcatttcttgtcatttttcattgcatttcagcattttctttcttatgggatctattcaaaatgtgattatctattcactcttttggttcttatctgtggagggatcaagtatcacatgcctctagtcagctatcttgaagcccctccctgatggaatttctcattgtaaaagatttcattgagcataaacatataactaaattaaatgactctgacagtgtaatgaaaaaacacaaatacaaggcagccacatgtacaaagtgcaatcaaaaagaaacttaattgatacagaagtaggtaactgtaggggagaactgtgatctggggagacaactcaggatgtcgaccatatgacatcagatttttcattagaatgaaagaagtatcatgtagtaaatgcctcggaaccagttagataaaaatgtaaagccaaggtcttcttcagcagaattttgtttagctattctggacttacttaattgtgactttcctgtgatttatctcaacaacttgaagtttttgatattaggagactagcttctccagtcagtgtattataaatatattactttctcatagtttacatttttctttgtaagtaagtttgttccttgtttgttataggaatgcattgtagtattcctctttccctagttaaatctctaatgaagatcagtcctaacatattacaggcctcagaaatatttttcaaataaatagaaaacatgtgtttttagtttgtattttgatatttaataatagagcttttaaaaaatattggtttttgttatttttagcttttaattacttagacttgatgtaacttacaaagttaaaaaaaacttgaatgtttttgtcgcaaatattggtgagtctttgccttaaataatgataactttttaaaaaaatcagccttgtatagtgaatattgtgctgtagattcaaataaacctatgtgtgcatatcccagtttagaatcttccagatttaggcagatctcctttctgatctagatctttcttgacttctaaatcatgaattatacaggtgtgactttattccatctcaaatgcaatgctgaaacagtgcttagataacctgccatgatttctgcccttagactcaaagtagtaaacattagtctattcaagattctgtcttatgtcattcaatgcttgttcggggcgaatgactgatggggttggtgctaacaacctacacttgggtctgtacagcaattttatagattattatgctttcttctatgtggaggttgtaatcatttcatcaaatttactcacaagtcgctcttcagagcaaaatgtatttaaacctaccccagggaaattccaatagaccataacctctccctaaatagattagagacagaaacatattcttagacaaaggaaatttaagcatggatttgcacgtcttatttatcatcctttaatgcaatcgtgcaaatatttgacaagataagctccctctttagtatgtctttataggtccaaggccttaatattaggatttgctattctttattagaagtaaggttcattaaaatttggcaacagggattattttgtggatccaccactttaactatttagctatccttaaaaacttaatggttctttaactgattctgaaccaaatctaaaattacttaatcctaaaaagaatttttctgtcagcaaaaatggaaataataataaaagaaaataaatgagatcatacttttcgtgtgctaagcataagagctttacagagtaaatgttcaatacatattatttaatcttttaaagatattcttgtcatttctaagttattatatttataatgaattattgattcactgagatttttatttacttaatgttttaaaacatgtccttgagtatattataatataattctgtgacagaggtcattgctaggaataaaaatatataatttaaattgcaatatgtgtttgtacagctctcttttaactggagggatgtagaaactatttagatgtgttcattctaacttttatgcccttcatacacaattaatattttcatgtaataacttttttccctttattaaataatgctgctttttctatgcttttgttgatgcatagattagggccattttattgaagtcttcatctttcctttctatagtatttgaggtagaaaaagaaaagagcaactactaatgcactgcttagtttaaaagattttgagaaaatgtttgcatcagctaaggaattggtgcaagggaacctactttttaaggaggccacttcataaatatcatgtgtgttctacttttcacaaaacttcctgtcaaatttaaatgttcccatcttttgctgtaatttttattttactttcatgttttggtgtgttatatatattttttacttaatttcctacaaacattaatatatatttgtctgccaaaaataggaactcataggacttatttgataaaagcagcctcttaagccacctttatttattttgatttctattcatttctccaccattttctactgttactaatgctgacatcatttgctccaaaaaaaaaaatttgttttatttacagggcacagcttatggaagtgctcctgtaccttctcgcaggcaattatgtgagtctcttaaattcagctctgtgttgtaaacatgactgtgttcctgtgctgtagcatggcatgctgattgagaccaaatgcccaaaggtcaatatgcaatccccagtgttgtatattacctataatatgtttgtagtaaatggttccctttgcctcttccttatctgtttgtcattatccagcccatttaagaaaactgcattgcaatgtggccaactgcattgagactaatggctcaaagtctggggcaaagaaagaagtgactcttacttaagtttattttcatttagcaacaatattagcactctctctctcaactcagtaaggtttcttaagttctaactccttttacttattggttcaaagacttcttatatcatgcacagttgtgtttttgccacagctaatgagaactttcctagaaaaggaaatccattaaaagaaatacttcttctagtgaatttaaagcaaacttgacattgtaacaatgttggttttttttcccaaagtcatcacatttagaaaattgaaattaatctataaatgtttagatagaaagcccagagtttacaaccttgctcagctgtgttataaatatatgcacctcggcagagtcagatacctgcatttcagttcgggagatttctgtgacagcttgtctgctttaacatgtactttttgtcaatgagaaatgtatatgtaaattgaatatgtaggctctccaaagtgccatcagactttgagaaagagctattttcattgcccattccatccatgtctttcctcttttcccacaccagcatccgtcagataatcatggttgtttacctccattatagactgctacagcaagacacccatgtgactctaattgtcatgcctagcaataaatgccaagtaaatccatcttaatatgatgttaaaggtgattcaaaggtacagtcctgtttgcataatgcttttcttcactattggcagaaaaaaacatatgagttgatgacattcactgagaaggatccgtgaatcacttcaacaaaaaatgcaggactttccaccatgataaagctgccccaacaatgaacaaaaaaatatgtactttactatctcctttctaatgaaaaaattttgaaagtttgggttcttatgaatatagttgcagcagacagaactgctaatgtgaacagaagatggggtttagatatattaaaactccacctaaagttaaataatctctcaaacatctcaaattgtcctttgctcttatttcttttcataggtctctctatcgtctacatttctaatgtacactaaagatatggcttcttaaatataggcattacggcagtattaattaatgaaaattgaaaaccatagcaaaaacttcaatgggtttttttttttttttttaagatgtgtctctttttaaagaaaaaagtccttgtgctatatgttatatttcattgaatataggaaatgctgttatggagatagagaagatatttttactagagatttggggaactgtgaatttattatatgtgctatgaagccataagcggaaatataaagggtatggaattattatccttaatttgaattaaacttaccttttgctttcacgaaatcaaagtgtatttatatgtaaataaaaatactggatatttgagattttcgatcactggttccagttaagtgagttaatcctactaaaaatagaaagaaaaacaaaaagatgtatgatttctgtaagtctgagggtcttaagttgcaatatttaccaatatgtaccacgataaaatggatattaccttcctaaatatgctgacttggcacagataagcatgtaagattcatgaatttggaatgcttattatcacattttcttttagtcaaatgcaaattttaggatctctgcattacacattagaagaatctccttgagtatttgtaattgtggtgcttatcaaagttgttatgtagaaggaatgaatgctttttttctatacacaaatgttagaatattaatagtaaacatttttgtttctcccctacttcctgtgaatacctatctagaaattttatagttggttcttgattctagcgtgtttgttttgttttttttttccatttctacctacatcacaaggtgtgatgaatactttcctgaagttacaattaaagtttagttttttttttaattcagttttaaggactttgttttatggttgccattttaactatttcaaaaatataatcagtcaagaaattttccttaacaataatttgaaatggaatttagcaacagagagggattgcctagatgatgatatgattagaaaggctgtgaatctacaatgacaggattcactctctatcttggaaagcactgtatagcttttaattaacaggcccacacaaatatgcatttatttgttgctaataatttatcaacgttaaattggaaatagtataggtttggttagtattttccactttcagagaaaacgcttgatgaaggttcactaagttggataatgtggagtcttggaaagttatttgaatgctactagtacatttttatttaaataccaaaatgatgcatcatttattcagatacagttctcttctcaatttccgatgggtttatgttttaaaattgtaatcagtattgttacatgaaactctatcatgtgttggtataaccttatctacatgtgatatgaatggagatctttaacatttggataaaatttggcaaagatgtgacccatagattattgcctcaacattcaaaatacaagaactgatttcaatttggttattgttttccattttgtgaccataattactactttaagagttccaaattacagaagcatgtaactctaaaatttaataaaccataaatatgtgttctctagaaaaaaatagtaaacatcaagtttcgtaatgtattcaacaattcaaaaccaatttggttaaaaaaattaaatgtaggtcacatgctttcatattttataacatggcttctttatttctcagtatatgaatgaaaggagcaccaaatgtttgtaagttgtctattcaggagtagttacctaatttagctgaatcattcatcagatagttcaatgttaacccaactgaactgaatatacatgaaaataatactgccttgctattcagaatcagatagcagttattttatagcacaaatgggactgaaattatatatttaaagtggggtaccttaaaaacatacctaccctaatttccagtcaagtttttttcctactaaagagcaatttttaaattcagaattcatgaacacaaaaaattcaagaaaaaagtcaggaaaacaatgtatttactgaaaataatactaacctcaaagtcagaaaaaatagttctaataagtgtctgtaagaacagatgtttctgactagtttttgtactgtgccttctgatttattcccttttcttttcaattaatcagtttatttcctgtcatttcccttttttctgtatctactgttccacacaatgtatttgcattatttatcattctattttagatatagctttgattttatttgttttcttcattctttgccaggcttataaacaggataggaccaagcttccacagtagtgaggactaacataacttttcctgtaactgtgtttgaaatatatcttcagataatctgtctggtaaggttgcttcaaacctgagtaaaccaatgcctacttgactgtgcattcttagggaacaaaagaaagtgcattgtgtctataacttcacatgtaagtgcacatatgtatttaggattaaagaagctctaatcttcagaaggtaggcttcagtcagagagtgaagagcagggaaaagttttaagtggcatgataaaatcatccacataccacaggaagaggctaagctaatacaatagatagctagaaagagggaaaggcacaaaggaaaaatgcaatatgtgttataatcctgtggaaggcaaattctgaatattgcctttcttttgagaccacagtaatgattttacatgtaattgagctgaccatttttgagctactaaagagtaaaagttatgctctgttctggtaaaagaaaaaaaataaatgacattttctttgatatataaacaacagtaattactattctaggctattgagtttatttaggatatatatatatatacactcatatatatataggatatatatataggatatatatatatacacactcatgtatatatatatacactcgtatatatatatatacatacacacacacatatacacatacatacacatatgtacacacacaccttctggttttagcgtaggatgtagaaagctgtaaagaacattgttcatacccttataataacaacacaaaatctggagaaaattcaaattcacaatttttctttaaccatcagagagttaaagtcacacggcaaccaactaacctgtacataagtaaagatagatactgacaaggtgagaccagttgtagcagacacagccagaacatagaattttgcaaaaacaacaacaacaacaaaaaggttaatgaatcaatgagtcaagtgtgagataggaaggaaatataaatatggtgagaatttgcacctgcttacaggctctttatagacctcactgaatgctcacataaaaataatagcaagattcctgagaagctgtcccttgtgctaaaggcttgaagaagggaacaacagctactgcaagaaaggcacaaaactctattctgttgcttccttcctttatccattcaaaacaaaagcctaaaatgcaggggaaagagcaacaacacagtcactcttaggaccctggtgaaaatccattgcagctaggggaagggagcagaaaaagatcatttattcttgggacagatacaaaaatacatgatgggcctagaaccacaggtggaggagaggctgtagtactgagaaggccacatcagtgacagccaggaacgtagtgcctgctttaagacttagagttgatcagagaaagagagaatgcctcccttcttgttttatagactaataacgattgagtcataaataacaatgggatatgactaggaaagtcacaagagtgtggaaagagattttctctgaaacacagtgcaaaggagagacctaaagccaaaggagggacttacatcaggaaaaaccctatgacaaaccagtcactattctaaatgcaaggtactgttagagaaaatttaagcttgggggtaaccatagcaacaataacaaacccagctcaacacctgcctttattgacctagactcccacactaaaggcttcatagaaggaaaagcatgctcatttctgggcatacagctgatttattaaagtctataatgtcctacataaaatgtctgctttccacagaatttctggggcattcagagaagcaagagaaagcaaagcactgcctagtgataaaagaatcaacagaatcagattcagatattatgaagatattggaactattaacaaggggaattaaaataattacaattattgtgttaaatattttaatggaagagtttgacagcatgaaagaacagatgtctaattactgagttagagctgtaagaatgaattgagtggaaattcaattcattaaaagctcagtaacagagatgaggaatgcctgtgatggtctcatctgtaaactcaacacagccaaggagagaattatgaacttgaagagagaggtcaatagaaattgcccaactgaaacacaaaaggaaaaaaatatgtggtgggattatgggatgggggaagaacattaaggagctgtggaaaaatatcaagtcatctaatttatttgtaattgaaatcccaatggaagaagagagaaaacaataaagaagaaatgtttgagaaaaatggccacaaattttctaaaataatggcacataccaaattatagatccaagaagcttaaagaacaaacagataaaaaacaataacaacaacaaaacacaatcaggcatattatattcaaaatgtagaaaatcagacaagaaaaagtctgaaggtaatctgaagagggagaaatacatgctatctacaaagaaacaaagacaggattatagtagacttctcatcaggtactctgtaagctatgaagtggcatctttaaagttttgagagggataaactaacaagctagctacaaaacattctatagtcagtaactatatcatccaaaaatggaagggaaattgaagtttttctcagacaaataaatactgagaaacgtattgccagcaaacctgcactatgagaaatgttaagggaagaaattaacactgggagtggaatgaatgaaatgaaaactttgctttaaaaatatttacataaatatctgtgctatatttatatataatttatgacatgttgtgatttaatgtgtggccttatttaaattatatttgctgctaagatattaccaaaatgaccatattcccagtgtttttgtagtttatgcctctaacctctacagtagctgtcttgcagacatttctttttatttgtgtatatgtgtacatttatctgtcaatacagttttataatatattaaaagttaatgatgaaacagaaaatatgcacccagtatggtacagaggagaggcaggaaccaatactgaactattaaaatatgaatgatctagtacttcttttactatcccatacctctatacctcaatgattatagtatgtatttcatgttgttacagttttgtcttaccaaaattaacatattctttttctatagaaaacatattcaaatgtttgaactgtttgaaactcaacattaattttacattgtcatatgtgctaactaaacttttcattactcaaagaacatttgcctattatgaaattattctaaaacagaataacatttaaagattgaaaattgaataaataaatttaatagataagacatgttgtgggctaatcctaaaacaaaataaaagaatgtcttgattttatattttccttttaaataattaatgagctaactagtaaattaagttaccatttttaataattaggaataatcagaatactctcttagaactttgactttttgattattaaattagcacctcttattaaaatcaattttttcttttatatatattattttataaatattttacctttcacagtattaataaatatctgtaagcacccaagacggtgctggcgttattaaagtgttggatccttccttattaaagcttgcagataggtaataagatcactgataacataaattaaagtcaagattaaggcaacatattgaagaaatgtattagtaaatataatttagatttagcagttagggcccattgatatcatggattttgagggtaaatttaatttgatctgttattacttttctagaatgtgtaaaatgtttcaaaggctctgtatttgttagttctcgcactgctacgaagaaacacccgagactggggaatttataaagaaaagaggtttaattggctcatggttgtacaaaccgtacaggaagcatgatgctagcatctgctgggcttctggggattcctcaggaaacttacagtcacgacagaagcaaagggggcgcacacatatcacatggctggagcaggagcaagagagagaagggaggtgccaaagagttttaaacagccagatctcatgaagaactcgcttgctatcacgagaacagcaccaaggggacggtgctaaaccattcactagaaagtgcccctatgattcagtcccctcccaccaggccccacctccaacagtggggattacaatttgccatgggatttggcggggacacagattcaaagcatgtgaggctctgagtaaagaaaagcatgagaaattgccatgagctgacaatacataattgtaaatgttcctagagattcttgattccagtccatccacatcacagataaattattgaaagattaattggtttacccaacatccaagactttgtgataaacgcagacttctaactcatttgtcccatttttttcttccaaggttgttttctttaatatttctgttaaagcatcatgtcctcttccccctaaatttggaaagttttcctctatcaaactagcaagcgatgcctgagtaactcttgaaaggcgaatagaagttagttgttgaatgtgaacaagagcaagtccaggagcatgtggaaggcctggcagaacccagaacacagcttgtttgaggagctgtatgtacatggtccacagagctagagaactgggtatttgtacaactgaaagattcccttgcagtgtgtgaaaaagacagtgtctgttataaatcaaacaaaattcatgaatattgctgttatttctcttgtttgaataagctttgtatcattttaaggcaaaagacactgaatttttattaaaattcagggttctgttttttttaagttgtccaaaattatgttcaaataatttgaacttaattatgcttacgctagattactcagacaacccaaaataagctattttaagtccattcttcaatttgtttgtgaaatgaggtaaatattacttatgatctaatctttatatcaaataattagatataattggaaataaatatagataatttttgttttgttttgctttgcttcttaaagaacaagcagatcagggacttcaactcattgcagaagtctgatatgaatggcaagcccttaaattgtagctgtattaggcctcaatgtattacaatatgtaaagaaagaaggcatccatcagaagtggagcatttaagaatcattaaaacagagcaaaaataaattttaaaaaagtcaggaggtgaatcatttttatttattgtggaaatgaaggtattggttaactgagctcaatgcttgagtatccacttgtctatactattccatgctccatatgtacccctctcattatgatctgttatctcctctcccatatgacatctacagagagaatataaggctgggacctgggacccttaagtatacggttccttcagcagtgacaattcagattagaaactgataaattaacattgaattttagacatctttcacatgaacttgtttagataagcctgtctataaaaaataatttgcctgtttttaaatttgaaaagaataaatgtaaaatctggagacaaaaaaaatgcactgagatcagatttcatgggagaccctcacaggaacattccttagagttcctttcccactcagcaccatccactacaacccttgttgtaccggccaactgtcatttagaatcacgtgtacatatataaatagatcttttattttcttaatgtctgtcgtttgggtatttatagcatttggaaactcggtacacatagatgtacagcaaccacttaattgagggtcttttgttattatcaatgttgtaaaatttaacttgaacagattaaggtaagtccttctattaagagtctttttctaatgtattatttttatgcataaaatgtaaattagtacaccaaatgaataacatgttatttgtttaccactgcttttgtttcaattgacatgggaaaggaaaataaatcatcccttataagtaaatatgcattgaacattgaggttattctataaaaacttgttggtgagaatgcattcaatgcacgttttgaagtagttctacattttattctgtatgtctttttaaaattttgttttctgcaagatgttgtttaagttagaaagtgggatctatggtgatttttttttaacttttatttattataaaccagagaatgagtttctttgttctcatgtcaaggaatagccaaaagaggcaaaacattaaaaagaatagcaaaagatattatgtggtcaggctgtcaagtttaaaagcctttaaaaattacattatatttgtttgatctgcaaaaatttaaggctataattgcttttcaagttatgtactctgaaagctttcctctggcctttcaggagttaagagcttagagtcttccttttcatcctccccagccctctttttttttattccttcattctacatttcatgttgaggtcgctcatttattgtgggtagctgtaatggaatggtcaagaagtcaagcattcagggaagaaaatgaaaattgtgtgtctgacttcttgatattacaagtaatttaaatttcttaaagaaactatagttccttaataatatttgctgcatttagttgaatttttatgatactcatttctaaatcatcagcaatatagaaatatatgtgaaaatttccttttaatgggttatagtttgtgcaaacttgtacaaattatatgtgtacaccttactaacagaagcatgttttggacaagatcatttgggaaattctagtggagacttaatacgttatttaatcttcctgatagatccgaaaagtgaaaccttgtcccattttaaaataatatgtcgaactctcttattgactatctgcttgtcttagtttcctaggcctgcctaacaagttaccacaaactcagtggcttaaaacaacacaaatacattctcttctggaggcctgaaatgcaaaatcaggatggcaacagggtttgttccttctggaggtttgaaggagagtctgttttgagcccatctgttagctctagaggctgtcaggggttcctgatgtttcttggcttgtgaacactactctagtctctccccctgtttccgcatggctcttcctgtgtatacctccaacttcccttgtttttaatttcataaactcattggatttaggattcatccaagataatctcatcttatctaaacatccttagcctaattacattgtacagatcctattttcaaatgagtccaactaaggtatcaagggctccaagttgtacatatattttgggagtgtgtattcagcatgctacagacagagtacaatgccagagtcagaattcaaatttcttttcctgactttattgcacaaattattttcattgttctactccaactcaataacaacaaatatggttcaggtatcatattaggtagaagacgatactcttaacaagatgactaaaacacagttcttgccttaggtgcttgcttacacagtagtggaatatggcaaaccctttaatttccaaaaagctagcaatgttatctcaatataatgacagtgagaaaatatgatttaagctatctaatgaaatatatgaccaatactacctttttggttagagatttttctgtattgtttataattttgaaaatggcaaaatgaaataattcaagtaaatgcagtggatcttagtttttataggatataaatagaattacaaatttcttcttgtatcagaaagtgagatagacaaaatatacaagaaattaatttttaaagaaatacagtattgtttgtaaagaggcaaaatttttactacagttagtctccaaaaataccataaagattttgagtacaaaatttattagaaagtaagtctgttatctaaatggttatatatttttttctgaagaaacgttaatatttaattactgaaatatgggaaagtaaatattttgaaaaattaaaatatcaattttattattttacaaagatcatgaacaattattttagaaaacatagaaatctgagagttataaagatgtatttatattcatgcatatgtgatattgcataatgcatacaaagagaaacctctaggtttgtttgttctggttgttgctctttttgtcattattctagagaagagtggctcatgatgatagcacatcacagttttcctatttgctctttggtgttacgcatcataccatgaatcagcctcctgtgtttttatgtatgtctcagtaatttgatataaatagctgttttaaaagccatttgagtatattttgtattaggatattttatgcagaaaaaaatacaaattaaaacaaaaaatctttaacctagggactttatagtaactaaataaagatgtatgccttctataagtatagcggtctatcaaagtatttccatgataatgtggctttttgaaatgaaatattgaagtcattcctcaaaatcttaatttgaaatcagatttgaagtcacacaaattttcaggtagtttgtctcaagtctgagtgtataatgcctttctaaaacaaagtaatcataagtgaagtgtatacaaagtacaaatggttttgggtaactaagattaacaaagaatgtggcttaagtttctggcagccaaaaaaagagaaagctcattttattagaaaaagctttctaagtttttccatagaacaccactcccttagaaacataaccttaaagggagggagaagaagttagaatcaaatcactttggggaatcccatatactataatttttccctcctagagacttacagtgtataaaagcatagtaaagtcttcatatttttctggtgtaaacagaagtgtctaacattatatatatatatatatgtatatatatatatatatattttaattaaatatacagttatctgtataattatagatatagatataaaaataacaatataactatagatgctttatatgttaatatatagttaacatatagttatgtgtataatagttgaatatataggtatatatagttgtgtgtatatatataagtatgtaagataaatatatatgtacttcttcccaaatagtatcatctcttttattttaagaactttaaatactatcccagacaatttcaattcaatgtattctatacattgtaaatcactgacaaggttagagggaatttattaccagactgggattttttaaaatctaccaaaaaccacaaataatgacacagtatgcaagtttatttactgcacccatcttttttacttagcacagtttttaaaaaggaatttttatctggtttctttttcaaattataatgaatattatattttttaaaaaatacatcaaaatgttgtgaagattttgggttaaaaaaaaacaggacaagatattgccagcaatccttaaagaggactagtggttgctatagagatgagtgtatcccaggcagaagacaaaattaagcaaagaatgtaaaggaatgttcagggttaaatgaggcttggaaagtaagttttggttaggcagtgaagagtcttggctaaagagtgtatatcctctgagaaatttcttagcatttcattttacctttttcttctcctctcttttaataaacttatgttatgtttgtaaaaaagacagatacattttaaaaacaggctgcagaaacagcaagagcaggatagcagtaaacagtttccccaaagaaaaaagtaaaaagccaagaatgttctgctcacctgaggagaatggatgcttgtgtgtgtgtgtgtgtgtatgtgtgtgtgtgtgtgtgtgtgtgtgtgtgtgtgtgtgttagggagacagatgtggataaggagggagaaaaaatcttctagtatgatgagagtaggtgagataattgtatatgaagtaaaagatttagatttctgagtttaatattttgtagaataagcaatttcagacaatgacaggatccaggttgcacccatgggcatggaagactgaatgaagtagggccaaaagtcacacaagggaaaagttcaaggttagactggaaaataggaggtaaaatcacctagatgacagcaggaattgccaaaggatagaaaacttttgatcatgtggtgaaattctcaatagaaataaggacagtatgtaagcagacagccaaccaacaaatgaaaaaaggaaaataccatgtataaaggaaaaaccattttaaaggagaattggggtacttgaggaaaagtggtaaaaacagtattttttgaataagcagtttgtagccacaatgatgttaaatctagagcctgaccttgaaagacgtgcatgagaattgcatggatgtggataaaatagataaaaatttgttcacttaattaggaaactcaaggaattcacaaagcataataataggtagtgttaagaaggaaaaaatcctacatggagaagcataagtagggaactgatgaatttgatgttgaatgaaaatggctgggatgacaaataataaagagttttactattaactgtgattatgagatacagtaaaggggctatcaagtagaaataagtattagaaaagtggatcagtcagatttccgtgcaagtattagatactacttaaattggaaattacaaaattgttggaagtgctgctgaattggaaatcaggacacctgtcattgttcattcttgccaccacaggcaagatgcagttgctggaagctgcagaaaaccactgtgaacatcacagctgcccagagctcaaatgaccacatagcagaatatgatgccgtatgtgggagcctatgtgtcagccaccattcctgctaaaggaggcctgcccttggccttttgccttccttttaccttcaaaattttatttcatccttggcagagtctaaaacacatgctgtactctgatggcaagggaaaatggtgaatgtggtttccaggattcaggccaattcaaaaaagcacttagaacatacaagagcgtgggaatggagactaactaagaagggcaaaatatttatgaaagtaagagtaaaaatatcataggaaaaaaaccttctttacagttttaagttaaactttggcaagttcttttgttgagcatggaggcatcctggcctgtaagactacaatatgtagtcctaatatacagaaccaaataaacagagagatcacagacaaacttaatgctctcacatattaccagcttttacaaaatcctccacaagtgctgggtaatagctgactacatagttcccaaaacccaaaagggggaaaatcaaccatatgttttagcacagtggttctctaagtgtggtgtctagacgagcagcagcaccagcagcagcagcatctgtgaactggtgagaaaggcaaatactttggacctctacccagacctactaaataaaaaatgttgtgggtggggttctgcattctatgtttaacaggctatgttaaacattctatgtttatacatgctagagtttgtgaaccactgctttaaataaaagaacagtggttataggcatatattaaaatattaaatattatggtaaaatttaagctccataatgcccttttaagagtgaggcagacacaaatttgatgagattacactgaattaaagcatacttgtttttcttaatatgctacatttgtgaggtacaaatggtatatctgtggatttttaagttaaactgtcttttaaaaaaatgcaaacattatctcacttgagaaattattgtttgacttcatttactaaaggcccaactatacctttttggtagtcaaaataataatagccgacattcatctagtacttgcaatatgtcaaggacttatctgtgcatcatacttacactaatttatttagtacttacctatgggatagttgtcagtattattatcatcccctttttttgcagatgaaaaagtagaggtagtgacaactgagatttcaaagctaactagtttgattccagtcttttatttggtaccagccatacagcgtaaataagaaaatagtactacaaggatatttccatactctatgcatctttctaacaaataaaaactgattttttatatgcatgtgcaaaattgacaaatggtacctttctgtaaaagtcacaataaaaaattttagcagggactttttctacctgaaagttttttttttttttaaatacatatattagtcctcataatgttgttaaatgctgttactaagttaaaattggctttaaaatcatactgccataaataatttttgctttaaatgaacgacttgctactctgatatctaatttctagtggaagacaccgtgcgagaagtaaaagagaaacacacacaaaaaaacaaaacattgccaagttagcagctcggaattatgttttaccttagtgtggcttccacctcttttgaagtaatgggccattttgttgccttgactttggagtacttttcagactcaggaagtcaataatccttttggaagagagaattaatgagtctttcagtgtaaccaatttcagggatatcagggaggcctgttataaaattattacaagcaatatttatatgatcacatatatgaactataattatttgcaattttatgtttctgttatctgctgtgggaacagctttttgataatgggaattttataaaaatggtttattaaaatgtctagttttggtatctactcattattttagatgaattacaactctgaataagactcgaaggcaccatttcttagtgccaaggaaataaaagtaatgtgtgttcatggcagtgaaaatgaagccactatcagtactgttagggaaatatataaaagagttaattgctttcagaggctgagacatatgcctcaggtagatactaatttaatgttcttccttaaaatatagtcaattattcaaacacaacaactaaattactccaatattttaaaaatgatttccaccagtccatatttggagggatactatttaaaaatacattttatttcatatatcaccaagaaaggtgatatttttaggatacttctgaaagattttaactaagtactgctggcaactgaaaaaaaatgggagaagttataattggtgttaagaagtaaagttgattattatgagaaatgtttatcgccaaagagaattttcaaaattatataacatgaatgatatatgatatatttgataactaggttagcattaagcctctttgattcaaactgtgttccaaccagtgtttcagatacattccagaagtttacttttacctttgattgtaaaggtagtttttaaagggtgagtcattagggaggtttttaaaaatatacagttgctactcactttatcctaaaaggaaaggaagattaaatttagctgagaggaaatacttttacattatattctcagtaatactagggcaagatggctttgcgtggcatttgtacattatgcatacataatatgcacaatttacagatgggtattgataaatatactattactggataatgaaatgaaaagtaaaagttatgcagagtatgggagaaggtcataattgtctgattaccacacagttgcatgggttctttatagatattctccttttatataaacagtatgtgtattttaattaatacattgtctactgaaataatagaaaatctacctttacttctgaatttataatcataactcagctttaaaacaattgcaatattaaaaaggagaattaatacatggattatctactataacatgactgtcatatattccaagtggaaaaaaatgtgttcacctaataagcattttgatgctgagtttatacaaagtaaattgtttctcattataggtgtgtttaggtggagtcattatttgcctctctgtctatgtatatataaaatatagtatatatatatatatatgtacaaaatagaacagagggatatattaagtaagaactttgtgctcccttgtggtttaacaactgatatgtttttctctatgcaaacctatgtcctttaatggcagttatcttcacttttcgggttgctactttttagagaaagtcacattcaccaatggataagaatcattttaaaacaaagcaccaaggtttagatcgtagcacatccaccaccacaacaaaaagaaatagaaagtaaattaagccaccaacaatgatgaggcaaacagggctctgtgaatggtgaaaatcaatgaggtcaaaatggaccactttcttctcattgatttttctcttttgcttgtttcttggagctggattcaattactcagttactctatgtccttccttcctttcttctttccttctttccttccttccttccttcgtttatttcctttttcccttgtttatttctttcttaaatggtgctctgacacatattgcttaataataactcagttccaacaaaggacaataatgtccctgtgaaaatcaaatttgaatcaccagtactgacctcttcccaaactctaggcatatattgaactgccacactgatatcttcatttgcatttagatgcaatcatctaaaatgcatggtggtcaaaataaaatcctcacttctgacctttgaatatattcctctgcatggtttgccttggtaaatagctacctgttttcacgccaagagatctaggaaaactctctggttcctctttttctcttcactgcaacgttgttttaagcagcaaatcttgttagctctactttcaaaagacattctcagtccttccacttctgtttatttctactgcatctactttcatccaaggcaaaaccattttttttctataatcacttcttgactgatcatctatttttgactcttggtttcctccagatcaaatcttcacaggacaggggcattatatttttaaaacataaatcagatcagataagccttctacataaactctctctatttgaaattctcctatggcttatttattgtgatataaatccaaacttctcaccatggcttaaaaggccttattattctagtgtggcctttattacttctctgacttccagccactttcccttttctctgccatcacatccttccacactagactgattcctaaactttcttatcccttaaaactttatatctgctattctctatgcctgtaatttttttcccctagatcttttttttttttgtcatttgtaaatcggtgcaaattttatagtttattttttcacagcatttatcaatatctgaaattatgttattaaattatctaatttttgacgttttgccctaactagggtataaactcaatgacaacaaggactttttctggtttactcatcaccgtatattcaatgccacaagagtgtctagcacttagcaatcactcagtaatgaccacttgaataaatagccataaatttatcaataaaaaagtttgaagtaagtactgtcagtcatgccagatgttgtgggaggacataaaatgatcccagtagtctagttcatgttaagaatgatgcccagtcacctgatgcatgacaagatacaagtgatttattagggactttcaaaatgcctacctgaaagcagtcttatgaagttaaattgataagttcagtcattgctattgcctcagggatacatgatggtgggtgttaagccaatcttatattaaagaattttctaaaaaatccatgtcacagccacaaagagcctaaggaaacctgacaagtaaatgtaatgtagtattttggatggaatactggaacataggcaaaaagtaaggaaatctaaataaattatgaactttagttactagtaatgaatcaatgttggttccttacttctaaaaattgtaccatataggccaggcacagttgttcacacttgtaatcccagcactttgggaggctgaagtgggaggatcacttgagtccaggagttcaagaccggccttggcaacatagcaagaccccatctctacaaaaagaataataataataataattagctaggtgcagtggtgcatgcctgtaatccaggttactggagatgctgaggtgggaggatcacctgagtctgggaggtcaaggttgcagtgagctgtgatcctgccactgcgctccaacctggacaatggactgagatcctgtctccaaaaacaaacaaacaacaacaacaaaacaacaaaactaaaactaactacccaggataaaataaaaattgtatcatgtaaatataaacagttaataagggaaactgtggagcagggtgggaggatatatagagtctaatacagatctgaaaatatagtctgttaattaaataatatatattattcacacatttgttgagaaaagccttaagggaaagaaaaaatgttcccttataaatattgtggtagcacccttcctgagtcaattgcattctatattaaaccatcttttgctattttaactgaaggaaaaatttactagtgatcttgccgactaaattgcatatttcaaaatccttaatgttctaaaaaacttttattgatggcaactctctggaaatagtgaattaaaatgaaattcaaaattttattgaaagctagttgattaaatagaactgtttaaaagataacaaaaccacaaaaaaatctataattttagtattatgtttatttacatttaaaggaaaggtttaatttggtaaatattaggtttaataagaatgcaaggcaattgccttaaattttcctttctattgagttattttttgatacattagttaactttgtcaggctaatttaaattatctgccataatatgcatgtctatagtctgtgaggtttatcccttgactcatcattttatacactgagatcatcaaaaatatcttaccttagcgacccaatattagttccaggacttagtaatctactttaatttgcacattttcacacatcacatacgttcctcttttataatggagggcagccagaatttaattagatcgcagagttcacaccacaggatatactgtcctttaattagtagcatatattgtttcagatgcttacttggacacactgttaacactatgaatgaatcacaatacaatccccgaatgttaatggaaacatatgtatttattattttattgttttcatttataaaactacgtatgccttctaagtgattagggagatattaaaagaatgttacttaaattaaatatcttctagaactaatactaaagtagaaaattcaattatatggtgaatcatatgtttttcttatttccgtagaaagcagggcaaaattttctcaccctcttccttttaaactagattatttttctttgtcacagccaggcatcatgcttgatttacctttaatgctatataaaacatctgaaacctcaaacacataggaataatttgaatcttttcattctccctaagaaaaaattaacagacagctcatatgatttctatctcagtgtatgtcttatttttcatgatcaaattacttcttttcaagttattagattgtttatagaatcattcaaaagtttgtttttacttgtaaaaaaggctatcacaatttaacatttcattcattttataaaatgcaaaaaaaagaattttacaattgaagcccctgaacattcctgtaaccaaaataaaatgactataacagtaaatgggatccatttggtatgcaaaatatttgtagaaaagttcaaaagccattatttgcaattgtaaggtgcagaaattttttttataaaatatgtatctttgcatgtctcaacttggaattaattgtaaagcatgaaaacacaaataacttgagacaacattacataggaaaggctataaaatgtaatcaatattttggacattgtgtaaaatacttcccacactgtaattaatgattgattcatacatttcatttatttttggtcttctgctcataaattatttgaaagtagaccaattgaattattttctgtttttgtcagtgtgtatgtatgtgtgtgtgtgtgtgtgcatgtgtgtattagtctgttctcatgctgctaataaatacctacccaagagtgggtaatttataaagaaaaagaggttcaatggactcatagttccacatgactggggaggcctcacaatcatggcagaaggcgaaggaggagcaaggcgcctcttacacggcagcaggcagaagagcgtgttcaggggaactgccatttataaaaccgtcagatcttgtgagaccccccctcactatcacgagaacagcatgggagaacatgcccccatgattcagttatctcccaccaggtccctctcataacacatgggaattatgggagctacaattcaagatgagatttgtttgggtggggacacaaccaaaccatatcagtgtgtttgtgtgtgtgtgtgtgtgtgtgtgtgtgtgtgtgtgtatacgaaaaaaatccataacagaaatttttttcatgaacatcattgccaacctttcatatatgattactttttcttttctttgtttcatagagaagtcaaatttaagagttatcagctacattaatacttccttccagagtagtaggaaaaggtgaaggcatgagaagaaaaaatcctcatatgtttatttgtttcaaatgcttggatcatatttgaagacttaaattgctttagctttttgttttggtttgctttggctttctctaaaacagattcttcttctgaaaaaaatataaagaattagtacattctgcttgtttttaagcatttgctttttgaaagcataagaaagtaaatagcaaatgttttcctcagtgattctttttaaacctctatacttgtcagcttcccttttactagcatataccaatagtaaaagtgtcatctgtaagcagaagctcctcatcttaatacctaaacacgttaattctttattcatgagtatattctttaaggaagtctgaaacttggttcattcaaagctggaaagaaaaaaatcaagatgattgtctaattctaaaatatttgtcaacattttactatatttcaatgttttagaaatattttaatgttccactgttctcacaatgaagtgtaagcatgccattttccaagtaacagagatacaaattgaccacagctattaatttaggttaactgttaaatcaacttttacaaaacttttagttaggcaagtcattttattccttttgttttttttctgctgcactctgaggaaggtgtctgactttttattaaaggcacataatgactgagatgctggtgtcatctaaagaacattcagataatttgtaatagtaattagaagagactacaattattcttggttgaaatactttagggctaaagatttttctttagggtatgatgttttataagatatcaaaatttcattcttaagtatcacaacaatctatgatttttcaaatgaacatgattttaggtacccaatgatttttgaaagagttgtggttatatccattatgtattaactcttaataaaatatttctgtgttttcatagaatatatccccatataacctctctgtgtagtaatttttcatgaagaaaagttatgaaacaataaaaaaaaggattctgaacagatctaatatataactgtctttgtaatcctctctagtcttatcttgctatttcctttcaagaactttttctatgatgcttttttttctttagtccctagagaattattttctaactcattatttgagttttttagcccaatatcattatactattaaattttaagcaaattgttacagctgtaagcaaatttttacaactgtaagcaaattgtaagcaagtttattttccctgcaacttggtatacttataccatggctgacgttttttcagatgaaacattttgccaagcaggttatatgttgtggtaaaagaatggcacaacttacaatgagtaagaagaaagtgaaacaatcttgtgtctactggaacctgaaagaccttttccttgagagaatagaaaagaacagttccttgctgaagggaaacaaagaaaacagtataactgcttaaatagaaaccataagaagttcttttggtacaatatcatttgaattgtaattgttgctgactttagtattgttctgaactttaaattcatcaagagtgctattaaaaatattggtcatttatacccgttttaatgggtccatgaagcaatgatatgctataatgctttctgtctttaaatggcccattagagtacactgtaatcttatgttttcctcatgatctgagagctacgaaatgctttagccaaggatattttatgcatctgggtgttaaacactctacttgtagatattagttcccttcactgctaaaattttggaaaataatcatcccaccccaaatctaagtttattttattcttatttccaaaaaggcatcttctttggatgggtatgcacacatttgaaagtgtagatgaacgcaaagagattttataccactgcactgttcatgtcctgtatggcttgctgtttactgaactgtggcctcttcatttatattttggtgagtgtttcatctcataatgattgataaaatatttacaagtgacagggctgactcttccctgaaggcacaaagaaaaagagtattatgctagacattaaaatgtttaggtacctggatgtactttgaaggaaatgttccataagtggaagcgtttggtgttataatggacctcataaacaaatcactaggtaggagagatttacaaacatttttaaggacattgtcagcaagcggtgttgtctgggcctactaggaactcaggacacagaaagtagaagaatctttgctaaagaacaatgcctgttatgccacatattttcatagaggctatcctttaacaacttatttgctcagtgcattctcagttctgaaaaatgtatccttgctgttgcactagcatgcacatatttggaagtgtacataaacaaaaagtttgggaattactggcccaggacattcaaatcatcattagcctattttttcaaagaatgttaatcaaccatttagtggaatgtagtcaacagtaatgtattgccaagttaatgacaccaaaaatataagggaaatatttgggagccctagattttttttaacacaggagcaaccaaataaatgtataaaacataatttgtaattttctatgactagaaatgaattaagtttacttcttaataaaatggaaaacaattgaaattatttgaatatggtcaaaaagtggttactttttaggctactggcctaaaccctatgggaaagtgagctgcctaccttttttaaggacactttttgtagttgttctcattttcatgctgagttctttcccttgcatattattctaaagtattttctcctcctcttttttaaaaatagcaacatattttcaaatacaaaaagtgagtattttaaatcttgtccgtcctttttagatgattactctattctaattttacaaccacctgtccagacattggagcacatgcagatacctcattggcttactattcttttccttctaatggcaaggctgatatttgttaatacagctatttaaaataaaaccaccaacaacaaattcttcaaggaggccactgatgattctgtaaaaatgtatgtgtgtgtgtgtttgtgtgcatgtgcacgcacgtgctcacatgaatgagctcaagtgggttcctagacagatttcattaaatagaaagaaagagagaaacatacaatccgtttgctagtatactgatgtttgcagaaaacccttatcaaaatttaatgaccctaaaggtggttatcgattttcctttttcttcagacaatatttcatttgtgatattgacttgccacaaatgaatgtttgcttaagacagtgttacatgttatagagcaatactacataaaaggcttgcagctcttgtactctacaaggaacaaccaaggcactcgtagatagcaatggaatgtaaaaccaaagccaacctgtctttttcattcttttcatgtatatataggaatatataagaatttaattttttccttaggtttatgaggaatatcttgccaatgtgaatctggatttggaagaatgatacgttagtgtattagtttcccaggcctgccataacagagggccacaaactgggtggcttaaccaacagcaatttattgtctcagatttctgaaggctagaggtccaagatcaaggtattggcagggccttcctgcctctgaaggctctagggaatgatatattccaggcctctctcttaacatctcatagttactttggcatgtggcagcaattccaatcctcacaatctccttatgtggttgtctctctccaaatttacctttttaataaaaacactagtcatattagagcccacctgctaaagcttagagtggaagcttagctagttttagacactcttatgccacatcccgtgttctgcattccatgattgtggcttgagtccttttaattgcaacattggcctgattggctgccattttattatcgtgccttgaccattgttattccctgccctgctgtgctttcttgcataatgacaatgtcttccctgggccagattggaagaagaattgtcttgggccaaacataaaatacacgaacactaacaatagctgatgagctaaaaccaatgcaaaaaaaaaaaaaaatctcataatgttttaagaaagtttacgaatttttgttgggccacattcaaaattgtctttgtcaagaagaagacaaggatatcttctccttgatgaacatggtcttcccgatgagcatgaccattccagattctctcatttctagctctggtctatctcacttccctctgaattccaagctctaattctggtattagaattaacactccttttttgttctctaccaaaatggagataaattcgctaagggtacatgttcttttgacttaatggagccatgaacccttttttccatcagaaggctgacaggaggtaatagtattgccttgaaataaaagtctaatctgatcttgtcaaatctgtggcccaggacagctttgaatgtggcccaatacaaattcataaactttcttaaaacattctgagactttttttgtgatttttttttagctcatcaggtattgttagtgttagtgtattttatgtgtggtccatgacaattcttccaatgtggcctagggaaaccaaaagattggattcccctggtctaatccattatcatctagaagaaataacttttaaaatagacctgcttatgtataactatttctgattgattaaactatttactgtaactattactttctttaataatactactgctttcatttaactattacatgattcttttgaaatgatgtatttacagaagaagatagggttcatctgacatatgttaaaatcttgtcttaagcatgtggcaatatgtatccctggctaaaaattctttaaccattagctttcaggacttttaagtacctgctaaaaagctgtgcatatgtctgctttatttaataaagtggtctgcaaacttaggtatcaaactttaagttatctgcatttagttattcctactgctattggcaagagctatcaaaattacaatgtttttctcctgccagaaaagtactagagactttttgtttttgttgctaaatgaagacactttgacatagatttttttcctaatagtagatgctaatagagacaatatttttcacaacagcagtaacgacaacaagtttacttatttcattatttcattgaacatgcctattatctttgtgcaaatgttattagaattctgtggtggaagtaaatgtaaccttaatgtatttacctttcagttctttcacccttagtagctgtctgtatttctagtaatttttttaaaaatataatctataaatcataaactgacattgaaacagtgagacttgtctataggtcttaaagccagtgccacatgctcatgtgatgaatttagcttacatatttgcaataccatataggtagaattattagttactgtttcattacaattaatccaggaatgcacatagacatcttttcaataaattttccttttgacaataatgcagagaacatgtttatttaatgaaagcatgggttgttactcaaaaccactattcactttgtcttccattgttgactgttataattctggttagtaactcctgtctaacaggactaatgatttagttttgtaggaatgaaagtgaggaggaaattattctgatttttaaaatatagaaaagctaaaaaacatcaaacatgtgaaaacttccaagatggaaggagctctggctttaagtagtaggttcagtttataacaagtatacaaatttatattgtagtgcatattctagttgcacagtaagtcatctctaaacataataatagtaatatagggctaatcatttagtattactaaaagaatgactagattacaagagttataatatataagataatatgaatttccacaggcagcactgttttattcagcaggacttataggtataaaagaatatcaaggagaaagaggcagagattccaatgtggtggtaagagtgatgagacatgtattaattttgcctggaattaagctgagtaaataatttaagctgtagacatatactgtatatctgtgataggctagacattgcacaggttgctagggatatactggtgaacgaaagttagcatcatccctgctttcatgaaacataccaaccagtggaaaatagtgtttttcaaataccataaaaatgaactccagagtacaaactaaaaaagtgccctcaagaaaaaaaggcataaagcacgcaatacagactggtggactttaaacttggattccatactcactaaaagagtttggaaaattatgtacctcttcacccatgtttaacttgtcatctaaatttttcattgtaagtcgaaatttcttaatgggtccaatgtacattattcaggtgatggatgctgtaaattgcctagtcttaccactgtgcaatctatgcatgtaaaaaaattgcacttgtaccctataaatgtatatacaatttttagaaggagataaataactaaataaattttatagagttgtaaaggctgctgattctagcatgtggtaactcccgtctagtaaaaatgttatagcattctgaaaatcataattatttgatacccctttccaagattaaaaaataagcctgctcttttttaacatttgaaaaatgtatacctttcctttttactctttgagctgatatttgttccatgacattcaaagattttcatccaagtctatacataacacatttttataattatcataccacaaatatgtatgaacattttaaaatctgtcttctcacattcataagacattaagtacttaaacatattttctatgctaacttataaattcaattaatatttttatataattagttataacatattctaattatttattttttggtcttattactagctttttctaagatttttgatgtgttaaatacttttgtctttttgaaaggcttttcacccttggcttccttggcccttctctttgtttgcattctttctatcacttctttctaaagatcttatttggctcctgatccactactaaatttgatttggttcctacttacaaagctgatactctcaagatttcaaaactcttttggagttgtctgttataatcatggcattgactaagtcacatctttctcggttgatgcctgtttaaaatgtaatgttgagccatcagccccttgactcttgtctggccttttgacttgcttaaaccattaaaacgtggcagttgtggcattgcacatggtcctgagccttggcctgaagagacatagtggcttctgcttttgcttcttgggattccaccttgagtccgagttcaccatatgaggaagctagtctggaagatgcaaggccacatggaaaagatgacccagtccaagccccctgacctatgattgaggccattttatacttcccagttctgccaggctggataaagctacagagatgagtccaagtaaacaagggaaataacttcctagacacttcatagaattggaaaatctttgctgtgttaaactactaagtttaaagtggttgtgtagtaacagatgattgatatatacttacattagaaaacctccagatctctatctctttttaccacgttactactgaacaattccctgatgtcctagagatacttcaatgtcaacatcttcaaaacggaattccttatcgtttagcttctctttcctattccataaatcaatgcctatttcatctgcagtttctgccatgtttgagaatggcacatgtacatacccagttatgaaaacaagtggtaaataagttacccaggttgttttattctcccttactgtatcttctcgccaagtgtctatagtcagtgaccatacctcagtaacatatttgtaatcactattcttgcctccatttttgctttgacttggttgctgctttccccatatcttcctcatactttgcactgttcttctgatggcctgtcttcatgtatctagggaaccttataatccttcttttctattcctgcaaatttaacttttctaaaatgcaaactatatgtcataattttactcagttgattagaaaaccaattaagtttaacttaataactcaccattgtctacaaaattaagtgtaacctcttcatcaagacaaggaagactctctctgatgtatcccagactagctctctggcttcctccctctactgcttattatgttgcagccgtgctgaaattactaacatactaacaaaagctttctcctctgtatatactcaagctccccacttttccaagagtgctccctcccttcttcactgccttctaagattctcaagataattgacatttctgggttgttatcttttttaaatctccatcataccaaatatggatatccattgtaggagcaatagctatgtctgattttttatttatgtacatgcctatttccctctattgtagttaagattccctcagaagcagggctccctaaaggtaatgattcaaatacaagtaagtaattttgtaggtaagctaaggatactattgtagaggagtgggaaagtgagagagtgagaaagtcaacaaaatgtgtaaagccagatactactgtgggcaactagagtttagtcctgcaggaaaactctgaacaatagtagaatataagcctcaggattctctctactaggggatgaggaaactgtagtatttatttacccacttcagccaatagatgagggctacttctagatagaaccgtgtgtgcaagtgtgtgtgtgtgtgtgtgtgtgtgtgtgtaagtgtgtaattattcttctggcctctcaggaggcagacaaagagtaatcttttatggcttctgaattggccctcaggaaacgagatgcaaatggaagccagccccatacattcaaatggtatggtcacagagataagagcatggtattaatagaaagcagtacacctccttgtaatatgttatgaacttctttcaggcagagacagtgctgtatttttcattatatttccactgccaaacccagcgcctggccatacattggaaccataaacacagttgttgaatgaataagttataaaatgaaaaatcactgatatcatagtagcttaacactagcatttactgagtattttctataggcaaggcactgttctatgttctttattggcattaattcattgaactgaagtggagcaagaataaacgatttatttatgctagtggaaatctgagaaaaagacacatcaatgagccaatccacttgatcagtaataatttgtaaagcataaggataaaaaattcatctaatactctacatttctaggcaatttcaattatttacaatgaatactacagcatagcagttaagacagtaggcttcataccagactgtcttggtttagttgctagttccacagcttataagccatgtgaccttgggcaagttatctgagttctctgtgaaattagtatcataattgatatggtttggctgtgtccccacccacatctcatcttgaattgtacctcccataatcaccacatgtcatgggaaggagctggtgggaggtaatttaatcataagggtgggttttttcccatgctgttctcatgataatgaataagtctcatgagatctgatggttttacatagggcagtttcactgcccatgccttcttgcctgccgccatgtaggacgtaactttgttcctgctttgctttctgccataattgtgaggcctccccagccatatggaagtgtgagtgcattaaatatctttttatttataaattactcagtcttgagtatgcctttattagcagcgtgagaatgaaataacacagtaatagtttttatattttaggtttatgagggtcatttatattagtaaattcaaagaacatggaacaatgcctggtacatcatgagcactcaataaatatgattactatcagtctttcttagaggagaattaattcatttacaaagactcgaagattgtagaactgtatatccaataataagcaagaactgtgtttgaaatgtgtgtttcatttgtaaaatttctctgatagaattcattcattacttataatggactgcaattgattgtaaagtaggatatacaatgtttattctatgacactaaatacgtacgtcctcttggacatcttgaaattattcttgacccctccatttctctaacacccaacctgtcaggaaatcccttggttctaattctattgctacttgctgggaaaaagccaccaccatctcttcaattagtaaaatattcttctactcctgtctcctatagtctgtccttaacacagtgtgatcttttaaagtgtaagtcatatcatggaaaacctctgctcaaagcatttcaaagacttcctatctccttcagtgtaaaatattttaaaaattcaagctcatagaaataaagagtggaatggtgattgccagaggctggtggcagaagatggaggtgaacggggataaaaggagatgtcactcaaagggtaacatgtttcagttgggcaagaggcataaattgtcatgctatcttacacagcatggtgactacagttaataataatgtattgtaaatttcaaaattgctaaaagagtagattttaaatgttcccaacacagagaaatgataaatgtgtggtgacatgttaattagattgatttaatcattccacaatttatacatatatcacattacattatactccataaatacatataattattatttgacaaacaaaaattaaattaaaaaaagataaagaatgtgtaacccaaccaggcttatcctctgaaatctcttcctaccagtctctcagcaatacattagccagactggcctgtttgctattattccaacacatccctatactataggacctttgaatttttcctccagatatcccgagggctaattttctcacatctttgagatctttattcaaatgtcccttctcagtgaggcaattaccctatttaaaattataagctacaccctccccattctctttcaccttgccccactcttcatatattatggaagggtagggctctctgttttctttactgaagtttgtcagctttgcctggaaaagtacctgaaacacatcttctaagactcaacaaacatttaggaaacaaagtatatacgtgtgtgtgtgtgcgtgtgtgtgtgtgtgcgcatgtgggtgtgggtgcatgcataatctaaggtcttactgaagctcataactgaagtgaactttataatggaaagaaacttaggagagacttttgagaacatgttgaccttggtacctggcaatcctttgaactgcccacttgacacgatgctttcccagaatagcactgaagaataacaagattgagaaggtttcagtcaggcaagtggaacaattgggggcttactgaaaattataatatatacaaaggtagagtgaaagctgctaatgaaaccctgggtgagagcatccagtacacccactgtgctttgctccatttggattgaagagggatgttttgaacttaatgagatggtcctcatttcataggagaagggttgtagtggttttggagaggcagatttttttgtagacagaaagtgaaacatacatttgtcctattggtgcctttaaaatacactcttgctggtcattgtacatggcccatgctctgggtggggagggatttatggagtactctgtatggatgtgaggggcacaaccttagctgcaatatactgagtaaacaaagaaaggactcctgatacttcaatagggaattattttgcaatcaaactggctgagaagtttaggcggtcactgatatttatattttatattctaattgcagtataaagtaaataatttttataagtctgtaaagtttcattattttccaatcagtttttccattaacaattattcagagcatcatcacaacataacttttcctattacctacctactgggcctgaataaataagatattggaaagaactgagtttgagtgaaattcctgggtttacattatgattctgccagttaccaacagtacaacctgggagaaagaaagttttttatagactcaattgtctccatgagcaaaacaaggataatattaaccaaataagattattgtaaggatcaaatcaggacttatgtgaaaacttcaatatcttatggcagctcagtagctaattttctttcttaaaattgtaaatgctactttaaagaatagaataagggagattatctttattcttctctatgtcataactttttatatgttgtttctgtccaaatgtccaaatacagtgaatattgaagttattggttttcttacatcatttactaagttattgagactttactatgttttaggctctactctagatttggaatacacagctgcctttttaacgttctgattgtgcatattccctcattagtttttggttttttgtttttgtttttaaaaatttcatggagaggaaaaaaaatgaggttctgtcacgcatggtcttgaccagagggagtatgccacacaggtagaagatgattttgagatgtttcctgacaatcaggaagataactttaggttcctccagtgtccatttttaatctccagaacttggtaaggaaattaacagatggtaattaagacagacggtatcagcttctggataattttttctaaagggaaaaaaataaaattagatgatgcataagtttacatgaagaatgctaaaaagaatagagtatcaccttcgaagcagaataagttaaaaagcaaaataagttattctcaaaatgtatcattattctcaaataagacgtgatttgaccatgcctcccagagaatgaagtgccaatcttctagtagcaggatgtactattgacttcccggatttggtgataactttatgaaaggaaatctttgttcaccaagagtctatcaccaatccacatgtgctattgtttccaaacaaaaggcaatgttcattatgtgtgaaggtctagccagccctatagagtttgacaaaatgactttggcattccctcatggaactttgttatggataagaaaatggctaaaatatatgaaaaattgctatcctgtgaaagaagtaaagaataagtgtcacaaagaagcaatagttggtgcagaattgcagtttttgacatattaaaaatattaacctacctaatacaaaacccagtctgtgattctcccttctccacttagtcttctgatttccctgtgtgtccctcaggtttctatagcactgggaggcagaagcaccatttgttaatcacctgtcagctgcttctcttatgctctaaagtccctctcacaaggcacagcagaattgaacagccagaaatacagtagttccccctcatctgcatttcactatccaccgtttcacttacttgtggtcacccacaatccaaaatattaaatggaaaattccagaaacaaaccaatcctgagttttaaattgcactacattcagagtagcgcgatgaaatcctgagctgtcctgttccgtctagcctgagatgtgaatcatcctttttgtccagggtattcatgctgtctgtgctacctgccctagccacttagcagctgtcttggttatcagatcagctgtctctgtatcacagtgcttgtattcagatcactgttatttgacttaataatggtcccaaagtgcaagagtagtgatgctggctttgtaaagtgcttcaaatgaaaaggtgaaggttcttggctcataaggaggaaaaaacattcatatgtcaaggttgctaagatctactgtaagaatgactcttctatttatgagaccatgaagaagaaaaaataaattagtgccagttttgcagtcacatcttaaactgccccccagataaaaggcgactactgtatatggctgagacccactgctttaattaggcatgattgtgcataattatagtagacaaatacagtgcaaattaaagaatttttcctaataaaaagactgccttttgttgtgtagctatttataggaaacacctcagcaattaccttgctgttttcattattcatgataacatgtgctgttggttcttaaacttgagtaagaagagtgctgtcatttcctttcaaacagtttgttgagaagactggtttttgtttctggctcactagagtacagtatttaatatttaaatgcactgtaaatgggtactttctgtgcaccagttacaggtgatgacttataaaatgggagggattttcacatttacaaatgaatcacctgttttaataaaaccaggaaagcacagtttcccattcttatctctggttcatctttctgccgcaattgatttttattgcttagtaaatttgccctcttgaaagataataggttcagtctatactataatcaaggtcaattttccatttttagtaataggaaagtgaatgattgaattgtttagtcatgatttttggaatcttgaaagacaaagaaaaccaaaaattaattcagtttgaaattttaaaacaggctttggaatcatgattgttttaccttgtcttatatttcagaattactttcagttgtaacttcttcctgttattttataggtcagccccagggaagttaattaatttgatttgagacccaaaattagttagaataagaggataaacttgattcttattccgtaagtgtttctacgctaaacagtctttttcaattcaggctcaaataggaatgctatgataataacaacttaacactttctcttagtaattttattctgatatctgttttggtgaattacaccactgttaatgctaactatgaatgagagaggacctataatgtgaaatcacttaagaatttatagcttgagcggccaaaatttattccatggcctgcaattgatagaagaaacattttttttagaggctcaatgtccagactagttgggaagtagaaaattccaaaaaggtgccgattgcagcttaacataagcaatcattgatttcttcaaaagcaggagtattgaaaataaacagttttgccttattatttgtagttatgctattcgaagtcagtccatttaacttatttttttattgttcatgaaatactatctttttaaaaactctctttttattaggaaatagatttatttagctttcaacttaaggttttttatttttaaaatgttttataaatgaaatcatgctcacacttagttttccaaatgtactatcttctctgcaagagcagacagaacctttgagcatgcatgccttcccatcctcccagtcttcagtcatgaacatgttcatcctttcctcaaagaagccttccaagctcccttcgatcatttaaatttatattttactctcttatcacaccaagaatttccatagtaaaagttttccttttacaagtacaatatttgtgttattatttgattaacatcagtctttgtcacaaaaatggaattcactaaggataggaaatgttgatttttaccaactgttttatccttaacattttaggataaatcaaggaggattcaaaagaggcactgaatgaatatcggatgaatgaatgaattatttaaaatgccactgaaaacagaaacatttataggaaaaacaatgctttctccaaattgtttgtctttagcagggttaaaaatccactgaattatattgatatgaacaaagcaaaatatacttcactttttatttttaataaatatttttatattctttaagaatctctcccctcactgatctgtcccttgacagagagaggtgagtggctcaatttaattttttcttgtaaattcatcccaattcaataatgtaaacaattgtaactatctgagtctctgtagattttagctcttccccatatcctctttaagttgatgtccaagtgtttaagtcaatatgattttgaaagagaatatatgaaaatttgtgaagaaattgttaataaaacaactacttctaaaagtgatttcaatacagattatactccaaactcctaaagggtgaattccaagtcttgtttttttcacttttttccttttattcaacacaataactagcacatagtagttgctcaataaaatttggttaaatgaatgaattagaaatacattatattaattaaattaaggggaaacatgaacatttaaaagtttctgctgaaaattatgtgtctaaccattattcacaatgtcttttcagtgcatgactttgcttcagtttaaaaaatagatctgaaaatctgatagcttcagtagatatgaggcctagcaaacatgccagatgaataaaagaaaacccaggtagtgtgatcaaattgcaaatctgattgtgttatataagaaaaggggctttttgatcaaatagactgtaaggatagaagtagaaatagagataaagatgttggaatccaaaacagtctttcagtctgatatcagaaaaagtaaagcagtaaagtgaggttctgttttctcttttaagatacagtaagatctgctgagagaggaaagcccaaaatttagttggagaagtgggattaagtatgaataattaatagccaaaccagtaaaagaggaatatccattagacctgagcagaaacatgcgggctggactcattgtagccaacaggaagatacccaaccaggctggaagggcaagatacctggcaatcctgaggacaggtgtttggtgacagtccaggttgccttttcagtgcagataaacagatggtctctgctctcaataggcaaagagcagtggttctcaagctttagtgtgcaacacccagaaagctcattttaaatgcagattcataggactcctccttagaggttctaattccttaggtttaggttatgcctcagaatctatgtttttatctagcacccatggaaattctgatgccctattactttttcaaaaacactgaagtacgaagaaacattagtcttttttcaagtaaattgaacttttgcttatgaatgattacctaaaatgtacataatgacataaatagaactcttgaattatagatattttaggtccttctacacttaggacacatttaagatacataggttaagatatttacctgaatttcaattttgaacgatttttctatagcaaacaaaaaagcagtttatccctcatttaaactttgaacaatctaagaagtctaagttttctttttgtcagaaactcattatggtcagtttaacataagctttctgaacataacaaggaagaccttgctagcgcaatggcctatggatgcatagttccatggggaatttcttgaatggaattcaattttccttagactggaactacttgccacactaaaatcctgcattagaggctaggaaattttctttctgtttctgcatctctgaaatatttcactagaaagcctagattaagcacaattttgtcttttgtattctccgtcattatgtagtggacttttggtaaacattctgaagaaaggcatgcatttgacatacagcgacatctaatttcacttatgataattttgacttcttacagattgttgttaaagctggagatcatcttaaagtaatttaatcaaatcttactttacaatggaaacaatttaggtagagagacatgcctaacataattctgtctaaatcaggactcctgatttatacatataaggttttattttgcatttaactgttctatctccaaaattatagtatttattcttatattatttaataggtttacttttttcataatttggaaaacatcagtctttcgggtctattttatggtaatgtactatttgtcggagtgtcaaaatgacttaattgctaactgtgctcagcaaagtgtttagaagagaattctcgagtgttgtcaacgtcaacgtgcaatacatttgttcacacgagcaaaatgttggtgacaagttttgaaaatgttggatcttttaaatttaaatttctaaagaagttttaaatttttaagcttaaagaaaaatattacatagaacaatattgtattatttaagaatacagtagtttatatttacatatattaacagatgaataacaactataaacctcataggcagtgttatcaattagtgatgtctttggctctgagtaataaacaaacaaaatatgaccctagagttgtttgaataaatacagattttatttcattctagtacaggaaatctgggaatagcaatctagagttaattgagggccttactgaaatcagcaaggtgccggactttttcttaagccttcagtgtagtattgagcatctttggggaactgctggaaaggcatgattatgttttgaaatatgagaaggacatggaatttgggaggggccaagggcagaataatatgatttggctctgtgttcccacccaaatcacatgacgaattgtaatcccctagtgttgaaggtggggcctggtgggaggtgattggatcatgaaggcagatttcccccttattgttctagtgatagtgaatggaaatgcaaaaggccatcggacctgtggggcaaggggcttggggccctaaatagcttggggctaccctttaccaagagggagtaccttatttctaattccacaggtgtcaaatgggttagcagtggtcctctttttctgtcttcttgtttcaccagcatagtaggtggctcttgccattattgtaattagatatggctgttgcacatctaagcctgtgcacatgggtcctaggcaggaagaagaaagaagagttacaaaggcttttttcccaaagaagctttacttggaaaatgaagccatttgacagaaactattgccaatatcttactgttcataagtatgccatgtgtcatctatagatgaaagggagcaaggggtaggcagaagtatttttagctagtacattatgatgctgagaaaacaatcaagagaaggaagggagaatgggtaacagataggcagctagaagaagctgccaagggaataattagatgaagaaggagaccaaatcaacataagctttgggccaaggttaatagcactgcagattttcagcacaaagatcaaatctcagcagcaagattctggtaaaataaaagtctctcctttcatccattgctccttccaatacggcacaaagcttcccagactcagaatttggctgcctgccatatgactaatatgtgaaccaattcacttatcttcacttttatactatttcagttccagtatcaatatgacttcagccttctccatcttcacaacagacaaagaaaaaagagtttggaaagtataattaaatatttataacttacactggtattttctcagaacaaaagattagttttagtttgagaaatgaaaatatttcttcattgattagaactttatgaatcaaattagaaatgaacgtccatcttcaaaattcctagagttttctttgaaagagtagctttgtttttttttttaagttgttaaatttgcttttctgagttttgaattctctaattgctagactgagaatatgtcataaatatgtacatttgtgacattttaataaaatcctgctcagtaaagttacaaaacctagattgattaaattagcacatgtagatcaaaataaaaatgagctcttctttttataaccactgcattattctgttctcacattgctataaagaactacccgagactgggtaatttatgatgaaagaggtttaattgactcacagttctgcaggctgtacagaaagcatgactgggaggcctcaggaaacttacaatcatggcagaaggtgaaggggaagtgagcatgtcttcaggccagagcaggagaaagagagtaaaaggggaagtgctacacaactttatacaaccagatcttgtgagaactcattcactatcactagaacagtaagggggaaatctgccttcatgatccaatcacctcccaccaggccctaccttcaacactgggggataacaattcatcatgtgatttgcgtgggaacacagaaccaaatcatattattctgcccttggcccctcccaaattccatgtccttctcttatttcaaaacacaatcatgcctttccagcagttccccagagtcctaactcattccatcattaagtcaaaagtccatatccaaagtctcatctgacatacagcaagtcccttctgcctatgagcctgtaaaacaaaaaacaagctagttacttccaagatacaatgggggtactggcattggttaaatgctcccattccaaaataaaggaattggccaaaaccaagggtctgcaggccccacccaagtccaaaacccagcagtgcctccattaaatcttaaagcttcaaactaacttcctctgactctatgtctcacatccaggccactctgacacaaaggatggactaccaaggccttgggcagctctgcctctgtggctctggaaggcacagcccatgcagctattttcatggactggcatagagtgcctgcaacagttccaggcacatggtacaagctgttggtggatctatcgttctggggtctagaatatggtggccctcttctcacagcttcactaatcagtgccccagtgggaactctatgtgggggctcgaaccccacatttcccctctgcacttccctagtagagtttctccgtgagggctctacccctgtagcaaacttctgcctggacatccaggtgtttccataatcctctgaaatgtaggtggaggctcccactcctcaactcttgtcttctgtgcacccacaggcccaataccacggggaagccaccaaggcttggggcttacaccctttcaagcaatggttggagctgcaccttggtcccttttagccatggctggagctggagagtctgggatgccaggcaccatgtctcaaggcagcacagagcagcagggccctaagcctggcccatgaaaccatttttccctcctaggcctccaggcctgtgatgggaggggctgccatgaaggtctctgaaatgccctgggggcattttccccattgtcttggcttttaacatttgactcctcttttcttatgcaaatttctgtagttgacttgaatttctcctgagaaaatagctttttattttctatcacatggccaggctgcaaattttccaagcttttatgctctacttcccctttaaatataagttccaaattcaggtcatttctttgtttctgcaaatgagcataggcttttagaagcagccaggccaaatcttacatgcttttgctcctttgagatttgttccagcagataccctaaatcatttctctcaatctcaaagttccacagatctctagagtgaggcacaatgccaccagtctctttgctaaagcataacaagaatgacctttactccagttcccaataagttcctcatctccatctgagaccacctcagcctggacttcattatccatgtaactatcagaattttggtcacaaccattcaacaggtctctagaatgcttcaatcttctcaatttcctgccttcttctgagccttaaaaactgtcctaacttctgcccattacccagttccaaagctgcttccacatttttaggtatctttatagcaagacccaactcctgatttcaattttctgtattagtccattttcacactgctataaagaactaccttagactgggtaatttatgaagaaaagaggtttaattgactcacagttacacaggctgtacaggaaagctgtctgagaggcctcaggaaacttacaatcatggccaaaggtaaaggggaagtaagcacatcctcacatcagagcaggaaagaaagtgtaggaggaagtagtacacatttttaaacaaccagaccttgtgaaaactcactcactatcacaagaacagcaaaggagaagtctgcccccatgatccaatcacttcctaccaggcctcaccttcaacattgcagattacaattcaacaggagagttgagtggggacagacagccaaaccatatcaaccacagaaatattttccgaaccacttggattttagatttcagtaaaacttacctgaattatttgtactcattaattaacagtgaaagtttagttaaattatgtgataaagggaccctataaaataaaataaaacacttttggcacctgggaatgtagacacaatgcatatttattttattttgtatgttattattaaagagttgatatggtttggctgtgtcctcacccaaatatcaccttgaattgtaatgatccccacatgtcaaggatgggaccacgtagagatagttgaatcatggtagcagtttcccccctactgttctcatggtagtgaataggtctcatgagatctgagggatttataagtgggagttcccctgcaaaagctctcttgcctgccgccatgtaagatgtgactttgctcctcatttgccttctgacgtgattgtgaggcctcctcagccatgtggagatgtcagtcaattaaacctctttcctttataaattacccagtctcagttttatctttattagcagaatgagaacagattaatactcttgtattagtataatatcacatagaactctaatttatcttccacacaaaaagagtagttaaaatatctgtgaaaaataatacactgaaatgtaaagggaaaaatattttgaacatattgatcttatatccagcaatgctgctaagcaattttttaaaaatcatcttttctacaaataatgacaactctaatttctgatgctgtgtgttaattttcttttacaatttactaagtagaattcacaataaaatgttaaacagaaataacacaggtacatttttcccatttctgagttcaagggaaatgctgttaaaatattatcattaagtatgagtttcccatattatttagttttatgggtgtgttagtcatgttgggatcccatgactgggtggctttaaacagcatgtatttgtcacagttttggagaacgaaaactccaagatcaaggtgctagcagatcaaggtgccaccagtgtctggtgaggaccctcttcctggttgacagatggctatgttcttgttgtgtcttcacatggcagtgtctaagtcatctctcttgtgtctcttctcattagggcactaatcccatttatgaggactctaccctcatgatctaattacctgccatgaacctcaactttaaatatttcttatgtaaaattgttagtgattcttttgtatttttttactccttgctagagttataatcatgtcctccttttaattcccaatgttatttatatttggcttctctcttttgttgttaaatttttttcccagatatttgctacttttattagtcattttgctttattgctcctcctttatttttcctttcattaacttttgctcttaagagtatgagttttcctctgctgtattctttgggtttattcttctgttttattctaacttcttattttgagtttctacttcattaattttttgcctttacttttttctaatgtaattcttcaagtgtattttacttccctctaagtactgcttttactccacgtacaggttgataagcagtaatttcattatccagagctaagaattttataattgcagaaatgttatttattcagaaatacatttaattttttctcttacttatcttttatggttattgatgcttaggaggtagtagaaaaatgggatggaaattacagagatagattaatattgaaaggaaaaaattgagactaatactcacttagctgatacttcaagtcatggtgcttcaagtcaccgatcactgtggcaaatgtggagtgagaagagagccaagaatgtctcttacagagtcttaggaaattttctatttgtctctttctattttttttccaactaacagtaatttctcttattacccctcaaaaacattaagataaccctttagctgagctaagtgagggcttgtcttccccttgcggaagcaacatccaaatgctgtaaaggctaacttatctggaaatagaaataaaaactcttcattatcttttcagttttccaatttaaaatatccctgttgcaaaacaatcaaggagaccaattgccctggagaagtagtggctcagcttttaggtactttactttctataacaagtatccttcccaatcagtgcaggtttcacttccaaattacagtagtctccccttatctgaggttttgcttttcacggtttaagttatctgtggtcagttgcagtctgaaaatattaaatgtaaagttccacaaataaatatttaataagttttaaattgcatgcagttttgggaagcatgataaattcttgtgctgtctggctttgttcagcctgggacatgaatcatccctttgtccagcttattcataacttataggctaacctgctgttattatacaggaaaaaccatagtgtgtgtagcgttcagtattatccttggtttcagacatccactgggggtcttgaaatgtatccttcaagataagggggaactactgtacatgattcatagaatgttggaaatggaaagtatcttagaaggtatccagtctaacttccttattttatatttaggacaatggcatacagaggagttgaataactcaattttttattgctatttctttaatatccttgtcagatatattttcctcatgtgttacatcccactatggacactttagttttctttaatttttcattttattacttaacatgcaaatctgaccgtcccattgtaattctagacccactcttgctcatgtaagaaacccctaaggtatctgcaagggcttaaaagatctggctccacatcatcttttagcctcatcttgtttcaagcttctactggcttgctgctctgccacagtgacgttttccttcctgacgcttgcctgcttcaagacatttgaccttaccctctttacctttctagttaattcctatttatttttcagatctagaaacttttgaataaaatcttccttaacctccctgactctgtcaagggctttttacaaatttgcataaaataataaacatagaatctccataagatgtgttttgagcgttgattttgcacatttaaaaagatgtcaattgataaatacagtgccccacccactaggcttgtaagctccatcaacacaggataacatatctttatcacaagctgcatgtaacacaacatctgacacaagatatttgttcactaaagagtactgctaggctacacttgaaactaagtaggccaactacaagacctgtatctctcaatagagactctttgcaatatatgaatacttctaaaacaaagctgttttcatcaccatcaaaattaggctgatacatatacatatcacaatgaacttcagcaatttgatgtcaatataaatgaatgataataagacattagattctcattagcttattgaaaacttcctaatttctaaaaatgtactatattggtttatttgacatgcttttcttgtgttgaaatcatttcgaatgctcattaaaaactaatttcaaattataattaatcttattttcagattcaatgttgttattttagaaataatataattatttatagcataattgaaaaattcttaaaacaaaatcatgttttctttggtaatcaaaatataattttcttcttttaatctggaaagcattgcttacattgataatattatccctctcattgtcaacattactggagtgcttacaaaccctgtgggaaaatagatcaaagtggagaaattttagatataaataataaattaacttaagtcccttaggactaggataaatataataataaatacactggaataatggaaaattgtcattaccatctaacaatgctataattatctaggtaccagagtttctagttctttttattttttatatacaatagatacatataataaattccataactttcagataaaaaaaaagggccatttaacttacctcagttgtaaggatttattacagcgctacaaaaggaggtaggaaataaaaggtaagaatattaacagttgtaacatccatcaagatcattagtagctctaataggcaaactacaggtctgtggaacgtaaggagctttgtatactgctaattcagtttatagtaacatcacctttctttctgctgctaaatatccaagtgaaatctgaacctactttttatataaaaaggccttgtcattttccctgtaaagttttaaatagctttatttcttcagggagacattctgccccattaaaaatggccacataagtaacattatttctattatgtataaaagtttattaaattcactgtctcacatgcaacttcagtttcaaaattacttgagatgaacaaacttaactctcatgggagaatgtttctccttgttcttgtgttagatttttatgcttatgagcatctaaacatccattcttgtcacaaaggcaatcttcgcgaaacatctgcagaaacatttggaatgctattgttatgagaggaattgtccaagtgtgcatgtttttataacataccattatggttggattgatagtcctgaaaaaaaagaattctgaatacagtataatgcaccatcttaatcatctaccactgtgtatcagacaaaatgacttgtttatcatagaattcttcaaaactgaaatgtaagttgcttctagatttgcaagtgttatgtcacctgaaacattattcatttgcagtcaacttatttgctgagaaaagcattgtaaactctggcaaggactctagctatctgtaaaacactcttacatttgtacttttaaggcaagaatcatgttgcccatcatattcatttgctatcccttcctctctccattatatagggctaaaacataatgacagattttcattttatgatttatctgcatattgggttgcacctcctacttctgtggaccatggctttcagatatggaagcagaataaagtagaacacctcttctggctgtaatatacaatcacaaatcaataatattaatagtgggaccatgtaaacaatacataaatataactgttttcataattaaaaaatacagtctgtatttgtataatcctgttaaatgtatttatagtttttaaaaaactgattaaagttagtactaagtaggagctgaaatctgataacatgaggtagaaggacatacaaatagcaaaagagcaagacaattacttttttggattgacttatgtctgagtgacataagtcagtgtaattcttacattcaaaacagattaacagtctctcagtttttcaaataattttttcttacaatagaagcaaaagttactgagaagttattaatgtgttttggaaaatggacatcatctatgtattttaccaaaaagcagctaaagagttaaattgaacaatttaaacactttaaaaagttatactaaaaaattcagtgttatttcaaaacatacaaatgtttacataaatggtgtaatgtattgttattccatgagattcttgagatcctaattatgtgataatagcgacaaaatcacaagttttctttgttatacagccaatctgttttacctctctacttatttcttatctaaccaaaactctcttgctcatgccttcttcaaaaccagtgttttattcagcatcatgcacttctctcaacctcgtatgcttcttgaggtatgtgtgtctggatctcattttatatccctaacattttacctaggtgttccctaattcattaaaaagttcattaaaatattcagtaaatatctactctgtatttactatgtgtcaatgtttgacacaatttgcagcgacaggtgaaaagacatgagaaaagcagttgctaccattgtaataaggtagagaaaagaaaacacacactcacacacacacattcactcacacacacagacacacccacacaccctagaaaatctataaaacatggtggtagagaacactttttcctgatcagagaaatctaaatatgtatgcatcacttagcacattttgcaaagggctgtatttgtgcattgttttccacatttaagtgagtaagtgtcatcacctatgatgtcttttctcatgggtgtggacgtctagttgagtgggacagtttccctttccaattgtatgtctatctgtgttggccattctatattaaagccatatctgctatgtgcttcctaaatctgtaaagctcacttggtgaggaagatacatttattcaggtcagtaaaaactaacatgggctgggatttaagaatgaaaaaaaaaaatcttcagtgtttgtgtgttgaattctgcctgaaggttttcttactgaaatgaaataaagcttttaaatgttttttttaattaaaagactactgttattctgagtaaaattaatatctattctttgtaatattgcagaaatgagaataggcatttctgagtggggatttttcagcctggagcctggattctccaggctctttatagattgttcgtgttgtcagccaatggtaaaccagcatctcaagtaagggaggaaaaggttagctaaagctggaaaggagccacagcatgaaactgagggcaaaatgtattttctgtttcctaccccaatccccagtgaacttgcccacgctatcacagactaagcaggatggagaaaggcatacctcctaccctgtccccacatccagacctactttctaactccctaaagcttacctgttccaggaagagaaaacagcgggaagggtggctgtgaaggaaaggagagaggaccagaaagactgagcagggttttactgagctttttctcaatgacatgaattaagtacttcactcattttacttattttattaggagaaataaggcaatgttggagaaagagactgtttttctcacggggagtgcagaggaaattctttcccttttctggacatagaaggggtattataataatatccagaacatgaataaggagagaaaacagagacttctttcagtggagctgataccatgttttataggaaaagtcagggaaatatttcaggtgaagaagatacagcattggggcagtcagatcagtgtgttattgtggaaaatggtggccatttctttagcagcatcatgaaaagacaaatcatgttgactaggattttttttagagttagagacaaaaaaaattgtttatgtgtgctcatcactgtcagtgtggaagagtaatttgagttttgtatacatttacgttttaacaacatgccttacataaagaatcacaaaaccatttttggccataatttactcttcatttgctgcactttatttttctgcttctcttatcatagctttgatcatgaattgtaaagggcaaattcagcaaagccttacttttatataactgctgagaagaaaggaggagggtatatgtacatagtaagaggaaaagttatttaaaattcaattgtaatgatatctgtgtctatgcacattcattaactgttgttgataagagaatctccatctcatcaagctacatttccatacatactgcccagcatagttatatatctgtgttgtttctatgcaccttgcatacataattacatttactctactttgattcagagtatatttgaaaattagaatccatttttaattattgtcagaattttatgagcttcaagtatttaatattctataaagctataaatcctacagaactggtcaataaagtcccttgtctttaagacttaattattaattcacaagaaggtataagcctagtatttgctacgctatgcctttcccttaatacattgctatacttggaggaataatgcatgcaaaacacatctttgataaaatgttccttctatacagtgaagatttcaaacttccactttaggaaatgtagaaaaactaacttttcagaacaaaatacataaagggctcaatgcctaaaatgattgaaattgtcatatatacaaaaataaaacagtctttcagtagtaattggataataaatatgtattgatatttattctaattagagtttattctaatagacttaagaactctctttaattatattttaacaaaaacattacttttatctgattaaaattatctgcctataaaattatagaaacataatgttaaactttactgacctccacatttatgccctcagggaaaataactgttaatttgttaatggttaggtaatatggtactttgtgttgatttgattatgaagtgatatgtataaatacatccccttataatatgtgaatgcatctttttgttaaagatgtaaataaatacaaatgcatatagaataaactaaaatggagtcagtattagacctttttcatataaatgcttacatatttacattgatgacagctcctcaaaagatataacagatgttagtttatccaacagctgctaactatgctaaagtctgcacattttcagaaagagtcaagtttagattactgatgctattgtaatgatttcagaaagggaagttagtctagagaaatttagagacatttaatgagtttatttgaactgaatgcaggttagaatgataatgcttacttataacgcatgaacatccaccataattttctaatataccatatacattagaaccaagtattacacaagagaaccatatttttctgcgttgtggtcaagtcttgcctcatcatcttctgatacaatggctgtatcagtggaataaatcctgttcagttaatctaaattggaatacagattagaacatctggcattttaagaagtgagtctgaatgtgtcacctggttctttccatattgatattccatgcattaggcatcttataaactttggactgcagcttctttacgtaacccttaatgactgtgacctgtttgtctgctgagtctttgaactcatcctgttcctagttcctcttttggagtatttctgggcctgattctggaatctgagctctagccaagtgaacatggataaaacattctctcctgttccccaaggctttttcctctcaactgtagctataacacagaccctttcaagaactagggatattctgtagacactctctgggtgaaactaacatttttatatttattaatatatcagggtttaataataaaagaatttgaattagtcatagtgggacaatcaggacactttaaagatcttatcacgtttaagttttgttactgttacaattttaaattacataaggagagaggtatgtgtggcagtggaagtgggggaaaacagtattttcagtgttttggccccagccttgtaagttcctgactatagctaatgcctttgtccttctcttcttataaaatcccttgagaatagccctgatcagattcaggattacttatccctcttgtatgtgaacactgactctttaggtagataatcgtataatcctgatgagctttttaaatccccctagattgtttgtgcactttctttctctctggcctagacattccaaacagccttgtagccatggctctcctgtcattacattatgacagttattataaaagctgagaatataaaagtggttattaattataaacctgtaaatatatagatgaatcctctgtaggaggcatcatgagaagaatatagcaacataccgtgtaaatcattctatttcagattcttaaggcacatcacaaaagtccaaagaattgtcccttggggcgtgacttctggagttaaggaaacaactctgtaattcttgaagaatcaaagatcaagtgccatcatctaatatttattaggtgagggcaatgaaaaatgaaaataatttaatacatgggttacacaaacaagttgacctgcaaacattataatgcatagatacaacttagaagaaagcacagatttttaaatctcttaaaataagataaacaatatagttaacatactaaagtgcacttaaaatgaaaatttccaagtgacaacatttttcaggtaggaattagaaaacaaattatgcacattaagtaatttacttcacatagatgtggaactcacttatatggcatttcagtatcatgtgggttaaaatttaatagcatatttcccaaaataaagactagaaaactggaatccataaaatttcctggtgatgcccacatgctgatgtagttttctctttaaatatatatatttaaaagcacagaattttttgttttaacaccacgtagcagtctcttgaaatacaggcagtttggccaaagatactgcattcatttgaagaccactgttcctttaccattcaatttctcttctgccttccctatcatatcaagtaatgagttttaaaactatctttttattcttctgacttttggtccaaaatcattgatttacttgatgcttatgaatagtctagcatatagaattgtgcctcaatgctgaaggaattttggtataggaaactccacattacatcaagtaagtatatctttgctttaagaagccttgatgtcctgggaagggaaaactgaaatgaaagataagacaattaagaatggagtctaagtgaattcttagcacttgccatactgccagacactaaatgattgtgtaataaatattatattaaaataatgaatacattaataaagttgaaagattcctatatagttcctctttttatttttgatcacttatgaatctttgtttttgaatcactttttaagtgaaagaaaaaaaaccctatagttactttatccgagttaatatgggggggtagggctgacttaaggctgttggatttagaaataaatagagctctcagtttttgacatctcttcatacttgtagctttgcttttcgctgtgtttgacttcagtctctgcttttgaatggtaacaagatggcagcatcagttgcaacattctacatcctctcagatttcagtaccacttttttctttaccaaaatcttcctcagaataatactcatgatgtacttttggttctggtagggaagatacagctctccccctcttctctgtaggggatacattccaagacccccagtagatgcctgaaagcatagatagtactgaaccctatgtatactattttttttttctttacatgaatacctacgacaaagattaatttaggccaggtgccatggcttatgcctgtaatcccagcactttgggaggctgaagcaggcagatcacgaggtcaggagttcaagaccagcctgatcaacatggtgaaaccccatctctactaaaaatacaaaaattagccaggagtggtggcacgcacctgtaatcccagcaattcagtaggctgaggcaggagaatcgcttgaacccgggaggcagaggttgcagtgagccatgatcacaccactgtactccagcctgggctacagagagagactgtctcaaaaaaaacaaaaaaagattaatttataagtttgccacagtaagagattaacaaccgtatctaataataaaataggataattataacatatattgtattaaaagttatgtgaatgtggtctaattctctcaaaatttcttattgtactacattgtgagtaactgaaacagtagaaagtgaaactacagataaggaagaattactgtctacaccaacaaatcaatcactgtcctgaattaaatatgtgatttccatcaaatgcatttagtagaatgtaaagaagaatttttttccccagagggaaatttggatataattccatgaagaatgaatagaggctagttgacaaaaacatttgctgtagcctttgagaagaatatgtatgactattttgatttatgggcttttttgttaagtaattaagtcttaatagtgtcaggaaattgtgttttcatatgaaaagaagaattgcatattaaatgtctttaatttggtatgtggtgaagttatacatgctatcttctatcatactttgataatatattatagataattacagcttataaatctaatttaatgaagattgtgtggtgtatacatctgtttaattgttagtttggacttctttttgtgattttgattttaggttatctttccattgcctgcacaggaatttctatatcaattcacagtgggcaccacaatatgaaattgtgggaacttcgttaaaatagagccagtgtttctaaatttctttaagtatctctgcctggctttaatattgcatgattaatataaaaaatcatttagcttttgtgagttagtcaggatctattggcctagtttcaaaagttggtctcctgagcataatggacataactgaaactcctgttaagtttttccattttaatgaaaatattaaatgacttgtggagtagcatggcaaatttgctgcccagatctcagaggggcaggctatgatttcattcagctgccttctgctgttttattctcaacatttagaaactttattaaaatgatttcagtcctttgactttgttttcagatcattgctttctaaggtgacttaggtttttattttattttcataattttctctttataattgaaagctacaaaagggcaccatagagaatggaaaataaaaatgcactgattaattctgtggttttgcttttctgaactgtggattgagtaaagcagtgtaatagggtgatatgcttggaactacaaaaagctttggttttagaaaaaagttctaattattagtttcagaatataactaactacaattaacattaaaagtagctttaatggttttctgatagagaaaaaaattgaatacaattgaaaatgcactttaacatttagcatgtgcatttagaataaaatgatagttttttggttgtttgttttgttttgttttttgtttttgagacagggtctcactctgtcatccaggctggagtgcagttgtgccatgtcggctcactgcctccaggttcaagctattctcccaccttagcctcccgaatagctggggctccagacatgcactaccacccctggctaatttttgtattttttggtggaaacagggtttcaccatgttggccagtctggtctcttgacctcaagtgatccgcctgcctcggtcttccgaagtgctgggattataggcatgaaccaccgcacttggcctagaataaaaatgatagttatttagtgcatttcttttacttggaaaatataaagacttttaccaggacttttggcattatgtattttacaaaattattgttaatattttcatgcatctacattaattgctgttatatataaagtaggaaagggcacagagtaagaggaaaggatgcaattaaatctaatcagagggtaaaagtttaaattctgtatttctgtcacctgttttgctgcataaaagtgaataggctaaaaatctaaaaaaataggaaacttcactacactaagcatttgaaatatattgacatttgtaatttttactacagtctataagattgttaaaattatcatacccatttctagatgaagaaggccaaaacccagagaggtttactaagttcacagtgtcccacagttaaatgagtaatagagctagaattcaaacccagatagcctgatctaaagctagacatattagccattactttatatctttaatatggacatagtaaccattactttataaccttagactttttacttagtctttggatactttggtttgtatgtaaagactaagtgctaataccttggaaagtcacaaaaatataaggattggcctactctttttaccaaagtgttaaacatgttgaaatttctcagcatattccatgtgtataataaattaggtactaatttttgtttcttttatttctggcatatcatgttctgtgtattttttcccataaaaacaaagtaaaacaaaagatagggttttcagtgtctcattttgtgttagtaactcagttctatcattgccaacatctaacaagaaattcctgactccaggaacagttttacacatacaacaataaaagtgattccatatgtccttctaaaatgtttcaattacatataggttgtatgcctattgtcaggcataggaatgtatacattccctggtcactttccccactgataaatgcagctttcttttcatttgttttatttggtttctttacagaattatgtgattcatcattttccttgagaacattcatgttaagtcattcaagctttgtgattaattcactcctttaagcaaaaaatttaaagtttattatatttttatatgtaagcaaataaatgacattcccgtactaggaatataaaaaattcagtgaagatactgatttttgaagtggttgaaatctgtgttatataatacattataaatacatgttacaaatttataataaaatatttactgttgcctacatggtagtaacaaggatcccaaataataaagattaacagtttttcctttttgcccaatttcttctgaaatttttcttatcctctattttagaatctggaagaacacttggtacatagtatgtgattaataaaaaattttaaaaatacttaaattttatttaattgtatgatgcaaaaatctttcctcattaacctgaaatgaaattccacattatatgcttgacagctttttctgctttagctacatgttttccctttgctcagaattttaacacaaattgatttgtacatcagaaaatcctttgagcaaaacagtgaaaataaacacactagacaatgacttaccatttaaaaaaatacattttctagagataaaagtaaatctttcttgcactaatctctatgctattatttccaaagtgtgaattcactaagttggattataccagaaatgattgtgggtgctctgaatttaaggaacgtttatttacagaaggagaattaaatttcctttaacagtacctactgtttcttgagatagaatttttaatcaaattttagcgtggagatgatagatctttaacaccttaatatattcaacctcttactttaagaaagagagaggaggtactagactaagcccctcatcagacaatacgatctatgtaaaatttaacaatattggtctgttttcatggtatttatttgtgatgactatagtctatagcaagtggtactggttttccacatgatactgaaatgagattttctctacacatatatgtaagttaaaatttgagtttaagaaatgtaaaaataaataataggtagtacactgatatggcctttgaaggtgatatgtggaagactgaaatttaggtaactgccatttatcattggaattagcagctactatggttggatgtttgtgatccctcaatattcatatgttgaaacctaatccctaatgtgatagtattaagaagtggggcctttagaaggtgattaagtcttaagggcttcgccagctgaatgtgattagtgtccttataaaagggatctgagagagtttgtttgccccttcctccatgtgagaacacatagaatgcaccatctctgaagaataaggcccccacttgacaccagttcttgccagtgccttgatttaagtttcccaaactccagaactgtgagaaatttttataagttacacagtctaagttattttgttacatcagccccaatggactaagacttcggcataataattataacaaagaaatatctacattctacattttaaagcataataatgatttcttccaatttctgatatggaaagaaaaagtaagtgtaatgtaatgtgtagtaatagacatggtttataagtgttttaaaataatagaaaatatagaataatgcagagcttcctgtggaaaagtaacaaaatatttaggtacagataattgtagagttgtttaataagttttttggtagctttttaacctcaaactttggagtctacaaaggaaaaaaaaaaaggaataaaagagattctatttgaagaaatagtgaatggcattaaaagtttcttgaatgatgggaaagttgctatctgggaaaaactactttaaagtaaatgtaatcacagagatactagggaaaagctagatatttataagcctctacatgaaattcatactgggggataatattacagtactcaaaataaatgaattataaaggtaaatatgtaaatatttgaaatgattattcaaagaggtcgagtatatcattagacagacttcataaatgtttatgagcaataagtatgtgccaacttaagtagaaaatattaattaacaatataatctctctgagcattgaaaagaaattaacagaagctgttaaaatattgtaagtgctatgttccttgaagaaggaagcactttcctaactgttccctggagttgttgaaaatctttattagtggcctggcacggtggctcacacctctaatcccatcactttgggaggccaaggtgtgcagatcacttgaggatcaggagttcaagactggcctggccaatatgacgaaaccctgtctctactaaaaatgcaaaattagccaggagtgagggcgggtgcttctccagctgctcaggaggctgaggcaggagaatcgcttgaacctgggaggcagaggttgcagtgagtcaagatcctgccactgcactccagcctgggagacagagtgaaactccatctcaaaaatgaagaagaagaagaaaaaaagaaactctatgagcaatatgatcaatttaaagtaaaaattattttcaatgaataagtatttatttaggtaaacctttgcaacaaattggacttttcttttttaattaatagattttattttttgtgtagttataatttatttctaaaatgagcagaaagtgcaggtcccctgtatctccttaccatgccccactgtttccctgattattgacatcttgtattagtatagtatttttgttatataattgatgaaccagtatcaatacattgttataaaccaaactccataatttatattaaggtttattctttgtgttgtgccttatatgaattttgaaatgtataataatatggatttactctcatcagagtattatgtaggacagtttcacttccctaaattgccctgtgctctcctattcatcctttcccctcatgccccacaaactcctggcaaccactgatctttttactgtgtccatagttggccttttctaaaatgacatattgttgaaatcataagagtatatatagtcttttcagattggattacttcacttagcaatatgcatttaagatacttgcatgatacttgcatatcatactggggcttgacagctctttttttttttaagacagtctcactctgtcaccaggctggagtgcagtggtgtggtcttggctcactgcaacctccacgtcccgggttcaatccattttcctgcctcagcctccttgggactacaggcgctcaccaccacacccagagaatttttgtatttttagtagagacagggtttcaccatgttggccaggatggtctcgacctcttgaccttgtgacccgcctacctcagcctcccaaagtgctgggattacaggtgtgagccacggcgcctggtcttatttctttttatcattggatgtattatattgtatggatataccacagtttgtttattcattaacctattcaagggtatcttggatggttccgaattatggcaattgtgattaaaactgcggttaatactcatgtgcaggttttgatgtgggcatacaacaattttcaactcacttaggtaaatactaaggagcacaattgctggatcctatgataagagtgtgtttaattttataaaaaattgcaaaactgtcttccaaagtggctgggctattttgcgtatccaccagcaatgaatgagatctccttttgtttcacatcttcatcagtatttgatgtcagtgttttggattttcatcattctcacaggtttaaagtggtatctgtttgttttaatttgaaattccctaatagcatacgatgttgagcattttttcatgtgcttatttgccatctgtatatctgttttagtgaggtgtctatagataacttttgcccattttaaattatattgtttgtttcttatttttgagttataagatatttttgtatattttgggtaccagtccattatcagatatgtgctttgaaaatatattttcctagtctatagtttctcctttctttctcttcacagtgtcttttgcagagcaaaagttttagttttaatgagcttcaacttatgagtttttttttgtttgtttgttttatgcatcaggctttagtgttgtatctaaaaattcatcaccaaactcaaggtcaccaagattttctcctgtggtatcatttagaagttttatatctttgtgtttacatttagatgtatggttcattttgagttaattttgtgaaaggtataacgtctgggtgtagatttattttttgcatgtggattttgagtttcagcaccacttgtgaaaagactattatatttccatttatttgactttgttcctttgtcaaacatcacttgactatatttgctattttgttccattaatctatttgtcttttacttcatcaacctcacactgtcttgattactgtaaatttatagtgtatcttgaagtttggtagtatcagtcttccaacttttttacttcttcaatattgtgttaaatattatgagtcttttgctttttcttatgaaatttagaacacattattattttttttttgcatccacaaaatgactcactgagatttcggctgggattgtgtttaatgtattgatcaagttgggaagaattgaaatcttgacaatgttaagtattcttatacatgtagatagaatatatttgtatttatttagatcttctttgatttttttcatcagaatattgtagtttttctcatacagattttatacttattttgatatatttatatctaagtattcaatttttgagatgtactaatttaaatggtattatgttttccatttcaaattccaatttttcatggctagtattaagaaaaaaattgacttttgcttattagtcttatatcctccaatattgctgtaatcacttcttagtgccagtagttttttttttgtcaattctctgcaattttctacattaataatcatgtcaccaccttaaaaagacagttttatttcttccttcccaatctgtctactttttatttccttttttgttgttcttatttcattggctggtactcccagtatgatgttgagtagaagtgtaagaacagacttccttgccttgttcctgatattagcaggaaaagcatatagtttttcactgttaagtatgatgttagctgtaagtgtttatagattttttatcaaattgagaaagttcctatttaatcttagattgctgatggttttacttatgaattatgaatgagaattggtttttttagatgcttttgctgcatctattaaaataataatataatttctcttatttagcccgttgatgtgagggattatagtaattgatttttgaatattgaatcagccttgcacacctgtcataaattccatttgatcatggtgtataattctttatatacattgttggatttaatgtgctttcttttaggatttatgcatctatgttcctgagagatattggtctataatgtttttgtcttgtaactgatttgtctggttctggattagggtaatgatggcctagaagaatgagttaggaaatattcccactacttccattttttggaggaaactagagaattgctgtaatttcatttttaaattattggtagaattcatctgagcttggtgctttcattttggaatgttattatttactgatccaattttttaaatagatgtttagattagttcttctgatgtgagttttggtagattgtgtgtctttcaaggaattgctccatttcatccaggttatcaaatgtgtgggcacatagttgttcacaatatttttttataatccttttaacatccagtggttcagtaatgatagttgcttttttatttctcatcatagcaatttgggtctctcattatttcttccttaacctggctagaggttgaaacagattttgattttgttgattttttaaaattaattaattaatttatttatttatttttgagacggagtctcactctgccccccaggctggagtgcagtggtgagatctcgactcactgcaagctccgcctcccgggttcacgccattcttctgcctcagcctcccaagtaggtgggactacaggcaccgccaccgtgcccggctaactttctgtatttttagtagagacagggtttcaccgtgttagccaggatggtctttatctcctgacctcgtgatctgcctgcctcggcctcccaaagtgctgggattacaggcgtgagacacggcgcccggccaatttttttatgttgattctcttttttcaatttatgtttttgactaagggttgggtgttttttttactgtttgctgtagctataggtgtcagaggttaaatttttccctaatttccttggttttgtcttccctgttgggtttgagttacctaagagacaaattcatctttaaataaggtctcagtcatgtacttctttcagttgtattctcctgatgtaatggttaagttgtagaaaggcaaatggtctaaagtcttacattaggcctccttctgttactgagcctgtgcaccttatagaagtcaataacccttaaagggcttccaagttctgttttgaagtctggagggggttaacgttgtatatttctcatttcccagtttgtttactttatggtaaaaccccagtaggtaaggctgtgctacaatagtttgtcttgaggtcaggcctttcaaaatggttactttttctcttcccctgctggaagcaagagagtttttctttttttttttcctctcaggttttcactgagagaacccaactgggctgtaggaggtacatttcatgaaagtttgggggcctcgtaagattgagttcccctagaattttttccacactgtgccttcagcaatttgtcaattacagtttagggtttcctaacagcattgtttcccatggaggtttctgcttctaggcttctgcttcagtaaatcgtgattctctgtatcttacctgtgtgtctctccattttagggagcaatatattgccctttgacctcacttctctgatgtatctaagaagagttattgagtttcagtttgttctgttttttcattgtagtgagaatgggagtgatgatgcccaaggttcttacatgccatattggaaactggaagtcatgaattaaacctttaatacataaattaacagtattatttttgtttgttttgcttcccatgtaaacttttatttaatcattaaaaatggcttaacatttctgtattaaattgaatttgcaaaacaaatttagatctgaatctaccagtttgcattttgtgttaattcttctgatatgtttctattctctgaaactttaaggaaaaattaattatataaagcatatacttataaattggttattatacttaccttaaaaacctgctttttggcaaaaatagagctcatttaaattattttattgttattaaaaatagtttgaagactaacatatcaaagttcctctttttagtgtcatttaaatgcattttctggcacaagcaggaaaagaacattaactgatatataacaatagggaacaactatcaccagaggaaaatgatgtatagatggcattcacagatatttttcttatattgaagagattaatttgtttattgtcacattaactacatgttactttgaatacttttgcagtttaaaaatttgactgcagaacgttgatagtttaacattgacaaatacataagaatcagtctgagatttaggaaaggtaaaaaatattaagaatattaataaatgtataatttttggcaaattctagacttaatattactgtcatttttatattttatggtattaagcacacagtaggctatatttttaatgatgttacaatggttaatttcaacaacatcaaaaaatttactttgacaggaaacaaaaaaatttagtcttaaaacatattattattttatacggggagtaaattaagcccaataaaaaatttatttatgaaattaaaagtaatagatttttgaggggctttaatttgggtcttacatgcatgtatttatttgtactctaccttgttttaaatatgatttaaagcagcttactatggtactgactaggttagatgggtttgagatgaagtttcctctgtttgtttaatttcatgtgctgaaatgaagaagggaaactatattatggggagaatatttccttcatgacactatctacacatattactttattataaaataaagctattttataaatacacatcaatgttgcacaatactcaattgtctttacatattcttttacttgtaaatacataagtaaaaagtgtgactggaaggtcactaaattgtaagcttaatttgaatccttcagagatgaaataatcctaatttcttaatatttattgataaaaaatgagattcttaatctttgagtttcttctctgggtatcacttttttatatggagatgaatacagatttcttgttttgtttaaaattattttcagtactaattattggttttctaaagcatgaaacagattctggtatacaaaaatacttacttataaaataaattttacagtatactgggacgagagttatgccaacattaaatcatgtttttattaaatcatttaagaatataaaatatggggaatatttttgccctgtggatcattttagatatgttcttatttaaaacagtttttcagatgctcttaagaatgagagagaataataataggcagaaaactattttaaattaatttttacattaatgtaaatgttatgatttttttttaattaaagaatgtcttctaccatttcaattttaaagggaaaatattcatttgtcctattttgtttttcaagttgcattcctttgtgttctccaatctgaagtttcctctttggtgaaccctccaacatagtctactgcagttattaattgtacataatataaatgatgacaacagacttctgagcgctgaaatgcaatgagaaacacagaagtaccaatggtcaaaaatcaaccaaaggggcatttgataacatttatattgtaaattgctgagaattgattgcaagtgataaaataaaaagaggctgaaaatagaaaactaaaaatcaaccaaaggcaatttgtatgattcaataatagctatataccaatttatatacctgactactttagattattctctaaagattgtcaaaacttttaatttaacaacattgctcattgtataataggcttaggaaaatttattttattttagtttagtttagttttttgaaacagggtctcactctgtcacccaggagtgcagtggcgcgatctccgctcgctacaacctccacctcctaggttcaagcaattctcctgcctcagcctcccaagtagctggaactacaggcgtgtgccaccatgcccagctaagtttttgtaattttagtagagacagcgtttcactgtgttagccaggatggtctatctcctgacttcgtgatctgcccgcctcagcatcccaaagtgctcagattacaggcgtgagccaccgtgcccggcaggaagatttatttgaaaaagcacacagaataatggttatacaggggtcatacaatttttcatataaaggttagaaataaaaagcattcttgcctatactgtataaaacctgatttcttagaccaaataatttatgcttaccgttaaaagtgacatatgtaattatgttataaggaatataatgtggaatgaagttttaaccattttagagacaatccacctaagctaacaaaatatattaagaatctgccatgtgccaaacactcttctggccattggagacacagaagtgaacaagcatatgtcatccctgtactcaggactggtgtctactgggaagatgagagggtaaactataaatgaacatagtaatatacaatcaggtaatattcagtgcaatgttgaaaaaaatagacagtgtatgggaagagggtgagagaaagctgcatcagatagggtggccaggaagttcttccaacagagacaagaatggagagaaggaatcgatgtgaaaacctgggggaactgtaatccagacagcaggacagcaaatgcaaaggacaatttcaacatcttgtagcaggataagctgcagacaaaacctctcagacactgagttgtagaaggaagggctttattcagccaggagcgtcggcaagctactgccttaaaatctgagctccccaagtgcacaatttctgtcccttttaagggctcacaacactaaagatttcacatgaaagggtcgtgattgatttgggcaagcaaggggtccgtgacgggctgcatgcaccagtggtcagagagaaacagaacagggcagggagtttcacgatgttcttctatacaatgtctgtaatctatgaataacgtcggtttctaagttatgagttgatttttaactactgggtttaggccaggcaggcccaggcctggttttgggcgtggtgctgggctgcctgtctttggttttacttccttgttgttttttcttaaaacaggtactgagtatacaacaatataaaacaatatgagagggtctctctctttcctcctttcccccctttgagactctcactttttattagtgggagttctcactcttatttttgctacttatgacttcttatgcaatagattgatagtgatttatatagtatgcttgtgctgaagcattttggtgaactaaggtagcgatgaagtttttttatcatttggagaaatacaggtatcagacaagggagcagtaagcaggttcctattactatgattacttttattataagagttttaaatcctcctattgctgggaaccaatttccaaacatggctacaggattgcatctgtgccacacttgcatgggtacatgtgccagttttgttatatctttaactatattttcaactacttcccctcatcatctatgtgtaggcaacaattagtaaggttaatttttcacaaactcctccttcagctgttagcaagtagtaagagctagtctattttgatagatagcatttctcattagagtttcttgctgggccagaatagtcaaggcttgaccagttttattagcaatgatttttaaaacagcttgtaaccgtatgattcagttgagcatgtagatgggggtttgatatcctcctgagccatcttgtgcctaagtggcaggtctataatattgtatgattttttcaggggaccatttatcatctttccaatcacttacagctatgcttcatttttcgtgggaagcatagactgggaagcccagaagtttacctgtttttatcggcagtaagaagaaagatggcttaatggtgccaattatacagctacctgtccactgatcaggcagattagcataagctctgtgtccacatatccagtataaccctgtggggccgtccagtcctggtggaattctgggtgggcccaaatagtctgcaactttggaaatttactgaatggatttctttctgtgtaattggaactccaccatgtaactgtttttgtggtaccattatacagcttttgcctaagacaactaaaccgccttacaggatgagtgaatccttttccttctttagctatgcaatactgtccaataattgagacttttaggacgaaaaatatgtcagggtggttcttttgggctgggaattcatcaggaactggatctgtaggaactaattattgggcttcccatggccattgatcttctattacagtttttccacaaacataacatgaagtgacatttagagactgggctacatgctcggctaattgcaaaaacaaatttctggtttttcctagagtctctggtactggcacatttagtttattacagaaagtctgaaatactggttctggagagcgtatttgaacctcccatttcattaggatgtttacactaggatctagtccttttccatcaatgcctaatgatacatatttttctttattttattttgggtctgaggggtttgtgattactaattttaaagggttgcagctcccactcatgcaggaggggctgccttttcctttgcagagccaaacaagatctttttttaatcctcttttcaagtagcctaaatgacacaagaccagtattgacacatctcacataaatatgatttttgacagatatactttttttttttaactgtttaacttttttttagtttacagaacggcatcttattccatgctgcttactatcaatagcagcacaagtgtcaaattttaaggttacatttttgggggcccctctttcttctgttctagctattaccttacttgtgtcacctagaaaaggaccagtccttaattttattttaaaaactgtgatcgtgggaggcttaaaatgggtcataacacacatcaggttggttatttcctgggctacataccttggatagaatagcattatacaaacgagtttcttttagagtcctggtacacttataataaccataaaataataggactgtagcaattttttgtcctacctcagtgacttgatgtatatactgggaacagttctcagtctgacgaaggttagttgacgtccttactgaaaaagtccaaattttaaggaaaatgagtcccacaatgagttttctgatgcatcggccatgcgtggaccagtcagcttccgggtgtgactggagcagggcttgtcatcttctttagagtcactttgcaggggctggcgaagctgctcccatccacgtacagctcccagtctactgatgtgtaagggtggtctcagaggttgggcctactagaataaacagagtctaacacctctacacagttaatgtttcactgggctccctgataccaggagtaaggtggtggggttagggtgttgcaaacttcaatggttatgtggggatttttgcagagcaagctttggtatctagttagtctaacattcattggctaatggtgtcctttggtatttattaaaatcaccacagcatggggacactttatgtttaggttttgcccaagagttagcttatctgtttcttgtgctaacaggtctgttgctaccagggcccttggacatgggggccagtctttggaaaccccttctagttgttttgagagataggccactggccttggccagggccctacagtctgggttaaaactccaactgccattttttctctttctgacacatagagtgtaaagagttttgtcaggtcaggtagcctcagggctggggccgacatgcgtttttctttttaacttacgaaaagctcgttgctgttggttgtaatagatgtagtttatctaatttacatttttattgactgtcatctaccaaaatattgacttaaatcttacaactatttgatttcaagctttaaattgatctggtattccttgtggggctccaattgcatctaaatagatgtgagagttgaaagacctataaggggcttctcttgctttacgatgtcttattattattttttttcctctggctgatgaaatgccagggtgaaatggatagccaaatggactaaagcacaagtgccactctagttatttggcagagtgcccagtaaaagtccaccacaataccaccacaaatccactcggggatgaacaagggctgactgattgataagctcttgaaaattcctaagatcactgcatcccttcaggtctccaaggaatgctaagtctcctcccctgccatgagagacaagaagtgaacttagtgttgggagacggaagctggatggccctcggggatgacctgcagggacttcaggatacagcagagagagcttggcatgacttattactccaggctgtagaatcctggaaaacagctaccatacagcccacgcctggtcgactgaaggaccaccttagtggaagggggacaatcagggtctctaacctgccaacctgccatgtgcacaagcataacagttgctttgtttaacgtgcggatggaatatttgatccatttcatccaggcatttgtatcttggtatgctgtcttaactgccgaagtttgttttaagtctttaactttcttgatcctctagtaaaatgaatgtttcctttagcacctatttttattagtttttagaccaaagaaagctaaacaccattttatatttaataatgcttcttgtgtgatttttatgccagataagttaaattttacctttatattagtgtgttattaatgttaaacttaattttaataaagccttgtagacatatttatccaatttttcatgtttgaccataaggtaagattttatagactctttaatcttttataatttttgttaaagagcaggttgatgctttaagaaaaacttgttgcatttttactttaatgtccagttcacagaaaaactggatgatatctttttaactttagctaatatgtttacacacagaattttctttataattaacattttaaagcttgcttaaacttttaaaacaataatttttttaaccttttaatgtaggtaaaaatctacattattatgcccctttataatctttttaccaaaggtatattttacttttcttatacacttcgcacataaactgttttttttaatggtactcaggaggccttattacttttaaattatacaacattttttgcatacaatttttataacattttttctttcatgactttcgccgacaatttttcaacatgtctcaactttctgacttattacaaacattttttttttctttaaacaaccagttaatttatttcaggacaagaatttaccatataacactctttttacctaaattctgcctgcccccccccccttttttttttttttttgaagataaccattcctttttttaaagcaaactttctttatgtctttgggactaaggccacaagattagaagttaccataatacatgttacactgttaacttttagcaaacttcacttttgttgaaaaccttgtaagtttgggatttcaattatcctttgctattaataagaccttgtttagtctaaattaacttacaattggtttagatggcctttttttctctctgctggtctttccttttctctctgctgcctctgccagctgcttatactgctgttcttttaactactgtggggaggaaagggggtctaaaaccagctgttactgtctgtgtacggaaactggtctgggtgctttggcttacaggttaccttgtgccatacctttgaaacaagggacctgtccaggcttcctcaattctttcttgaatttttttttttttaacatagttcccagtggggtgggcttactttgtgcctgacccacgttgttttttttttttttttcccgagacaaaataccacactcacaccacacataccacaagacaaagaacaggtaaagagggcacacacacacttctaccgtttataccaaaccaaaatcatgaaattcaaaatccaagtatcaaaaaattccagccaagtcaaaaccaaaaccaaagtatccagcaattcaagtcaagtcaaaaccagaacaagagtgccaatgcaggcacgctgtgggtgatcaggccacgcttccactcagatggagtgaggcaagttccaaagactagtcttaccaagtttcagatgtccggactccaagtgccagttccttcctggtgttcagccactgtgttaatcctcctcgggggcctgctatgtgcgctgctctggcgaggtgttccactggggcagtttcctacccgggagcgctctttggatcacgtcactcaggctggctggagtccccctcagggatgctccacagggcaggcttaagtcacctaaggggctgcctcagctatccatcagtcacctcgcttcccagtcagggaaccaagaaatgtagcaggacgagccgcagacaaaacctctcagacaccgagttgtagaaggaagggctttattcagctgggagcatcggcaagctactgccttaaaatccgagttccccaaatgcacaatttctgtcccttttaagggctcacaacactaaagatttcacatgaaagggtcgtgattgatttgagcaagcaggtggtatgtgacaggggctgcatgcaccagtggtcagagagatacagaacagggcagggagtttcacaatgctctactatacaatgtctgtaatctatgaataacattggtttctaagttatgagttgatttttaactactgggtttaggccaggcaggcccaggcctggtttcaggcctggcgccaggctgcctgtctttggttttacttccttgttgtttttccttaaaacaggtactgagtataaagcaacgtaaaacaatatgagagggtctctctcttacctcaatctcatgtggaaaacagtgactgataaacttatgatggcaaaagctgctacctattaaaattatatgaacataatgttattttagagtagtttaattttcatttttaggtaaattcaaactagcttgtgaggtattgcttcttattaacagaagataacaacaatatctcaagcgattagtatctcagatctcataatttggttgataaaggggtttcaggagagaaaaggatattgaaaaagggctaagcaatcttgcgttgctgtagtgaaacaaaggcaaacataattttgattttttttaagaaaattacatgatgctgagtattggtgcataatttcacgtccagcagtaatcgttaacaagagcagttgtcataggaataccagcagtggtgtggcagaggtggtggtggtaattttagtgcagatagaaagccttaaaggaacaccatctatgtgacagccacagtgccaagtgtgacttgcattatctcttttattttggcaaacagatattaaggtgagggtcaatattatccctgcaaggttaggtttacacaattataaaatttcaaagctgagattcaaactcagttgcgtctcatcccacaatccaagctatttttaaggggggaaataacattcattatgattaatggtagtgtggcaccatatagttcaaaatttgaaattgaaagagtatttagaaatcctgagttttagggttgactctgctatgctataaaattgatgtgtgggaaagatacttctgttccccgagtctgcaaatgagcataccaatgccatttttcttccagatttgttctggtaaacacatgattgcataaaaataatatgaaaaaaagatctactaaaaattgatttaaactgtgtagacattaagagagctcttataaaatgctattcactacattatgaactgggaataaaactaatagttaagacacaaaccttcaaatgtcaaaaaaaaattggggtccatacaactgtacaagaaaaaatctgagtacattatgcatccattcatgtttaatgattgtagtagacatctgtaatttttacccattaagccagcctcctagtaagagacccatctcttccccaatcccagatccctgtgttttggataggatgccttccatcctttgtgtccaaggatagaccctatagctcgagctcagccaacaagacagccataaccacagtaactgatgtagaagaaggtttatggcacaagcctaggtgaaaaaacagagagagagagaaagagagagaaaggatgctacatttgacacattttttccaacttttcttctttattggatgtctcatttatatgagccagcaaattcctgtctattgaaagctaggttgcactggttttctcttacctgtagttaagaatgcaaatcagtaataggatggaggaggttataaatgagccaggattttgaatatgccaggaagactgatttagacagtgtagttatgtgaactcctttgagataaaaagctgagcttggagtcaatgaaattcttcagctttcataagatggtaggtatttaaataaggtcttgaagagttaaatctaaatagatgaaaccaaagttatcacagagggggaggaaatggccttttttttagtctagcagatgctagaccagaaataaatatttcacatatatgttttattagctaaaggatgtgttttgttattattattcttggtcattaatttcacagaaacatatattaaggtattcattaaatctcaaaggtttaaggaattttggttccttttatggtccagcacaaattatgaagaaaggtgacatgatgtgaattttactttaggaagaaaataccaacagcagaaagatggactggaggcatgagaaagcagagaaaaagaatcagctggaagcttttaaatttagttaacttaaattttttttggacacagaaagactttctgaagtaggagatgattagagtcttaactaatgtaataataatgggaatggatgaaagtaaaacaatatgtgacaggcattgtggaggtagaatagacaggatgtgagaaataaaaagctgtaagttataatggagatgaagtagtcaatatgtttccattgggatttcaaagagtggagggagagacttattaacagagactgcaagtagagaataatcattatattagcaagtaagagcgaaatctatgaagacactaattaatttagtttgaagacatgtctttgagatacggaagtgtttttgctatgaagaccattagatatttatgcattagttcaaaaaatatgtattgaacacctaactatggcctaactactgtactagacaactttcctgcttttgtggaccctatattgtaaaagttggctgcaattaaatgaatgtatactctatatgaggtggtacaaaaatatacaaagaaaaataaaatggggagggtatttggcgctattttacaatcttggttacaaaaaacctctctgagcagatatctgaagaaactgagggagaaaaccataaggatatgtgggcaggtaaaagaaagcaatgaaggccctgcacggaagggacatatttgagagactgcaaggggtcaagtgtggctgcagagaaggaatctagggaagataaggtcagagagatagaatgccttgaaaattctagactggtggcccagaaaacgatcttgagattatggcaaagattgtagttgttttccagaaacaattcttcccctttttggtagtagtagatattttagctgagcctgtagtgtctgagagtgaagattaccttgaagccatgtggccatgtgagtaggagtatggggctgaaagctcacttaagttattgatggtctgtttcatttacccttctattccttgctctttcctcacacacatacacacacacaatgtaggatctctgagtccagatattggaagactttttttgagcacagccaccttactagtttatatatgtataagaaagaaacatattttatttaaagtccaaaatattttgctttttatattaccctttctactactcacagtttaatgctaattaatgcaggaagtatggttgtaaggcttgtaggggctaaggctatctgagtttatgtgattgctcacagagagcatatagattgagatggcatctagagtggaaactttacaagtatgcagagccgtgaatacattttcctcatcttcctcctttttttgttttttctaagtaggtaaaatctgattctctaagacctagctcaaatataactgtctttgtgaaactactagtaataaaagctcatcctgtttctcttcaaaaagcagaattacttgctttgccatgttctccctctgctctacctcttactattttgtctcatgttgtatttatgtacatgtaccactccttgaatacagggtgaactcctgaaaaagcctgttacccttaacattttaaacaaacaatccaagctcagtttcagaccctcattgtatccatcctggattgctggcttaggctcccaagggatcttcatttgcctcattttctttttcttttttgtccacaagaaactctcttacaaattttcattcgtgagtcatttcctcaaaaaacaaaaaacaaaaacaaaacaaacaaagaaacaaaaaaacagggtagataaaatactgtcatctggaccccatatttctagcgtaatgcttttgagttacaagtctataaaatcattgaagaaaagacctatagtttacgtctagcagattaattcataataaatttttgttaaattgaattggaagtagaagtaatctagattgattgaagcataggatggagatattttgtgtgtgtgtgtgtgtgtgtgtgtgtgtgtgtgagacaaaaatacagggaaaagaagacataaaatatgaagatgccaacaacagctaaggaaaaaactgttgaaacagctgattcagtaactaaactggcttgtcaaggaataactgaaacacaaggagaaggcagctgtttctactgtagtgtcctctgttttctccccttttccttctgtctgtctctaatgaagtaaagctacataaatatggcacatagcagtgtatgtcaaatagtgctcaataaaatatctccagttagagcttttggtgaacaagtcttgaaagatatttgcatcattttctttgattaaagagtcagtgattttattgaacacattaatttagatatgtgtacctattctttgatcaagatcttattactatatttatttctgtatcaggagtactttttcagttcagaaacaaccctttttcattttcaatttagggaacattacttttagtttgaggtttatatgactttggatgaagacagtgctgtcacaaatgagactctaactgtagcccatggatttggatctttagtctattgtattgattatactttccagtctccttgatgtctcagcacattttggtaaagtattgacataatttaactccatggattccaggatacacatgaccttttcagaaagtatacattattgtaagaatttacaagaactgaataattctgcagaaattatgaatgttatagtcaatggcaaaacagctattagtattaagtctttaaataattatactttgatttattgtttgattatatgttcaactttgttttaaatagcatagtgcagtagctccttgtcttcagttcaaaatgcaaagttactctaatttttttgaggtacaaaaactcttctataaatatataaaattaggcctagaaaagactaattttcatgatgggaaatacacactagatttttaaattttagtactttacataaaaatattggtgtggtactatttaattacatcataatttagtagttaaaagaattcttctcaatatctggttattgctcgatttattagcacatgagcgtttctgagattggcattcagagagatttcccataataaatgttactagttatccaacaagaaaagaacattaatgatttcacctaacatgctctcaactgtatgatattatatgaagagttaattctcatatttagtctagaaagatttttaacatgagttactgagttaatatctttaaaattttattaagtctttctctttctgatacagaagatccataattcaggttattaatctctggttacctgtcctttgtggaaagattaattattttctattattcattgcatttccaccaaattttggagatatttatcataaagttgtggatctgagctaagtttaaagacatcaaatagtaagttttaatttttccagctattactattaattctaagttttttttctctgatatgtcttctttgatgtttcttaaaaatcaagatttataaagagatagagaaggccattagtatatctctcaatgtcacaaaattaacctagccactgtaaagttaacctgtatccacaatataagtgacaaatggcagataatatctttaggaaaagtattaaatagtgcacactacttccatcaaagtatagtgttcgaggcaagtttaggtaatggtgcatttctaataaacagtctttaaaagatattagcatttctgttatttatgagaggctttcagtgtatttttcacatatgtattattagggcagtgtagaaatattattgtgatgtattaatgggctgacctgaggtaaacaataactacatccatgcgtgcatcatacatgcatacaaacttactcattttctttttaagcagactagtagttaagttccaagagagaaaggattctatatcatgaaatgccctgtacgtttttgattctctatctggaatgccaacttgaaatattactttcaataacacattacattttgtattttttagagcataatgtgcaaagtagatgatattatattttaaattaaacaaaattagagaggatctagagaaaccaatgaagtaattagtgtgttttgtttcagtggtacagaatcagactctttatagctgaactcataatgtgtacatttattaaacaaattgccaatttagtaatttataaaggaatattaatttgataaaatattttttaaaacaattaaattattttttccttatttaattcatctggaaaacatttagggagtcaatactaattgtcagtcactttgcatagggccactttgtgacagggatgaagtggcgtggtcagagggagatctgcatgaacctaagcctacaaccaataaagggagttaatgttttgaataggtaggtccatgttttggacatgaatgcattatccagtgtggagcgcagtgcctagcccatgagaagttccctatggctttgtctctggtatcaaagatttatgtaaaattagagtacaataaatctttatgtatgcatcacctatctcaacagttaacaattcatagccaataatatttcttctgaactctcaccttctttggggggtaggggtgagatggagttttgctcttgttgcccaggctggaatgcaatggcacgatcttggctcactgcaacctccgcctcccaggttcaagtgagtctcctgactcagcttcctgagtagctgggattacaggcgcaccacctccacgcccagctaattttttgtatttttagtagaaattgggtttcactatgttagccaggctggtctcgaactcctgacttcaggtggtccatccgcctcggcctcccaaagtgctgggattacaggcgtgagccactgtgcctggacctctcacctattcttcctgctaggactttgtcatattttttgagtgggctttggaaacaaatcctggcattgtaccatttatctgtaaatattttactgtgaatctctaaacaaaaatcacaatactattatcacacaaaaatagtcataatttttaatatcatcaaatattccatcaggattcatatttctcaaatattcttttaagagtaagtttgactcagagtccatttaaattagtttatatgtctcttaattctctttcagtagattgtcctgtgtctcctgattcttgaccttttgagtaaacagagctagcatgctacagcataagttcatactgatccattcaattcaaatttagaattacaggacttacacataatcttattgaacttgcatttgcatgtcctttctctcatgctggtaatcctggttgttagtaacactataccatttgctttatcccacactttgtaataatgcagtttcactatacatcatcaacaccacaataagcaatatatatttcttcctggcaatgggtttgcacacaatgaacagtataattaccaaatatagtttgtaaattttgtttgctgttgtactttttttgaaattgaaaatcacatattaattcaacaggataattagcagcaatcaaaaatttttaaaaagtcaaaatattaagagctgagcacagtggctcttgcctataatcctagcattttgggaggctgaggtgggtggattgcttgaattcaggagtttgagaccatcctgggcaacatggtgaaacaccatctctccaaaaaaaaaaaaaaaaaaaagagaaaaaaatgcaaagttcgcttgttatggtggattgaacctgtagtcgaagctacttggggggctgaggtgggaggatcacctgagcccaggaggtggaggttgcagtgagccaagattgcaccgctgcactccagcataggtgacagagtgagatcctgtctccaaaaaaaaaaaaaaaaaaaaagttaaaatattaaatatacatattaattgaattcatggttgtaaggatgagatccatggaagtttcctgggaggaagggctttcttgatttctttcttttttttttttttaacacacagatgttctgaccatggaactggagcataggcaattcttgagatagttctttatctttatctctaggtcttttctggactctctggaattctctttttatgtttgccctctttgctctttaccagtaggcatgcctagtcatagtttctatccttttgtaatcttgtctcatacaaagaacatcatgtccactctctacacattactatatcatggattttcttcttcaccttccactattcaagactttcctctctcaatactacctgattctcatcttctggttcttggctttttcatgtgatgaatatccctttgatcacatgccaaccagccatcccatctgttttttggtggaatatcacctggaattattccttacatagtttttctgattattttatgagtagctctgtgtatgtcagtcattctcaagaaatatctggcaagtttattatactttcaggaaatgttttgaataataaatgtgtcttactttttgagtgggcttggatagcatttattcttagtctctgttattacataaaatatatgggaataaatgtatacaattttcctatgtggatatttggtaaaaatataatgatagtatttttccatgggtggatgaattttaaagaaataatttcttagcttgcatgaagtattttttttttatttctgcatttcccttctattttctccctaggatgtcagaagagataactaaaacttttatgataaccatgtggtcagatccataacttacactgaagtctgttcttgttcaacagaagctaatattaaattcaatgttctcaaatatttactcacagtaatatgctccatttggtctattctgtgattttttggctcccacttaataatagttatatgccctttagcaaatataacagcaggaagaccataatgttcaaaacaacagacttgttaaatgtgtagcatattttttctttcttatttgcctttaccagctgaatattgtttctgtaattcttggcagaattatgcatttttctactacttaaaagcatacattttagttgtttctcttcttctaaaaacatataagagatatgttttatgataaatattttatcatgtttttctatacttttatatttctttgagggagcttattttagctcctctgttgtctcctggattcataattgccatacaattttatggatcaaacatttataattaacacattttagtttggtagcaatttcatttactttaatcagtcttttatactggaaaaaataactataaagttcacaaaatatttctctgcattactataaagtttacaaaaatttccctgtaaatcagtttctatattttcagaactaacaatgattttattctatataagttgccaacataatacaaatatggaattgcctaattcttgaaatgaaaaggaagcatgaacagttactattgatgaggagacatctcaatcctgctatggtaggaaaacacagaatccttctgtggtagatttctttagttattcccaacagtccttatcttttcttgtaagggttttcacactcatcatgaagtgacttccatgtgttctgtaggcagagcttttatccctgttcttttgatttttggctttggctctgtaacccagtttggacaatggaatgtgaatggatatgatttatgttacagctcagcagaggagttaatgggcattgctaggttgtttcagtacttttgttctttccctctgctttgaccatggactacccaaaggggattgctccttcagcctcggcgatgaaacaaggcaacatgtagaacagagatccagcagatgacttccgtttctaacacataatatcagataaatatttgtttttgtaagctattgagatgttggggtggtttttcacttcaggaaagctaagtaatataattctcatttttgcaatttgcaggaatttttgagcaattcttgttatctttgtctccagaattatagttccagattttaagatttttcaagctctttacatctcactttactatatgttttccacaaagtagtcgttttcataaatgttttgagagttaatgatttaatgaataaatagaagattgactatcaattagacaaacccttcaaatacattaacaaggtcccaggtccaaattaatctgtagcttttttttttttttttttttttttttttgacagtctctcactctgtcaccaggctggagtgcagtggcacgatcttggctcactgcaacctctgcctcctgtgttcaagtgattctcctgcctcagcctcccaagtagctgggactttgggagcacgcccaccacgcctagctaatttttttttttttgtatttttttttaggagagacggggtttcaccatgttggccaggatggtcttgacctcttgacctcatgatcctcccaccccagcctctcaaagtgctgggattataggcatgagccactgtgcccagccagtcagtagcttttgaatttttgattactgaacccttacttctaaactatatgatacttattgtggtttcttaaaattgatactagtctatttaaccatgtagaccttgtgctcaatcaatacctgctaacaagtctatttaatttggggatataagactttaaatatccaagttagttctgctgcagagttaagtctacacttataaagaaagactgggaaaaaattgtctcagttattgaatgttttattaaataacatttgatagacacataatacacaaattgacaatattcaaggaactatcatgaaataaaactcatgctttactggattaatattttaagtaaaccagaaaatataattgagaaatacaggaaccaaatctcaaatcatacaaaacccaaatgtgttatttcttttaaaaaaatgttttgccgggcatggtggctcacacctgtaatcccagcactttgggagattgaggtgggtggatcatgaggtcaggagttcaagaccatcctggccagtatggtgaaaccctgtctctactaaaaatatgaaaattagccaggcgtggtagcacaacatctatagtcccagatactcaggaggctgaggcaggagaattgctttaacctgggaggccgaggttgcagtgagccgagatcatgccattgcactccagcctgggcgacagaatgagactctgtctcaaaaaaaaaaaaattgttttattttgaatttgtatgggtacatagtgtttatatttatgcggcacatgagatattttgacagagacatagaatgtgtaataatcacataaggttaaatgggatgcccatcaccttaattatcatttctttgtgttacaagcattcaaattatactcttttagttatttttattttttactctgtcgcccaggttggagtgctatagtgtgatcttggctcactgcaacctccgcctcctgggttcaagtgattctcctgcctcagtctcctgagtagctgggattacaggtgcacaccaccacacccagctaatttttgtatttttagtggagaagggggtttcatcatattggccaggcttatctcgaactcctgacctcaggtgatccacctgccttggcctcccaaagtgctgggattacaggcatgagccaccacaactgccatattttagttattttttaatgtgcaataaattattattgactgtaatcactctgttgtgctatctaatactacatcatattcattctaactgtatttttgtacatccccacttaccgtgcccccaaccccaagcccccaccaccactcccaacactacctttctcagcctctgctaaccatctttctactctgtccccatgagctcagttgttttaattattagctcccataaatgaatgcaaatatttgaagttttctttttttctatttttcatgtacctggcttacttcacttaacataatgtccttcagttccatttatgttgttgcaaatgacaggttctcttattttttaattgctgaatagtatcccattgtgtatatgtggcaaattttctttattcattcatccgttcatggacacttagattgcttccaaatcttaactactgtggatagtgcttcaataaacttcagagtgctgatattttttgatatactgatttctgttcttgtccttgtgtaacagagttaataattttcattcttgacaatctctagtagcaagtaatttggagtctcataaatcaaaatacaatcacacattatgcaatatcttttgtacctaaagaagaaacctattctacctgtgaccatcaccgtaggacctaggtgatgagctttctaccctaggacctagggctgagctttctgatcccaagactttataaaaagaagaatgacacagggggcataataagatcagaacagactttacacatattcagaattctagaatgtaagggctaaattttacttttacctcaaagatgtactgacttatttgtatctacaaagtttcctactataaataaaaatgttttgtaaaaatagataaattcatttaaaattacctttgacacacttctaaaaggatctgtgtatttgtatggcttttgatcaattgagtcattgattaaaagtgtaatcatgcctctttatatgcaaagactttggtgtttatacaaaacaagcttgaacttcttttcttgtcacactgctcctacttggaaggaggataaccagcttgtactagaggtttattcttctaatcttctaaaatgcacagtatatacaagtttaaccatacataggataatctcattccactgtatgtcaacagaacaacctgatttgactcccttttccagttacccatatcctgtgaaacaaaattagaggtagctccaagatctaggtacattgtgatttagtttgttttacctttcttaataatacattttatatatattgattttcttcatataccctattacctattttcttattttctcaattctattgttctttctttttttgaaaaaaaagccctcatttttagctcattaatatttgaattctctaaatagatatgctatggtataaacagaataaagtaatcacataaaaacttacagaagttacctctgatatggctaataacatttgaaaactacttaaattcatctaattggtgattcatcataaactgatggaatataataatacaagatgaagacggtagtttattatgtcttctgtgtagcgggtgcacatgaataataatatctaaatttggaccattaaactctgagtaagagacaaaccaccacaatcatgactgtgaagtgcaacgctaaagtcatctgtcagtatgcagtcatggagtgctgaatctgctttcagaaaatctttctgttattagagttctagtatcttaatgaagcagcctacatcaggatgtggatcctcaggtaaaataagaataattatattcaagcttgaaaaaaacaattgggaaatgtattggtttgtgtttttgacctgcaggcagaaacactgaaatcatttctacttccactttaagacttctactatttgctatttggaactttatattaattcatgtttaaacatacttttttttttttgcaaataggaaactatatattataggccacatttctcccggtgccaacaatatttagctcagttacagatgatacaggatatgcaattataggcacatctcatgttattgtgcttttctttgttgcactttgcagatattgcacgtttttacatattgaaggtttgtatcaaccccgcctcgagcaagtctgttagcaccattttccaacagcatgtgatcacttcatgtctctgtgtcacattttggtaattctcccaatatttaaaactctttcattattattatatctcttatggtgatttgtgatcagcaatctttgatgctactgttttaattgttttgggacactgtcaaatatgtctatagaagacagcaaactgaatacataaatgttctgtgggttttgactgctccacggacttgcctttcctttaaatctctttatatccctgagtttcattatttcctgagacacaacaatgttgacattatgtcagttaatgaccctacaatggcctctaaattttctgacaagggaaacagtcacaggtctctcactttcaataaaaaactagtaattattaagcttagtgaagaaggcacgtcaaaagctgagtaggccaaaggtgaggtttcttgcaccagcaattagccacgttgtgaatcaaaggaaacgttcttagaggaaattaaaaatgctactccagagcacatatgaatgataagaaagtgaaacagccttattgctgatatggaaaaagttttagtggtctggataaaaaatcaaattagccacaacattctgttaagtgaaagcctaattcagagcaaggttctaactgtcttcaattttatgaaggctgagagaggtgaagaagtcacagagaaaagtttgaagctagcagaggttggttcatgaggtttatgaaaagacaccatcttcataacataaaggagcaaggtaaagcagtgatgaggatgtagaagctgcagcaagttatctagtagatgtagctaagattattttgatgaaggtggccgcatttcaaatagcatatttacaatgtagacattcaggtttgtattggaagaagatgccatctaggactttcatagctagagaggagaaatcaatgcctggctccaaggcttttaaggacggaatgactcctgttagaggctaacgcagctggtaactatacattgaagcaaatgtccatttaccattctgaaaatcatagggccattaagaattatgctatatctattctccctgtggcctataaatgaaatgtcaaagactggatgacagcactgctgtttacaacaaagatactgaatgttttaagcccattgttgagacctagtgcacagcaaacaagattcctttcaaattattactactcattgacaatgtacctagtcacctaagagctatgatggaaatgaacaagaagattaatgtttttatgcctgctaacacaacattcattctgcaactcatggatcaaggaataattttgactttcaagttttgttattttagaaatacatttaggccgggcgtgatggctcacgcctgtaatcccagaactttgggaggccgaggtgggtgaatctcttgaggtcaggagtttgagaccagcctggccaacatggtgaaatcccatctctactaaaaatacaaaaattagccaggcatggtggtgcacacctgtagtaccagctacttaggaggctgatgctggagaattgcttgaacccagtaggctgaggttgcagtgagctgagatcatctcatcactgcattccagcctgggagagagagtcttgctctgtcaaaaaaaaaattgtcattttgtaaggctatagctgccatcaatagtgattgctctgttagacatggtaaaagtaaattgaaaaccttctggaaaggactaattattctagatgtcactaagaacagtcatgattcatgggcagaggtataaatatcaacattaacaggagtttggaagatgttgattccagcctccatggatgattttgagggattcaaaagttcaggggaggaagtaattgcaaatagatttgaagtagcaagagaactagaagtggatcctgaagatatgactgaattgttaccatcttgtgatggcacgaaacattgttaaaatgaccagaagtaaattagaacattacataaacttagttgataaagcagcagcaaaatttgagaggatcggttccacttttgaaagaagctctactgtgggtaaaatgttatcaaacagcattacacactacagagaaatttttcatgaaaggaagtgtcaactgatgtgggatacttcactgttgtcttttttttttttttttaagacaactaaagccacttaaactccctttaagcacaacttttagcatttcaactacaatgcttttcatggggaaagttccacatcaccctctggttacatttttctcacttcaatgatagaaacaactttagtaaaagaatcccttttactttaggcttaacacctttacatttgtgtttaaaagtgaaacaaatagctgataaaagaaagacttatttcaacaaataacaaatacagtagcctaaatgacttaatactggtacaaaaccaaagggattactcaaaagtctagaaagagacctatgtactaatatagaattttagtatttgataaaatattgcattatacctcattggggaaaattagtctattcaaagttagatccctactttacaggtaaaatcagaataaattccaaacaaattataaattacaattatatatattaaaaagatggattaatgtttttataatctgaaggagagaaagaactttctagataaacttaactatgtggaaaacataaaactttagatcagcagaaaagtccaaaccaaacttaagggaagagaaaaataaaacacaaaaattccgataaataagtataagataaacattatgacaataggtcaaagacccaacaggaaatacagtcgtgtgtcccttaatgacagagatacgttctaagaaatgtattgttaggtgattgcatcattgtacaagcaacctaagagtgtacacaagcctagatggaatagcctactagacacctaggctatatggcatagcctattgctcttaggctatgaacctttgagcatgtgatagtgtagacaactgtaacacaatgggaagtattcgtgtatctaaacatatctaaacacaggaaaggtacagtaaaaaatatggttttataatctaataggaccactgtcacatatgtggtctatcattgaattaaaggttgttatgtggcacatgattgtacataaaccaggaaatttcaaaggtcaataaaaatatgaaatgacaagcatcaccactatcagaattatgcaaattaagcaaccagagttatgcaaattaaagaaaaaaattattcaaattaaactaagagatgaagtttttccattaatgggcaaacataaaaataataattgtatttgatgttgtgaagaaaaaggcactatcaaatatttttacaaagtaaacgtttagggtagttttttattactatactttaagttctagggtacatgtgcacaatgtgcaggtttgttacatatgtatacatgtgccatgttggtgtgctgcacccattaactcatcatttacattaggtatatctcctaatactatccctccccccacccaggacaggccccagtgtgtgatgttccccttcctgtgtccaactgtcctcattgttcaattcccacctatgagtgagaacatgtggtgtttcgttttttgtccttgcgatagtttgctgagaatgacggtttccagcttcatccatgtccctacaaaggacatgaactcatcattttttatggctgcatagtattccatggtatatatgtgtcacattttcttaatccagtctatcattgttggacatttgggttggttccaagtctttgctattgtgaatagtgccgcaataaacatacatgtgcatgtgtctttatagcaggatgacttataatcctttgggtatatacccagtaatgagacagctgggtcaaatggtatttctagttctagatccttgaggaatcgccacactgtcttccacaatggttgaactagtttacagtcccaccaacagtgtaaaagtgttcctatttctctacatcctctccagcacctgttgtttcctgactttttaatgatcaccattctaactggtgtgagatggtatctcattgtggttttgatttgcatttctctgatggccagtgatgtgagcatgttttcatgtatttgttggctgcataagtgtgttcttttgagaagtgtctgttcatatcctttgcccacgttttgatggggttgtttgtttttttcttgtaaatttgtttgagttctttggagattctggatattagccctttgttagatgagtagattgcaagaatgttctcccactctgtaggttgcctgttcactctgatggtagtttcttttgctgtgcagaagctctttagtttaattagatcccatctgcctattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcaactttctacatatggctagccagttttccaagcaccatttattaaatatagaattctttccccatttcttgtttttgtcagatttgtcaaagatcagatggttgtagatgtgtggtattatttctgagggctctgttctgttccattggtctatatctctgttgtggtaccagtgccatgctgttttggttaccgtagccttgtagtatagtttgaagtcaggtagcgtgatgcctccaactttgttcttttggcttaggattgtcttggccatgcaggctcttttgtggttccatatgaactttaaagtagatttttccaattctgtgaagaaagtcagtggtagcttgatgtggatggcattgaatctataaattaccttgggcagtgtggccattttcacgatattgattcttcttacccatgagcatggaatgttcttccatttgtttgtgtcctcttttatttcattgagcagtggtttgtagttctccttgaagaagtccttcacattccttgtaagttggattcctaagtattttattctctttgaagcaattgtaaatgggagttcactcatgatttggctctctgtttgtctgttattggtgtataagaatgcttgtgacttttgcacattgattttgtatcctgaggctttcctgaagttgcttatcagctgtaggagattttgggctgagatgatggggttttctaaatatacaatcttgtcatctgcaaagagggacaatttgacttcctcttttcctagctgaataccctttaattctttctcctgccttattgccctggccagaacttccaaccctatgttgaataggagtggtaagagagggcatccctgttttgtgccagttttcaaagggaatgcttccagtttttgcccattcagtatgatattggctgtgggtttgccatagatagctcttattattttgagatatgtcccatcaatacctaatttattgagagtttttagcatgaagggctgttgaattttgtcaaaggccttttctgcatctattgagataatcaagtggtttttgtctttggttctgtttatatgctggattatgtttattgatttgcatatgttgaaccagccttgcatcccagggatgaagcccacttgatcatggtggatgagctttttgatgtgctgctggattcagtttgccacgattttattgaggatttttgcatcgatcttcatcagggatattggtctaaaattctctttttttgttgtgtctctgtcaggctttggtatcaggatgatgctggcctcataaaatgagttagggaggattccctctttttctattgattggaatagtttcagaaggaatggtcccagctcctccttgtacctctggtagaattcggctgtgaatccgtctggtcctggacttttttttggttggtaggctcttaattattgcctcaatttcagagcctgttattggtctattcagggattcaacttcttcctggtttacccttgggagggtgtatgtgtccaggagtttatccatttcttctagattttctagtttatttgcatagaggtgtttctagtactctctgatggtagtttgtatttctgtgggattggtggtgatatcccctttatcattttttattgcatctacttgattcttctctctgctttattcatcttgctagtggtctatcatttttgttgatcttttcaaaaaaccaggtcctggattcattgatttcttgaagggatttttgtgtctctatctccttcagttctgctctgatcttagttatttcttgccttctgctagattttgaatgtgtttgctcttgctttctagttcttttaattgtgatgttagggtgtcaattttagatctttcctgctttctcttgtgggcattaagtgctataaatttccctctacacactgctttaaatgtgtcccagagattctggtatgttgtgtgtttgttcttgttggtttcaaagaacatctttatttctgccttcatttcgttatgtacccagtagtcatttaggagcaggttgttcagtttccgtgtagttgagcagttttgagtgagtttcttaatcctgagttctagtttgattgcactgtggtctgagagacagtttgttataatttctgttcttttacatttgctgaggagtgctttacttccaactatgtggtcaattttggaataagtgcgatgtggtgctgagaataatatatattctgttgatttggggtggagagttctgtagatgtctattaggtccacttagtgcagaactgacttcaattcctgaatatcctttttaactttctgtctcattgatctgtctaatgttgacagtgaggtgttaaagtctcccattattattgtgtgggagtctaagtctctttgtaggtctctaaggacttgctttatgaatatgggtgctcctgtattgggtgcatatatatttaggatagttagctctacttgttgaattgatccctttaccgttatgtaatgtccttctttgtctcttttgatctttgatggtttaaagtctgttttatcagagactaggattgcaaccctgcctttttttgttttccgtttgcttggtacatcttcctccttccctttattttgagcctttgtgtgtctctgcatgtgagatggatctcctgaatacagcacactgatgggtcttgactctttatctgatttgccagtgtgtgtcttttaattggagcatttagcccatttacatttaaggctaatattgttatgtgtgaatttgatcctgtcattatgatattagctggttattttgctccttagttgatgcagtttcttcccagcatgaatgttctttacaatttgtcatgtttttgcagtggctggtactggttgttcctttccatgtttagtgcttccttcaggagctcttataggacaggcctagtggtgacaaaatctctcagcatttgcttgtctataaaggattttatttctccttcactgatgaagcttattttggctggttatgaaattctgagttgaaaattcttttctttaagaatgttgaatattggcccccactctcttctggattatagagcttctgccatgagatccgccattactctgatgggcttccctttgtgggtaacctgacctttctctatggctgccgttaacattttttccttcatttcaactttggtgaatctgacaattatgtgtcttggggttgctcttctcgaggagtatctttgtggcattctctgggtttcctgaatctgaatgttggcctgccttgctagattggggaagttctcctggataatatcctgcagagtgttttccaacttggttccattctccccgtcactttcaggtacaccaatcagacctagatttggtcttttcacatagtcccatatttcttcgaggctttgttcatttatttttactcttttttctgtaaacttttctcacttcatttcatttatttgatcttcaatcactgataccctttcttcccattgatcaaatcggctactaaagcttgtgcattcatcaggtagttctcgtgccatggttttcagctccatcaggtcatttaaggacttctctacactgattattctagttagccattcgtctaatcttttttcaaggtttttagcttctttgtgatgggttcaagcttcctcctttgctcggagaagtttgattgtctgaagccttcttctctcaactcgtcaaagtcattctctgtccagctttgctccattgctggtgaggatctgagtttctttggagggtgactggcactctgatttttagaactttcagcttttctgctctgttttatccccatcttcatggttttatctacctttggtctttgatgatggtgatgtacagatggggttttggtgtagatgtcctttctgtttcttagttttccttctaacagtcaggaccttcagctgcaactgaaggttccaactctgttggagtttgctggaggcccattccagatcctgtttgcctgggtgtcagcagtggaggctgccgaacagtggatattgctgaacagcaaatgttgctgcctagtcgttcctctggaagctttgtctcagaggtgtacccagctgtgttcggtgtcagtctgcctctactggggggttcctcccagttaggccatgctgggagaaccactactctcttcacagctgtcagacagggacatttatgggataaggaaacctgcagaggtttctgctgccttttgttcggctatggcctgcccccatgggtagagtctacagaggcaggcaggcctccttcagctgcagtgagttccacccagtttgagtttcctggctgctttgtttacctactcaagcctcagcaatggcgggcacctggccctcagcctcgctgctgtcttgcagttcgatctcagactactgtgctagcaatgagtgaggctccatggtcatgggaccctctgagccaggcatgggatataatctcctggtgtgccatttgctaagaccattggaaaagtgcagtattagggtgagagtgacctgattttccaggtgccatctgccacagcttcccttggctaggaaagggaattccctgacccattgcgcttcttgggtgaggcgatccctcaccctcctttggctcacacttggtggactgcacccactgtcctgcacccactgtctgacaagccccagtgagatgaacctggtacctcagttagaaatgcagaaatcacccgtcttctgcgtcgctcatgctgggagctgtagactggagctcttcctatttggccgtcttggaattgctcccttgtcttattttaagaatggcccacagccacccaaactagcagcaaccacagccctgattaagttagcatccatcaatatcgaggcaggactgtccaccagaaaaaagattctgactccctgaagactcagatgatcattatcattttttttttttagcaataaaggatttttaaattaagatatctacatttttaacataatgatattacacattcagtattatcagtgtagcataaacataacttttacattcactggaaaacgaaaaaaattgtgtgattcagtttattgcaacattcacttcattgcagtcatcagctaccaaacctgcaatattgatgtatgcctgtattgtgcattaagttcaaaggccaaaaagatggtaattatatgataaaggtattgagcattttaaagacattttcttaatatgaagtatcacaatcattcattcttcaagctttcctaaccattttttcttcatgttatctcacttttttttttcaaaaaggagatcagaaggtgagagttaacaaattaaaacaatatgataacaaatatgagatgctgcttgtaactagggaaacagtactcctttaaagcctcaactttggggcaaattttttgaatttatgcttcttaataaatttaactggagttattctaagatgtaaatactagtgaaactttaagagtttaggataaatagttcaatcatattttttaggacaaactatagccacttttgtgctatagtttcaaagttgagtaattacaacagaaaacatttggcttgcaaagcctgaaatatttactatgttgctccgtatagaataaatttgctaatccccattacactttatttgtttcttattgagggtgggagggacaagattaaaatatattaagtgaagaaaaaggaatatagcctgaatatttatttttattacattacacagaattgttgacatcttgagggacaaccattaggtagcaagtagagtgttgcataaagtgttttcacttttgtaaaccacaaaaaagacaaatttttttaatggatctcagcaatagacttaattttaaaatcccaacactgctgttggaagattgtgctgaagggctgtgagcaaacctgcagtttttgttaaagaatcaactttggctcccagtgggtaatctattcctgttccagttgctgtagctaaagtgaattttttttgtgaatgtttccaactactatataatggatgtttgccctaaatattgctggttaatttaatcttcttttgtggagtaggattccaatgagtcactgtaaatgaatgatattcaagtggatctttactggaagatagaaaacctaacacctagatctacaaaatctttgtagtttggctgagtgaatccatggttgacaaaaatgtattgcagataaataagtttacattttagaaaactgttaaagtaactgggaaaacaattccaatatttaaagaaacacactgataaatgagcgtttccgttattttttattattatttatgagattaaaatgcaacatgatattagatttttcaaaagcatttttgaaatgattttaaacagtcaaaaatctttttttttaaaaaaataaatgctgttaggataacaaaatgtcatttaggataagatacaattagatatattactcacattatgtgcaagaataatataaaaatggttgagagaattaaatgtaaacaatgaaacaagttctgggtgaatgtaagggtatatcttatataatatgactatatagaaatgctttctgaattgactcaatattcagatgcaacaaaattacagattgttaaatttcactgacagacacaaaaacttttcatgacaaagtgcaccgtaggcaaagtcaaaggacaaataaaaatttagagaaaatatttacggaagatacaaataggcagtagactgttaaatagctgaaaagagattcaactttaaatgatgagaaaaacggaaaagcaaaactacactgagatacctatgatattgacaaaatctcaaaaatttgaaaatacactgttggcaaggctgtgggaaacagtcattctcatgcattgcatctgggaatgaagagtagtgaaaccctatggaagagaacttggcaatatataagaaaaactatttgtgcatttatctttgactccaggaattgcactttcaggaatttatcctgaagatacaggcccaatagtacaaaaatacaaggttattcattgaaaaatgatttatagttgtaaaatattggaaattatgaaaatatccaaacttagttgaataaactatggtaaaaacatacaatggagtattaagcatctgtaaaaagaatgaggaagatatttatgaaaggtatggggtgatttttcaaaagatgataagtgaaaaaaacaaagtgcaaaaaagaacatgtagtatgtttccttttgagtaataaagaggaggaaataacaatatgcatataccaacttatctgaataaaaagaaacagaaaagctaagctggtacacatagatgcagcatggagcaggaggaacaggggagctcctgatgcttctctgactatgcttttctgcattgttctgacttttagatggaggttaatgtttatatatttaaaaaatttaaagagataggaagtaaacaaaaaactaaaactgataagccagtgaacacaattgttttcaaatgaatagcattagtaaactgaaaggggacatagaaaaaggaaaaaaaaaagcttaatttttgtgactttggattttattgcctgccccctttgttgccacggggtaagggaaaagtggacaaaaaacttctaggagtagttttcttattttagtggtattggtaaagcaattccaaaattctacgtgtatttttggaagaagggagatacaaatgtagaatttaggaaggcaagggaaaaccccatgagatagattggaattaatgttatcagtaagaagtcatgatttcggatacatatgtgtatgtttgtttttacatacatataaatatacgtgtatatccatgtgtatttatacatacacacacacacatacatatatatgtatatgtacactcacacacacaaatgcatacatatatgcttctaggccctcttagtaaacagatattcaagctctgacacccaagaataatgagcacttttagtgccctgaatcctgttttttttttaaataccattccccagtgaatggacccagggttccaccaagaaatggctgattacagaactggggcaacaagagtccaaggtaagcctggagaaacttttgatgtcagataataaatgttgaaaaaattataggagtttatcaaaaggtcacaggggatatcttgaaggagctctcactgtaaaatctgagataatttaatctccaaataattaaggatagcaaggaataataaattgtttaacaacagaattcatgagtctatattagtattaaagagatggcaaatagatggattatttaattgaataaatacataactgtggaagaagagagggctttcccttatagtagaatatcaattgataaatgtgtagatggtactagagttggaaaatcatcactttgcaaccaccataataaaggttagtcaagagtaaggatcatcaatggatgataagtctatgggaaattatgatgcggagcatggtttaaagtgtcctcctacagactgccaataagttggaaaagaaaaaatagtaactctagactggggaagctggacggcactttatccaggtgattgtaaatgaaagcaatgaactttgtttctgcatgtgacagcctacaaagcacacagcgtctcttatgtattagccttcccacatatatacatgtatatatagcctgcatttaatcatgagcaaacaccagacaaactcaaaatgtgaaatattatattaaggaaacaaaaaagatgcataaaccctcatattcttcaaaaatgtaaatatcatgatagaaaaagaatggatgaggaaatgttccagatttatggggactaaaaagacatggcaaccaaatgtaatacataatcctcgacaggatcctgtataggaggaaaaacagcagtcttataaagaacaaaattaagatcattcataaaatgtgaatattgttgatagattaaatgaaaatattgtagtaatgttaaattttctgaagttgataatgaaactgtgattctgcaagaggatgcccttgtttataaatatataccaaaatatttattatttagggataaaaatatatacatagacatacacacaaacatacctttataaagagagagacaaatgatgcaaatagggcaaatattaacaatgggtgaatctcagtaagactacatgtttttccttgattttgcaacttttctgaaagcttgaagagattttcagctataatgtttttaaaaattagatttctgtcatttagtccctgaaatcttaataaggagacaatttaactgtaaaatacttaggacactgagaaaaaaatgatttgatcatcatttatgtctgaacatttaagaagatatatcaaaatctatgaaatattatactttagcttatgaaggaagccatatatattaaatgctcctaaatgtttaagtatctaactaattttgtgagtaagatttccttgaggctttggtctccattttcttgtctacaagatggggctactagggcctctgtacctttctgtgtattacaaggcaatgcatgatttagtaacttatagattaaggggaacaaggagttaactaaatgataaaaaaatgataagacagataagagagataagaacatactgtaaatgttcagaggtggaagtgattgcatctggatgggaaaacagttaaaagttcttgaaggagcatttaaattaaacttaaaagacaggtaattctttaataacttttctacattttgcctattgttttctataggactttagactattattcatgaaatgtagaaaaaaaatgttacttgcagtattgacagcaattctaataaagtaacactttttcattttattgtaacaattagttcaccctatcaaaataaacaatatgttttcttaactagagaaaaatatcattattgatcaattgataatgaaatggcaaaagctggtcttgaattcctgacctcaagtgatccacctgcctcaacctcccaaagtgctgagattacaggcatgaatcaccacacccagcttgatatgtttcattttgaacattggtatttattaaagcaccaagaaaagctgccataacctctgatcagagatcccctttgttaaaaatttttcttgtcttaattttataaataagtcaatagctgtataaatatatacacaccaaaatgggataatcaaattatggatatataatagatgttttaataattgtaccattatctgagtgaacgtgattttcaattcatttgggcaaagaccaaggaacacaattgctggaacatagggaaactatatgtttactttgtaagaaactgaaaaactcttccaaagtggctatataattttacattcccatcaccaatgattgagggttcctattgttccaaatttttgccaacatttagtgttgtcagtgatttcgattttggccattcttataggtgtgtagtggtatctggttgttttaatgtgcatttcctgatgacacatgatgtggaacatcttttcatgtgcttattttccaaagacagttttatttcttccttcctaacctacatatcaatcattgtctctgattactgtagctttataataggtctcaaagttaggtagtgtccgtcttctaactttgttttttttcccttcagtattgagttggttattctgggtcttttgtttctccatataaactttagaatcggtttgaaaatgcctgtgtatcttttttggtgaggtacgtgttcaggtctttggtccacgttttaattggattgttttcttattgttaaattttaagtattatttatatattttgaataacaatcttttatcagatatgccttttacaaatacttcctcacagtttgtggcttggcttccaattcttttaacattgtcttttgcagggcagagtttctgaattttaatgaagtctgatgtatgaattggtgttatatctaaaaattcaacattatacctaaggttatctaggttttgtcctcagtcatcttctagggaacttatggttttaaaatttacatttggatctatgatctattttgagttaatttttgtgaagagtgttaagatcagtgcctagattcattttttttgttttgttttttgcatgtggttgtccagtttttccagcaccatttgttgaaaagactatctttgttccattgtattgccactgctcctttgtcaaaaatcagttggctatatgtatgtgggtctatttctgggttctcttttccattccattacctatttgcttattcatttgccaatatcaatcattgtctctgattactgtagctttataataggtctcaaagttaggtagtgtccgtcttctaactttgttttttttcccttcaatattgagttggttattctgggtcttttgtttctccatataaactttagaatcagtttgtaaatatcgacaaaacaacttgctgagatttcggtggggattgtgttgaatctgtagttcaggttaataattgacatcttgacaatattgagcctttctgttcaggaacagagaatatctgttcattgatttagtttctctttgatctatttctcaaagtttatagtttgcctcatgtaaatcttgttagacatattgtattagatttttacttaagtattttatttttggggtgctaatacaaatggttatgtggttttaatttcaaatgccacttgttaattgctgtgtatagaaaagcagatgattttgtatattatttcctgtgcattgttataatcactagttccagaaattttttgtagattatttgggattttgtgaatatacaatcatgtatcttcatatatctgtgacaaagacagttttatttcttccttcctaacctacgtatgttttatttcctttccagtggtggaaagggacatccttgcctcgtttctgatcttactgagaaaattttgagtttctaaccattaagcctgatgttagctgtaggttttttgtagatttttaaaaaactcaatttgaggaagttttcctattgcttttttgataagagttttttttaaattttattttatcatggttggccattggatattgtcaaatgctttttctgcatatatttatataatctataatgatgtgatttttcctctttagcctgctgatgtgatggatgataataatttattttcaaatgttgaacctggggtaaatcacacttgatcatgctgtattataattcttttcatatattgttggattttatttgctaattatgttaaagagttttgtgtatgtgttaaagaaaggtatcactctgtggttttagttttttcaatgcatttgtctgattttggtattagggtaaaatgctgatctcatggaatgaatcaagtaccctagaacttaaagtattttatttatatatatatatatgaagtattccttatacttttatcttctgaatgatagtgtagagaatttgtataattttctccttagatgtttggtagaattcaccagtgaacccatctgggcactgtggtttctgttttggaaggttattggttaccgattcaacttctttgataaatgtaggcctagtcagattgtttattttttcttgagtgagttttggcggattatgttctccaaggaattagttcattttatttagcttatcaaatacatgggcctagagctgttcatatttattatcccttcagtttccatgaggtctgtagttatatctcctatctcacttctgattttagtaatttgtgccttctgtctttttttcttagttagcttagctagaggcttattgatattattgatcttttcaaggatcatcttttggctttgttgattttctctatttcctgttttaagttattttctactctaattttcatgttttttttaattatgcttacttaggatttaatttattaaggtggaaacttagatgattgattttagattgttcttcttttctaatatatgagttctgtgctataaattctcctctaaccactgctgcattgcattctaaaaaatttaataaattatatttcactctcatctagttcaaatatttttaaatttctccagagatttcacctatctgttatttttattttttattgagacagcatctcactctgtcacccaggctagaatgcagtggcacgatcatggctcagtgcagcctctacctcctgggctcaagtgatccttgaacctcagccatcagagcagctgggactacaggcgtgtgccaccacgcctcactaattttttatttttttgtacagatggtgtgtccctatgttgcccaggctggtcttgaattcctgggctcaagtgatctacccgccatgtcctcccaaagtgctgagattataggcataagccaccatgctcagcctcatccatttgttacctagagatatgttatttaatctctagaattttgggatttgccagcagtctgttgctaacttcttgtttagttccattgtgtctgaaagcagatattgtgtaatatatattcttttaaatttgttaagttgtgtttggtggcccagaatttggtctgttttagaaaatgttctatgtgaggctgagaagaatgtgtaatctgctatgttggccgtgatcattttcattaaatatttttcaatttaatttttcaacctctaagatcatactgatcttaggaacttgaaaagttgaaaaattattatatacatttatgcacatatgtacatatacacataaacatacatacatacaatacatatatatacacatatatagacatatagacatattattcatatgtgcccatcgatacagcaattgtactctatttgtagtatttgaaatagatactgtcacatcatagtattgagtttattaaataccatctgagtatgctaggaatgaactaatttttcaaaattgtgcattattttgcatctcagggtaaaagtattttaaaaattgacatctcgtaaaagatatctcttgaaaaatataaatttagaactgaaaatagcaggatatttctctttgcacatttttctctctctgagattaagcaaaaaagtagcagccaaataataaaactcttatattttctggtgtagacataccaaaactagttagcaatatgaaacctacacatgcacacacacacacacacacacacacacttacacattatagaaataaatgtattttcttttgtgattttttttcctatttgaactataaaataaggagtaacttcaaattgtattaaatcttagaatttcataaagattgcataatccagctaaagatgaaatttctagggataatataagcagttcatatatctgtgtgtagcagtgatgtttctgataataattgtatactggtttgggggtttttctttagagtcatatatattagctcatttgcacagttactatgtgtaaaacatgcacattttttgaatagtagttaaaatctggaaatgttgaaatgatgcatttatatttagatatttagtcatgtgtatggatgtggaaaatagcaatgatctgataagttttgatttattccaaaagtcaccatggtataaagggggttttccacatttttctgatctacttcaaggcagaatttgaatagacaagtgattctcaagagtgcctcagaatcacttgaagggcttgtgtaaagtgataaagagatggctaggccccacccctcgagtttttgataaaggaagtcagatatagggctgaggtggtgtatttttaacaagttctcagatatagctgatgctggtagtttggaatcacaccttgcaaaccaatggagtaatagataatggacaattttctaataaaatcagcacataattatttctactaagcaaatctgaatcatgaataggactgacagcctttcagatccacattaaaggaaactaactcttctgtctcggtactgatattattggtattataaatatgcagtaaataacacataatggagacatacctattctactagatctctctaggatcttaagttttgttatttaaataattgataaaaattagaaaagaatatgccaaatagttgggttcttttcctgaacaaaaagagtattttttgaaccatgcatgaaattcaaggaatgtaagtaaaaattgaaatctatattgagtgcctctgctgaactaaaatggatattttaaagtaagtgcccttgatgggatatttagatgaaaatctatattttttgtcgtattatattttgcaatgaaatccacttttatgaaactgaattcagaaaactctcatttcaaagtaacctgaagacaaatggatattcgttgtcaatcttaagatatattaaagttaatttgtgttggtaaaattttgagtgagtgtgctcttgtaaacacctgagtgctattcagcttaattgggttatagctcatcctgattgtgtttttctcctgctgtatctaatttctttttttcaatattttattgtttggtttgattttgaaggtgtatggaaattaaagaactctaattttttaagagccctaaagggaagtatgctttcgtgttagtcattcctgtgaacacctgtgcactgttgaatttaattgggttacagctggtgctgagagagagtcaactaaatgaggttttatagactggctagaaacttgacattgcatgtcattgcttcttccctcccattacttttctttctatacatttacaagatgcttggatctgaaagattttgaaggtaaattgaatgaacttatgatcggtgatacttggtagtgattacttcagaaaaagtgtacttccattatacgtttgtgcagtacctcagaataaggtgatcctaacctcagaagctagatggcctgcttgttgccagtaattcaggaacacaatgtaatactgtagttagattttcagagactggttattcaatcatatgagggttttcagaggaaaaaacaatgcgttgaaattgaaaaggtagtaaaaaattaaatattatagaaaccatagataacaaagtaaatgagggtagaatctatccactgagaggtaattatttttaatatctcaatatcatcattagaataagttcctcagtatggccaataacaataattaaataatttcaaataatttgttaaaaattaaatagaacaatttggcaacttctttagaaaatttaagatggctctgtgtttttctcttgagccaatatcatagactattaattagttcggcagataaaattgaatatacaaagggcatttgggaactaggagtaggtggcaatagagtaatatttaatggcactaaatattagaatcttcaactagatcccagttttagaaaactatattcctttttatttcaaataagtttgaaaatttaatagcattgaatgtttgttttgaatctattttacatgacagaaagcaaaatttaaaacaccagcaaaaactaacgaagtataaaacagcagttaaagtattcacttagtaaagcatttctaacatataacaaaaaaccttctagatgtattgctatgctactttaaatgtataatagagaaaaagaatttgctatcccactgttttttttttgaaaattaaactctgatgagtgacctacattttttcacatcctctgtgataaattaagaaagctatatattaagataaataaaatgtctttaaattcaatagaactattaaaaataggcattataatagaattaatgcatgtaaagtactaatatatctttcgtaatattcttgatcttgtgattaagccagcattttcccatttttgaaagatgaaactttcaaaatattatgggtcattcattttggtcaaattattcaacctggtgttctttgtgcacttgtctgatcagtaaagctttaggaagacagcttgctctcaggcactctccataagactgagcatataactgtgctggtcagttacaggagcaaaatgttcctttgaacctctatagattcaatggcaaacatgctggaggtctcactttgtagtacaccatcacccgtgcccaaatagggatgtgactatatcaagagagtgcagccattatgtgaggacagattcaggggacttgttagtttctggtaaagaaggagtgtaagtttaactactttccaaatgcggcctgatggagcatgcagagctgccatcccagcagagtaccttatcttggaaatgagatggatttgtggactgaggtgtgtctgaggagatctgatcacattggtgtcaactgaaggatgtggggagtccacaggctgaattatatacaataagggggtctacttaatttgtcctaaatcactgagattagaaagtttatccaggtttctaggagaaaaagtgagaatagggtgttttttttatatcacaggaatcttattaattttatgttcatgaagagatgcttggtgctttaaggaatgccagttaagtaatgggtaaatgagaaagaaaaaaaaattccctgcttgcctgattactcttttctagaagtaagtaacctggttttatggggctcaagactatgcctcaagttactacttttgtaaaacacaactcgccttactccaacttcatagaaactaagcttttgcaaatgtcataaacagctattgaatgtagtcagttacttttgcacagaataaaatatgaagaatatatgtttgcctggctcctgccatgatgcctgcccctgcttcttcgtgctccccatatccgtgtattcatttctagatagcaattcagccattgagcctcagacctagtacttgaaataaacataagttatttagaaaaccagctgcattttaacacattgcctgaggcaaccaactgggtcctgtgaactttatgcagttattattgacctgttttctctgttactccaaactaaatgtgtattatattgaggtaaccattatgcaagcaaatgtggttcttaaatatatttatgaaatgaagaaaatggtcagataagtggtaataattgtagtttagctgtggataaagttctggaattacttgataggaaagttttaagtctgatgatgatatctcaaatgttcaacttcagactctggaacttagtaagctatcacttatgtatttatgagatttgctgtgatagtaacattttaaatgcaaaggtacatttaattgagctttctctttttggcaacttgtactagaagaatgtacctaaattttcagtaagctgatcaaattaggagagcatctgtcttagcaatgtattattcatctctaaacaataatgatgcgggcagttgtattgtattgtcataattgaagttgcctagccatatgttatacaccctgaagacacacaaccacacaaaaattttaagtgatcatttactgattctgatattttacttgagaagataagcattttcaagtgcgccaagggaaataaaaatattacagagattttcctttgatacctaaccattaaattcaataactcataaatcaaaaaattttaaagcttattacgagtcaagaattgtggtaaatgagcagctgtggagacaagttaaagcctgataagatagaagccacctttcccaacactgataggaattgaaaaggaccattgaccctcaacctggaagccccacaaacacttcaaactctaaagcccaaatgcaattgccctccacaatcacacttctgcctagccaagcaaccaagctagagagaagcatctttgatatctggctctgtattgtttatcctctatgttaaaatctgtctacaagcactatcatttcaaattgctaaatatttcttgaaatgactctcttgtttacattttgtcattgatttcttcttaggcccttattaaatgatttatttctgcatttaagaaattctagactgagtactactatgtatcaattctgtgccagttacatgatgacaagagagaacatggtcttaggtagcttcagtggtgtgggtaagacagatataagaaacaaaccattttgtataaggatacattccataataaatggattacataagaagatgtacctaacatagcctttatgctggacctttcatcctttattcttcatgtattttatgcgtgactcagatgccaaaatccctatgcctgggcaacccatgcattctttatgtttttgtagattttctacatttcattttcttaaaagtatacacagcagcactggattaattatatacttatttgtctagttatctagttattcactgtcaagccataagtttttaaagagcaggtatcatgattatttattgaattcctaggtgatgagaaaacattgtttgtatgagatagtgcaaactctccctgggtattggatggaaggcttcattgaggaagtgaacttgagttgacttttaatataaattaaattagaaataaattcttaaaggaaattaaaattttaatagaattagacactttccagacagaaaggatttcagtggcaatgtgaaagcaaatgtgatggtgtgaaataacagaataacatgaaatgatccaagagctgtcagtagtttggtgtggctggggcatactgttttgggaaggagataccagaaatcaggacgggcatgggtagagaggctagaaatggaagcaccttgtacattttgcagagaaatgtaatcattatatgctgaaatctcagaagtagactgagttttatttttgcatattacctaggtagcaatgagtaattattttttttaaaactttttgggtctcatactcctcatctgtaaaatcatgattataatagttattttgaggatcagatgtatgtctataagtgcttagaaaaatgtgtggtccatggtaaacattcaatataagctggctggttttactgtcattatgacttttgtcttcattattattaaatatttgagggccatgagataatcttaaagcaattaagtaacatcataattacattttagaagggaaactgtgttacatagggagaggaaggactgaaaatgaaaactgaattaaaaaagataatttaagaggctttatgacagattttttgcttaaacagcattgtttaaatattatatttaaaatactttaaattaaaagttaaatagttttaagctgtgaaaagcatccacaagcaatggtgatggttacttatttaaaagataataaaaaatagatgagacaaaagcacagaattaattcattaatgtacaagatcacttttattattggggtattcgtattcattaataagagagcatagtgtaggggaaattaaatgctttaattaaaaaattgagatatttagagatacctggcagacaattacatgatatgatagcagtgctaaacgaagttctggtctctaaagagaggaatcagcaacagaaagtaaatgagcacagtatatccttcatcaagcctattttactaccaaggaaaaaaaaaaagtcagctgatctaaaccatgtttaggtccttaaggacagaagagcttatatacattttgatgcaagtttcttagctcagggtagatcagaattattcttggaccagtgtgcagaccagtgtttgaggagcactagtccagagcttaagaaaattaagagaattctgaattataaatattgagttaggactatacactagtaatagataaaatttttggaatgtaggaaaacattaaaagaaatcgtgagatgtgtaaaaaaaattaaaccacttaattttaaaagtgggcagagaggaacaccaaaaagtaatactcatggaattagaccatgaacaataagagcatggcacactgacaagaggataggcagcaattctcaaagggaggaaggctccccaagggaatgatcatgcaagacatgataattaacttactccttcagaaaatgctggatacttataaattcactctagtcttgacttttccctatcagatagctaagatactagatctatagtttaaagatggctatatgacttaagattgacaaagaagtttatctgttttatgtgccaaggtgtcctaatggagggaaaaacattataggaagtaggaggaaattttaaaatgttcatcattgtaatttatgcctataaaacacttcaatttttatccctatattttatgcctgtcttcagaggggtaatcaattcctctaaccactgaacagggattctgaagagactttcatatagctgctgctgtttcttagtttcctgctcccagggttttagttttagcttgctttgacctgctaagtcagttaacatgtactcatcagctttcaggtccaagactttttaacatctctttgtggtgtttcttctccaattctctcttcttttgtagccttagttttatttttcctgtcatttggtaggaattggggaaagagcaaatataaacttgtgctaacactacccacttccctgggagtccaaatttgtaatatgtgaggtaaatttatagtcatgctgaaataacaatcctttcttttttagtgattcatttacctttcctctgaacgttttctgttctaaagtatgttttcatcactttcctatttttataaattatataggtagaactcatgtagaatagttctaaagtctgtatcatttccattcttctctcagtctgattctaattgatgtgacttgagcacaacaaattattgccttgagcaaaacactgatttaagccactccctctctcttacatcatgctagggctaaaatttctgtttcactaagacgcaaatgtgcagttgctatcacttattgcctatgcaatttgttttgtctttttaaaaactagatctcttacatatagaacttactttcttgcttggtttttcagatttaataaatgcatctatcagcttttccttaaaccttttattccattatataaatcattttgttgatctcactaatttctatatctctacctttaaaaagtaaatagtattaagtgctgaagttaagtagtactaagaagggctcagattcaacacatcacatttctttacataagtatctttcaaaaagttaaataaaattatgtaatagacttttaagcaatatatgcttttcaatgccttcatatcccttcttctttgctattacttgtagaatacctaatttgtccatatattattgatcatttattatctaggatgcatcattttgagtaactatttgcccttaaaatcacaagccatttattaacaatagttaaaatatttataattgtactcatctttggaacactatttgtagtgtttttatgtctcccttctgaaagcataactgcaaggcatgtgattatatcatttgtataattatcatctgtatagcatccctaaatatctagaaaaataaagtatcaactgcttgtaaaatgtatattatgaacatgttccaataattcaattacactgtgtttaattttcaattaagtctatggttgtaccattttatccccctgaattggtcttttggcttccttgttacctaagaaaaaagggcacagtggcacctaattaagtgatttagattgctgacattgatgccattaaaaatattgggtcattcaatttgatacacttgtggaataaacccagttcaaagttaagaactatttatagttatttacatttctaattcaatcatctgtttttcttcgagataaagaaaatgtgaagaatgagggaaataagtaatacttagtgattactatgatccagatattgtgctgttttatttatttaatcttcattacctcacgtgcccatctaaatagatacccattttttgactttcagccattaaaataactaataatataaaatatctaatgcagtttaatatggtgaattatatatgtgtattctaagacatatatagttatatactatgctacatagatatactatatagtatatactatacaatatagatatactgtatatatattacatataatatactacattgatatactatatattatatataatataacatatcaatataatatatatatactttttttattatactttaagttctagggtacatgtgcacaacgtgcaggtttgttacatatgtatacatgtgccatgttggtgtgctgcacccattaactcgtcatttaaattaggtatatctcctaattctattcgtcccccctcccccaaccccatgacagaccctggtgtgtgatgttccccaccatgtgtccaagtgttctcattgttcaattcccacctatgagttgagaacatgtggtgttttattttctgtccttgcgatagtttgctcagaatgatggtttccagcttcatccatatccctacaaaggacatgaactcatccttttgtatggctgcatagtattccatggtgtatatgtgccacattttcttaatccagtctatcattgatggacatttgggttggttccaagtctttgctattgtgaatagtgccacaataaacatacgtgtgcatgtgtctttatagcagcatgatttataatcctttgggtatatacccagtaatgggatggctggatcaaatgatatttctagttctagatccttgaggaatttccacactgtcttccacaatggttgaactagtttacagtcccaccaacagtgtaaaagtgttcctatttctccacatcctctccagcacctgtttcctgactttttaatgaccgccattctaactggtgtgagatggtatctcattgtggttttgatttgcatttctctgatgggcagtgatgatgagcattttttcatgtgtctgttggctgcataaatgtcttcttttgagaagtgtctgttcatatcctttgcccagtttttgatggggttgatttttttcttgtaaatttgtttaagttctttgtagattctggaaattagccttttgtcagatgggtagattgtaaaaattttctcccattctgtaggttgcctattcactctgatggtagtttcttttgctgtgcagaagctctttagtttaattagatcccatttgtctattttggcttttgttgctgttgcttttggtattttagacatgaagtccttgcccatgcctatgtcctgaatggtattgcctaggttttcttctagaatttttatggttttaggtctaacatttaagtctttaatccatcttgagttaatttttgtataaggtgtaaggaagggatccagtttcagctttctacatatggctagccagttttcccagcaccatttgttaaatagggaatcctttccccatttcttgtttttctcaggtttgtcaaagatcagatgtttgtagatgtgtggtattatttctgaggactctgttctgttctattggtctatctctctgttttgataccagtgccatgctgttttggttactgtagccttgtagtatagtttgaagtcaggtagcatgatgcctccagctttgttccttttgcttaggattgtcttggcaatgagtgctcttttttggttccatatgaactttaaagtagttttttccaattctgtgaagaaagtcattggtagcttgatgcggatggcattgaatctataaattaccttgggcagtatggccattttcacaatattgattcttcctatccatgagcatggactgttcttccatttgtttgtgtcttcttctatttcgttgagcagtggtttgtagttttccttgaagaggtccttcacatctcttataagttggattcataggtattttattctctttgtagcaattgtgaatgggagttcactcatggtttggatctctgtttgtctgttattggtgtataggaatgcttgtgatttttgtacgttgattttgtatcctgagactttgctgaagtcgcttatcagattaaggagattttgggctgagatgatggggttttctaaatatacaatcttgtcatctgcaaacagtgacaatttcacttcctcattgctaatggaatacctattatttctttcttctgcctgactgccctgggcagaacttgcaacattatgttcaataggagtagtgagaaaaggcatccctgtcttgtgccagttttcaaagggaatgcttccagcttttgcccactcagtatgatattggctgtgggtttgtcataaatagctcttgttattttgagatacgtcccatcgatacctaatttattgagaatttttagcatgaagggccgctaaatattgttgaatgccttttctgcatccattgaggtaatcatgtggtttttgtctttggttctgtttgtatgatggattacatttattgatttgtgtatgttgaaccagccttgcatatcagggaagaagctgacttcatcatcatggataagctttttgatgggctgctggattcagtttgccagtattttattgaggattttttgcatcgatgttcatcagggatattggtctaaaattctctttttttgttgtgtctctgccagacattgataccaggatgatgctggcctcataaaatgagttagggaggattccctcttttcctactcattggaatagtttcagaaggaatggtaccagctcctctttgtacctctggtagaattttgctgtgaatccatctggtcctggactttttttggttggtaggctattaattattgcctcaatttcagagcctgttattgctctactcagggattcaacttcttcctggtttaatcttgggagggtgtatgtgtccaggaatgtatccatttcttctagattttctagtttctttgcatagaggtgtttatagtattccctgatggtagtttgtatttctgtgtgatcggtggtcatatcccttttctttttttattgtatctatttgattcttctctctttgcttctttattagtcttgctagcagtctatcaattttgttgatgttttcaaaaaaacagatcctggattccttgatttcttgaagggtttttttctgtctctgtctcctccagttctgctctgatcttagttatttcttgccttctgctagcttttgaatgtgtttgctcttgcttctctagttcttttaattgtgatgttagggtgtcaattttagatctttcctgcttctcttgtgggcattaagtgctataaatttccctctacacactgctttaaatgtgtcccagagattctggtatgttgtgtctttgttctcattggtttcaaagaacctctttatttctgccttcctttcattatgtacccagtagtcattcaggagcaggttgttcagtttccatgttgttgaggggttttgagtgagtttcttagtcccgagctctagtttgattgcaccattgtctgagagacagtttgttataatttctgttcttttacatttgctgaggagtgctttacttcctactatgtggtcaattttggaataagtgcaatgaggtgatgagaagaatgtatattctgttgatttggagtggagagttctgtagatgtctattaggtccacttggtgcagagctgagttcaattcctggatatccttgttaactttctgtcttgttgatctgtctaatgttgacagtggggtgttaaagtcactcattattattgtgtgggagtgtaagtctctttgtaggtctctaaggacttggcttatgaatctgggtgcttctgtattgtgtgcatatatatttaggatagttagctcttcttgttgaattgatccctttaccattatgtaatggctatctttgtctcttttgatctttgttggtttaatgtctgttttatcagagactaggattgcaacccctggtttttttttttgttttccatttgcttggccatatgtagaaagctgaaaccagatcccttccttacaccttatacaaaaattaattgaagatggattaaagacttaaatgttagacctaaaaccataaaaaccctagaagaaaacctaggcaataccattcaagacacaggcatgggcaaggacttcatgtctaaaataccaaaagcaacagtaacaaaagcgaaaatagacaaatgggatctaattaaactaaagagcttctgcacagcaaaagaaactaccatcagagtgaataggcaacctacagaatgggagaaaatttttacaatctacctactgaagcctcagcaatggctggcgcccctccccctgcctcggggctgccttgcaattcaatatcagactgctgtgctagcagtgagcctggctccgtggcattggaccctccaatctaagcacaggatataatctcctggtgtgccatttgctaagaccgttggaaaagcacagtattagggtaagagtgtccgaattttccaggtaccatctgtcatggcttcccttggctaggaaagggaattctccgaccccttgcacttcccaggtgaggcaatgccccaccctgctttggcttaatctccttaggttgcacccactgtccaacaagccccagtgagatgaacctggtacctcaattggaaatgcagaaatcacccgtcttctacattgctcatgctgggagctgtagactggagctgttcctatttggccatcttggaactgcctcccgatatatgtatattcttatccatacaacaaacctatgagaggtaggtgaaattattaacatagataataatgaagaaagtgcaaaacagagaaatttgttaacttgtaacatgaaattgcataataagagtcaagacccataagtgtgctgtattcaggagaaccatgaaattgcataatttgttaacttgtacaataagtagcatgaaattgcataatagacttctaagcaattcatgctttgcatcaccttcaaaccccttcttctttcctatgttgttcaagttaataaatttaagaagtcaaacagcagggtctcttttactccaaagcttatactgtttccagtatactatattgttttatgacattctagttaacatatcttttaatttgtttcttaggattcaatgtggttctttatttagtaatagccatcttgccaattgtgtcaataatatgtcgactctttaaagttgctaaatgtttattccttaccactgggactcatctgtttgtaaataagcagttccacaaatacacgctagtaaattctagagctgatagaaacagtagtgctagttatcgcatgttatgtaagaatgtgtcatttgttttgtttttaatatagctgacaatgtattcatgatttttcctggtacataaataaaagactttcaatttatagttaaaatgataatatcttcatgactgtacaacatgttgtataaataaaatattctgcttttattatattgttatccatgtttaatgaatttgagctatgtagataaaacttgaggcactagacagaataagtttctaagtcctcagtttttttattcatagtattgttagccacagaattattaatgaaaaaaacaacctttgtttatttgaatattctcacaacatggcacattgaagatgtgttttattttaaactcacatttcatacctaatattgcaaagcagacaatcctcactgtaagtattatttattgatgcttaaaacttcaatgaattattcagcccctttaacccttcttgctttgctgcacacctattgagttttcagagcagtttcatatcaataaatttgttcttgctttgctgctccaatttcatgcttggcctttctaagtgacatacaagaaaaataaataaatagctagaaggaataaaataagtatacaaattactttgaacaactcgagatccaaatcattaaagctctcaaagattttaaaaattaagatgtgaaagcaagtctacaaaaacaggctacatgcaaaaataataggcaaaaaccgtgtcttgttaacatgcaatctgtggagagtgaccatgtatttatacgcatcctgtacccggggttgaaatgaactctttacaaataagttcctaagagttcaaggacttactgccactttttatctcatgttgtcatgcacattagagaggtagacaagaagagaatgaacggcctttttagtatgtttgtgttactataaagaaacacttgaagccaagtaatttataaagaaaagaggtttatttggctcacagttgtacaggctatacaagaagcatcatgtagcttctgcttctgatgcgggagcttcaggctgcttccactcatggtagaagggaaacaggagcaggcttctatacagagatcacatggtgagagaagggacaagagagatggggaaccagctctacagggaactagtagagtgagaactcactcattactttgtggtcaacaccacccatgagggatccattccatgactcaaatatgtcccaggaggcgccacttccaacactggggatgaaatttcaacatgaggtgtggagagtcaaatattcaaactgtagtcatctcttctgtggagctagagggttgggaaatttacccactaactccatttgtcagtggtctattgccgtttcagtgagggctgttgatgctcctgcacttccggcttgctcagcctaggagctgatagtgctccaggccagtaaaaaaaaaagccctcaggccaaaagtgagtactaatcctttagcacagagatgaatgtctagagtacaacagcctcagttgtattaagataaagagagatgttcatgatgtttaaaatcagatgatgacatcaaaattgaaatggaaaacaaaaagtaaatatttcttttcacttcctcattcttctgactttgaaaacctcttaccttttatggatacagagacaaatatatctctgtctatggaaatagtaaaatgaaattaagaacaattttcacataacagtataatttagtataattctctactatcaattgtacaagaatgctttatctcatgatgcaagattaaattgttatccagttccaaaccaggtggttatatcagccagcctttttatgatgacttatttgcctttaagcaaatatattacatccaaccttttaaaatatttttatcatttcctatttttaatactgaatcctcagactgaaaattcaacagtttttgctttaaagttttacatctcttcctaaattttatttgcctgcaatctgatataggtgttcatagtcatctaaacatttctcttgttgttgttggctttgctgctggggcattcagtaattttcatgacctgtctccaggtgctttataatttccacatgccttgtatttatgaacaccagcttatataacattcagatagaaacaaaggaaaatgttatatatcacaatggcaggatgatacagctgtgaaggtagcagacatatacagtgctttatattttttaaatcattgctttaagattagatatgatgaatttcagatgagtaaaccaaccatagtgtactcctgtattttatctagaaaagtaatgataatggataccctcaggtcagacctgggtgttcatgatcacaacctctgtgtcttttcttggcaccttatttgctgtgggggaaaacaatttccattcatgtatcatactccattcggacaaagcaaacacctgaaacttagacaaatgttattcacatggcatcctctagatttctgaggcaaagacattggcaaaaacaaaaaaagaatcatttacaatagtgaatctcagtagaccttttcccctatctcagtaaagattaaacaatcttcttaataaactttgcattaggaacaattaaatggttcatttttgatgcagacatttatttgaatgattttaattaccacttaatatgcccttatattgcccaatttattcattttagtatcttataaccttgatttacatatttttgctgttctatttatcaccattcattgtaggttattagtgagatttaatttacactgacatttccagtgacacttaattttatattctttttccagatttaaatgtttctgtagttttcaaattttatttttaagccaacaaagtttccttcccatctccatgtgttctattttaaaaaattttcaaaagtaatttcaaaaacctttagttcagttataaatatagatttttattcttcccaagcaatactgtttatacattcaaaatcttatagctacccaaagtataatgtgatcagtgaatattactcttaaagtaaaaaatactaatttctttgtctttttcttttttctttttttcttttgcagagtctcgctgggtcacccaggctggaatgcagtggcactcagctcactgaaatctctgcctcctgggttcaagcgattctcctgcctcagcctcctgagtagctgggatcacaggcgcctgccaccatgactggctaatttttgtatttttagtagagacaggttttcaccatttggccaggctggtctcgaactcccgacctcaggtgatctgcccactgtggcctcaggccgtttaccacatattctctagattcgtgcaaaataaacacattgacagtaagttccttaactttaaagaatttccatatccttatcagaatcagtgtattaatgtgactgggaaaaggagaaaatacagcaaaatgacccaccattttactcagtcctggttttctttgtttttcttgaactggggaatttatcaatatcatgtctatttctaaaaagttacctagtcaaaagctttgtaagcaatttcactgttattcctactggataattgagtaaaattttggaggaggaagacattttaaatttcacttcttatattcaaatccaagatttttttcaatttaaaatactaaatactgtctttccatcatttttttttaccatagatgaaataacttaaagggtagtatgagctgagaagggaatacagaatgtaatttactcacatctttgtttgatctactatgaaaatttttaaaggcttcttttatgtttgctgccttgaaacatttgaatgaacttcatgaaagatgtactgagcatgtatacctttatgttctggttgcttgagtccttcgaaagctgaagaacctatttttacaaaagaattttctcaggtaccaagcagccaaccaatgataatcactagtttctttagaaaacttaaatattctctgccttattttattatggcaaaacatattatggcaaatgaaataaaggaaagtattaggaagaataaagagaaaaagaatgtataattttatgttacctttatgtaatttatctggtctatttcccttggttttgattcaatgaaatgtcaatttaggaattatttattttaatacagctttttttctaaatgttttataagcatgtatccaacaaacatgatttatgataatgtttaatcactaaacaaaatcaataacacaatatatttggaaaatacagcacattcagaagctagatttttagtgatcttagcatcatatactaaaaagtacattgtcttctgtatgaagtcacttcatccccaactaaaatgattatagttatgtgaagttaataatctgttgttagattgaagattcacaatatttatataattttatgtaattttataaattttcctataatatagattttagaaattactgtctgattactatcttttgggactcttctaaatttcttaaaatattcctctcataatattttgacatgagaggataagagctgcatctggagaaaagaggcttgggtgttattaagtcctcagtgttataccaattacttgcaagaaattaagtccaactgaaatggctgtactagaagattacttaagccatcctcatagatagaatttttgataagaatttagtgtcctttccaagaatcttcagtgactccctatttttcctctgttgctcagtatttctaacctattctgcaagggttttgaatgccttaatttatctgataccaccttccagataaaactatctggaagtaattaatcactaaatttctgcatatatacatatatatatatatatatatatatatatatatataaaatcttgactagttaatatatttaatattttgcttcccattttctgtgacctaatttgtgtgcttagttgtataatttatacacctgtatggtgtttattttagtaccaaacccataattatgattttttctctcataaggctgtgagtcctttgagagtttgagaaagggttttcattttttttttttcatcccactactgatattggagctagtggcacaaaaaaaaaatgttttggatgaacaagatagccaggattttgacccccaggatctttgcctctggtgttatgcctataaacatgactagtgttatgttgttacacagtaaaaaaaaaaagactttgcatatggaatcagtgggccttaaaatacatagattatcatggttatccagatgggcccagtgtaatccttggaccctgaaaggcagatgagggggaagtgacttcagcaagaagcagggttaggaggttctccacttgtatctcttcacagcaacaataattttgcagccatctgtaggaaaagaaaagtgactttgtaggggtattgggattcaggaaactccagtggagcctaagccctggaagaattgttttgagagggcagacccatgcccaggtggccagatctctaatcatggtcccaactccagagcctatccccctgtaaatatatctatattcctgtttggcttttgccatgccaccagaaccatccaccgaggaatcagggaagagtcacacccactcaagccttgagtgacagatccaccaactcagatccagctgtgagccatgaaacagctgtaagacacagctccaacctccctcaactatattctgaggccaatactgcttgtccagagacccacttggttaccaagtggaatctcttccagaaacctggaagaaggcacacacatctgtgaaattggtaacaagctctccatctgtggacatgaaagcaggtattcatcctggtgccagtgctactgactgaggtccttatggaagtccaacccacccagggaccagacaaatccataatcactggagtctccagtaacaggcccaccaaccatagactctgcggcagattcaacagtaggcacatgtcctggctcaaaccccaccagacaattatcttttaagcaactttatcatcccagataccaaacaggagaaggtctttacattctgagaccagtctgtaaagaatggaagtggtatttattccttcaaatgcacagatacctacacaaggctacacagataatgaaatatcttggaaacatgataccaccaaatgaaacaaataaagctccaggagctaaccctaaagaaggggggatctatgaattgcctaaaaataattcaaaataatgattgtaaagaaggtcaatgagatgcataaggaaacaaaaaaaaaacagataactaaatgatattaggaaaaaaatgcatgaacaaagtaaggagtttaataaagaattagaagccataaaaaaagaaacccaaacagaaatcctggagctaaaaaatacaatgatagaaatttaaaaaattaatggagagcttcagcagcagacctgatcatacagaagacttagtaaactcaaagataggttggccaggcatggtagctcactcctgtaatcccggcactttgggagacataggcatgaagatagcttaaggccaggagtttgagaccagcctgggaaacatagcaagaccttatctctacaaaaatgttaaaattaaatattagctagacaagtaccaggtttggtggcacacacctgtagtcctagctactcaggaggtggtagtgggaggatcactggtgcccagaaattcaaggtgacagtgagctataatccttccactgcattcaagcctgggtgacagagtgagaccatgtctctcaaaaaaagaaaatataggccaatcagaacaagaacaacaacaacaaaaaaaaacaaaaagaatgaaaaaaattaaaacaagcataagggacctatgggacaccatgaagtgtgtgaatatatgaattaagagcatcctagaaggagaaaagagaaaaagccagaaagcttatttaaagaagtacttactgaaaacttctaccatcttaagaaggacatggacatacagaataataaagctctggggatctaagcaagataaatttaaaaaatcatctaagacacattataatcaaattgtcaacagtcaagaacaaagagagaattttaaaagcaacaagacttgtcacataaaagggaacctacaaaaggctatcagcagacttctcagcaaaaaccttacaagccaggagagagtgggataatatattaaaattgctgaaagaaaaaaaaactatcaaccagaaatactataccaagaaaagtggtctttcatacgtgaagaaaagataaagacattatagataaacaaatgccaagagagttcatcaccaggaaagctgtcacaagaaattctaaaaggaagtctttgagttgaaacaaaatgctgctaagtaacaatgtgaacacttaagaaaatataaaactcactgctaaaggtaaatatatggtcaaatcagaatgctctaatactgtaatggtggcatataaattacttttaactttaacagaaatgttaaaagacaaaaatactaataactatcactacaataatgtattaatgcttacacaatataaaatatgcaaagtgtgacatcaataacattaaatttgagggggcagtgaaaatgtagagttcttccatgcaattgaagttaagttgttatttgcttaaaataaaattttataacactaagatgttttatgtaaacccaatggtgactgtaaggaaaaaaacctgtagtagatacataaaagagaagcatatcatttcaaaaaaattcacaaatttaaaggaaggcagcaagagaggaagaaaggaacaggggatccatgagacagccagaaaacaatgaacaaaatggcaatagtaagactatgcctatttattatctctttaaatgcaaatggattaaattctccaatcaaaagatgtagagtggccaaaagaattttacagtagaaatccaacatttgctacctatgagagaccaactttagccataaagacaaacataggttgaaagcaaaatgactgaaaaacaaaacccatctaaattgtaaacagagcaaaggtgactatatttatattaaacaaaatacacttacaattaaaaatatcacatgagaaacaaagaaggtcattatataaaatcattatataatgggttgattgattcaagagaacataacaaatgtaagtataagtaagtgcatcatatgcacccaaaattgacacacctatgtatataaagcaaatgttagtagaactgaagtagatatagacagcaatacaataatagtaggagacttttataccccactttcaacatgaatagatcatccagacacaaaacctataaggaagcagtggacttgaatagtgctatgtggcaaatagacctaacagatgtatacagaacattccatctaacagcatcagaatacacattcatcttaactttactcagaatattctccaagatagcaattgtgaatgggagttcattcatgatttggctgtctgcttgcctcttgttgatgtgtatgaatgctagcagtttttgcagatctattttgtatctgaggctttgctgaagtggctaatcagcttaacaagcttttgggctgagttgatgatggggttttctagacatggaatcatgacatctgcaataaaagataatttgacttcctctgttcctatttgaatatcctttatttctttctcttgcctgattgccctggccagaaattccaatactatgttgattaagcatggtaagggagggcatccttgtcttgtgctggttttcaagggaaatgcttccagcttttgcccattctgtatgatatggctatgggtttgtcatatatggctcttactattttgaggtatgttccttcaataccagtttattgagagtttttaccatgaagcgatgttgaatattatcgaaggccttttctatgtctattggaataatcatatggtttctgtatttatttcgtttatgtgatgaattacatttattgctttgcatatgttgaaccaaccttgcattccaggaagaagccaatttgattgtgttatataagctttctgatgtgctgctggatttcgtttgccagtattttaatagaggatttttgcattgatgttcatcagggatattggcctgaagttttattatttttttgttgtatctctgccaggttttggtatcaggatgatgctaactgcatcatcaggagtccctcattttcaattgtttggaatagtttcaccaggaatggtactcttattttatgtctggtagaattcagctgtaaatccatcttgtcctggtcttttttaattgataggctatttattactgcctcagtttcagaacttgttattggtctattcagggattcagtttcttcctggttcagtcttgggtaggaatacaggtaacaagggaagtgaaggacctcttcaaggagaactacaaactactcctcaaggaaatcagagagaacacatacaaatggaaaaacattccatgctcatggataggaagaatcaatattgtgaaaatggtcatactgcccagacgaatttatacattcaatgctattcccattaaactaccattgacattcttcacagaattagaaaaaaaaaactattttaaaaatcagatggaaccaaaaaagagcctgaataggaaagagaatcctaagcaaaaagaacaaaactggagtcatcacactacctgacttcaaactatatcacaaggctatagtagccaaaacagcatgacactgacaaaaacagacacataggccaatgtaacagaatagagaaaacagaaataagactgcatacctgcaatcatcttatcttcgacaaacctgacaaaaacaagcaatggggaaaggattccctatttaataagtggtgccgggagaactggctagccatatgcaggaaattgaaactggaccccttccttatatcttatacaaaaattaactcaaaatggagtaaagacttgactgcaaaaccaaaaactatgaaaaccttcaaagaaaatctaggcaataccattcaggacataggcactggcaaagatttcatgaggaacatgtcaaaaggaattgcaacaaaagccagaattgacaaataggatctacttaaactaaagagtttctgcacagcaaaagaaattatcatcagagtgaacagaaaacctacaaaatgggagaaaatttttgcaatctgtccatctgacaaaggtctaatatccagagtctacaaggagcttaaacaaatttacaagaaaaaaactgaacaaccccattaaaaaatgagcaaaggacataaatggacacttctcaaaagaagacattcatgcagcaaacaaacatatgaaaaaaagcctcaacatcattgatcattagagaaatgccaatcaaaaccacaatgagataccatatcatgccagtgagtatgatgattattaaaaaatcaagaaacaacagatgctggcacagctgtgtaggaaaagattggtggaagtgtaaattagttcaaccattgtggatacagtgtggtgatttctcactgatctagaagcagagatatcatttgacccagcaatcccattactcagtacatagccaaaggaatataaatcattctattataaagatacatgcatgcatatgtttattgcagcactattcacaatagcaaagatattgaatcaacccaaatgttcatcaatgatagactggatgaaggaaatgtggtacatatataccatggaatactatgcagctataaaaaggaatgagatcctgttctttgcagggacatggatggagttggaagccattatcctcatgaaactaatgcaggaacagaaagccaaacactgcatgtttttacttataagtgggaggtgaatgataagaacacatagatacatgtttaggaacaacacacactggggcctgtcattgggggtcaaggggagagagagcatcaggaagaatagctaatggatgctgggcttaatcctaggtgatgggctgatctgtgctgcagaccaccgtgacacatgtttacctatgtaacaaacctgcacattgtgcacgtgtaccctggaacttaaaataaaagttgaagagaatttaaaaaatattctctaggatagagcatatgttgagccacaaaacaaatcctaacaaatttaagaagcttgaaatcatatcaagtatcttttctgaccacactgttataaaattaaaaatcaacaacaggaagaaaaatcgaaaattggtaaacagtgacttgacacaaaagaatattgaaacataacttaccagaatgtatgggatgcaaacaaaaaagcagttctagaagggaagctgtgaccaatgcctacatttagagaaaagaaagatactggataaacaacttaaattcacacctgaaggaaatagaataaaagaacaaattaagcccaaagttagcatcaggaaagaaataatacagattagaactgaaataaatgaaatagagactagaaaaacaatatataaatcaacaaaattcagagattttttaattaaaaaaaaaaaaaacaaaattgacaaaactccagataggctaaccaagaaaaagagtgagactcaaataaataaaatgttaaatgaaagaagagaaattacaaattataccacagaaatacaaaagatcataatactatgaacaaatatacactattaaattgtgtaaccaaaagaaatgaataaatttgtagaaacatgaaacctgccgagactaaatcataaagaaatagaaaatctgaactgatcaataatgggtaaggagattgaatcagtaatcaaagaaacacccaacaatgaaaacctagaatttgatggttttacaggttaactctaccaagcctttaaagaagaaatacaaccttctcaaactttccaaaaaattaaagaagaaacacctcccaaactcatttactatgctagccttaccttgatactttggtatcaagtattaaagacaaaagctttgccagagaaggacattataagaaaagaaaattacaggccaatatccctgataaacgtatatgcaaaaatcctcaagaaaatgctagcaaaccaaactcaacagcacattaaaagaatcataaaccatgatcaagtaggatttatccatggggtacaagtatggttcaacatacacaaatcaataagtgtaatatatcacatttacaatatgtacagtaaaaatcatatgatcatctcaatagatgcataaaaatttttcaacactttttcacgataacaactgtcaacaaattaggtataaaacaatgtatctcagcataatgagtggtcatataaaacaagcccacagctaacatactcaatagtgaaaagctgaagcttttcctctaatatcaggagaaagacaaaaaaagtccatttttgccacctgcattcaagataatactagaagtcttagccagaacaattaggcaaaaataaatgaatagaaggcattcaaattggaaaggaagaagttaagttgtctctgcaaatgacatgatctaatatatagcaaaccctgaaaattcagtaaaaactgtcaagctaataaatgaatttggtaaaatcgtagattcaatattaaaattcaatttctgaaaagttacaatgagccacctgaaaaagaaattaagaaaacaatttcagttacagtagcatcgacgataacaaaatattaggaataatttgaaggagacaaaacatctgtacacctaaaattatgagattttgatgaaagaaattgaagaaggcacaaatgcaaaggtatctcatgctcatggattgaaagaattaatcttgttaaaatgtccatactatccaaagtaatctataaattcattgcaatccttatcagaattccaatggcatttttcagaataatagaaaaaaatctaaaatttatatggagccacaaaagtccaataatagccaaagcaatcctcagaaagaagaaaaatctggagacatcacatgtactaattccaaactatattacaaagctatggtaatcaaaacatgatggtactggcataaaaacaaactcatggacagatggtatagaatagtgagcctgtaagtaaacccacacatatatagtcaaaaaagctttgacaagagcaccaagaatacacgttaggaaagatgagtttcttcaataactaatcttgggaaaactggataaccacatgcaaaagagtgaaactggacccttgtcttacaacatatacaaatattaacacaaaatggattaaatacttaaatgaaagatctgaaactctaaaagtcctagaagaaaacatagggtaaactcttcttgatattggtcttggcaatggtttcttggatatgactcccaaagcacaagcaacaaaagcaaaaataaacaaatgggacaacagccacctgaaaagcttcagcacagcaaaggaaacaaagtgaaaatgcaacctacagaacaggagaaaatatctgcaaactatatgtctgataattggttgaaatatgtaaggaactcatctaactcaatagtgaaaagaaaacaaattaccttatttaaaaatgggcaaaggacctgaatagacagttttccaaagaagacataaaaatatccaacagatatataaaaaggtactcaacatcattaattgtcagagaaatgcaaatgaaaatcacaatgagatattacttcacgtctcttagaatggcttttgttaaaaaaacaggagataacaattgttggcaagtctctggagaagcagggaacccttatatgatgttggtagaaatgtaagtttgtagagccctgtggaaaacaatgcagtttcttcaaagatgaaaaatagaattaccataggatccagaaattctacttctggttatatgtccaaaggaaattaaattaatatttcaaagatatatcttcatcatcaggttgactgcaatattattcacataggcacaatatggaaacaacttaagtgtcagctgacagatgaatggatagaaaatgtgatagagatagatagatagagatatatagatggaaaatgtcttttagtcattaaagcaaaaagggaaatcctgccatttgtgacaacatggataaacctggagggtattatgctaagtgaaatagccagagacagaaaaacaaatcctgtgtgatctcacttacgtgtagaatctaaaaaagtctaacttacagaagcagagcgtagaattgtggttcccagtggctgggggttggaagaaatggggaaagttggtcaggggtacaaactgtcaattattagatgaataagttctggggatcacagctaatgtgaattagcatgggtggtgtgttagccagagatgtcctgtgaaacagaacagaagggtatacatagatatataaaaggagatctattacaggaattggcttaggtggttatggaggatgaaaagtctcatgatatgtagtatgcaaactggagaaccaggaaagcctatggtgtaattcagttggagtctgaaagcctgagaaccagagaaacagcataactctcgtccaaggctgaaggcctgagaaccttgtggagtcgtgggtgtaagtcctgaaatacagtggccagagtatgtgtaactctgatatcccaggcagaagaagatggatgtcccaactttggaaaagatggctaatttgtccttttactaattttttgttatatggaggcgtatcttctttattcagtctgttgattcaaatgctaatctcttccagaaatatatcatagacacacccagataaaacattttaccacctgtctgtatatcttgtaacccactcaagttgacgcataaaataaacgatgacaggtagtgatgagcatgttaatttgattgtagtaatcattacacagtgtaaatatgtatcaaatggccgcactgtacaccttcaatatacataatttacacttatcaattaaatattttaaaattaaaaattaaaaaaagttaaaaaaaaaaaccacaatgagaaaggaatgataaaaggaaaggcaggtaagctgaggcaactgaaggattttgattataaagggctttatatttcagctgcctttgaagataaaggaagccaggatcgaagaaatgcaggcaagctttagaagcttagattacccttggcaaaagccagcaagaaaaggggacctcagttctacaactgccagaaactgaattttgttaacaacctgcaagtgcctggaagtaaattctcttccagagcctccaggaaagaatgtagccctgtccacaccttgattttagcttagtaatactcatgatggactcctgacattcagaactgtgagataataaaacttttgttgttttaaccatgatgtttctggtaatttgttacatcagcaaaaaaaaaacccctgtacattaagttattgattgtatggttgaatatctttgctcctccctttgcctttacatccctttctctttacatactcacattcacctttccaggctcagcctagtcacaccacagcacagggatcttctctgatgattccggcttagactgatcattttcttctctgaattttcttatgtgtacaacacacttactgcattttgtgttgccttattgcctaattgtgtgtcatacttaattaccctgttaataataattttgtatgcatatattttgttttccatgtggatttgcaaacagagaattaggaggacattggtgcttatgaaatactcattgtttgattcatgttttttaattttcaaaatatttctaactaatcaagtaattcttaggtgattttttaaaaagaattccagtatattttgaaacagatttctggccttaattttgtataaaaaagaaaaaaacagatgcattaagataaaaggatcctgcacgttgcctttaggacatccagtaaatcaccaaaaagaagcaaagcatataaaatcaaaacatacacaacctttttaaaacagcaggtatagctcaagttctataacagtaaagcagctggtgttagcaatgggtaaataatttatataggactgagaggaagttggaaagacatttcaatgtcaactttttaacatataagattttcaaattaataaatatagcgtatttgtggttgtggctactaaaaataaaattcactgaaaattaagacataattctactaatgagtttattctagaaaacctgacagttttatatggcatgaaaatgcatatcttctttttatttcattagaaaaacatgctgaaatatagtattgtttttttcttttaaaaaaagtaggtctggcctggcgctgtggctcacgcctgtagtcccaacactttgggaggctgaggcgggcagatcacctgaggtcaggagttcaagaccagcgtggccaacatggtgaaaacccgtctctacttaaaaaaaaaaaaaaaattagccaggcatgatggaaagtgcctgtaatcccagatgctaaggagactgaggcaggagaattgcttgaacccaggaggtggagattgcagtaggttgagatcatgccactgcaattcagcctgggtgacaagtgtgaaactccgtctaaaaaaaaaaagtagttctggttaacggtagaaaaagaatataagcataattaggaacctgataatcagaggtttgcttagcaaaaataggtgaaagaaatacttaatattccttattttataaagaacaggcttgaaactaatttctaacatatagcttatgaaaccaagaaacttattttataggtaatgcacaaataagacacttagcctctagaattgaaagcaattactggaactttattcagaagagtttccccctatctacttatcttactagcatctcctaatataaattttagcctataaaaatactggtcatctccttcaaagaagttctaagaaaacaaaagataatatatacaaatcaaccaagcagtgttcactgagtctctgtattgtgcactgttcccgtcagcttcagaggagacagcaggcagagaaatgtcatatataagagaatgagttatgatctggtcaccagaaagcctgcaaaatagctgaagaatgaggaaacctatgtaaggaaataaaggcaaagagtacataacactgtaagaactcagcagatcttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaatttttttgtatttttagtagagacggggtttcaccttgttagccaggatggtctcgatctcctgacctcatgatccacccgcctcggcctcccaaagtgctgggattacaggcgtgagccaccgcgcccggccaagaactcagcagatcttaagaaaactcttagatctgcggaatttgggttggtttttgaaatgccctctcacactttacctttctcatcctactcaaaccttcaatatctgggtcaacagttatctcagctctatggagtaattttgttatgttcccacacaaaattattccactgttttacaaccactctagctatttcacatttatccacatttctagctatatgcacttggatagttacttaagcactctatgcctcaatgttctcatcagtaacataacagtttctatctcataggattattgtattatatgagtttctataaattagttagaacagtgtttggcacatagtaagtgcttgagaactgctagcttttagtataataatgttttatttttaggagccgatattataaaatgcaaggtcattaagagtaaaatatgccttatttttacagaagtaaatgtaatatctttccgagtataggtgattaatagctattgtttaattggtgtgagtatgtagaaaaagaaaatgttttaggtaagagaaacaagaaattatatgtgtggttgtgattaagctttcataccatagttcttgtttaattgaattagcttttaatattattcctctcagtaaaatgacttttatacacattaatttgacttgaattggacatgtatgtttaaatatgcctatttttataaaactatcctatgaatatatatgaactaggtgtaagcaatgtatggtttatatatttaagaaattaatttgtttctaataactatattttgagttagaaacactaaaagcgacagcatgaatttttagtatcctggcttaagagaaagaagataattgacatgtttgggtgaacatcttttacctcgtattttcatttttgctcaattttagaactaatgggaactttaaacttttttatcttgaaaaacaaaattgaaggaaatacttttgagaaactttgctgttagaaagattttgatttcattcccatcagaatgtcatataaattacacaaatcaaatctgtcgacatcccaagaatattataattacacgttcttatgaattacatgggaattgcacatactgtgaaaagcattgtaattgtaattattatgtaatatgtattataatttatcctatagaagtaacaaagtcttgtaattaaataaagtaataaatgtgttgctatattaccataattgacaagtaattgataagttatcttctttaggacaaaatggtcactagtaagaatggacccaattcaacttttatcttaagttaaaatactcattaaatttaagatgagcattgggtatctaaaataatcagtcatagaaatagagtcaaaagttggtttccatagactggtagagagggaaatgtggagttgctgctcaacaagtataaagtttcatttatgcaagatcaatacgttctaaagatctgctctacaacattatgtttatagttaacaacactgtattgtataccttacattttgttgaggatagatcttatgttcagggttcctaccacaatttttaaaattatactttaagactggtatacatgtgcagaatgtgcagttttgttacataggtatacacgtgccatggtggtttgctgcacccatcaacccatcacctacattaggtattcctcctaatgttatcccttccctagccccccacatcccaataggccccgatgtgtgatgttccccttcctatgtccatgtgttctcattgttcaactcccactatgagtgagcacatgcggtgtttggttttctgttcttgtgatagtttgctgagaatgatggtttctgacttcatccatgtccctgcaaaggacatgaactcatccttttttatggctgcatagtattccatggtgtttatgtgccacattttctttaaccaatctattattgatggacatttgggttggttccaagtcttcgttattgtgaatagtgctgcaataaacatacgtgcacatatgtctttatagtagattgatttataatcctttgagtatacacccagcaatgggattgctggatcaaatggtatttctagttctagatccttgaggaatctccacactgtcttccacaatggttgaactgatttacatgaccacgatttaaaaaaaaaaagaaaagtagtggattgactcatgaaaggtcaagaaacttcagaatgaaattttacacagaaatattcagaattttaaaaaaacttagtctattgtatttaatacaatttcaatttgaaacctatatgataaaatgtgtgcaattttaagagtatttttaattgaatcctaaatgtttcttgttgacttttaatttctgatttgtgtgtttgcatatttgtatgtaaattttggatacttaatagtcttctaaaaacaattttgaaaagtaaaacagactttaaatttatataaaaaaatgattccaacttttagaatgcttactatatgctgggtactaagcatgttatatttattgaaccctatgagtcagacactcatataagtgattcagataactcatttaaagctcactataatcctataagtagatgctgttaccatccccattttctaggtgaggagctagggcacagtatagtaaggtgactgtcctaacatcatagaataatgatggattaatggtattcaactctagcagctagttccagaatccaggctcttaatcaccatgctaaccatcttcattcaaatggaaaacagataaggaagatagaagtttaaggttgtttttctgtgaatgaagaacatcaccaccaccacatttatttaacagccttacacactttaaagtagcacttttcagatgggacacattgattgctccaaggggataggtacaaagtaaataaaatttccccacggcccatcctgctgtcttatcctggaaagtattagtcacttttctcaaagtgtgattcatgtaatatataacatcatgttaggtgctcttttcaaaagcttacctttcagtgggattgtatgtcaagaattacaaacttgtacgatcatgagtaagttacccagccattcaaggattcagtttttctatctgtaaacaatcccattagactgaatgagttctaagcatattttagatgagtttaggatatacaatggagaaaaaaatgcaggctttgtaggcagagggccagcttcactgatgaagttaccaatttactgaatctctacttttaccactgtgaaactgagatgaaaataatctattttacagaatggttgtgaggattaacttaactagctagtgcacattcaagaaatattagccattattcttataaaataatataataattgtatttactataaaatttgacccaattgcaaatgactgtttgtcatggagtttattactaagggaacttaatttaaaataactgacatggaattttaaatgatctggtgagatttaaatgattctgttagtatgcttttaatatgcttgattaaatgtctttgtgtataaatataaataccatgcttagtccagggatatagcttttatttagctcctaatacaaagtcccaattgctctgcaggtgattcacatcttgaaagggtataaaagtgattctacactcattttcaatccaacttgaatttctgtttcattattttctaatgaaattgaatttggtaatacttgacacctgataagattttgtttatcttgttataaaaaatagactaataaaacagatttccacagcgctcaatcttggctatagcattttacagccacataaaaattatcatccatccacttacaatattctatctttatggcttttcataagcaatattgctttcagtttggtattgaattttaagaaactaaaatataattgtacacattgtatatttctgtaatgaaattgagttaaacacaattgtctagattcctttgtcactttttatggacaacatttattcaaaatgcagtggacatgtgaacaaatttgggtctttataatatggcaaatgcagttgccttgcttttggaaaataaagcatcctaaaattggcatcaattactaattagaatgttagagtttaaaataagactatgatcttcagagagtgattggactactgagatcgtagtacatcatcactggatggtctaggtgcagtcccaacttgattttctttctctactcccattttcagatttttcatcagactctctagttgtttatttccaaccacctttcatgccctgtgtgtaattatgaataatatattcttttaagtattcgtaggtacagtttctgttccttactgttttcacttgtttcttagatttataggtattgataatgtgtaattctctccttttgatacattattgcattttagtattgtttgaaattcaatcgaatgaaaagtactttattaatcatcactctattgtctgtctattatttttcaaaatctttagaaatgcaaacaatgctgcaatcaacatcttcctgtttatatctatttatatgtgccaagtttcctgcaggtttctgaggtcttccttatgcttatcaattatgaaaagattaaaggcaaaaggatagttctgagggaaacatattacccctccaaggcaggaataaatacagcattgatttatcttgtatcaaattaaagagtttttgataatattagttcttctattatcataatactttttcttttcaagctattatttcatttttatgccatcacagaataaaatgtcaatattatgtactaatcctaccttatttctcccttaagaattttagattctgttttggtctttcagagacataatttcagatgttcttgactgatcgtttttgatatctatatctatttctctttcaatttaagtacgttcaaatgcatcttgcagaataatatatgatggaacaataatcttttttaaagaaaacaggtactacactataatatttagctattaaccttatttgtttttaaaagtacataaaaagtcacttgacaccaaaataaacatttgttaagaacccattacgtgcccaattctgttaccattttattatttattcacctaaatatactatttatttagatcaatacagtatcacagtgtagattaagaaagcaagagtgagaaagtaaaaatctgtaaacattttgaagcaaacatatgaaagcaaaattcttaattactaggtttttgttgatttttgttaataaggccacaaactttactgatatttatgcacacgataaatatacttaaattaacctgtcttacactcatgttgtcatgagtaaaatctcaagcataagaattttattatattttcatctgaaaatatattaagtactattgaatgtaattctattgtctataatctcagttacgtgtttttttcctttagcatgctttaaaagttaattaagataagtatattctatactagaaaatttttatcattataaaactatctatattaaacagactagatagatctgagacatacaacctatgcctcatttctatattttcacttcactagcaatgtgtttatagcattgtgtaacactttaaaaaatttttagctttcattgtttatatctcatgtattttacaaatacatcttatgttggaaaataattgagactagaaagacataatttatcattcaaatcctcttaaaatatcttggttgggatacttggtatatatgttcagaacataagtattttcacataaaattatatacaataagcattcaaaagaatagggggaaaaaagctattacaatggtataccatagtatttcagtcattgtgtttaaacttgtgcctgtgtgtgaatatagtggacatttttctcttagaaatattgtaaaaacagtttttattgcatagggtatgtgtattatttgaaacgtattagattttaaatttactttactacagactatgtgaaatctgaatattgacttcattctaacctgtgctgacttcccagttaaactattgattattttgcttacaatgcaccagtatgcacatgtgtgcatgggcacaactatttttactttgttaagattttatttgctgatacataaaggtaacaagcacccaatttattgctgaaagaatattaaaggtgttatttagttctcaattgacttacctttgaaatatgattgttttccaaaaaaagaaaacattatgaaatggacacatggcaaaacaaagaatatcattcggctaagttgaaaaccattttagaaatgttcgattatatgaatgtactacatatttcttttcctacttctttagcttctcaaatgaatgcaaactctgattcttttctacacttttatgagtgtgcttttgtacatctacataccacgactttttagtcaagtgctaaacctattaatgatggaaatcctctagcgttttattggttctttcattcatgtaaacaatctgttttattgtatataagccttttgtaaataaaaatttggctagcttggccgggcgtggtggctcacgcctgtaatcccagcattttgggaggcggaggtgggcggataacgaggtcaggagttcaagaccatcctggctaacacggtgaaaccccgtctctactaaaaatacaaaaagttagctgggcgtggtggcgggcgcctgtagtcccagctactcggcaggctgaggcaggagaatggcgtgaacccgggaggcggaacttagagtgagcggagatggcgccaatgcactccagtctgggcaacagagcgagactccatctcaaaaacagcaacaacaacaacaacaaaaacaaacataaaaaattggctagctaatacattcacagagctcaaatttggaaaaataaaactataaactgtgaaatgcttttccttcactattttttcccagctacccagttaattcaattttagaaactattgttattagttttctaggtatacttctaaagagagtgttttcacacatatacatacacagcatttcttcccttttttttcggggggcggtggatggggtttcgctcttgttgcccgggctggagtgcaatggtgcgatcttggctcacggcaacctctgcctcccaggttcaagcgattctcctgcctcagcctcccgagtagctgggattacgggcatgcaccaccacgccaggctaattttgtatttttagtagaaatggggtttccccatgttggtcaggctgttctcaaactcccgacctcaggtgatctgtctgcctcggcctcccaaagtgctggaattacaggcatgagtcaccaagcccggcctcttcccatttttatctaaatcgaagcattctatacaattgtctaacaccttgttattttaattaaggatatatgttttagatttttctaaattagttcacaggttttttttttctttattgttggttcactgctgcatactttttccattgtatagatgcaacataattgatatggtttggctctgtgtccccaccaaatctcatctcgaattataatcctcacttgtcgagggagggacctggtgggaggtgattggatcaccagggcagttcccctatgctgttctcatgatagtgagggagttctggtgagatctggtggtttcaaagtttgtagcagttccccatccaccccctcttgctgccttgtaaagaaggttcttgcttcttctttgccttcctctgtgattgtaagtttcctgaggcctccctagctgtgtggaactgtgagtcaattaaacctcttttctctatagattatccagtctcaattagttctttatagcagtgtgataatggactactacaataattaatttaattaaacacctatttatagacatctgtgaatagaattatagtacaaataatactataatgaataactctcgatgtgtgtatgtatttctatagaataaattccatgaagaggatttgcatattcaataaatatatagatttatttcaatagatacagacaacgttttctgtatcaggcttaaaacaatttacaatgtactagcattttatgagagtgtctgtttcctataccctcatctagagaatatgctatcaaacttccatacttttattaactggtaggtgaaaaaaatatctctatgtagatttatttgcacctctctaataataaatgaaattgagcttattttataatcataaaagggacatatattcctttatgtgaacttttcttttttactactggatttttgtattgtgttactgatttttaggaggtttatacattagggaaattagctctttgtagtaatagaacttctatatttcccgttttaaaaaagttgattgtagtcatttttaatttttatgttatttaagttatattttgttttattaagttttggttttggaaaggcttctcccactctgatagtgtgaaagtaaagaaatgtgtattatggatctaatacgagtatgtatgaggtactatatcagttgctattatcaatacctccctgcccagagaggtatttgggggtaatcaatgtgaaaatgactgagaaatactaggttgaataaaataagtgatataataatatataagccacattaatttactctttattatattgattaccagttataatttttagttatatgaatgaaaatttgattagcaattcttctctttcagaccccattaagctccgtgagatttagaaagtatagtcgtgtgccatgtaacaacatttcagtcaatgacaaactatatattgtctgtgggtggtcctgtaaaattataatggggctgaaaaattcttatcacctagtgacactgtggccatcataacgtcatagcacaactgctttatttcttaataaagtgtagcctaagcgtacagtgtttataaagtctacagtagtgtacagtaatttcctaggccttcaccgtcactcagcactcattcactgactcgcccaaggcagcttccagtactgcaacctccaaacaaggcaaatgccctccctacacaggtgtaccattttttatctttcattctctcatttttagtttcctttttaaaatatagacatatgtttggatacataaacatttaccatgtgttacagtattctgttaaaattgcctgcagtattcagtacaataactgctgtacgggtttgtagcctagaagcaatgggctgtaccatagagcataggtatgccacagtccatctaggtttgtgtaagtacatcttatgatatgtgcacaacaatgaaatcacctaaccacgtgtctgtgttgttagatgatgcatgactgtatgtctgtcttgtttatcaaagtgtcccaagagtctagctcagagcctagaaaatggtagacacttaagcatctacttactaaataataaatcagtgtttatcacagtacctcacactgtaaactaagtctacctggaaagacacatgtttaagcaaataatcatagtataggttctgagaagtaacactaatagggacaaggcattgagaccgcttgaggaaggagctcctgactctgtctgagggcgacttctggagggagacttatcaactgagcacacagtcttgaattatggtactccggctgcacaaaatattcagaaggaataaaagtcatagcagaaaaagggaagcaaactattgtaatggtttgttttaactgctacagactttttgtttgttttttttttgtttatttgtggaatcgctggtatttttggtagtaggggaatgttaaaataggggtacttaatttaggaatatcttgtggaataggttatgttcgtaattagaatatggaaaaacggcgtagcaactcaataggcagaaaattgatgggaaggatccaggtctaaaagaacacgttcaaagttacagagaagccataaaatactttgttgtttttttaaaaaacagatattatttagaacagcagaagcctaacaaaagcaatacgggtaaaaaatgagatagggtgtcctcttagagaagtttaaaaatgaaagggtgtaagcttaccaattcaatatcttaataaaataattttttgtttgtttttcactcctgaatgtaattatgcatagtaagaatatccacagctttccataactggtatgaagattgatggcagttttttctgttttatctattttatctcataaatatttctcaatagcagttattttacagaatataatagagactaagagtattgacctaaatctgaacttgccatacatattcctatgatacaaatgagccaaggattttctttacaacttgtcctcttaggtcaggagccattccaagattccccttggctcagggtcctggtgaaagacatagtccaatgatgatgacatcagatagttttatgagtctatattctttactttttagtttgaaatttatttagagcacttttcaaaatagtttcttcctaacatggccgtagagttctgttgttgttgttgttgtttgtttgttttgtctatgttccatgatgtttaatgaatttacctgctggcatgtacatgggcaatatcaaggtttggtggcagcagctgcacattttcttgttagtgcaacaatgcttatctaacactttccatggtatttcatgtataacaaaagtgtctaggctgggtgtagtggcccatgcctgtgatcccaagcactttgggaggctgaggtgggagaatcacttgagtcctggagtttgagaccagcgtagacaagatgatgaaactctgtctctacaaaaaatatttaaaagttagctgggagtggtggctgtgtctgtactctcagctactctggaggctgaggtgggaggataacctgagcccatgagatcacggctgcagagattcgtgatcatgccactgcactccagcctgagtgacagagtgagaccctgtctcaaaaaaaaaaaaatgtatctaaacatttagaaaattcaaaatgcaaacttgctttaaatactcaaaaataaattgctttctcttacttttcatcgtctgagagttagaagattgttagaaaagatttcggcaccatctatctctcatgcttcttaaagcatgtgtagtattaaattacaggaatttatatgtagttcttttatatattttttgaaaacttatgaactactgggaagtatttatgctaacaattttaattagacacaagaaagtaaattaaggtatttataccatttaaagctttatttgagatatctccactaattattttggcatgctttcatgtaaaacaattcaactttcatttggagttcatagttttgagcccagcctataatttgctttttgtcttactttcatttgaatcaaaccactatgttgtacaaaactgtgcttatgtgattacaactggaacgcaacatcataagtaactgacataaacatgccaaagcagtagaagaaagctccttggattagctgtatttgagcaatactcttttttctggtctctgcccatccatttgtggctccctgcaatcaattttcatcattgaaggtagattaattatatcactgtagttacattatattattaggttggttcaaacattattgtggtttttgctgttactttcgatgtcaagaaccacaattacttttgcaccaacctaataagactttctattttatgccatcttccctcttactttctgtgatctaggcacattggatttatttcagttcctcaaagttttgtttctgtttggtaggattttaaattaaggtaatatatataaatcacacagagtactacatggcatatagcaagctttcaataaatgtactgatatttatgatgttttgcctaagaacttatgaagaaaggaaataggaatcacttaaacaccaagatcaagtaaatttttctccaaaaattttctctaatcaatcttgcctcaatgagagttaatttttgaaggtgatagaaagtatgagaaagtcgatgacttcagttttgaattattagagattctgcttcaagacatagaaatggagatttatttaggcagctacatagatttacagtatacataatgctgccaatgttaataatcgtgtggggaggtaaatgagaaaatgagacttagacaggttaaattatttctttaagatcaaggctatttctgctacaccatgttgtcttccaatagtgaaaccatgagtggagctcagctagggaaacagagagatagccaagccacagatggatctaaattaggaaaagaagtcaaagccacagagaaagtctagtcagagacagagcaggacaaaaagcacaatgtctcaaacatccagaaaagaatttccaaaagtatttattgaaaataaccaaaagccaattaagataaagttgtatgaaaatgtccttggtgcctagggacttcctactttcatgtgttacctgtcttcctggcaattgcacataaggtgtgagtgaaggcctgctgagatcatatttgcctgctaagtcaggtgggtaacacatgaattatcaaagccctggaactaaagaaactgaagaggccatgcttagtgtccttgcctttgcatttaaattaagattcagactttcagagagaaaggaaaatatgagaaataaatgtcagattaactgggccaaaaataaaacttgtatttttggtgcatatctaaagatatcagaatactagggtattgactagggattaagtatatctcataccctgggggaagcatgtttgttcagaaggcagtttatttgaccataaaggaatttgaactgttgtgggaggaaaacatgtatggactacacataatgtcataaaacaagaaaaatattgaggcgctattctgcaatttgcagctacgtaattatagatcaaacagctctaataataaatggacctccagagcctcacgatctcagaatggatgtttaaaataattaatatgagggcagccaagatggccgaataggaacagctccggtctacagctcccagcgtgagcgatgcagaagacgggtgatttctgcatttccatctgaggtactgggttcatctcactagggagtgccagacagtgggcgcaggacagtgggtgcagcgcaccctgcgccagccgaagcagggcgaggcattgcctcactcaggaagcgcaaggggtcagggagttcccttccctagtcaaagaaaggggtgacagatggcacctggaaaatcgggtcactcccaccctaatactccgcttttacaaagggcttaaaaaatggcacaccaggagattatatctcgcacctggtttggagggtcctacgcccacagagtcttgctgattgctagcacagcagtctgagatcaaactgcaaggcagcagcgaggcagggggaggggcgcccgccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacacagccggagatctgagaatgggcagactacctcctcaagtgggtccctgacccctgacccctgagcagcctaactgggaggcaccccccagtaggggcagactgacacctcacacggccgggtactcttctgagacaaaacttctagaggaatgatcagacagcagcattcgcggttcatgaaaatctgcggttctgcagccaccactgctgtcacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggatactctaaaaagcagagcgcctctcctcctccaaaggaacataattcatcaccagcaacggaacaaagctggatggagaatgactttgacaagttgagagaagaaggcttcagatgatcaaactactctgagctacaggaggaaattcaaaccaaagacaaagaagtaaaactttcaaaaaaatttagacaaatgtataactagaataaccaatacagagaagtgcttaaaggagctgatggagctgaacaccaaggctcgagaactacgtgaagaatgcagaaggctcaggagccaatgcgatcaactggaagaaagggtatcagtgatggaagatgaaatgaacgaaatgaagcaagaagggaagtttagagaaaaaagaataaaaagaaatgaacaaatcctccaagaaatatgggactatgtgaaaggaccaaacctatgtctcattggtgtacctgaaagtgacggggagaatggaaccaagttggaaaacactctgcaggatattatccaggagaacttccccaatctagcaaggcacgccaacattcaaattcaggaaatacagagaacgccacaaagatactcctcgagaagagcaactccaagacacataattgtcagattcaccaaagttgaaatgaaggaaaaaatgttaagggcagccagagagaaaggtcgggttacccccaaagggaagcccatcagactaacagcggatctctcggcagaaactctacaagccagaagagagtgggggccaatattcaacattcttaaagaaaagaattttcaacccagaatttcatatccaaccaaactaagcttcataagtgcaagagaaataaaatcctttacagacaagcaaatgctgagagactttgtcaccaccaggcctgccctaaaagagctcctgaaggaagcactaaacatggaaaggaacaaccagtaccagccactgcaaaatcacgccaaattgtaaagaccatcgagactaggaagaaactgcatcaactaacaagcaaaataaccaggatcaaattcacacataacaatattaactttaaatgtaaagggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaaggcaggggttgcaatcctagtcttggataaaacagactttaaaccaacaaagatcaaaagagacaaagaaggccattacataatggtaaagggatcactacaacaagaagaactaactatcctaaatatatatgcacccaatacaggagcacccagattcataaagcaagtcctgagtgacctacagagagacttagactcccacgcaataataatgggagattttaacaccccactgtcaacattagacagatcaacgagacagaaagttaacaaggatacccaggaattgaactcagctctgcaccaagtggacctaatagacatctacagaactctccaccccaaatcaacagaatatacatttttttcagcagcacaccatgcctattccaaaatagaccacatagttggaggtaaaactctcctcagcaaacataaaagaacagaaattagaacaaactgtctctcagaccacagtgcaatcaaactagaactgaggattaagaaactcactcaaaaccgctcaactacatggaaactgaacaatctgctcctgaatgactactgggtacgtaacgaaatgaaggcagaaataaagatgttctttgaaaccaatgagaacaaagaaagatacaacataccagaatctctgggacacgttcaaagcagtgtgtagagggaaatttatagcactaaatgcccacaagagaaagcaggaaatatctaaaatcgacagcctaacatcacaattaaaagaactagagaagcaacagcaaacacattcaaaagctaggagaaggcaagaaataactaaaatcagagcagaactgaaggaaatagagacacaaaaaacccttcaaaaaattaatgaatccaggagctgtttttttgaaaggatcaacaacattgatagaccactagcaagactaataaagaagaaaagagagaagaatcaaatagatgcaataaaaaatgataaagggcatatcaccaccaatcccacagaaatacaaactaccatcagacaatactacaaacacctctatgcaagtaaactagaaaatctagaagaaatggataaattcctcgacacatacaccctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccaggatcatccttataccaaagccaggcagagacacaaccaaaaaagagagttttagaccaatatccttgatgaacattgatacaaaaatcctcaataaaatactggcaaaccgaatccagcagcacatcaaaaagcttatccaccatgatcaagtgggcttcatccctgggatgcaaggctggttcaatatacacaaaacaataaatgtaacccagcatataaacagaaccaaagacaaaaaccacatgattatctcaatagatgcagaaaaggcctttgacaaaattcaacaacccttcatgctaaaaattctcaataaattaggtattgatgggacataactcaaaataataagagctatctatgacaaactcacagccaatatcatactgaatgggcaaaaactggaagcattccctttgaaaactggcacaagacagggatgccttctctcaccactcctattccacatagtgttggaagttctggtcagggcagttaggcaggagaaggaaataaagggtattcaattaggaaaagaggaagtcaaattgtccctgtttgcagatgacatgactgtatatctagaaaaccccattgtctcagcccaaaatctccttaagctgataagcaacttcagcaaagtctcaggatacaaaatcaatgtgcaaaaatcacaagcattcttatacaccaataacagacacacagagtgccaaattatgagtgagctcccattcacaattgcttcaaagagaataaaatacctaggaatccaacttacaagggatgtgaaggacctcttcaaggagaactacaaaccactgctcaaggaaataaaagagaatacaaacaaatggaagaacattccatgctcatggataggaagaatcaatatcatgaaaatgaccatactgcccaaggtaatttatagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacgctacctgacttcaaactattctacaaggctacggtaaccaaaacagcatggtactggtaccaaaacagagatatagatcaatggaacagaacagagccctcagaaataatgccgcatatctaccaccatctgatctttgacaaacctgacaaaaacaagcaatggggaaaggattcgctatttaataaatggtgctgggaaaactggctagccatatgtagaaagctgaaactggatgccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctacccatctgacaaagggctaatatccagaatctacaatgaactcaaacaaatttacaagaaaaaaacaaacaaccccatcaaaaagtgggcaaaggacatgaacagacacttctaaaaagaagacatttatgcagccaaaaaacacatgaaaaactgctcaccatcactggccgtcagagaaatgcaaatcaaaaccgcagtgagataccatctcacaccagttagaatggcaatcattaaaaagtcaggaaacaacaggtgctggagaggatgtggagaaacaggaacacttttacactgttggtgggactgtaaactatttcaaccattgtggaagtcagtgtggtgattcctcagggatctagaactagaaataccatttgacccagccatcccattactgggtatatacccaaaggactataaatcatgctgctataaagacacatgcacacatatgtttattgcggcactattcataatagcaaagacttggaaccaacccaaatgtccaacagtgatagactggattaagaaaatgtggcacatatacaccatggaatactatgcagccataaaaaatgatgagttcatgtgctttgtagagacatggatgaaactggaaatcatcattctcagtaaactttgaaactggaaatcatcattctcagtaaactatcgcaaggacaaaaaaccaaacactgcatgttctcactcatatgtgggaattgaacaatgagaacacatggacacaggaaggggaacatcacactctggggactgttgtggggtggggggagggggagggatagcattaggagatatacctaatgctaaatgatgagttaatgggtgcagcacaccagcatggcacatgtatacatatgtaactaaccttcacattgtgcacgtgtaccctaaaacttaaagtataataataataaaataataataaaataaaagaaaataatattagcgatcagaaaaaaattaagtatagagaaaactatatgtatatatatataaatatgtattatataatatatataattcatttcagataaaaagaaaaatgggatttttattcacacttgattagataaccatccaattatatagatatttaacaattcagaataatttatttgtccaaatacttgaagaagtgtatagtggaattcttcctaaaattagtaagaataaacttaataatacccttattgaatctgaggagagctacttactgaaattatatgtcctggcttcagaatggatttccaaggagaagaaaacaaaagaattgcttgtgatacattttgtctcattcaacttttattaggttttttcaattaatgtatacatataatacacaggaatattatttaatggtatgatttattgatggggtgcgatcacatatacttagatattttccttagtcttcaaatggcatcttttctgtcactagagttaaaaataaaaacctgagaacatgagaatctgagtattcaacaatgtgaaaagcttggtagccacttagaacaaggagcataagctaaattatttaattgtccagtagagcatattctttgatataaacttactactgcatattttatacaagttttctaaaataaaatgtctaatgatgtaatcatcaataataggaaagcaaagtgatgcaagattcacgaacacactgagcacaaatcattttttttaaagtgccaattcttttgctttttttttgagacagagtctccctctatcacccaggctggagtgcaatggcaccatctcggctcactgcaacttccacctcctgggttcaagcgatcctcctgcctcggcctcctgagtagctgggattacaggcgcccaccaccacacctggttaatttttgcatttttagtagagatgaagtttcaccatgttggccaggctggtctcaaactcctgacctcaggtgaccagcccaccttggcctcccaaagtgctgggatcacaggtgttaaccaccacacccagcctcttgcttcttcaagctaatggaccactgtgagtgaaatgtcagatgatggtgaaaacgtttatatatttgtagtttgttgtccttgcttgctttaatcagtagtagctctcaatttattggtgaggtcaattactaaaattcagtggccttcctcacactatggctaaacattccattcacttcagtgtgctgtgcttcaggatgtactttggtataaatcctgctattacaggaaagagagtgtgttgttaaaagcaaagatacaaatgtgtctacattatactgtaaagatgttcctgaaaatgtgagtataaattctttaaaaactattttttccctcatttgcttcatacttggtctagggcttttctgcctctgaggtaacttttagaagataataacaatctcccctttgcttcaacacaaaataattcctgtagggcttttcttgcctgctgctgtgcaaaaccctttcaagaattattttatgacttgaaaattttaagatatttcatctatttttattattttattatatggtggtattgctatgaattttacttgtattttgcaacagtttttgtattgggagataaaaagagagatatttggccaactatagtaagaaatagtaattcctttttttttttttttctcattttagccatcttttcctctctctctgccacccaatagcaaagacactttctcccaagcggtcacagtggactggcatgggagttatgatgaataagagaaatgttgacagtagagattatatatttttgattttatgaaaatgtagagaccaaatactgatgtattcgttatcattctctctcactttctcacccccaccatttctttcactttacatccaatctatttgtttttatctctctatttatatccctgtcatctatccatagcttctctctatcatttatctttcaatctaactatccaccatccatttaacatatattacccccaaatttgcaaaggtaccttctattaacaaaaaaattggcccaagttggagaagaataaagcacagtgatgtcataataacactctactgtctttgattggatacctcttcaaaaatagtgggtttttttttctttatctggtctgtgtaaattctgcatctgccaccctgcatttccataaaagatttagaatagaattgattcttaatactgataattacacttaagaaatgactattatttttgaagtgcttagaatatatattataaataagaaaaacaagtgaataattgttgtatagtttgagtgggaagaagtgtttcattctgactttgttttgcttttgtaatgttttattgtgtattgttttaatgcctagtaagaacagtgtgaaggtcgtgccttcattgtttgcttttttgtttttgagggaaagtataattttaaaaagttttattcctcatacttttttgccagatgataaggataggattttagcagactaagtcacatcaagcagtggccaaaagcaagaatacattggttataagaaaacaattatttattcataaattaagtaaaaggtcatcactttagacattttgaactaccaagttttctatacagtgagaattaaccatttacatgtcagaagatttacgtattggcagagtgtgctctagaaatactatactgtttttctgttacaaatattatgcatattcattatggaaactttcaaaattcaataaattttaaaacgacatttttaaaagtctgtaaccccagatgaatacataacaactgatattctgctatttttctttctattctttgtgtgtgtgtgtgtgtgtgcatctttgtatgtagtaatgaatatgtaatgtctatgtaatgaatattttatacaaatatatattttaaataaataaatatatatatatatataatagtcctgcatcctttttacttgatattatttttaaatatttttatattctggaaaatatttgacaatacagttttatgatgaatatctgtataaaatattttcttattagatatttaggttatttcagctttgcggttatgatgtctacagcaggtatttattataaaacatatttggcaatatattgaatttcttcttgaattcggggtacttttttcttgatttggtttagttaaaactgtgaatggagatggagtgttataggaagtaaatgtctcctttccctaagttaagggtagctggaccatatcacttggtgtggctttagcacagggacatggggtgtcaaccaatgcttgacatgtggcatcaggggctttcttagctcttcctaacttccattcattttcctgagtttaggcgtcttaagcttgctaaggaaatctcttgaggctccaaagagagagttacagagtattaagaagtccagtgacttttgaggttacacataatattgcagtgccagaggttgtctgcttcgtgtcatagaacataatgccttttctctccttttactctttatagttgattctccccttttcttctgtcaatgactagtgctccttgtcttttgttccttgtcctgtcaccctttatagtgttggctttgtcacttattatcttacactcccccctaaacctgctatttctcctttattcctcatcttgattggtggttcaaatgtctccctcctgtggagctgctcccagaattgaacaaatcacttccttctccatgtacctatcacactactattatagcaatgttgctgaaaacaatgatatgtcagtttgtaatgaaatttgaattatttaaaaaataaggacagaaaaattagttttccatgaagttaaataaatttaataagatattttacttaatgatgatactgtttttctactatgattgatggtctaatagtatatactttatgcagtaatgctagaaagcaagttgacagccccatttttgtttaatttttttgaaattaagattgcactggcccaagacatttaaagtctagaaagtacagtaatacagtacttatcatagtgaaatatacttatttgtctacatgtgtgaatctttcagattttgagccttttgacagcatgcttgtgtctttaattttttctcctattgtctcataaagagtggtccataaaaagtggtgcttattaagtgtatattatgttttatttgcattattttagatgtttatgtgagtgttcatattactttcagtgtaagagttgagtaatgtaatttagcaaagttttacataggcaagttgctacttcataaggcaatgatctacctgaggataaaagcatgaattgaaattggatcattctctgcattctggtccaaattaatcggtctcattttgtattaatgctctacctttccttttagtattatcaacttatattaatgtttgtctttcaaattttcaaatatttctatttgacagactaatttctctgttcttgcttttctataaatttaattttcagcacacacacattattcttcacactttctgtaaattctcctgttcttctttaaatgtatgaagcttgattgtgtaactcagggaatttcattcaataaaatatcttagctcaataaaccatttaattacttaaataatagttcaaattgcttaaaacatatttatcaaaaacaaccaattacatatttggatagataatgttacctgaaggtgttatttgaaataatcctaactcattcagtgtgtggtcttagatagagttgcttattttgagtgttaagagtgtttctatatttttatctgatatccatgtatccatgcaaaaattcagggtccttggaataatttggcgttttaccataataaaataaagctaataatgattattatgatgataaaaagttgttcacaattttactgaacatttatgatatgccatatattatgtgccaagattaattaatcttgtgtgcttaattaatttattcattcaacaaatgtttatgtatcattgtaggaactggtaatacaacaggggaaaaaaatgcatgaagttactgcccttgcagaacttgcattctagtagggagaggcagacaacaaaggaattacaagtgaatatacagaactatagacagtgataagagttttgaaacaaataagagggaataagaatagtgatggggtagggggtaggtatggtttactgttttacatggggtggtcagggaaagactcactactaatgtcacatacatgtagagacttgtaagatggaagggagtgggccatgtagaaacctgtagaaagaattcagaaagagaaaagcaaatacaaaaccctcgagaggtcaggatgatttgctttatgtaaattattcctcatgccagagagatagacgttactctcctgagaagctgctctcaccacagaatgagtcactcactcctctatgctcctgaagcagatgtggtaatatttttcaaaacattagtccactaattagggttggtctatgataaagatttcattgagtaaaaaaaatgagaaaagtggtggtaattgagagtcccaggttgacacctaattttgaagttaaaaatttgatatatgaaatccaaatgaatctgaatcatttggcatcataagacatttagacagtttaaattgtgtcattttttttggtgctcagtagacacctctctctccagtaaaataaaaatttaaaatgattacaaatttgtaataatacaggaagataactgagctctgtttaggttccttctctctgaacttcaccatggaaattctgcagacagcaagccagggcaattgtagggcggacctcatttggttctcctcactccaagattatgatactgtgaaattttaatcacttttcagtccctaatatgcttaaaattatttatttaaattaattatttttcgttaattgttttgtatttagggactaaaaagtgattaaaattttaagtttgttgaaattttatgaattcttgaaaagattcatctgcctttttggaaaaagatagaattggtcactgttaactgaataaagctgaataaagtatataactttttaatgttctcaaatctttctcattttgaggagttgaattgaaagtagtttcaatatggcagtgttacatttagagatcatgagttaaccattttttatttcattttatgttttgttcttctcagactgagtaaccaagttctaatctgcatatgtgatttatttatttgctacattgctatgaactgggtactacacagggcaagttatatgctgaaacaaagcctcacaatggctggagatttgtttttatacaggatgggtcgtcatgctgtgcaagagaattgtcttacttcccagtcctactagggagagactcttctactcaaaacgtcctatatttcctcctcacataccgacgatcatgaatttcttagaaagcattgtttagaaacacagagcagagaattattcattcatgggaaaaaaaaccatcaaaacaagcatgacttaatgagacatctgattataaaacctcaggaagtacttacctttatcaactataaaaccttaggaaggacttccatttatctggaatcatggcttccaaatttactctgtagccctaaacaactaaaaatcttgatacaatatataaaacaacaggtttcacacatcggactataggtgtcacagtatagtaatcttggagtgaggagaaacaaacgagatgggccctacaattgtcctggcttgctgtctgcagagtttccaggctgaagttcagagagaaggaacctaaacagagctcagttatctccttcattgaggagacagagtatttggggagttagttaaggtggctgtaattgatgaggcagtgcaagtgagatgagagaattgcacaagagagctcagaggtctgctgaggacttcactccggtcttcagttcggtactaatcagcatttctgtgagaaactactcaatgctaaaaaaatgtcatgggaaagaaatgggtgacacaattatcagagctcagacagggctaggagtaattcacaatccaaaaagccaggatgggaaaaaagttgtaatacatgaaacatcaggcaaaagggtcatttcttagtctgttagggatactataagaaatacaatagactgagtgacctatgaacaacagaatttgtttctcacatttctggaggctgggaagccaaaatcaaagcactggcagattcagtgtccggtgaatgtgagttttctagttcaaagatggtaccttctagctgtatcctcacatagaagaaaaggggaaccccagcttgtttgggcttactttataaaatcaaaaatcccattcatgaggccttatgctcatgacctaattaatcagcttccaaaacatcccacctcctgataccattaccttgggggttataatttcaacatatgaaaatttaagggcttcaaacattaagactgtggcatgggaccaaattagtcctagaagtaaaggctgctatgggcctaatgaattttaaaagctcattttaaaagcatcatactatttccaactagcttagttgcaaactaaagtaaatttgaaaaatatttaaaggattactctcttaaagaaaaaagtccagcacccagacacacttcaataaaaaattgttgaacattcaaagaagtagaagaccaggaataataataaggagaataaccaatcaatagaaacatccagaaatgacaaataatagaataagcaaacaagagcattaaaagagccactgtattctccaaataaccaaaaagaaggaggaaatcatgagcatgttgaaaaattctgcatgtaacatacaatatgcacccaaatttaatttctaaagctgaaaaatacaatgtttgagataaaaaaatacttgggtggaattaatagcagattagacactgtagaataaaatattatagaatttaaaaataaaactttagtagtaagtaatttaagtaaaaatgcaaagtcccagtttcatattaagtattagtaataagcattaccattatcgagaagtaaacatttctgattagcctgggttgagctggtccaatgtgatccaaaaaggtactctggactgggccaacaatatcttagttgtgttcctgaagacttatctctatttcatttttaagggtttgcatcagaacatgctctatatacactatgatgtctggatagtaagtatttacatctcattatgaagtgtaggcttagatgttttcaacaaatcctggaaagtaacttctatggcaggagtctcagaaatgataatccatagtcatagggcaaaattgacacacagacatcctctcttttgccagtacaattaaagttaaatttaaatgtcttcaagtagagcatatcatcatcttgtcacagatcccatgaacctagcctgtgaaataatttgaacttgtaactcaagccttttgaaaacattttacaaaattttctgaactccatggactccacgtgactgtaagagtcagaggcaatggcaggtaagcattgccttttatgtggttttgtcttaataaggctaatttgtattgggtacactacttgtcatttgtagagtaccagaaatactaaaaaacactcatattggtgttgactggcaaagcacatatgtcaagcaaatctaaatgtatgtctttgtcactcctttgagaacatttccagaaatgatacagccaaagtgataacagaaaagggtaaataactgcacattgtcttccaaatgtgctgagatactatagaagctaaagatggaaaatgaaattcatacatcttaaaacaactgaatgaattccttaatttcttagtcacagcaagttcaatgtttgacctgtaaagctaataaagactggagacctcactttgttcttgacaagcactgttgagctctttggttgcagttgaagctgaagagcattcctaataagatttttttctagctcattttcctgcaaatgaaatctctgccttacattgtccttagttatggaaaataagatcactaaaccttggtaactgttgccgaatggcagtaaagatttcattgttcaaataatcctcaagacttcgcatatcaagtatactctatattttgagaaatatttgtattactctcttttaaatgaagttacctcattttattacctgtcacttcactgggtttcaaattgtctaatttatttaactagcaaagtaagggatttgagcccactataggttatgatttatacattatcatttggtcatttagagttttgtttggtagtagttcatggtgattctgtaaattttgtaaataactatccttatactttctagcatttggagttttatgtcttttcttggtgaaattagtgttctgcaaattaggaaaggcagaaacaagtcaatcaaacttataacactgtctgcttgagaaagtcaccatgttcattttataggtgatttgttttgccccattgtattttgaattctcccgtcagccaggtcatttgtatctcaggccacagagggtctctcaagactgcttcctgtgaaattgagtggcccctttttatttctctgttacaaatgtttactttttccagagcacttttctcctaaagaaaattttacatccatttaaatgtcttgccacctcttccttgccaggcatactgacttttaaacctaagcctttggagcatgtaaaatcaatgatgtgtactgagttttctatctattcccgataaattgcagtcactacttcacctttgcctacctgctcagcaatatcctccgaagaacccaagcatatctggcaggtgttctatatcttagctgaatctatagctgattttctagcatagtgaggtgagtctatactaggcttggaagaaacagaagaaattatataaaggaaaatatatgtggctttatcattatatcacatattttcatctggtgataggccatttatgaaaggaataactcctggatacacaagtggatgtgtgaatggaagaaaataatcaaataattaatgagcacattctttgtgtctagtattgtaatgaggtatgtttacagtgtctcacagatgtcaacaggaataaatatcactagaacagcattctatattaagtgtttcttaacctgacatctatgagctccagaactttcatatacatggtttaacgttcagaggtaatcaagaacatggaactatttttaatagtgtttgcattggttttctatggctgttgtaaaacattgtcacacactttctggcttaaaacaatacacgtttattctcttacagttctggaaatcagaagtctgaaatcagtttcattggggaaaaatcagtatgactgcagggctggtcgccctacaaaggctctgaggagagaatcagttcccttggcttctccagctcctagatctgcattctttgcattttgtgctcgtgaccccttcccccatctttaaagccagcagtatctcatttttatttagtagtcacattgttttctgcctctgcggtcaaatttccctccaccttctacttataaggacacacacagattacatttaggacccacctggataatccaggataatctccccatctctggatctttaacttaatctaatctttttggcaaacttccttttgccaaaaagttaacatttacaggtgttagggattaagttctggatattttgaggggacattttattcagcctattataatgtctgaaacagcttgttaactcaggatcttatttaattttttaaaaggaagctattaattgtaaattactaagttggcactgtaacagtttattcaagagtctatctaagtatatttatatatgtgtcaactaacaacatctaattaaggtgttctgtctggtgttaatttcccaaaatcgactccccgagaagctgatgaaatcttagccatagtagacacagaaaattcccttgttctaacccttttagcatctcgattttgaaatgttcacagttatatttgtcaccagtggcagtttcaactggaatagtaattttctgaatttcttcatttgtttaaattct

SEQ ID NO: 840 - DNA, 3054421 bp, Homo sapiens (residues 1,527,212-3,054,421 of 3,054,421)
aattttaaggagactatttgccagtgatttctattttttccaacttctaaaaaaagtaaaatgtaattgctggatcatgttttgtatataaaaggaagcaaatatatctaggttactcacaaaatatttgagtttaataaaatttcatggagggaaagagagaaaacattccaagtgaaaataacacaatgagtggaggtaatagaaagttcctgtgtcacctatcctgggatctgacttatggaaaactgaattaggtgtcccctcattctgtcagggtatgtactgtgctgtagtcatttatgtttctccttgctatggtctgaatattcttttctctcaaaaattcatatttttggaactcagtatacaatatgatagcattaacaggtggggtcttttggaaaatgattaaatcatgagggccctagcatcaggaataggattgagattagtgctcttataaaagagattgaatggagtgttcttgcttcttctgacatgtgagaatgcagcaataaggcaccatctaggaaacagacagcaaggcctcattagacaccgtatatactggaacctccttcttggacttcccagcctccagaattatgagaaatagatttctgtttttcatatactacccagtctaaggaatttgttaaagcaggctggatggactaagacgcccccaaccagactgaaggcgtgattatgccttttctttggagttgaaactcccagcactatgcctgaaatataattgcagaacaaatatttggaagcaattggattgggtagaatattaggatattagacaggaatttgatgagagtaaagatgtgtgtatgtggaggaatgggggaaagttgtatatgcacaggaatggctcacgttattgagatctttaaagtcgagggaaaattttgtctgcaaaccttgttaagaatgcatagtgaaggggaattcagagacaaggaggtaaactggaaaagtcatctctgtaattctgacctaagataatgagaatctgaatcatgattgtcttagtcagtttgggctgctaccacagaattttatgaactaggtgtcttgtaaacctgtgagaaatttatttctcccagttctggaggttagaagtctgagttccagcctggtcagttcctggagagggttctcctgtgggttgcagattgctgacctcatcttgtgtccttgcatggtgaaaagacagataactatttcttgggcctcatttcataaggacagtattccctttcatgaggtctctgccctcatgacctaattacctcccaaaggtctcatttccaaatactatcacagaggggctagggtttcaacatctaaattttggagggactcaaatgctcagtcccttgcaagggttaaatgaataaatgaaaaagaggtaggcagatggaacagaaaagggacatttcaaaggagaaatggctagagtgatattgccaactatatcttttaatgtactttcttaaatgcttgttatgcactttctaactgtatttttcaacttgaaagccatatttgccattctgttctctttttttaagtttttttcatgtattgaagtagtcattctgaaaatagaattttaaaaaatcctatttcaccacttcaagcagtatttctatcattttacttattccaagtcaaacaattccaagttaccaggtgaaagttaccactcatactttctgtttttataaattgtagctctgatattatttacctttgttgtttcaggaatatacttaagttggtcaggaaccagacccactaaaatactaatactgatatttttattgaatctaataaatgttatcttgtttgccaatctggataaattaaattttccattgctgtccatttactttataaaaatgccattttattaattgaattatttattggcctgagtaattctttcgtgtcatatacctgtatcataatccctgtgctaaaattaaaataagaattatttaatttaggaagtattcgttgagtagctactatgtgcatagcattgaaaggaacatacaatccatgtgttttaatatttttatctttatctgatatttgcagtttcccaaatttaccttttcctaaagaatggctacacgtctcccatttttatcccaccacatctaaatatcaactgatattcatattatttctctagtttactgtaaagaacatgagtaaattatacacatatatttaatcagtactatagtttattttgcctgaaaatacatgttttaacattgtacaatttttttctaacttgattatcctagttcaagaatatcttcaactcctatttttgtttagtttcaacccagaagacattttctttaaaattttaattggctaggtttggtggctcatgcctgtactccctacactttgggaccccaagacaggagatcacttgagccaggaatttgagatcagcccgggcaacatagcaagaccccatctctacaaaaaaataaaaaaaataattagtcatgtgtggtggcgcatgcctttagtctcagctacttgagagggtgaagctggaagattgcttgataccaggaggtcgaggctgaagtgagctgtgattgtgccactgcactcaatcttgggcaacagagtgagatcctattgaaaaaaaacataaaataaaataattgttttacttgagatttttttgtattacaatttttaacatgttaattttaaaataatcattgattacttttttacctctcttccaatcaaaaagtgtaattttttctgtaggcaagctttatcatctaaaatgtactgatattaaagaatggtaacacattaattcataagttctttgaaatagctaaactgaaatttgatatgaaattatattagatacaagtgtatgatatatgatgtcagactatgaactgatgtgttattttcaatgaatatttaactatataatgcaataatggctttatatagttatgtatattctagaatgccatgctttagctttagtagccatgcttttgaggtctttctcaagaaatctttgcctggaccaatgtcctgaagtagttctccaatttttttcttttagaagttttatagttttgagtctaagtctttaatccatcttgagtttgtttttgtatatatagagagataggggtgtactttcatccttctgcatatggatgtctaattttaccagcactacttattaaagagactcttccccaatgtcctttccccccatacaagagcaatgtatgttcttggttcctttgttgaaaatgagttggctgtaaatatgtggatttctctctgggttctctcttctcttccattggtctatgtgtctatctttatacagtaccatgcatgctgttttgggaactatagctttgtagtatattttgaagtcaggtagtgagatgcctccaggtttgttctttttgctcaggattcatttggctatgtgggtcttttgtggttccgcagaaattttgcaattatttttctttttctgtgaagaatgtcattggtattttgataagagttgtactgaatctgtagatcactttgggtggtatgggcaatattaattcttttagcccatgaacatggaatatctttccatttcttgtcctcttcaatttctttcatcagtgctttacagttttaattgtatagatcttgcacttatttgcttaaatttatttctagttatttttatagctactgtaaatggaattgttttttatttttccagttgttcactgttaacatatagaaatgctgttgacttttgtacaatgattttgtatcctgtaacttaactgaatttgttttgagatttttctcacagtgatagtggcattttaaaaatatatgacctcctctccctatttttgatgaatcctttaggttatcataaatatttgttgaacaaatgtaggaacaaaatattatgataatggaacttatgggttttttttccctaagagttcttatgggacacaatatataatgtttccttcatattaaaaatcaattttaaataatcaaaaaattctgtgcataaaatgtgacttataacaatttgtttacaaagtctttttttaaaaacagaaattctatagtgaaaaagaagcactggggataatgagctgttagaattgtatttatttttattatttagttatttgttgataagtgttgtatgaaagggaggcttaagaggttatagagcataattattattgaagcattaggaatatgcatactaggaatgtgagtgtgtatgtgttatgtgtttgtatacatgcatatatatatatgtatataggcatgagtgtttctgggagcagatggatacaaataaaattgtttgattcctaagccagcatcctaccacctagcaagaggacagaggaaagtaatttcaggtatgtgaagactgccaagtaacacaggataacaagaccgaagagctgtgatatacgtggctctccaaggtagggagatgaaataacagatacaaagatgaatatttagagatttagagaagcatatttgattggctgccaggctccaggaatgatcagaagttcttgggaaaaaaaatggtgacttacttctgctacctctgtctttaagaccagtgtacaatttctaatttcactataccagagagtaaatcttgctcaaatgtctgtggccttaacattgaattctacttcaaggactactctttcctccatcagtatttttaactttgcaaaaactgcagttattccagtttataaaattctgttgttcacttgcttactagattattttacacctgaatataataactttcctatgatgagaaacagctcctcaccttgcttgttatttgagatagccattgactaagaaaaaagcctaagagatagaaatatcatagcaactcagccactggcagtggcaagcagagcattttgaagggaaatatgtagcccttcttcacatagtctcaaaggtagagtaagcatcaggcaatgcaagatcacattgcaggagcatttgactgagtggtaaatatcaaggccagcttccatggagagttgaaagtaaaatcagtaatttgtctttaatttgcaaacaaaaaaatttacatgtgttctaaataaacaaagctgtttatttccttcgtctaagaatattgataattcgtagggatgggttagggtactgctccttctatctagtgactccattaacatctcagatttcaaagtctcttgttggattttcggcatccagccagcagaagaggtaagagaaaataatgcagagaattgaggaatagcttttaaggtccaggaggtgacattccctttgccctcgttctactggtcaaaattcagtccgatggctctaacgatatgccacaaagattagaaaatatagtctagccctgtacccaggaagaagagaaacaatttttgtgtatctaccagctagagtctagctagtctgagtcttggtgatgatggtgatgatgatgataattgttgggtttggaataatcatctgtattaaccttatccttaatttgcactggatcagagacaagttaatcattaatatttacatatcaacaactgtgttgatcccttccaccccagtgtttactcttcgagcacaccgtgaaagccaggtggtaaaatctcttattgtgagtggccttacactttcatccataaatgtgaggatgaaagaaaatacattatatctacttgtatgctacagagaaggatggttgctttcaccacaaatcccaaaaggagggagaaaaatttctattccttggggatggaaagaaaaggaaaatttattcttactctaacctttggaatgaaaatcccctcaaaggataaaaaaaatcccattttccctggcttctatgacttttatgacttttagagatgtctccaagaccatgagtctcagtttctcttgaaatggaaacacataccactctgaggtaggtaaatctcttttgagttctctcactatctagatggttgtaaatttacttccaaagacttgctcatagcccaggatctcaagtttttggcataatttatttagccagtctatggctaaaacacagaaatactttcttagcactccacaatgacaatgatgataataacagctaaaatttattaagcacttgccatgtttcaaaaattattctccatgttttacttagaatttgtagtatctcattaatctccacaaactagtgaggatattactgattgaattccattttacacgtgagaaaattgagacacaaagaagttagtagagtacctaagaccacacaggtacaaagtggcacagatggaatttgcacacatgtagtttagtctagagtgtgtaaaatatatcctttattaagaaaaaaaaagtatagttgtgggacaacaaatgacccctgtgcattgtcaaaccccttaccaggacgtccttttatcactgtggtattaaggttcctgaccaccagccctcatttggattagctatacttgtatggatttcggtggagctctttattagtaaaatggctgttttatcttcaaacaatgtagcatacctattggattgatttatgaatagaaaagtagctttgagtcagagattttagtttgtttattcctgggttccctaaagcctagcacagtaatgttcaaaagggtatctctcagtaactatttttgtacaaatgattaagaacatattctaagcaggcatgtagcagatccatactaagcagtaggagtctatccttctttctgactaaggaccatagcccatttatggaataaaccaagtgagaagtaagtaactggtgaaaatacattcattatgggcaaattaagagctcttttactatctatttaatgtgtttcatcataaattataattccagggacctattgctgctcactcaaacaaaagtacaatcttattaagggataaaaagatgtaaggggaaatgtttaagagtgaaacttttcagagattatataaatgtaatcttcaattagttattgccttaataatcatgaattctgaagtaacaaaaatcctgaataaatgagattttcaccctgagattgaaagaaaattttcaactgaaataatttcctccttatcatacagtttaaatccctttttattcatattttatgcaaatatgtcattatattttgtacgtatcagatattgaagctctcttctaaaactttatatttttgataaatatttctgtgaaataaaagaaaatatgggaagggtggttccaagatggccgaataggaacagctctagtctacagctcctagcgtcagccacgcagaagatgggtgatttctgcatttccaactgaggtaccaggttcatctcactggggtttgttggacagtgggtgaaggacagtgggggcagcccaccgagtgtgagccaaagcagggcacggcatcgcctcacccgggaagtgcaaggggtcaaggaattccctttcctagccaagggaagcggtgccagacggcacttggaaaattgggtcactcccaccctaatactgtgcttttccaatggtcttagcaaatggcacaccaggagattatatcttgtgcctggctcggagggtcccacacccacggagcctcgctcattgctagcacagcagtcagagatcgaactgcaaggcagcagtgaggcttggggaggggcgcctgcaattgctgaggcttgagtaggtaaacaaagtggccaggaagcttgaactgggtagagcccacctctgctcaaggaggcctgcctacctctgagactccacctctgggggcagggcatagccgaacaaaaagcagcagaaacttctgcagacttaaatgtcccggtctgacagctttgaagagagtagtggttctcccagcatgcagctggagatatgagaacggacagactgcctcctcaagtgggtccctgaccccctgagtagcctaactgggaggcaccccccagtagaggtagactgactccccacatggccaagtaaccctctgagacaaagcttccagaggaatgatcaggcagcaacatttgctgttcagcaataatcgctgttctgcagcctccgctgctgatacccaggcaaacagggtctggagtggacctccagcaaactcaacagacctgcagctgagggtgctgactgttagaaggaaaactaacaaacagaaaggacatccacaccaaaaccccatctggacgtcaccatcatcaaagaccaaaggtagataaaaccacaaagatggggaaaaaacagagcaaaaaagctgaaaattctaaaaatcagagcacctctcctcctccaaaggaatgcagctcctcaccagcaacagaacaaaggtggacagagaatgactttgacgagttgagagaaggcgtcagacgatcaaacttctctgagctaaaggaggaagttcgaacccatcgcaaagaagctacaaaccttcaaaaaagattagacgaatggctaattagaataaccagtgtagagaagtccttaaatgacctgatggagctgaaaaccatggcacgagagctacgtgattaatgcacaagcttcagaagctgattcgatcaatgggaagaaagggtatcagtgattgaagatcaaatgaatgaaatgaagtgggaagagaagtttagagaaaaaagagtaaaaagaaatgaacaaagcctccaagaaatatgggactatgtgaaaagaccaaatctaggtctgattggtgtacctgaaagtaacagggagaatggaaccaagttggcaaacactctgcaggatattatccaggagaacttccccaacctagcaaggcaggccaacattcaaattcaggaaatacagagaatgccacaaagatattcctcgagaagagcaactccaagacacataattgtcagatttactgaagttgaaataaaggaaaaaatgttaagggcagccagtgagaaaggtcacgttacccacatagggaagcccatcaaactaacagcggatctctcagcagaaactctacaagccagaagagagtgggggccaatattcaacattttaaagaaaagtattttcaaaccagaatttcatatccagccaaactaagcttcataagtgaaggagaagtaaaatcctttacagacaagcaaatgctgagagattttgtcaccaaaaggcctgccctacaagagctcctaaaggaagcactaaacatgcaaaggaacaaccggtaccagccactgcaaaaatatgccaaaatataaagaccatcgatgctaagaagaaactgcatcaactgacaagcaaaataaccagctaacatcgtaatgacaggatcaaattcacacataacaatataaaccttaaatgtaaatgggctaaatgctccaattaaaagacacacactggcaaatcagataaagaatcaagacccatcactgtgctgtattcaggaaatccatctcacatgcagagacacgcataggctcaaaataaagggatggaggaagatctcccaagcaaatggaaaacaaaaaaatggcaggacttgcaatcctagtccctggtaaaacagactttaaaccaacaaagatcaaaagagacaaagaaggccattacataatggtaaagggatcaattcaacaaaaagagctaactatcctaaatatatatgcacccaatacaggaacacccagattcataaagcaagtcgttagagacctacaaagagacttagactcccacacaacagtaatgggagactttaacatcccactgtcagtattagacagatcaatgagacagaaagtgaacaaggatatccaggaattgaactcagctctgcaccaagtggaccgaatagacatctacagaactctccaccccaaatcaacagaatatacatttttctcagcaccacatcacatttattccaaaattgaccgcatagtcggaagtaaagcactcctcagcaaatggaaaagaacagaaattataacaaactgtctctcagatgacagtgcaatgaaactagaactcaggattaagaaactcactcaaaacccctcaacaacatggaaactgaacaacctgctcctgaatgattactgggtatataacgaaatgaagtcagaaataaagatgttctttgaaatcaatgggaacaaggacacaacatatcagaatctctgggacacatttaaagcagtgtgtagagggaaatttatagcactaaatgcccacaagagaaagcaggagggatctaaaatcaccctaacatcacaattaaaagaactagagaagcaagagcaaacatattcaaaagctagcagaaggcaagaaataactaagatcagagcagaactgaaggagatagagacacaaaaaacccttcaaaaaatcagtgaatccaggagctggttttttgaaaagatcaacaaaattgatagactgctagcaagactagtaaaggagaaaagagagaagaatcaaatagatgcaataaaaaatgataaaggggatatcaccaccaatcccacagaaatacaaactaccatcagagaatactataaacacctctatacaaataaactagaaaatctggaagaaatggacaaattcctggacacatacaccctcccaagactaaaccaggaagaagctgaatccctgaatataccactaacaggctctgaaatttaggcaataattaagagcctaccaaccaaaaaaagtccaggaccagatggattcacagccgaattctaccagaggtacaaggaggagctggtaccattctttctgaaactattccaatccatagaaaaagaggggatcctccctaactcattttatgaggccagcatcatcctgataccaaagcctggcagagccacagcaaaaaaagagaattttagaccaatatccctgatgaacattgatgcaaaaatcctcaataaaatactggcaaactgaatcagggagcacgtcaaaaagcttatccattatgatcaaatgggcttcatccctgggatgcaaggctggttcaacatatgcaaatcagtaaacgtaatccatcatataaacagaaccaaagacaaaaaccacataattatctcaatagatgaagaaaaggcctttgacaaaattcaacagcccttcatgctaaaaactctcaataaattaggtattgatgggacgtaactcaaaataataagagctatttgtgacaaacccacagccaatatcatattgaatgggcagaaagtggaagcattccctttgaaaactggcacaagacagggatgccctctctcaccactcctattcaacatagggttggaagttctggccagggcaatcaggcaagagaaagaaataataggtattcaactaggaaaagaggaagtcaaattgtccctctttgcagatgacatgatggcatatttagaaaaccccatcatctcagcccaaaatctccttaagctgataagcaacttcagcaaagtctcaggatacaaaatcaatgtgcaaaaatcacaagcattcctatacaccaataagagacaaacagagagccaaatcataagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatggagaggaggaatcaatatcatgaaaatggccatactgcccaaggtaatttatagattcaatgccattgccatcaagctaccaatgactttcttcacagaattagaaaaaaactactttaaagttcatatggaaccaaagaagagcccacattgccaagacaatcctaagccaaaagaacaaagctggaggcatcatgctacctgacttcaaactatactacaaggctacagtgaccaaaacagcatggtactggtaccaaaacagagatatagaccaatggaacagaacagagccctcagaaataataccacacatctacaaccatctttgacaaacctgacaaaaacaagaaatggggaaaggattccctatttaataaatggtactgggaaaactggctagccatgtgtagaaagctgaaactggatcccttccttacaccttacacaaaaattaattcaagatggattaaagacttcaatgttagacctaaaaccataaaaactctagaagaaatcctaggcaataccattcaggccataggcatgggcaagaacttcatgtctaaaaaaccaaaagcaatggcaacaaatgccaaaatagacaaatgggatctaattaaactaaagagcttctgcacagcaaaagaaactaccatcagagtgaacaggcaacctacagaatgggagaaaatttttgcaatctactcatctgacaaagggctaatatccagagtctacaaagaactcagacaaacttacaagaaaaaaacaaacaaccccatcaaaaagtgggcaaaggatatgaacagacacttctcaaaagaagacatgtatgcagccaacagtcacatgaaaacatgctcatcatcactggccatcagagaaatgcaaatcaaaaccacaatgagataccatctcacaccagttagaatggtgatcattaaaaagtcaggaaacaataggtgctggagaggatgtggagaaataggaatgcttttacacttttggtgggactgtaaactatttcaaccattgtggaagacagtgtggcgattcctcagggatctagaactagaagtgccatttgacccagccatcctattactgggtatatacccaaaggattataaatcatgctgctataaagacacatacacacatatgtttattgcagcactattcacaatagcaaagacttggaaccaacccaaatgtccaacagtgatagactggattaagaatatgtggcacatatactccatggaatactatgcagccataaaaaaggaagagttcatgtcctttttagggacatggatgaagctggaaaccatcattcttggcaaactatcgcaaggacaaaaaaaccaaacactgcatgttctcactcataggtgggaattgaacaatgagaacacttggacacaggaacaggaacatgacacacctgggcctgtcatggtgtgcagggaggggagagggatagcattaggagatatacctaatataaatgatgagttaatgggtgcagcacaccaacatggcacatgtatacatatgtaataagcctgcactttgtgcacatgtaccctagaacttaacatataattaaaaaaaaaaggaaaaatatggaggtaataaaatatttataaccataggaatagttttttttgataaaaagaagcaatcacaatgttatgttttattagtaatccaacaaataaggatgattttttgcaaattttggttgtatatgtttatgtttttatatttaagttttccatttagagttaacattaatcataaaaattattaaaatatattcttttaaatatagatttgatcctataactgaaaaagaattaatcagtttacttgggagaggtgcaataatgctctggatgctggaaatatcagaaatataaatggttgtgctgaggtataaatacatctcaagatgtaagccattgactcatgtctcattggtgatactaaggctatcataaatatgtccatataattttaagggatattaggccaaaattcaatctcatatctaaactaattatccaatttcagaagctttgccttccagatcttacagtccactgctcaaaatagtttgttagtttattagaaaagtgaaaagaaaaaataagtagtggaaaattaattgataatatgaaagattcgatgcagatttatctaatataccaaatctacattggatctttcattttatcaattaattttcttgtgtattactgatttcaaatttttgacaagctgctcatatctttaggcaagttaaacttcatatcttgggaattctgtttgtaaagctgacattttagctgaaaaatccttctggcctgctatgatataagataacaatgagacatgaagtgctttaagaatcacttcagtagaacatagtttttaaaaaagttctgactctaagaaaaggtggactacatgtatttctacatataatattttccctaataatgcttttaaggcagatttttcgttcagcttagtttttaggaaacctatcaaccactgtgtgttcactctgtttcctctcttggggcaccccaaaactagcaagtagttttccccctgttatccttcacattgacttgaatgtctcagtttgcttaaaagattagggtgaaagagaatcataccagtctagactaacctaagccctggagaacttccctaggttgagttaggtcaaatactcaatgctctgtgtacaaatgcttaactagatatgactaccttacatgaagtggctcaaccataattctgcatattgtttaaacaattctacattggatctatgatacttattaataagtgtctagaaatcacattaaaagaggaaataagactaattttgtatgttttggaagataattaatagtgatttcccagtgccctctactaagtggtgcaatcatagaagaagtttagcaagtgaacttgctaaacttaaaatttgctttgctcattcataagctatgaaactccatttgctttgctcattcataagctatgaaactcattcctacacattctaatgtttatgatgcaaatatatgtctctggaaaatttcaaattaccttcatggactttcagattgaaagtccgactgttaaatctgtagatgcaaaaagcctacttatataaccagtgctgaaatgacatctacagtgccatgggctaatcgtatctttattttaatattttgtaaacttgctaaactgaatgttgttaaactgaatgttgaatttgaagtgaagttatagacacttaggtgctagggtattgtacagattgtagacatttaacattttatttcacatttaaagtttcaaatatgtttttaaagctaatatgctaatggagaaggtatctaaatcctttgtagttggaagtaattctattcctccttcttcttcctaaatatactagctttcttctactgcaactaatcttttcattttattaataatatttatattatggaagactgaaatggtaaaaaaaataaaaataaatgagatccagtgtgtgctgctttatacgtagcagactggggatgacacgtatactttgttcttttttgctgttgttgttagagacaggctctcccaaagtgctgggattacagacatgagccacaccacctagccagcatatagacttttatctctcatgcctattctgatagaatagtagtggttacctggagggctgtgtacagaggaattttaggttgaatatggtatcagaacagaaaataattaataagccatatctgctatgagttcttgtaatctaccatctgccagtaaatccttgatttttggaagggatagtcataagacctctgaaaatttccatattcaaataagaacgtgtaattccctcttccccccacaaaattatgtatgcacagacaaatgaataataaataggatatattcatagcaatccatttgctttgctcattcataagctatgaaactcattcctgcatattctaatgtatatgatgcaaatgtgtgtctctggaaaatttcaaattaacttcatggactttcagattgaaagtccgactgttaaatctgtagatgcaaaaagcctacttatataactagtgctgaaatgacatctacagtgccatgggctaatcgtatctttattttaatattttgtccagttcaacaatatttgcttcagagataatcatgcatctaattgggccaaaatataaggttttaggggtgaatgttaagatgtaatgcatcagagaagactttcagtagcctcatcattgaatttgaaggataagaacactatggagaaattaggagaaaacactatgctatggaaaatactatgctgtggaaaccctatccagtaactttaccatgagtgtaatctacccaaatgaattgctggacccagactgtgtgcacagatggctgaaacagtcagacctacacctaggagatgagatcattcaggttcaccgtgacccagccgcgctggatggatctggatgtgctactctcacggttgtcatgaggtaatatggataggctattaacaaagccgtgacgacgcactcccctgagacacggtctgcttgttttgctgcatgtagtaaacagctctctcactagatctgacagcacttggtggtgatattcttttcccttcagactgactgaggaggatttcagaggtacctacagcattaagcctttgcctgtaggatgttataattttttgtgtgtgttgcataaggataaatttttgccatgttgctgtaaaaacatctaaagaaggagatcaagaccatcctggctaatacagtgaaaccttgtctctactaaaaatacaaaaaaagtagccgggcatagtggcgggcgcctgtagtcctagctactcatgagactgaggcaggagaatggcgtgaacccgggaggcagagcttgcagtgagctgagatcgtgccactgcactccagtctgggcgacagagcgacactccatctcaaaaaaaaaaaaaaaaagaaaaaaaagaaaaaaactaaagattttatttaactaagttattagtaaaaaaaatcattaggtctcattttagaattcacttggcacacatgaaaagaggtgacctgtttttcattgtttttttaaatgacttagagcttttatttacctagtgaatttccgattcacttgtactttatcaatttgtgactttgccaactggtgagctttcattttagggcttcgctgaagttttcttgagacaggctgttatgatagcatctctaagtgctgcaatatgacaagcttccaagacagttgtaaaacaattaaaattgtcactaaaatgtcttggctggaattcatattaacatgaataaaaggaactcaagagtctcaaatgttcttacttgagtctgtagtgttacttggtaaagattttacgtttttttcccatcgtatcaatcaatagtaaaccccaatcctttctttttggactgagaagtatgcaagcattttcataccacatgatattatctttccaaaagctacttgtagatgtaaaataaaatctgaattgttttattttgctcatagttagtaaatgacacattctgtgtctgggtgaaaatctttctctataataaccactgatatcttgagattgtaatatttgttactagtaccaagacagtttcataggcacaatctcttcgactggctcttttgcagctctttgggacccttgaataatatagagacagaatcttaggagatgttagcagtatcacaggtcataccttatgacaagccttaacaatagtgtgtcaggagactctcataaaaaatcattagatggatactttagctgcaaattatttcctctggacactgttctgtcctctttatccatcatcataacagtttatatcacataatggtcagcaagaactgtcaaaggagcagataggtagattactgatgaatgcctttcctgatattctcgtttttcctatgacagtctgtgatctgtgttatccctggttaagttgtggttactaccaactccaaattccaaatgatatttcatattctgtgtgttccgccaatgcccagtattacatggtattagggggaacataatcctttgctcagccaactccagacaaagtctgcagagcttctccttgagatgagcaaacttggaatgtaaggaaagttactgttcatcataaacatttttaactagtggaaaaagataacataaaagtccatatgctttcagaaagtaattttcattgtggaagcttctgagtagggcatacaaaggaacataaaacctggtgatgccatgaagcagctctttgcacagttgacatcatttctcataaagtattcccttttaagtcatccacagtagaaatcacaaaagaacagagatcaagtactggtctcgttagtcagagattgtgggttcgtacctcatttggtctgggatttcttagtcacaggggtgttttagaaggaccatgttttagaaggaccctggaagaacagggtttttggattcaacagacttagattaaaatcacaaccctagctagctcttttatctcagacaatttagttaatattttgatttcagttttcttatttataaaattaagatgatgatatatacttcttaggtttgttgtgaggaaaaattaaaagagtgttgaagagcctagcccacacctggcatactgtcagcactcagaaaatcatggctattatttttactattagcatgagactcagaaactatgggcctgttatctcatttgcctggttttatttcatatgtggatcttatgctgagatagctgactaggcatccaggcttggccacatcttctaagtatattttaatcaactctgtagtgtctgtttctttgttaacctcaaagagactattctgaaaaacaagtattattccctcaaattaacttcccgaatcatttttcgagaatataattcatatattaatgttaaaagtagtgttgtgtattctttaagtttcttcgatgttctagattttcagagtcatgagtaacaaatgctctattgctgtattttgcatgttctatctaatttccttgactagcctcatcaaaattttggtgatttttacacagtaaaactgggatcagaagttaaacactgggtgggattaagattcaattcacagtaagaaaaacaaaacctttgtatgtaacataagtgttttcattattccctatataacaccacaaaatggataaaaatctttgtataacagtttaaaataatttaaacatccagactaggaaataaaaatgaattaataatggataataaatttttatttcttatattgtgttacaattatataattacatatataatcacacatttaataaatatgtataatatcttattctgatatggatatagaattttacagttgataaatctttttaattcaaatcattctattctattcttaaaacaaaattctttgggataatgattacatcaattttttaaatggaagactaatgccaatgaggaatacaagtcgcaaaccaagatttgatagtagttctcatttacattttaccacatcaggctgcctcatgatgggatatgttgcaatctatgaacccactctccattttggggagtttcttcacagcatccttttcttctctcagtcttcttgtggctaaatttaggcacacatgtatacatacatgcacacacacacacacatgtgtgtgtatatatatatatatttgtgtatatatatatatatatatatatatacacacacacacacacacacacacacattgccttccaaatttgagggataaaaagtagaatgtaataacatgactcagtgtaaaactgcaccttcagttttatccttgtgtatttatcattgcatgtttatttatttataaattttgtataacatgtagctaattttgagcattgggtaataaaggtgggttagggtcactttttttggtggaagttgatgttggaaggaaggtgagacagtctcatataagaaactatgaatcatagagtctctactgttacacattgctgctgatgagaattttgttgtccaggacaattgtcattcctttgtaagtgactatgttttaaaggatgttgtgtgtgtgtgtttgtgtgtgtgtttaatgtggattaattttacttttatattcctgcatatggctaggccttctccttcagaccctgaacatcactatcttttgtaaaatagatacagtaaaatagatatagggatagtaaataagaaatgctcttacttcacttgaaaattttaatgtgatttcagagcagatatgaggttgatatggtacgaaggcgcacatttaatattggagtcaactaaggtcctattcattttattaccaatatcccaaacttgttatataaactcttaccttatattctaaaaggggggtaataataccttctattgtaattttaaaacacagagttttgagatgtgttaagaatcacagtgccttgcacttaatttagtaaaagttgaccccctgccaccttttctttctcttctgattaatagaggagtctactacctcaaacatttattactgatttgtgtggggaacattacaaatcttctagttattttgaaatatactataaattcttgttatctgtaatcatcctactgtgctaccagacactataacttattcattccatctgaatttttatacctattaactaacatctcctccttccctgctactcttcccagcctctggtaaccactattctactcactgtattcatgagattaatttttttagctcccacatatgagtgagaatgtgtgatatttgtctctctgtatcaggcatatttcatgtgacataatatcctccagttccatccatgttgctgcaaatgacaggatttcattcttttttatgattgaataatatattattgtgtatgacaatattttcttaagtactcatacatcgatggacatttaggttgtttccttatcttggctattgtgaatagcactgcaataaatatggaagtgcaggtattgcttcaatatactgatttcctttcttttggatacatattcatcagtgggatgggtagattatatggtagttctatttttaattttttgagaaactgccatattgttttccatagttgccatgctaatttacattcccaccaacagtatatgagtctctcctttctccacatccttgcaagcattattttctgtctttttggtaagaaatagacattttaactgggatgatatatctttttatggttttgatttgcatttcctttatgattagtgatgttgagcattttttcatattcctgttggcaatttgtgtgtcttggaagacttagtattgttaagatgtccataccgcccaaagtgatctacaggttcagtgcaatccctacaaaaataccaatgacattcttcacagaaattttaaaaatgaaatgatcctaaaatttatatggaacaacaaaacacctcaaatagccaaagcaattttgaggaaaaagaacaaagctggagacatcatattacctgacttcaaaatataccacaaagttatagtaactaaaatagcatgacactggcaaaaaaacaaaaaaaaccccatagacaaatagaacagaataatagaatagagaactcagaaataaatcttactcatttatagccaactcattttcaacaaaggtaccaaaaacatacattgaagaaaggacaatctcttcaatagatcatgctgggatgtctggatattcatatgcagaagaatgaaactagattactctctctcaattaatacataataaaatcaaaatggattaaagacttacacataggatgtgaaagtatgaaactactagaagaaaacattggggaaatgctccaggacagtggtctaggcaaggtcttacttttcagtaagacctcaaaaaacactaacaacaaaagcaaaaattgacaaatggattacatcatgctaaaaggtttcttcacagaaaaggatacaatcaacaaagtgaagagacaacccacagaatgggagaaaatatttacaaattattcactctacaaaggattaatacccagaatagataaggaactcaaataacttaatagtaaaaaataataataatccaatttaaaaatgagccaatgttcttaagacaattctcaaaagaagacatgtcacattgttttcagataatttttaaattggttttccttctgaagatactaaagttttggtggcaagagcactgaattttggttctagaccatgggttctagaatctactgtaatactaggcttacataatttcagctatgaaatgcagggtttggatttaatgctttgtaaaattatttatagctccaattttttttattaatacttctctattttctgaggaaagatttaacatgatatcctttacagtgtcctataggtttaataacattatagcctataatctaattttcaaaagtagttttcaagtactttttcacatgtatgtcaagttatggttataatgctaaataaataatcaaaaggttgaaaaaataaagcaattaaaatttattataataacttccaaagtgtactgaaaactaaggattttatctttcacttgtggctttccaaaggtgaaagagaaatcaataaaaattcttacattattaatgccatttaaaacaacacaccaaatcaacaatggcttgggtagtatatatgcatcaaattcttcttgttgataaacataaagatatctttgagctagagggcatatggttcctactgtcattttacaaatagaaaagaaatcaaaagcccagatagtaaatgactgattcaaggtcatagaatgaagtattacgactatattccagtcttcttgaccactagacaataatcttaattcatcaggtggcaaatacccaaatcatatttattggtttataagtttgtagccattgcttacgatcattaaaaggaatatagaagtcattgttcaatgtttcctgaaaagtctttcaaaaaaatcttactgatcccaagcttttctaaagtattaataacttgctggactaactgatttcaattatttctataaaatataattactggttattcctgctgactgtaaattagaactattcaactacattttagctgctgggcaattacattatttctacaagtaaattattttattttcaagagtctgtttttattaatcttaaatatgaattattacccaattgttcttgttatagaaacaatatgtcatttagttaaatattgtagaaaattgtttaaaatataattacgtgatttttatttaaaaactaagttgaatacttgagacagtctcaataaggatcagtcactaaaaaagatgaaaaaatcgtaacagtctcagagattctgcattcagattgataggcaaatgtattaaattctagtggtgctttaaaaatgccaaagctagacatcagaaacaattagtggatatatagtatgacatctgcaaaaaagtgtagttaaacatgattttttttaaatgtcaaagttcgaaatggtataactatgggcagactttgaagctataaatatttcagttgatcatatagatgacattacttatatttctatacctactttatatataccacaagagacctacttattcagtcaaataagacattgcgtttaatatagaatttaagaaatatataaaaatactcattataattaaatcttctatatttagcattgcagatttttaatttactctgtaaaataatgttatataaactgttactagtattagcctaaacacactttagtaatatatgtttgtgactttatttttttataattaagcaaatatacatacgtttaatgtagtagcacaattgcaaatagtatgtttcactattcattagagggataagttattatgcacaaaagttaaaataaaatgaaaataatactacaacttaaggatctattttgaaattatgaaattgacatcagcaaaataaaaacattttgttgaatattttctttctttttttttttagaataaaattaacttttattatgttgaaaattgtgacaaagaacgtttagtttactctggtcttagggaactatttaaatataaaaagcgatgggattacatggattccgtgaaaagttaaagcttctgtacattaaaaattcctaaaattaaaagataaacttcaaattggcataaaatatttacaactgatatgatagagaattaggatcctcattttgaaaataatattaatgaaaaaactggatagaaaacgtcactagaagaatcacacacaaaaagattgtatatagtgaataaacatgaaaattagtcaaataattacaataaaataatgaaaggtaaatcaaatcaccaccaaagataaataatactgaaatactattggttgagtctcaattttttagtgacaataatgctgttcagggtatggtaagatggagatacttcctaatgggactaagaattggtacaacatttatggaaagcagtttattcttattcttttttttttcttttttttctttcttttttatttatttatttattattattattaatttttttattatactttaagttttagggtacatgtgcacattgtgcaggttagttacatatgtatacatgtgccatgctggtgcgctgcacccactaactcgtcatctagcattaggtatatctcccaatgctatccctaccccctccccccaccccaccacagtccccagagtgtgatattccccttcctgtgtccatgtgatctcattgttcaattcccacctatgagtgagaatatgcagtgtttggttttttgttcttgcgatagtttactgagaatgatgatttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaatgaacatacatgtgcatgtgtctttatagcagcatgatttatagtcctttgggtatatacccagtaatgggatggctgggtcaaatggaatttctaattctagatccctaaggaatcaccacactgacttccagcatggttgaactagttcacagtcccaccaacagtgtaaaagtgttcctatttctccacatcctctccagcacctgttgtttcctgacattttaatgatcaccattctaactggtgtgagatggtatctcattgtggttttgatttgcatttgtctgatggcctaacactacttgctccagtatggcaaacctgaatgtcattgagattgacaccaatctttgtttttgtctgtttctgttctgtgtactgtaacagaaatgtttcatgtttatgcactttgttttgcaagagcacttcacatatctctgcccagttccaaagtataaccgagtagcagaagactacagtcatttccttatctttttaaatgtcacctaactccaggagatgttttttccatgttggaaacagcagtctagagcacaactgttttaaaatcccatctcctaattttaaatgatagaacgtgacacttcttacttctaaagaaactgttaatatgtaacaagtgtcttctcaatcactattgaattcaaaaacaggtactcaatctataaatcattgttctactgggagtacatttttgttgagtgacatttttcttaggttgtgtgtgtatgtgtgagtgagagagaggaagagggagagagagtcagtcttagccttcatctctgattttatatctgttttcctccctaccatttccctcccctccccacccctgccctcccttcccctcccctccccacccctgccttcccttcccttcccctcccctacagcctctcctttcctttatgtcaaccattgtgacatgcagtgtttgaatgacttcataatcagaaatgatatgctgtattagtttgccagggctgccataacaaagtaccacaaattgggtggctcaacaacagaaacatattttcttatagttctggagattataagtccaagatcaaagcgttggcagttttggtttatccttaagcttttctccttagcttgtagatggctatcttctctctgtgttctcacgtgatctttcctctgtagttgcgcatacttagtgactctttttgtgtccacgttgcctcttttcgtaagacacaaatcaggttggttgaggacctaccctaatggcctgtttaagctaatcacccccttaaaggccctatctccaaatactgtcacattctgacatgctggtggttaaagctgcaacatacacattttagtgagacacaatttagcccctaacatgaggattgcaagctattccacaaaataagattgggcaacactctacaaatgaaactattggaaaaatagttataatgggagagtttagccattgctacaatcagccacatacaaaaccctaaatgtgtaggaaactaaagaatttgaggtttcctcaaaagcatatcatagtggcccaggtggaggatctaattaaactaaaaagcttctgaacagcaaaagaaactaccatcagagtgaacaggcaacctacagaatgggagaaaatttttgcaatctactcatctgacaaagggctaatatctagaatttacaaagaactcaaacaaatttacaagaaaaaaacaaccccatcaaaaagtgggtgaaggatatgaacagacacttctcaaaagaagacatttatgcagccagcagacacatgaaaaaatgctcatcatcactggcgatcagagagatgcaaatcaaaaccatgatgagataccatctcacaccagttagaatggtgatcattaaaaagtcaggaaacgggccgggcgcggtggctcacgcctgtaatcccagcactttgggaggctgaggcgggtggatcatgaggtcaggagatcgagaccatcctggctaacaaggtaaaaccccgtctctactaaaaatacaaaaaattagccgggcgcggtggcaggcacctgtagtcccagctactcgggaggctgaggcaggagaatggcgtgaacccgggaagcggagcttgcagtgagccgagattgcgccactgcagtccgcagtccagcctgggtgacagagcgagactccgtctcaaaaaaaaaaaaaaaaaaaaaaaagtcaggaaacaacaggtgctggagaggatgtgtagaaatacgaatgcttttacacttttggttggactgtaaactagttcaaccattctggaagacagtgtggtgattcctcaaggatctagaactagaaataccatttgacccagccatcccattactgggtatatacccaaaggattataaatcatgctgctataaagacacatgcacacgtatatatattgtggcactattcacaatagcaaagacttgcaaccaacccaaatgcccatcaatgataggctagattaagaaaatgtggcacatatacaccatggaatactatgcagccataaaaaatgatgagttcatatcctttgtagggacatggatgaagctggaaaccgtcattctcagcaaactatcgcaaggacaaaaaaccaaacaccgcatgttctcactcataggtgggaattgaacaatgagaacacttggacacaggaaggggaacatcacacaccagggcctgttgtggggtggggggagcggggagggatagcattaggagatatacctaatgtaaatgaggagttaatgggtgcagcacaccaacatggcacatgtatacatatgtaacaaacctgcacgttgtgcatatgtaccctagaacttaaagtataataataaaaaaaaggaaagaaagaaaaaaattaaatgacttcccagaaaaaaaaaagaattagtaaatgtaaattcatagactagtaaatagtgtcatactctatctgataaaatagaagaatgtgttggcaaagatgctgatggtacatacagaagctagagaaaaacagccaaaagggtaagaatttgatgttacatttctagcaatgtaatggtctgaggtcagaatgaagggattattaagctttctggctactagaaaaatatgtcctctcttatgggcctgacttaaaggccttgctgaagtcagctgggttgtagtatgtccctgttattatacttttttacttttttttttttggagatggagtcttgctctgtcacccaggttggagtgcaatggggtgatcttggctcactgcagcctctgcctcctgagttcaagtgattctcctgcctcagcctcccaagtagcttggattacaggcacctgccaccattcccagctaatttttgtatttttaatagagacgggatttcaccatgttggtcaggctggtctcgaactcctgaccttaggtgacccacccgcctcggcctcccaaaatgctgggattacaggcataagccactgcacctggcctgtactgtttcattatattccatttttattatatcttatttttgtcaagagtaatttattctgaaattcaatttctcatgcgttctaacaatgcgaacttcatgaagaacaaacataaatattctagttctagggaacgataaccccaagttttaaatgaatagagttgctttctggtttaactatctaccatgagctccaagatagtcttgcccaagtaggcagccattttctttggaatgttccttatagtgcttacaactttaacttcagcacactcatataataagcactgttgagtcttattctgcctattctctaaaaaaaaaaaaaaaaagcaaagcaaaacaaaaaatagtatacatgattcagttctcaaattccaccagctgttttaaattttttttgaaacctctagtccagtcttaatatttaatcacatagcattttgtatggcattttgaaacaaactgaaaaacactaaattcagcttatttgagctttttgttactctagaaccttgaactactgctcactctattcttatatctttgcaaatctcacttctttacatattccatgtcaaatgtcaactcctccaaggatttcttgactacacttgttaaatgaccactcattcccatccccagtcactactgcatagacaaatgactgacactaattggggtcagggaatatttatttactaaacaaaatcaacaaatcaatgaatccattctggcttctatagcatatttgaagaatgatagttaacaacacaatttctatataatatttatttataaatgttcatgttttaggtaaacattgcctaaaagttgtagataatccctaaatattttcctatgatttatataatttatgaattcatactatcttctattggaagacaagtgatttttagcttctaaagagttcacttgtcaatgaattcttcagtgattctcaaagtgtgatccccaaaacagtagcattagcatcacctacaaatctattaaaaataaaaatttgaggccccacacaggaaccactgaatcagaaactcttagactggggtccagttatctgtgttttaacagactttcccagtaactcttgtcaaccactcttacctaatcaaaagtctaaatcgatacctgtggctattacagttaaaatggtagcattgtcattggaatatatttgaatttctttagtgattttagaaatttttgatataattgtagaaaatcaatcttagatcactactgatttacaattccattcataggcttgacatctcagactgatccaagagccctatacctaatttctcagctaaaagtcaatgtagacttggattcatttcctactacatggataaaaagctatttcccataacatttctttggtatgaaacagtaaaaaaaaaatgaataggaaatgacaataacccagcaccaatttatcaaccttgctgtcatttcttaaatatcattttcacaaatatgttattacagagctctggtagaggacaaagcgatgatttggcaagctccaaaaagactcaaatgtcggggaaaatattttaattccagaattatgacagatttatgctacgaataaatgtttgaaattcagataatatatgtcacctttcttttgtggcacaaagataatagaattataagagagaaacttcattgtttttacactatgacaaaaatatgggcctgtattaagaaggggaaaagtagcatgtattattgaagaaacaggagccagcggttgaatactctcctgccttttatctccacctgtagtgaactcacttgtactcttcttgccctacaaatagaactgcaatctgccatgcaattattacctaacctttgcaagctgcctgtgttgtcaaaacatttctgctcagtaacatactatacttaaagaagatagttactaatgcacttggacacattttctagtacaggcagaaattcttgactcttaaaatggcattattttcacttcttcatatacttggattgtatcttctaatagagatgatgaagcaaaaaatcgaaacaacaatgatttaaatcctttgggaataaatatgaagatcattgcatacaaatagaccaaaaagactaataattttttgaataggaatatctacatgaatatattttaaatgatgaaatgaaggtcctcagtatgtaggaaaatatagttcatgaaaattggaacttaaaacaagttttctttttaatgtagaatataagctcatccttttacaccactttatgtatatttcaattcaatgaactataattttattgagaattgcattttccactggactttcctagcaatttcttattaaaattttaagaatgtatgttgaaagcatatttactattatgaaaatatattgtatatatttaaaaatatatttgttattttgtaatatcaattgtatcaaaatgtatttcttagaaattacttttaaattatagggccttcagctagaaagagggcataatttgatgatctttctcctgaaaaaaaattagcatgtagtcctcttggtaaaagcataaatttaatatggcttgaaataatgcctttgtggcagattagagacacttttttgaaatattacaatgccttttaaaacttttagccttcaaaaaaggaactatttcagatactaattactaccaaaatttatttagtcatttttaactgctcaaacagcaaaatacacaaaagtaaaataattttaaagttgtaatcacggctgttgccctttgtgcccatgggttctgcatccacagattcactcaatcatggactaaagtattttgaaaaataaaaataaaaaacacaaatttaaaaatacagcataacaactatttacatagcatttacattgtattataaataatctaaagagatttaaagtgtttgagaggtcgtggatagattttatgcaactactatgccattttatataagggacttgaacatcagtggattttggtatgggatgggggatttctggaaccagttgccctgggatcccaaggtatttcaactgtatttcctgctagttatagatatttttagatctgctcttagattttttcctatagggattgattaccattgtataatgttagtataaaaattttaatcatgttgtagtaactgctgaaatatatgtaactaacatataatgtgattgtgaagtcttgatatacataaaccaaatatacatgtgcttaaagaggttacttgtatttttaatggcatataggccattattaaagaaactattaatttacaaatagaatcagcacagcttcttacaaaataaatacaggatatattttttgccttggaatagtcatagaaaaagtaggatttgttacattgtgggaaacttaggtagcattatggtttcaattagagtcgaaatttaagttcttcctttcaactttttttggtattttacgtttagaataccttcaactttgggaaacataagtcaagaggcagcaggaagggtctactcactcagtaaatacacaaggcatgctttgaactcaggggaaactaatttgcacaattcttactgctcttttgttgtggagaaagttttatgtgtggaaacaaatatgttcaaagagtcatgttacagaataatagagaaaactaagtaatttgtatgttatcagataaagtaaaagttctaatggaacaggtagtaagtcaggaaatgggtactttactaccaactatttacattaaccagatggttatttgcctaattttatttagattattatgtttcaatagtttgtagttgcacaagcaaaagaacagagccatatagttgcttaatataatattatgtaactctcaaattttctataattttaatttcctttaaatggaattcattcatatcaattcattcacttgaatatcactaaatttggtatctggtacagtataaattctatatgtatgtctgttgacattatacattatacataacattcaactatatatcataattagaacaacatgactatttttagagtaaaaatagtttcaaattgtatatttgtttcagatatgcacagatatgacatggtatacatacctgaaatgttatatttttattctgttgtaaaattacttttaagttaaattatataagacaaaatataaaattaataaaaaattaaatacgatcatttgaaatgattgtgatttaagaaatattttatagaaagcatttgaaaataactaaatttttcacatgcttactatctcaatatgtgcttcttatgattttaatagtatacttcaaaaggaaaaaaacgcagggtgttcaatcaatattttctatttatttgttcgcataagcggttatccaaaaattaagagttaaatggacatttgcctattatcaaataaaattgtttgtattttccactctgttctttttcattttatatggcaattattttatgtgattttttaaaatcaatttcaattattcatggatccctaaatatgaattttctatagccaatccaactaccaaataatgatagaaattcattaattcaataaacatttactgagaaactaccatgtgtcagacactattctaagccttagagattgatatggtttggatttgtacccccacccaaatctcacatcgaattttaatccccagcattggaggaggggcctggtgggaggtgatcagatcatgagagcagatttcccccttgctgttctcaggatagtgagtgagttagcacgagaactggttgtttaaaagtgtgtaacaccttgcccagctctttcttcctcctgctccagccatgcagtatgtgcctgcttcgccttcaccttccaccatgattctaagtttcctgaggcctcctcagccatgcttcctatacaggctgcaaaatcatgagtcaattaaacctcttttctttataaattacccattctcaggtagttctttatagcagtgctagaatgaactaatatggagatacaacagtgaaataaacaaagcccctgcggtcatagactgtactgcattgtagtaagggtcaggagattataggtagaaaaactaaacaaacatacaatttgttaggaagtcataagtttcaagcatcaaaaaacacaaatgaaaagagagtggtctaaaatggaagaaagcattattttgtaatcaggaaagattcctttcagatggttacatttacatagcgagtcctagaaaaaaagtgattgagtaagccttgtggatacatggggaaatgatgtttaagtgagaataaatagcaagtgctaataccctgagtcatatgcttgaaagtccttttggaagaaaagaaatgaaggaacatgactagaattaagtgaccaaagcagagaggggtagaagaggtattggggtagaatatgaggtcagaaatgtagatgagtaagagcagcagattatgccaatcttgcaggcccccacacagattttccattttattctgagtaatacggaaagtaattagacagttctttttttgtttcttacaatgttttatctctggggcagcctgccttcatttatcccttactatcttgcttatgcattatttatgtagtccctggaacagttagatagtctttgacatcagtatctacccaatctccacttttcccttcactgcaagattaagcttcctaggccgggcacggtggctcatgcctgtaataccagcactgtgggaggttgaggctgactgatcacctgaggtcaggagttagagaccagcctgaccaacaggacagaaccccatctcttagctgggtgtggtggcacgcacttgtaatcccagctacttgggaggctgaggtaggagaatcacttgaacccaggaggcagaggttgcagtgagccgagatcgctccactgcactccagcctgggagacagagcgagactccatcttaaaataaaaaaaagattgagcttcctaaaggacttcttggatgatgatactctctgaccaaaacttaaaaacaacccgaatatatatggacctcaaacaactctatagcaaaaaactcttataatccagttaaaaactaggcaaaagatatgaatagatatttctcaaaaaagagatacaaacagcaaacaagtgtacaaaaaggtgttcaacatcattgatcctcagagaattgcaaatcaaaagtacaatgaggtatgtcaccccagttaaaatggcttatatacaaaagacaggcaataatgaatgctggtgaaaatgtggagaaaagggagccttcctcaactattggtaggaaagtaaattagtacagccactatggagaacagtgtgaagcttcctcaaacaactaaaaatagaagtaacatatgatctagcaatcccactgctaggtacataccccgaagaaagaaaaacagtatatggaagagatatctgcactgtcatgtttattgctgcactattcacagtagtcaagatttggaagcagctgaaatgttcatcaacagatggatgaataaaggaaacatggtatatatacaagatggagtagtatttagccataaagaagaaagagatcctgtcatttgtagcaacatagatgggactggaggacattatgttaattggaatacaccaggcccagaaagataaacttcacgtgttatcattcatttgtgggagctaaaaattaaaataattgaactcatgaagattgaaagtagaatgatggttaccagaggctgggaaaaggtattggggtgggaggaagtagatttaatggtacaaaaatatagttaggtagaacgaatacgatcaagtatttgatagcacaacagttgtgctacacttaacagtgtgactacagttaacagtaatctagtatatgttttaaaataaccaagagtataattggaatgtttgcaacatgaagaaatgataaatgcttgaggtaatagataccccatttaccctgatatgatgattacacattgtatgcctgtatcaaaatatctcaggcactccatatatatatatatatatatatatatatatatatatatatatatatatatatataaaatatgcgtctactatgtacccataaaaattaaaaattaaaaaaaataagcaaaaaggccaatagtgattatcatttatagtgttacatccattatctaatttaaattattattcacgtgaaccctctgaagcaaatactactgttatacccactttacaaatgaaggaaacatggcttaataaagttaagaagtaatttgcttgagtgtatatatctagacaatgatggagacatgattttatctccactgctaatcaaatgaaatgaaattttctcaaccaaaaagttaagtccttccacatggtgcttacatgtaatctagactggccaagctccatgtgccctctccatcgcctattaaatttggggtcagaggcaagttatcaaacctagcgagtcagtaaacctctgtaaaattaatatcttcctcaaaattaaatgagaaaatgaacacaaaatactttaaacagagcttagtatatgatgggaaattagatgtcagctatactcattacctcggtattatcatatacatcaaataatgcaacaaaatgaagaaaaatttacatgtaaatcatattattgttaaattgcaggaatatatgctcaagatattggttggccacagcataggtaaaactataccatattatcaatataccaaaaccatatgtgagcattttaaaaacttatttaccttatctctttttctaaaatgcatgtttctttacagttatagctttaaaaagtttaactaaagccatgagtgttcttctttggccagtaggagctgaagaatattttttcctattattaaagaataaaacttttactcatgtgactaccctaccagatggatcaatagatggaaatgtttacaatgacaatgatgaatggtaaaaatattataattacttacaattcttcatgttattcaaatgttctactcatcagaaaaaaattcaacttatggctattaacaagtaatagaggagtagaataagtcattgctaatagttttttttttttttttttgcaatgcggcaatgtatctaatgatagcagcttctattaagaaaaataaagtggtatttatgaattttgtaaataatgttctctggccaggtttttaccatactcctgatgtgtaccactatttaattagcataatttttatttctctctgtcagcctgctcttggcttatctcctacaggaagtaggatggcttttattttaggactacattataatggctggatttttacaaaagcctgtcaacaccacctcaaccccactgtctgtaggaatataaatacagtgtaactgacaacatagaatggctggaagcataatctccaatttactactgcctcaaatctgtgaaaagcccaaaagggagttgctgaatctcttcttcaaataaaatcctataaagagccaaatttaccaaaaaaactacaattgtataaagtgctctcggagatctgggtaaataagcactgctgtctcttcccagggattcttcaggacaattccaggtctctgaagagcaacctctgcatttgatactctgcagtatatcccccagataagtccaactgtcagagacctatgtgttttgactataaactgttggctccatgtagctccatgctttcagttgatgtcatggcgtgaacttaagaacattataagaagcagcacattattaaatctgtaacaaagatgttgttgaaaatgtttatggatttacagagaatcctcgggggcaatttctctctggtctaaggcttttcatgaataattttctgactgagggaggagaggacagtcttcatagagatagtggtctttgaacttggccattttctgatggattattttataggatcattccagaaaggggaaatttatagatctgagaaagtacatgattagtttagggaataagtgattttgtgttctggtagcattgcatgtgtgaaataatgttttatgaagtatgactagacacatgagttctcattttacatagtgtagattattttgtgtgttccattaaaagcctgtgagaagcaaactcataatgataggagatctctgaaagcaatatgaaatactcgtaaatattgccctcaaggagtatagtttgtgtgcaagataagttttccatagaagtaaacgtaattaaatatagaaagcctgaaggatgtgagtcttatttgagtcattttattcatcttaacagagaactatatccttatatcatttatgttagatttatacacacatattctctctctatatatattaaacataatgttttcctgtgttaccttctgagactataactcatctcatttatcacatgataaagaatacaagggtagataattaaatctaaaatagaaagtcaataaatatttatgtgtattattaatggctagtgaggcataagttatttttcaagatacataatttctacatgttcaagtttcaaaatgtgtttattatgaaaaaaaatatgaaagtattcttttaaatgaaatatttattacaatgaaaccattactatttttcaattacaattaaaaaggcaataattatggaattcttattattttgtttttcttaggaattaagaatcattgttatgcaagcacatcattctcatagccaaattatacagtctttctaaattttttgctagtctgtttactgtcactggcattttagcatgtccttctttgactcatagtgaattatgattaattcactatgaattataattaaaatattataatttcatcaactcatgaggtgattccttatcaataaaatgataatgtcattaatttcttttctagataccacaaatatctaattttttttaaaaaaagtttgagccaaataagtaattttcagaaatatggaaagttagcaaggcatgataactttcactctgtagttcaatattattatattatctttccacaggggagcacatttcagagtttgatgatactatggtctgaatatgtcctctaaaattcatatgtcaaaacttaattgccaatgcaatagtattgaggtggggactttacaaaatgaaatgggggactttataaaagagactgaagagagcacgttagataagcaacaaggtgccatcttctaagtaaagagtagccagtactaaataccaaatcttccggccttttgatcttggactccctagcctccagactgtaagaaatatatatctgttatttataattaccagtgtcaggtattttgttacagcagcacaaacagactgagacaatgtgcaaatgtgaactactagcagtgggcaacccaggagaatagcaaaatcacattttatctatattttaaatcatacaatatctctccatgcgatttctgctcgttaagttcaaatacggttcataatgagtatgatgtaatacacacgtagtttccatgaatctttaattcatgtaattgggaattttacccagaatttccttaaaatattatctgttctatattttgcatatgaggactagtaattaccagtatgttttgttacaaaaagagtactaagaaatataatccttagaaatatgcatacagtttatttggataaacattcaatagaatatcatatagtttacaaattatcaataaatctgttcccacacttaaaaaattacttttcaatgctgaaacttccaataacatggaggaggtttattttcttttgtagtaatgcttaatcattcatttcatttttttcaaacttaaaaatcagtttgaatttgaagagaacatctctcaatctaatctttataaaaacagattaaagctaattgtatgatatttatttcatcaaaatggttggttttcaaaggaagaggtcatttttaaaatgtcattaattttattttatgtcattaattttattttattatacttctacgcagcattccataggaggattccttactcaaagtgtttgaggctcaaatatccaaatgcctgtaccacattgctacgtggtgttttgactgactcaactcctgtgtttcagttttctctctagcaaaatgtggggagttaaattaatgagtttgcatgtatgttggttagtgtgtaataattttcgaagaaaaaatattttaacttgtgtactttaagttctgtaattatgattagaatagtaatcagatacatataacactacttgaatgaatttgttcatggtattaaatgaggaaagacagtcattaagtatgtcattaggtatatatattcacatatataatgcaaactatacatgttttctgtatattgttgaggtatataaatacttaagtttgacaaactgttaaaaaccattattctaaaagaattatctctgttttggttcagatattgcttctttgatgcttctggttctagtaaccttattttgtatctcatacctttcttgtcctgcagttttagagcttgaatcttattttattttattaggaccattttaccagtgaagaattattttttacttgttccttaaaatttaaacttaaaaaaaaagcaatatgatatcagtaaaatagctgaaagaatggtataaatattctttttttggttcatttacttcaattccatgagtcattccttcagttattattcaagtatcaatttcataattttggtttacaagcagaaatatttagaaatatttttccccaaaacatattgtctgattttgtgtcaggatgaacgaaatgtaaataataaagtaagatattaattttatcagtattggtctattatctttccctcctttttacacaaaatagaagaaattttaactttattataaatttaaatatagctccgagttttttctgatgtacaatgagtactgggtaaaattaagtcaaaatactttaggtttatgcatgataacgttttgaataaaagcataaacatttgaatcctggaacagtttaacataggtgatagtaaagaagtagatttttataaaacttttaccatgaagaaagtgcattaagttgtgctttctgctatgataattgttcacaagtcactctaatctcccaccattagacaaataacagagagcagagttcctgagaatctctaagtgtcaacagatgataattttattttcttttggaaacaatcctaaatgcagtacctcagacatttttattcatgggcatgaagtaagagatgaaacaaaatacagtaaaaacagaatcattaaacgtattgaaatatgaggctttggttggtcattgagagcaaaggcttgtttttctgtgcttgtatcaccagttcagcagattagaataaattaagttaaacaaacacatcttgcaattcaaaagccttatggtataaaatgctatattataacagttactaaacatatgcttcttttcattttgagcaccaaaactacaatttaattatatttttcgttgaaatgagttttataaacactgtgatctactgtatgttttatgtatttgcctggtgtaaatgctttctacaaaaaatatatgaacatgagtggtatagttggcataaatcttgtatatatatatatatatatatacacgaatatatatttgaatatatatatacacgaatatatatttgaatatatatatattcaatatatattgaatatatatatattcaatatatttgaatatatatatattcaatatatatatatattcaatatatagaatatatatatatattgaatatatatttgaatatatatatattcaatatatattgaatatatattgaatatatatttgaatatatatatattcaatatatattgaatatatattgaatatatatatattcaaatatatattgaatatatatattcaattcaaatacatattccaaactaaatttgcaggaaagcctatttgaagtatgcacttttgggaatgaaattataaaacagaaggttgcatagacttatcgatgttcttctccatcctgaccattcttactgctattcttttctgtattagattcaaacttgatctctccacagatggtcttagggatagcatattatgctaattaaagatacacactctgaagttaagttgcctgggcttaaatcccagatttccatttactcactatttgtgcttgatcaagtttcttaacccctttgaggccttaggttcctcctataaattatgattaaaataagaatagttacctcatgaagcggttttgaaaattaaatgatgtaaaaaaagcgtttagaacagtatgaacacttctgctaagtctatatgctgatcacaagtcttagtacagttctaatattactggtttacatttctaaaaaaaatactggtgctaagatgtccacatttttatttttagggaagagaaatcaatatctagcattggcaaatactgaaaatagagaaatgaaatgttaataaaacaaaaattcctgtgatatagattatttaatctgtaatgtttaacatttcatataaaagagctaaatttgattcttctgattatgaaatgataactatggctttacaagagtttttgaaggatgctataataaacaatattttaaaggagttaccgtgttcagtaatctatgctaatttttaagagattttaaagctagagataaggaacacgtgtattaaaatcgaaattaggataggataggttttcttcagtttgactttgttttttaaaaagacaaaacagatgtatagtattcactattatatcaatctttaaaaagttattagtgacaggaccagtaagactaaatgaactgatatttaatgttttatgatgtactatttaaagaaaaactgtgtgaatttttctttaacctctagaagtatctttgccccacaatcctccccaaccctaacatgtgaaagaggtaatttaagtattgagcattacactttattgtgtggattactgcaattaactgtgcatctccaagcaacatatagccattgtgcaaaaccactgtgaacagatgatacattaagaagcacagcttcgctgtgcatccggcccttgatattgagaaatacagcggttcagatggaatatgcaaatagaaaatcgacccaaggtcagagtgagaaaggcaaaatgacaatctttgctggtttcagaatgagaaatccatttctgctgcaaaataaaggttgaagaaaatcagtaaaagaaaatttagatatttcacttctcctttcttctttagctggaaagtaattcagtaatttttgccagtacagagaaaaggaagaattagttacactgtatattatccctccgggataactttacacttttatttcctaacatttttccctttatatttactctaataagagaaaatggtgtgtagttgatagaaaatcactcctgagtttatccatcgtctttgttctatttatgcttttttttttaattttcagggtgaccttgagaatgtacatttttctgcacttctctttctccatcttaaataagtgtaataataattgataaatattatgttcttaattttcctggaggattaaaaatagtaataattaataggtttatttatctaaataaactttataattttatttctcttttttattttgtagtcaccttaggtgcagaggaattatctgatcatatttctgttgatggcacatggcacactatcctcatgccattctttttcttatcatgtttattataatatccacttctctttttatgcacttttctcataagtttgataaatgtgttatgatgagtatgtatcacataaaatatgtcccattaaataagttctgaatgcttaatttatataactacaatacagttatacatttcatattgcttatacatgcaaccatgtacaatatccattgtacatatccagcataatttacttattatgttaataatgttgtctccactctcctagatcacctgcaattgtctgttactgcaaacaatgccaagataacatcctggtatatgtgcccttctatacttatgcaggaatttctctaggcttaaacccatgaatggaaaggctgggtcaaatgttatgtttcatttcattttgttgcattttatttaatttcaagatatattttatttaatttaatgcactacattttcatttagggaattgatgtttgtattcacaaatttagataattagtattttggggttttgttttcttctgattactatgtagttactatgtattttgaagtttccagatatgtggagatttattcactttaagcaactttatttttaaagcactttttagtttacagcaaaattaggcagaaggtgcagagatttcccatataatccctgcccctacacgtgcacagccaccccactgtggacatcctgtaacacagtggtacatttgttaccatcaataaacctactctgatacatcatcattatccaaaatacatagtttacactagcattcattcttggtggtgcagattctgtgggtttagacaaacgtatgacaattatccaccattttaatatcatacagaataggtttacgctctaagagtcctctgtggtctgcctattcatctctcctttccccctaatctttgacagccactgatccttttactgtttctatagtttttacttttccaaaatgtcatataattgaaataatatactatgtagtcttttcagattggcttctttcacttggtaatgggcatttaaatttcctccatgtttcttcatggcttggtggctcattcatttgtgtttagtgatgaataatgttccctttctggatgtgctacagtttatctgttcatctactgaagaacatcctgattacttcctagtttggcagttatgaataaagcagttataaatatcaatgtataggtttctgagtgcatatatatttcaattaatttggtaaaaatcaataagtgcaattcctaaaccttatcgtaagagtatatttagttttttaagaaattgccaaattgtcttccaaagtggcagtgccattttgtatttacaccagcattgaataagaggtcctgttattccatatcctcatcaacattttgtgttgtaggcgttttggatttggccactctattaagtgtgtagtagtatctcattgttgtttcaatttgcaatgccctaatgacataatattgaacatcatgtcatatgcttacttgccatctctagatcctcttttatgagttatctcctcaggtcttttgcccatctttaaaatcaggttatttgatttcttattgttgagttttaagagttatttatatattttggataagtcctttaccagatacatctgcaaatattttctcctggtatatgacttggcttctcattttcttgttgtgaagtcttaagctatattcttcataatttcatttattttttccagagaccatagtaaataatatagttctttttcattttattgattcttcttttgtagctttgactacagtcaatttttgtgaatgtttcatgggtgcttgaaaatatcttttgctttgaacaggaatgtaaaggatagcataggctctgaaattcagaataactgattataaaactattttgccttttcttttgagcaaccttgggaaacttactcaaacattttgtgcttagattttccacatgaaaaatgtagataacaataaaacactccatcagttattttttattattatttcaaaagctttttgggaaacaggtggtgtttggttacatgaataacttatttagtggtgatttctaagatttgaactgataattaaatgaattaatgtatgttaggtacttacccagtgcctgagaaaaagtgttagatacttacaattattatttgttagtttgaagtaattgtgaaattcattacatttctataccttttatgttttttctactggactatcagtttctgataatgatatattaaatgcccttaataattatagattagttgttctatttatattaatatagtctgaccctatattattagatgtatatcaagctgaaaatattatattaatcaatttttattttactaggatataacatgtcacattgtcaagacacttggatagtttttgcttgttttcttttgcattaaataattatttgattagaaaattaacatctagaatttctttttatttatgatcccattcctttttgttgttgttgatttaagcctccttctgatttaaatgttgcttatgttcacaacattaatcttattttttccagttagaaaatctgtaattgtaattggtttaaccatttacatttattgtagtaactaatatattaggatagtttctgccatcttattatctatttattcacatttcttgtcttccatttgacattttacatttacttctgctaatttaaagagttacataatccattcatattcttttaattattacccctaatataataggacaggtatttatttgtatcttttcacttattccttatgtttatcaataactttaatttctccttgcataaaaattgtagtttcacatacttatctgccctattctccttttttctgtacctatacttctgcttttaacatgttattttttcctagaattatttttaccttttatctttcatcatttgtgttagataacaacatcaacaagaaactactaactaaattatatattagtaagagaactcaatttgggcatgtcataaaagaaacatgaaatgaaaaattaaaacatgagaatttcccacttttatgtagccaagtaaacccattacttacatatattcaaaataaataataactggttcttaagtaagcacaattgacagcatcacttatcatacacagttcatcttagatttacctgggttgtccatttgtgttagttaattggctttagacaaaggaaaaataaaacttactaatgataaaagattgtattgcgacttagaacaaggtgtccaccaaagttaggctcctgtcctcccacagaaactggtatacaggagtgctaactcctttgatgtttacagttcaaggagaggactgccagggctttgaggaaagcattcctggaacatgaagttgacaaaaggactacctagttttaaaaagatttcttattaaagagaggagaaagtacttacaagtttcctaaagtaaatactctgagaaaagggaaggacaactctcttcctttgttttatcaggaagaattaagcctctcatttttaattattatttatccttacaatacatagtgtagagcatgctcatttcatcctatattaagtgaaaaaaatttgaaaattaatgaaattaaatcaaacatattcttggcatataataataatatcatcaacaacaagaagcagcagcagcatttcttgttttccaagcctcaggtattttaactcatttaatcacaccacaatcctatgaagtactccattaccaccccctggtggagttgatgaagttgaagcactaaaagacctcttctaactgcagcaggtctcatttgccaattattcatcattaagccatccttaattattgccatcacagacctaatgtgaatctgtttcatcattgttaaagaatgaaataatttctcagttttatttttcttttttgtttgtggtaaaatgaatatagaaaacatatctactcttgtttttcactgacacacaagtgctccaaacagtgcctgacttgtagtaggagtttaataagtatttgagaaatgaatgagatgacttaatgtagtcttaacatatattcaaattgcagaccgtcattggccatgcttttaaaatcaaaatatatttatagcctgcattttcatttaggtgttctgaaataaattataatattttgaattaatatgctattgaattccactaaaaaaaattttacttttaaatctttgtttgtgggaaacttgtataagaaagatttgcagccaggcacggtggctcacgcctgtaatcccagcactttgggaggccgaggcgggcggatcacgaggtcaggagatcgagaccatcctggctaacatggtgaaaccccgtctctattaaaaatagaaaaaataagctgggcgtggtggcgggcgcctgtggtcccagctactcgggaggctgaggcaggagaatggagtgaacccgggaggcggagcttgcagtgagccaagatggtgccactgcagtccaacctgggagaaagagcgatactccatctcaaaaaaaaaaaaaagaaaaaaagaaagatttccatattttcaatggctatatgtgctgtagaaagggaaatttgagaaaatattagaaataaagtaaattattgaactgtggttcaatctgtgtatttttagaataaatgtgagaaatgtcagtgaagaaaatactgttaattttgatgaatttaaagcatggtaaatcactggcttgtggatatgtgttcctgtctggggtcttttggaaattatttgttttgagctaaaaaatgttaaaaggagcagtatctaaacttttactcataagcccggaacacaaaggctctggggaatcaatcaaacatgtttactcttaaaatattattaagattaatatgtgcgtaaaaaaacttttaataaagtttacaatttagaccagaacttgagaataattatatccagatgacttaaaagtcacagaaaaggttgctataacataaagttcagtagtttttctctagctccttagtggttaaatatggagacatgattatattaactattttcaaaagtttcttgaatccttgtcattggcggggtataatggagtttaataagtaccactaaattgcatgaacacattggatttatctcagagaggattcttatattcttttattactgtctactctgcatacataagtcctttttatttacttatcaatagaaattaaatcacattgaagtgttggattataaatgcacaggatcacaactgaaggactacatgtcacagaaaaattgtaagtatggtttcaagaaatatgaaagtacaacagacacaatactgtatggcagattactattaaacttttagcctaggatgatacatgatttatttttgggaaaagggtatacatttgagagtcaaaagaattgttgtatctaagtgaaactttattaactatgctgtaaaatgtggaagcaccaggtactaattgttttccctaatctgatttttttccacctattgaccattttccaaaaaattctaaaatttcctaagttgacagaatgaaatgaaagcataataggaggtataggacttatcccagacaagattagtcttatgttgcctacaaacaacatttgagtgtcttaattgttatgctggcctttaattcataagaaacagaaagcacttgtagatgaacaatattatagaaatttcattatatcatcacatatcacatatggttttattaaaataatactagataataattttattgtactttatcattgacatcattaaggataaattgcaaaactatcataatttttaaatttgacacatttttatttcaaaagtcagattcttatgtttcttattacctattttaatagttatttagccaatagaccattatgaatacaaccaaacaaaacatgactaaatatgaatatattttaaaatgctaacagtcaaaataattatggtgagaaggagtgttcacttgagtgataaaccaagtgaataaattactagcatgcccatctgatttttgacatttatttcctttgttcactttgtctttttacctctcaaattattttattctttaaaaaaattattttaagttcctgggtacatgtgcaggatgtacaggtttgctatatgggtaaacatgtgccatggtgatttgctgcacctatcaacccatcacctatgtattaagccctgcatgcattagctatttatcctgatgctctcccttcccctaccccactgacaggccccagtgtgtggtgttcccttccctgtgtccatgtgctctcatcgttcagcttctcccacttttaagtgagaacatacagtgtttggttttctgttcctcttgtttgctgaggataacgacttccagctctatccacatccctgcaaaggaaatgatctcattgctttttatggctgcatagtattcatggtgtatatgtaccacattttctttaatcagtctatcatctattgatgggcatttaggttgattccatgtctttgctaatgtgaatagtgctgcaatgaacatatgcgtgcatgtatctgtataatagaatgaattatattcctttgggtatatacccagtaatgggattgctaggtcaaatgatatttctggttctagttctttgaggaattaccacactatctttcaaaatggatgaactaatttacattcccactgacagtgtaaaaacattcctatttctccacagccttgccaacatttgttgtttcataactttttagtaatcaccattctgactgacatgagatgatatctcattctcgttttgatttgcagttatctaatgatcagtgatgctgagcttattttcatgtttgttggtgcatgaatgtgttcttttgagaagtgtctcttcatgtcctttgctcactttttaatggggttatttgttttgtttcttgtaaatttaagttctgtatagattctagatattagaactttgtcagatggatagattgcagaaagtttctcccattctgtgggttgtctgttcactctgatgatagttccttttgctgtgcagaagctctttaattagatcccatttgtcaatttttgcttttgttgcaattgcttttgatgtttttgtcatgaaatctttgcccatgcctatgtcctgaatggtattgcctagattttcttctagggttttatagctttgggttttacacttaagtctttaattcatcttgagttaatttttgtataaggtgtaaggaaggggtccagtttcagttttctgcatatggctagccagttttcctagcaccatttattaaatgggaattctttcctcattgtttgtttttgtcaggtttgtcaaagatcagatggttgtagatgtgccatcttattcctgagatctctgttctgttccattggtctatgtgtctgtttttgtaccagtaccatgttgttttggctaccgtagccttgtattctagtttgaagtcaggtagcatgatgactccagctttgtttttttgtttgtttgttttttgcttaggattgttttggctatatgggctattttttggttccatatgaaatttaaaggagtttttttttctaattatgtgaagaatgtcaatggcagtttgaaggaaatagcatttaatctataaattagccatttttatgatgttgattcttcctatccatgagcatggaatcttttcccatttgtttaaattcttattcttatcaactttagtggaaattaaaataggaataatgtgcttttcataacattaaaatattctttattgagaagtaattaacatatagtaaacttcattttttaaaattacaattaagttgttttcagtatgtgcatagagttgagcaaccattaccattgcctaatttataatatatcagtactcctttgctaatcctgttagcagtcggtctcccaaaccctggcgaatttactttctgtctcaatgaatttgcctattttggacgttcatgtatatgaaaacatagagtctgtagtttttgtgaccatcacttagcatattatttttatggttcattcatattgtagcatgtatcaatgcctcatttcttataattgataataaaaatcaattgtatggatataacattttatgtatcattactcagttgatgaaaatatgaattattttcactttttactattatgaacgaaacttttaattacatttatgtacacatttttgtgtggatatatgtcttcttatgtcttggctatatgacagtagaaatccatgatcacatggtaactttatatttaacattctgatgaactgccaagctgttttccaaggtgactgccacattttaaaatcccaacagcaacatatgaggatttcaatttctccacatcatatccaacatttgttgttgtctggtttctctagtttagccattctagtgggtgtgaagtggtatctcattgtgattttgattttcatttcttcaattcatgatgttggacatctttcatatgcttttgaccatttgcatatcttttatttatttatttatttattttttagacagagtatcgctctgttgccctggctggagtgcagtgacgcgatctcggctcactgcaagctctgcctctggggttcacgccattctcctgcctctacgtatcatttttgaggaatcatctattcacatcttttgcccatctttttaaattaggttgtctttttttttgttaagtggtgggtgtacttagtatattctgaatacacgtcctttacatatatataacttaattttttttctctcattctgaaggtagtcacactttcttgatgctgtccttagaagcaatttaaaaaaattttaataaacttcaatttattttcttcttttatcaaggatgcttttggtgtcttatctaagacatcaaatacttcaagattatgaaggcattcttttattgtgttttccaatttcatttttagcttattcattgctactgtatagagataaaattaattttgtatattcatcttgtatcccacaacatatctgagctggtttattagttctaataagctcttcatcaatttcttaggattttctatatatatatatatatatgaaattatgtcatctctcaataaagaaagttttactattttctttacatctgtgcctttttttttcttgcccaagttttctgtgtagaaactccagtatgatattggatagaagtgtctaggacagagatccttttttttttttttctgggtttttttttttttttttcctgatcttggaagaagaatttagtcttttaccattaagcatgttgttaactgggttttttcattgatcttcacatatgaaatttgaagaagttcctttcatttctaccttcttgagtacacccaatataaaaacatggtggcgcatttatccaatatcttatagcatctattgagatgatcatgtggtttacctcctttcatccattaatatggtattacatgaatggaattttgtattttagaaaatttttacatccctaagggaaatcccacctgttcctgatgtgtaattgtttctatatgctgctggatttgatttgctaatactttgatgaaggtgtttgcatctgaatccaataaaagttactggtctgtagtttttttttttttttcacatgaagtctttggtttaggtatcagtgaaatattgaccatatagaatcatttttgaaggatttattcctattctattttttgaaagagtttatgaaaaattgctattatttcttcttagaatatttcaatgaattcaccagtgaaggcttttcatgggagtttttactattattattatttaattcagtttcttcacttttttaggtctgtacagattttcttgttcttcattcggttttggtaatttgtatcttttggggagtttgtccattttagctatattacctaatattggtatatggtgattcataatatttccccttgatccctttgatcaattttatttctgtaagatttattgtcatgccccctttttcacttatgattttagtaatttgtgtgttctctctttctagtcattctagctaaaagttagtcaattttattaatcttttcaaaaaacaaatttcggatttgcttatttttactgttgcttttctctttctattttatttatttcctctgtagttttcattattttcttccttctgcttgctttgggtttagttttatgttcttttttttagcttctttatgtgaattgttatgtattgatgcaaatatattttcctctttaggatagacatttacagctgcagatatctctgtaaacactgtttcagctgtaacaaatccattttggttcattgtattttcatttagattaatctcaaactgcctcgcatataatctcttccaccaattggttatttataactgtgttatttaatttccacgcatttgtaaattcctcaatttttctcttattacattctaatttaactttgttctgcttgaagaatatattttgtatggctttaatcatttaaatttattgaggttcattttatggcctaacacatggtatattctggagaaccctttggaacttgaggataatatatctactattgctgagtggagtgttatatagatttctgttgaatgtagtttaaatgtagtgttcacatcttccatgtgttcaccttctgcctagttgttctatcctttattgaaagtgaaacctccagctatttctaataacattttctgtttttcccttaaattctttcagtttttttgtctaatattaacataatcattccagcttttttggttgtttctgttggtcaggattctctagagaaacataattaatagaatatagatgatagatatagatacagatgaagatatatagattttttttacataatttcaacttttattttagattcaagtggtacatgtgcagtttgttccattaggtacattgtgtgatgctgaagtttggggtacgattgatcctgtcaccgaggtactaagcatagtacccagttgttagtttttcaacccattgccccctctctccaccctcccatcccatatagccttgtgtctattgttgaatcttcttatgcccgtgagtacccattgtttagctcccacttataagtgaaaacatgcagtatttggttttctgttcctgcattatttcacttgggacaatggcccccagctgcatccatgttgctgcaaaggatacaattttgatttttgtggctatgtagtattccatggtgtatatgtgttacattttattttccaatccactgccgatgggcccttagctcgattccctatctttgctattgtgaatagtgttgtcataaacatatgagtgtaggtgtctttttggttgaatgatttattttattttgattgttgggttgagtggcagttctatttttagttctttgagaaatcttcaaattgctttccacggtggccgaactaacttaaattctcaccagtataaaggcattcatttttctccacagccttaccaacagctgttattttttgactttttaataataaccattctgactgacaaaagatggtgttttattgtggtttttatttgcattctctgatgacgagtgatgttgagaattttccacgtttgttggccatttgtatgtctactgttgagaagtgtctgtccatgtcatttgttcactttttaatagggtttgtttttacttattgatttctttaagttccttatagatctggatatcataccttttttggatacatcgtttgcaaatattttctcccattctataggttgtatactctgtactttttgctatgcaaaagctcttcagtttaattaggtcccacaggtcaatttttgtttttcttgtaaatgctttagaacaattgcttttgagcaacttattcatgatttgttttccaaggccaatttccagaatggtgtgttctaggttttcttctaggattttcatagtttgaggtcttatatttaagtctttaatccatcttaagctaatttttgtatatggcgataaaaaagggatccagcctctttcttctgcatatggttggtcagttactgcagcaatatttattgaatagggagcctttccactttgcttaattttttttttattttgttgaagcgcagttggtatgtgtggctttatttctagtttctctattctgtttcattggttgatgtctctgtttcagtactagtaccatgctgttttgttattgtagctttatagtatagtctaaagttgagtaatatgatgcctctggccttcttatttttcttagacttgccttggctattttggctcttttgttgttctatgtgaattttagaatagctcattctagttctgtgataaatgacattcatagcttgacaggaatagtgttgaataggtagattgctctgggtagtatggccattttaatgacaatgcttccaggccatagtaatgcaatattttttcccatttgtttgtgtcatgtataacagggggtccctaaaccctgggccatggactggtaccacacagcaggaggtgagcaagggaagattcatctgtttttacagccactacgcatcactcatattactgcctgagctccacctcctgtcagatcaatggtggcattagattcttttgggaacatgaaccctgttgtgaactgcacatgtgaggaatctaggttgcatgctccttatgagaatctaatgcctgatgatctgtcactgtctcctatcactcccagatgggacctcctagttgcaggaaaacaagctcaggactcccactgattctacattatggtgagttgtataattattttattatatattgcaaagtaatatataatagaaataaagtacacaataaatgtaatgcgcttgaatcatcccaaaactctccttccccagtggtctgtggaaaaattgtctgccgtgaaaccagtacctggtgtgaaaaaggttggggattactgatctataattacttttggcagtattttgtagttatccttgtagagatctgtgatggttaatattgagttaactatctgcgatggttcacacttttggtgatgttttgtagttctccttgtagagatctgtgatggttgatactgtcaacttgattggattgaaggacgcaatgtaccgtttttgggtgtgtctattagggtgttgccaaagaagattaacatttgaatcagcgcactgggagacacagacccaccctcaatctggatgggtaccatctaatcaactgccagtgtgattagaataaagcaggcagaagttggaaggacttgatttgctgagtcttccagccttcttctttctcccatcctggatgctttctatcctgggacatcagactccaagttcttcagcttttggactcttggacttacaccagtggtttgccaagggctctcaggcctttggccacagactgaaggctgcactgtcggcttccctacttttgaggttttgggactcggactgatccaccactggctttcttgccctcaacttgaagacagcctattgtgagcctttaccttgtgatcatatgagtcaattaacttgacaaacttaataaactcccttttatatatacatctatcctattagttctgtccctctagggaacactgactaatacaagatctttcacctccttgattagatgtattcctaggtattttatttttatggctattgtaaataggattgtattcttgattttgctcttagcttgaatgttattgatgtatagatatactacctatttttgtacattgattttatattctgaaactttactgaagttgtttatcaattccaggagccttttggtggagtctttgggagtgttctaggtatagaatcatatcttgaatgaagagagacagtttgacttcttcttttcttatttggataccttttattttttttatcttgcctgatttttctggcaaggatttccagtattgtgttaaataggagtggtgagagtgggcatccttgttttgttccagttctcaagggaaatgctaccagcttatgcccattaaatatactggctgtgcatttgtcacagatggctcttattattaatattttgaggtatgttctttcaatgcctagtttctttagggtttttatcatggagggattttggattttaatgagagctttttatgcatctatggagatgataatttttaattttagtttttaattctgcttatatggtgaatcacaattttttatttgcatcccaaccttatattccaggaatgaagccatgttatcatggtgaattaactttttgacatgctactggatttggtttgctagtatattgttgagaatttttacatctgtgttcagcagggatattagcctgtggttttccttttcccatgagtctttgccaggttttgatatcatagtgatgctggctttgtagaatgagttagggagaagcccctcctcatcagtttttttgaatagtttcagtaggatcagtaacagctcttatttggacttctggtagaattcagctgtgaatccatctggtccagggctttttttggttggtaggttttttatcactgattcagttttggaacatgatattggtgtattcagggtttcaatttctttctgattcaattttgtgagatagtgtgtttccaggaatttattcatttcctccagattttctagtttgtacacagagaagtgttcctaatagtctctgaagatcttttgtatttctgtgggattgtttgtaatgttaccatttttttttattgtgcttatttttatcttctctcccttttacttcaagtagctagcagtctatcaatgttgtttatcctctcaaatgataaatttttggtttcattgattctttttatggatttttgggtctcaatttcattcaattctgctctgatttcagttatttattttcttctgctggctttgtggttagtttgttcttgtttttccatttcctctatacgtgttgttagattgttaatttgagatctttttgactttttaattaggcatttagtgctataaactttcctgtcaacactacttttgctgcatcccctagattttggtatgttgtatctctgttttcacttatttcaaataatttttttatttctgccttaattttattgttaacccaaaagtaattcagaagcaagttgtttaatttctatgtacttgtgtggttttgggaaattttctgggtattgatttctattttaattccgctgcaatcccagaatatggttggtatgattttgattttttgctttattgagacttgctctatggttatgtatgtggttgatgttggagtatgttctatgtgcagatgagaagaatgaatattctgtgattgatatgagaagtattctatagatgtctgttaggttgatcaagtggcatatttaagtgcataatttctttgttagtttcttgccttgatgatctgtctaatgctgtcagtggggtttttaattccccgattattgttgtccaggtaagcctttttatacatctaggagtatttgttttatgaatctgggttcaaaaatagatttttatttggattagcttatgtgattatggagactgacaagttccacaatgtgcagggtgagtcagcaagctaggcaccatggagcaccaatggtttagttccagtcaaagtctgaaaacctgagaaccatgagagctgatggcatagttccagtctgaaagacagcaggctcacaatacaggacgacaaagtctctcagttaaaaggcaattaagcaggaagaattctcttttaagcagaggagaaatatcctttttattttttgtttttcaggttttcaacttaatagttggatgatgcctgcctacattaggaagaacaaactgcttaacttattctactgatttacaggttaagcttatcaaaaaacaccctcacaaaaacacccggaatgatgttttaccacatattgagtactatgtgacccagttacattgtcaaatatatttaactatcacatatggtattatggtattatttttcaccctattattttaaaactgtttgtatctttgaatctaagggggatttcttatagttaacatatagttggattttgcttttttttcttgtaacttttatcttaggctcaggggtacatgtgcaggtttgttaatataggtaaagtcaagtcatgggggattggtgtacagactgtctcatcacgcaggtatgaggcatagtaccttgtaggtattttttctgatcctttctcacctcctaacctccatcctcaagtagatcccagtgtctgtcatttccttctaagtgtccatgtgttcttgttatttagctcccacttataaggacaacaggcagtatttggttctgttcctgcattagtttacttaagataatggcttccacctccatccatgttgctgcaaagtacataatcttgttctttttatggctgcataatattccatggtgtatatataccacattttctttatctagtctaccactgatggtcatttaggttgattccatgtctttgctattgtgaacatgctgcagtaaatatatacacacatgtgtctttttggtagaatgatgatattcttttggatatatacccactaatgggattgttgggttgaagggtaattctctttttagttctttgaggaatcaccacattgccttccatgctggttgaactaatttactctcctaccagcagtgataagcattcctttttctctgcaatcttgccagcatctcttttttttttttttttttgacttcttaataatagccattctaactcatttgagaaggtatctcattgtcgttttattgcatttctcaaatgattagtgatgttgagcattttttttacatgcttgttggcttcatgtatgtcttcttttaaaaagtgtcgttcaagtatttgtcccactttttaatggggttgtatgttttttgcttgtaaatttatatatattccatatagattctggctattatatgtagttagaagcatagtttgtaaatattttttccctttctgtaagttgtctgtttactcagttgacagtttcttttgctgtgcagaagctcttaagtttaattagatctcatttgtcaatttttgcctttgttgcaattgcttttggcatctttgtcatgaaatcattgccagtttctatatccagatggtatttcctaggttattttccagagtttttataggtttaggttttacattcaagttcttaattcatcttgagttgatttttgtatacggttcaaggaggcatctggtttcaatcttctgcatatggctagacagctatcccagcaccatttattgaataggaatacctttctccattgcttgtttttgtcagttttgtcaaagattagatggttgtaagtgtgcagccttatttcagggtttttgattctgttccattggtctatatgtctgttttttgtattggtactatactgttttggttactgtagccttgtagtatattttgaagtgagctagtattatgcttccagctttgttctttttgcttaggacgtcttgtttcttcgggttctttttcttccaaatgaattttaaaatagttttttctagttctgtgaagaatgccattggtagtttgataagtgtagcattgaatctgtaaattttggggagaagtatggccattttacaatattgattcttcctatttatgagcatggagtgttttcccatttgtttgtgtcatctctgatttctcggaagagtattttgtaattctcattgcagagatttttcatttccctatgtagctgtattcctaggtattctttttgtggcagttataaatggcattgccctccttgtttggctcttggcttgcaggttgttgatatattggaatggtactgatttttgtacattgatttcttatcctgaaactttgctgaagttgtttatcagttcaaggaacttttggtcagacaatatggagtttcaagttatagaatcctgttgttgaaaaatgagatagtttgacttcttcttttcctatttggatgccttttatttctttttcttgcctgattgctctggctagaaattccataccatgtttataggagtagtgagagagggcatctttgtgttgtgcaagttttcaaaaagaatgcttccagctattgccccttccatatgatgttgggtgggggttttaaaagataactctttattttaaagtatgttccttcaatgcctagtcatttgagagtttttaacatgaaggatgttgaattttattgaaaactttttctgcatctatttagataatcatgtgtattttgtctttagtcagtttggttcatttgtacactcagctgttttgtctatcagctcctgtattgttttcttataatccacaacttctttggattgtgtttcaatattcacctgaatctcgatgatcttcattcctgtccatattcttaattctacgtctgtcatttcaggaacctcagcccatttaagaatcatttctgggaaactagtgcattcatttggaagaaagaatatactctgccatttgagttaccagagttcttacgctggttctttcagttctttctcgtgtgtgtgtgtgtgtgtgtgtgtgtgtgtgtgtgtgtgtttaactttgatataaattgagtacagtcagtaaacttatattctggatgttttcagagggctgatgctttgtgcaagacctttatttgtagctgaatttttgcttttggtttcacagggggggtatgatagcaaaacatttttgatgttgaagtttgggatgtgaactagtaggtggtgcttaagcataatgatcagtaggtagtctcttcctcagtcatgtagctcctctgtatttcctcatgtttgcagccatgctccctctgagggctctgaaattgtggactcctctttctcttgagtgctggctgcagatcttggcttggcactcccgggctgcatgcagcagctctggggtgatcttagtctttatgtttcctccccagcttggtagcagcaaaggaagcgaccttagcagtggttgtgttcaagagattttcacttgtctcttggggctctaccccagagatatgtggagcggcaatcaattagtgctattggctcatgatggagcagccgctctgtgggcccaagctggggaggaggtgtctggttatgagcagggggtttgggtgggacccatgggagacagattggccttctctccttagggcaactgcagctttctggaggtgtggataaatactcagtattttcactccttctatagtccaagggaagctagggaagtaccactgcaaaggtgtttttggttgccctggtagctccacctccaagaaacgtggagctgctcctactgagactgttcagccagagggtggggcagctgtactgctagcctgagctagtgggtctgtttgttgggtgttggggcatcaagggctcacatggaggagagactgggctcctctctatatagtggctattatgtgctgtaagttcaggtgaagacctcagactctttgttatttccttagaccaagagaaacaggagcagaaccatttctgtggcagtggcagaagggttgtcacttgcctttgagagactcttcccagggaaactgagagccaccaccagtgggtatgctcagccatgggttgggcaactattctgtggtcctgaaccaggggcccagattggtgaagagtgggggttaggctttcccagggaagatggactggactctgatccatgcagtggctgcagtgtgtgggaggttccagcgtattgactaggtcctttattctttccctagcctgatggtagttagagtggtaccactgcatctgcaatggcaaaggggttgtgggttgagtgggattttctccttggagaaatgctgagccacttctgaagtatccaggtgggggcagggtagatgtgctggagacctaggtcaggaggctgcgcccaatgaggagatgtaaggacagggacctgtatggagaacagtcctgccacttttccatagggcggccacactgtactgggggtccgctctagacagtagtcactcgggactcttcagagcctgtaggcagcaaaggtgagggcttcaaaacagcaaagatggcagcccaccccaccctctggaaactccagtccgggaggtacagagctgctactgtcctgagagccccagtgagggttggctggtgtcccagaccagtgggtattatcctgcgaggtgcagtggaatcaagtcatgcagacaatcactgctcaggttcctggatctagcccccttcctcggggcctatagggagcctaggcaccccttttgctggagctgcagccatgtgtgcctgagcagtggctctgcccagactctatatagctctgcatgtcagtctgaaggccttggtggagtggactcacaaggggatctcctgatcccagggttgcaaagatctattgaagaaatgtgggtccttggcatctcccactcactcactatttccctatggagggggtgtctcccctggctctgtgccactcctgggtgtgtggttgtcctgtcttgctcctccctgtcttccatgggttgagttgtcaagttgtttccttgatgaatcccaatatgttcgcctggatgtttcagttgaagatttagaatttacttgccacctccttttctgtctctgaaaacaatgtgtactagttccctctagtcagccatcttgtcccttcccccaatttgtttttttagaatcattatgccagtatctgcctcttgattaaagtattttgtcaatttacatttaaagtacttattgataaggtgagatttatttctgccatttactattgttttctacgtgttttatgtcttttctgttccttgtgttcatccattactaccttattctgtgataaatacatattgtctggtgcactgtactaatttatttcctttgtttattttaatatacatggatatatgtttttgagtttttttttcttagtggttgttctagggattacaattaatgtctttacttcaatctatcttctttagattaattccaaattaacttcaatagtatacaaaactgtttcttttttttttttaatcagtgttgaccagattggccttgaacgtgtaggctcgcctccctgagtgccagggcaactggcctgagacactgtggctcccaaaactgtttcaatatagttttttccctaccctccttagtggtctttgttgtcataacaattacatctttatgtatcacaatctatcaacttggttttataataattgctttttgcaatgatcttttaacttacatatgaaaagaaaaggttttaagcaaaaacacattttttactgtgttttctatttacctgtgtagtttcctttacttttgctctttgtttcttcatatggattcaagttactgtctgatgtctgttttttcagcttaatgactccatttagtacttcttgtaagataggtctgctggcaacaaattcccttagtttccttttttctttttaatatgaaatatcctaatttgtacttttgtttttgctgtcctgttatttgtaagagtcctgtgtaacaattttatgaagttctgacaactgtgaattatcagttggaaaatactgctctaagttcattttatttttcatttattcatttttttattatactttaagttcgagggtacatgtgcacaatgtgcaggtttgttacataggtatacatgtgtcatgttggtttgctgcacccatcaactcgtcatttacattaggttatttcttctagctatccgtcccccagacccccgcccctgacaggccccggtgtgtgatgttccccgcaatgtgtccaggtgttctcattgttcacttcccacttatgagtgagaacatgcagtgtttggttttctgtccttgtgatagtttgctgagaatgatggtttacagcttcatgcatgtccctgcaaaggacatgaactcatcattttttatggctgcatagtattccatgttgtatatgtgccacattaatccagtctatcattgatggacatttgggttggtcccaaatctttgctattgtgaatagtgccgcaataaacatgcatgtgcatgtgtctttatagtagcatgatttataaccctttgagtatatacccagtaatgggatcactgggtcaaatggtatttctagttctagatccttgaggaaatggcacactgtcttccacaatggttgaactaatttacactcccaccaacagcgtaaaagtgttcctgtttctccaaatcctctccaccatctgttgtttcctgactttttaatgatcaccatgctaactggtgcaagatggtatctcattgtggttttgatttgcatttctctgatgaccagtgatgatgagcattctttcatgtgtctgttggctgcataaatgtcttcttttgagaaatgcctgttcatattctttgcccactttttgatggggttgtttgatattttcttgtaaatttgtttaagttctttgtagattctggatattagcccttcatcagatgggcagattgcaaaaattttctcccattctgtaggttgcctgttcactctgatggcagttccttttgccgtgcagaagctctttagtttaattagatctcatttgttaattttggcttttgttgccattgcttttggtgttttagacatgaagtccttgcccatgcctatgtcctgaatggtattgcctagattttcttctagggtttttatggttttaggtctaacattgaagtctttaatccatcttgaattaatttttgtataaggtgaaaggaagggatccagtttcagctttctacatatggctagcccgttttcccagcaccatttattatagggaatcctttcaccatttcttgtttttgacatgtttgtcaaagatcagatggttgtagatgtgtggtgttacttccgaggactctgttctgttccattggtctgtatatctgttttggtaccagtaccatgctgttttagttactgtagccttgtagtatagtttgaagtcaggtagcgtgatgcctcagctttgttctttttgcttaggattgtcttggctatgtgagctctattttggttccatatgaatgttagttttttctaattctgtgaagaaagtcattggtagcttgatggggatggcactgaatctataaattaccttgggcagtatggccattttcacgatattgattcttcctatccatgagcatggaatgttcttccatttgtttgtgtcctcttttatttcgttgagcagtggtttgcagttttccttgaagaagtccttcacataccttgtaagttggattcctaggtattttattctctttgtagcaattgtgaatgggaatgcactcatgatttggctctctgtttgtctgttattggtgtataggaatgcttgtcatttttgcacattgattttgtatcctgagactttgctgaagttgcttatcagcttaaggagattttgggctgagctgatggggttttctaaatatacaatcatgtcatctgcaaacagggacaatttgacttccttttttcctagttgaataccttttatttctttattttgtctgattgccctggccagaacttccaatactatgttgaataagagtggtgagagagggcatccctgtcttgtgccagttttcaaagggaatgcttccagtttttgcccattcagtatgatattggctgtgggtttgtcataaatagctcttattattttgagatatgttccatcaatatctagtttattgagagtttttagcatgaagggctgttgagttttgtcgaaggccttttcttcatctattgagataataatgtggttttgtcgtttagttctgtttatgtgatggattatgtttattgatttgcatatgttgaaccagccttgcatcccagaaatgaagctgacttgatcatggtggataagctttttgatgtgctgctgtatttggtttgccagtattttattgaggattttcgcattgatgttcatcagggatattggtctaaaattctcttttattgttgtgtctctgccaggctttggtatcaggatgatgttggcctcataaaatgagttagggaggattccctctttttctgttgactggcatagtttcagaaggaatggtaccagctcctctttgtacctctggtagaattcggctgggaatccatctggttctggacttctttttgttggtaggctattaattattgcctcgatttcagagcctgttattggtctattcaaggatgcaacttcttcctggtttagtcttgggagggtatatgtgtccaggaatttatccttttcttttagattttctagtttatttgcgtagaggtgtttctggtattctctgatggtagtttgtatgtctgtgggatcgatggtgatatcccctttattatttttattgcgtccatttgattcttctctcttttcttctttattagtcttgctagcagtctatcaattttgttcatctttacaaaaaaccagctcctggtttcattgatttttgaagggttttgttgtgtctctatgtccttcagttctgctctgatcttagttacttcttgccttctgctagcctttgaatttgtttgtgttttccatgttagaatgacaaaatcacctatataaagtcactgccatattgaacaacaacaaatctaacattggaggaatgcctatgttttacaaactgccttttcattactctatttcatctttaagaacacccatgtgaagaaacaggacatgtgaaataactttccctgtcatccacttggtaatttgtttaaattgagtttcacctcaaggtcatatgtctcttaaattgtgaaatgtttccactacgttgaaggatatcactttagaaattttaagtatttctgtgaaggcccttcattttgtgacattgttaacaacagaggttataacatctctttttttgaaggagtatttgaagtcactatgctcattttgtttttatgaatgctgtaagttagtcataagtaaaaataagtgaagctatttcagttcttttgaataaaaaggaaagcagatttttcagttcagaaggataaagacacaagtctgctcaatgagatgtagttacaagatgctctggcttactcctagcatgtactgaacatctatttgtaacatacttggagatttctccactggtttttgtgagtaaaaacctggtggttatctcaatttgatattaattgctagtaatttgcttgtaataacctaatggtcgtgcctactggaggaagataacaaaagagaatgagagaagggaaccttgcagtagtagctcttagattctatgaatgaagaaatcctaaggggaaaccgtagttatttacaacaattagccaagagtgattacaccgcagaaaacaagtatcccacttgtattccatcactaactaaaaggcaagaaaaaatattaaggtaatgcagagtcttaaacaaagggcatggttatattgtcttcgtaataagaataacaaagagatctgttcttatcacataggacatagtatttccagggctcttctgcagattggggaggataaagtgtttcttgacagaatacataaattattttcattaggaaatcaggcagcttaagactccattaaggcagaaaaaaataagtgcagaacctggagagtggatcaaaagagaaagaaggaatggggaattttaaaaatggtctgtgctagagatctctaactaatacgagaatctccacagtgagggagattctagggctggtggagaagttccaggtttaagatagttgaggctaattgaaatataataagaaatatacaggagagtatataaatatgacaaaggaagtctaagaggggaggcagtatatttttggagatacaagaaaggcttctcttacaaaaggagaggtcaagaaatgtgggttggaattgctggaaggaagatccttaagattgattatgtgattgtctgcaatatgaagacaatggtatgtagactagatgtagacattaaggaggtcaagtgttttctaagattattttttgggctgacagactttctatacctgatgtctgattgatgtctacactggtattaattcactctgattatgaaccgtataaaggaaattgtaatccactgtgattataaactatgtatgggaaattgttttataatggagagagtgtacactatgtctcagtatataatcatctacttttcctctcacgctttaagctagtcatatcacttattatcagcctcctgctcacccctcagataccccctcctgtcattagtgtcagaccttcacatcatatttgtctccatctgtctcagaactcttttctcttactccaagtacactctaccctcttacctatgcttcttcttatttgtctcatatacgtagcctcaacctatggactttgatactgtaaaccaacactaaattctaagccccaccctgccaaccacctaagtggaattcctcctcagctagggatattttaaaatttaacccaagagactgtttcaggccacaaggggaagtgggggtcagacatgtctcattatacttctctggccatcacataacaaataaataaatcaaaatattttaatcccaaatatatttacttttcctatcttgaaatagccctgcaaagtttgttctttgggaaaaatccacattctgtagagaatctccttttccctttttcttctttccaaatccaggagataatcaactaagagacaggcacccttttaagtcccataagaaaatattttacaacatgttctctctgaagcctgctagctaaaagcttcctctacacaataaaactttggtctccatgatcctttatcttaactcaaacattcctttctgtggattccagatctttggataaactcaaccaattgtcaaccagaaaatattttaaatctacctacaagctggaagccccctacttcaagtcattctgcctttctggaccaaaccagtatttttcttaaatgtatttgattaaagtcttatgcctcccgaaaacaaactgcaccctgaccaccctggggacatgttctcaggacctcctgagggctgtgtcatgggccatgaataaatctctggctcagaataaatatttggctcagaataaatctctttaaatatattacagagtttgactctgtttgttggcaataatatccacccttttcttcagatcatatactctattatttacttatttcttgagatggagtttgctcctattgcccaggctggagtgcaatgatgcgatcttggctcactgcaacctctgcctcctcggttcaagcgattctcctgccaagtagctgggattacaggtgcccgccaccacgcccagctaattttttgtatttttagagacagggtttcaccatgttggccagggtgatctcgaactcctgatgtcaggtgatccacctgccttcgcctcccaaagtgctgagattataggcgtgggccactgtgcctggcccagatcatatactctcttgaataggagttgtcctattctcatttcaacttcaggaaaactctcctttgatgcagtcattaggccagctctgagactggccagccccaaccttaatctcatcaaaagaagtaatgacaatggacacaatagaattaaataaagtaaagtataataagaacacagaagaaggaagcaatgtgttaatgcatgagctaatctttatgagtagaacattaacagatctttaaagagaaaatgatattttgggaagatggatttattttaataaagtcatctgggtcttgaagtgcatagcattttaagaacaatgagtcatctattgtaagggaaatatattgaacatgtgccaaagaacttgctctgagattaagttgaaaatacagattagtgtcagaatctgaagtgtcttgaatgctatgctaaaacaattttactttcactactgatagtagaagtctctaaaggtcactgagcatgaccaatatgatcacatctgtatttggatgaagcaattttgttaccaatgcacaatatagtatttgaaaagaaagagatcaataaaggctattgtgatagccaaataagaaatgaaagtatcttgggcattaatgtggcaatagaaatagaaaggagaaaaaaatgggaatattttggaaatcaagtagaattaagatgttatttcagattatggagacagatataacagtgacataggtttctatattcaataaatggttcataccgtctactgtgatagaatattaaagaactggagatatgtcatttcaagtatgtttagtatgaggtatatatttagtatgaggtatatatttagtatgaggattagcatatataaatatctaaaggcaaatagaaattcaatactgcaggtaatacaagagggaagtcatctagcgctattgatacagacatgtaaatctagaaggatccttgcttccatagtacagaagcagcttattttacaagtgctaatatatgtattttgttttgttttgtttttgagacagtctcactttgtcacccaggctggagtgcagtgtcgcgatctcggctccctgcaacctccacttcccaggatcgaacgattctcatgcctcagccacctgagtagctggaattacaggcacaggctaccacttccagctaactttttttgtagtattattagtagagaaagggtttcaccatgttggccaggaaggtctcaaactcctgacctcaaggaatgcacttgccttggcctctcaaagtgctgggattacaggtgtgagccactgcgcccagcccaagtgctaatatatttgctatattttcatataatgtatttgcccatagtggttgccttgttaatgtctaaattatcaaccaataataattaagaaagtgatggtatataaagtgtcaaatgcagttttgttatttattctaacttctaacctcctataaacaaatgtattatcaacatacagctaataaccaacacacaaataaacagcatgttatttaaaaaggtaaatactttgacaaattcctttttccaaaaaaagagacatatttccaaaaacagagcaatgttgctatacatttcctcgggactacatgttaggttaaggtggttctgttgatgacagatatggcatacagatatatattttacatttctatatccagcacaataatgagcacatattagagacaatatgtttttgttgagtgaagaaactaaaataataaacattagatgtaaaagactagtcctttattgtgtagtaacccactccatgcttattgaatactcccttctgtgtaaagtctgctttttcttcagtgctgtttactttgctcaggatttagaagtttcccataaaaataatacaatgttaataaatacatcattcagagaaagttatgcagagtggaaatttatctgggtataaaatactacatacatcccaggacttctgggacacagagaaaaactgcatcagaattgaaggttttaattaatcgatcataataggagaaccaatccaaagtgcatttttttccaaaattctgaaacagaaatattgttactaattaaaatgtgaccaattttgtttctcaatgcttttgtttctcagtgctttgctaatatcacaggttttgatcaaatcattcccttgaatgacccccttggcagtgaattgtatttaatgacattggcatacccatagattaaattagtttcagatgtaagaaggaaaattctaaatgaatcctttcaatagcagtgaaattaaaatagactgcacttatctttttagtcagagaattatagaggggcatttatttatgtgtgtattttttgtttgcttgtttttaatattttgatttgtttctgtagccatgagggtaattttgtttactgcaagacccatgtagggcaagaaggaattctaaattaaatgttaattctaagttatcagttgtttttcaatcatattttgggagatttacattaaatggaaattaatttaattggtttgctttcacatgtttaaatgattgatttatgacttatcaaattttccttatactgtcttcaccttatttgttgtaacagcttgggaatcatgtaaaagccatgagaaaacgtggtcattatttattgtataaatactaggatgaaatcaagttgctttttctttttcctttttacatgtatctgagactaccttttatggcaagctacttaacagctcattagattgagtagctgcaggatagatctaagctattctcttcccttctcaggaagtctttgatttgttttgaccatctaaggaaagttaatagatttttgtctgtatatgttctctcctttatttcatctctgaaaaatgttctgatcattagcattgacagaacaagttgtagatattaactaaaatccacgtcagagggaagacacagggaatttatttactttctgaatgtatattacatattttccctgaagcaatttcatatcccaggagtatttcttctcattatgaactatatccatatgtgctgaacactgaaacttgtgcagatttttcagaaatggaaagcatctgaagaagcaaatgctttttaacaaatattattgaggtaccatacttgaatattattattcttactcaaaattaatcaatgaaacagtttatctctcaacggtaatgaagaaggaaaatgattaataagagggccttgagcctcaaaagaggcatgtgcttttattaaaaacatatattcaataatataaaaactagtgaatatgtgacaggatttgcctatcaataagttaatacattttaatttttaatatttagattacatttatatagtatatgaatgctataaacaatttatgaatattattggaaaataaattttagttttagcctaataactaatgcatgatttaagatcttacagataatttattaaagtcaattcccatctgttatattatcaaaaataacaaaacattaacaatgaataaatggaccaattgtatgtttcatgccagacaagttgtactgctctggcattaataaaaatattaaaaattatgtaaaaagtacattattcactttctacacaagctgattgttaaacattgaatcattacatattttgtctcatttctggactgttgacctatacaactatgtatttatgctgaaaaaaaaattctgttataaagaattgtatttttctttcttttttttttttttttgagacagagttttgctttggttgcccagggcggacagagtgcactggtgtgatctcggctaaccacaacctccgcctcccaggttcaagcgattctcctgtctcagtctcctgagtagctgggattacaggcatgcgccaccacacccagctaattttgtatttttagcagagacggggtttctccatgttgatcaggctggtctcaaactcctgacctcaggtgatccacctgcctcggcctcccaaagtgctagtattacaggcatgagccactgcacccggcaaaaattgtatatttctttaaaatcctttattcaataaaaatgtatacttatttattgaagatgtactaggtactttatgaggcccccaaaatattaaaaagatgactattttctatttaatgtatataggtagtaattagacaaagacattggcagaaataatttcaacattgtaagaggtatttaaaatttaagtaaattctgccttaatccaaagactgagcatgtatttcattatgtacattgtttaaaatttaataattggaggatttctccattcagaagatctatgtgattgtattcatcatataaaatgttaattttccttatgcctaaaatatgccaagcatgttataggaatatagtagttgaagtttttataaaccactggaagtggcctatcttgtagtatcagtgtggtgagttcttaattttatttgtctttggagtttaaagtttaagaaacaaagataataatgtaagaaaataccaaattacaacacaaacttactaaagcttagaaatgtaagtattcaatgaaaagggaaagtgtttaacttacagatagtaaattgttagttactccatgttttagtccattcctgctgctataacacaatgccttagactgggtaatttaaaagcagtagaattcattgctcacagttctggagactgggaagtccaagatcaaaacaattcaatgttgggaaaggacttgctctctgcttctaagatgacaccttcttgctgcattctcacatggcagaagagggtaatgagcccacacacctcttgcataaggacactaatcccagcaatgaaatatctgctctcataatctaatcacctctttaatgacccacctcttattactattgcatttggataactgttttgatttttaatagagataaggtctcactatattgcccaggctgatctcaaactcttgtgctcaagggaaatttctacctcggtctcccaatgtactggaattacaggtgtgagccactgctccaggcctacaaacaatgacatattatagccaatcagagtttcttgtcactatgctataattaatgtttttatgcagaatggagaatgtcaagacgaaaatgaataaaccaacttttcagttgcctattatgctgaaataaaaacttagggaatcaggtgaagatatcactggtcttcatattgaaggagagtttggatttttacctgtattggtagattataaaatgaaggcttaaactattgttttctgaccatctttaacaataaaattttaggtgcatttctaactagaaaaagacgcattataaatgataccatgtaaatggataattctgtaattctctaatggtttggaattattcatctagctataaatatagtctgagtagttactatatagagaccaaacttaattgattattatcccatctgcactatcattaggtaattattatacatacttaaactaactggaatattttctagattgagaataagtaagtaaagttagataaaaggcaaagtaatttgcagaacaaaaatatgtgtaatcagtagacatatttatggttagcatgtcttcaattaaaagttacactttcctactgggcgtggtcgctcatgtctgtaatcccagcactttgggaggcagaagcagaaggattgcctgggtaacatgatgaaacccattctctacaaaaaaatatgaaaattagatgggtgtggtggcatgcacctatagtcccccagctacccgagaggctgaggtgggaggatcacttgagtctgggaggaggaggttgcagtgagccaagatcacaccactgcactgcagcctggatgacagaatgaaaccctgtctcataaaaaaaaaaaaaagttatgctttccaagaggattaatcttactctatttttatagccatttgtggaggtatcccataaagaaatcattgctaaaataccaaagcataatctttgcagtgttgatttttcatcattcattcactgaagaagcattgttatctacctattacatgctgtacattaggcactaggaatacaaagattaatgcatttaaatatattattgtaaatgcacgggcaataagttattatttagattatttaatcaatgtacaacagaaacctgaataattctacctcactattttttcagagggattattttatatcattttatatacttatttcaacttttcacctaattttagtggcaaaaggttgaaaatatgattaatgtgtatgagttaaacaaatgtcttccgaccttacagttactagactctcaaactctacaatataaaacaagccataagttttcctatgattacagaatctcatatatattttggaaggagctttggaatgtgttttatccaacctcctgaaaaatgttggagtttcttctttatccttcccaaaggggaggggaatagggtatggaagttgattacggtagttgaaatatggataaaagaagagcaagagtgaatgagaataggtttagaagacaaatagctctttctctcaattttgcagaaggctggctatgattattggtataagccaggataagtcaaataatcaaatataaaaattgcagtgactttagaataaattgctggggacttaaatttgaaaaccccttttgtttgatttaatgcagttgagttctgtgtgtatatcaggaaaaatgaaaaaaaaaatcttaagcttctttgtaagctcattatttctacatttcccaatcgtaatttttaggtgactaaaataatgagtttaaacattattcattcacctggttctcaattatatcatggttgtttttactgtaacattgaaattttaaaggggttcttagtataagatatgtagcttctttctctgcttcttgcaggaatatgcctaaacaaaactgaaaaaaaattgcaaatagatatatgaatcattttccccttgagactctgcttcatataaagaatgcttctttcaagctactttcctattcaaaatcctctggcaactgtagattatctctaggattaagactaaatttgtgaggctaatattccattcaaggtagccacaatctatactccgtcacttttttataacttatttaaatttgaaataaattctcattagccactactattggcctatttatacctttttccaaattgccaggcacactctgtaatcagttatagtctcttaaatctgctatgtgcatttctgtctctatcattttgctcacattgattttgctaattaaattctttccgctctcttcctttccaacctaagttataatggttttaagtatgtatctaaatttaatgttcttggaatttttcaggcagactctgttgcacagtccttaaaaatcaagttctatcaatgagaaaccacactatgatgtttacttgctttctatcatgggcaattcatgaaaaatctttgtgctatgtatttagttatcataattggaaatactactagcaatatcacatgggtttgttgtgaagattaagtgaactaatatttggaaaatgtaaacattctataagtgttgctactgttgctgatattattgctattgttgctattattaagctatgtgacaacatgtttattgccttatataatttcttagctatattaattcaatttttatgtgtgattgacatatctctttaaattttaagctctttaagactgaataaaacatgtaggataatttctaaatatcctaattactttggacattttatagtaaaagttcaagaaaatgtgctcaatcaataagtgaaattatgaatgaaagactgaaataatgaatccttgtattcaacatccaacaatccaacattcttctattcccatttgtccatatagatcaatactattatcttaaatcacattttcttcagataaatttagccttttatagacattttgttttataaattttgttgattgttataaactctactacagataattttattttgtgttacatgtgtaagtataaattaagtgaacaataaatatttcataaaaatataaactagaggattttagcatcattattggataaattctcccaaatattaataactaatttataaccaaaacaatttgtatctgaaataagttattgtatgttacataggttgggtagaaattttatttttaataatgtaagctctgaatattgatttagccaatttatgacattaataaagtatgatatttggtgaaatttttattaatttaaccaaaaaaactttcagtaatattttgagagtttcctaccaagttatttgtactgggaagcaggtagtcatagaaccagatgtgctgaaagaactagggttattttggaaggtgagaatgatgaggtgaggagacggaataaaatctcacaaaatgaaaaataaaaaacaacaagaataaccaaatcttccactaggaggtattctcattctgctcaatgtcattattagcagttggatgtcttttgggaacatgtggttataagcattgcctcctgatttatgaaacgatttctgtttattcctatatatttatcagttttaaaatcagtaaataaaattttaagaataaacagaaatgtggaaacaaatatgaaaagaaacagtgaaaacatgtgatagtgcttgtcttctaagaagtgaatgttcaaaaggaaaattgagtcaacagacaagtgtttctcatttgaatccttgtaatgaagcttgaattttaacttaataagacataaacgtaatgactataaaagcaaaacatgggatgaagcaatgcttacagggtacttataaagtaagcaagaccacattaatctaaaagcatacttggcacctccttaaccttggcctttcccttttgtcctctcttctctttatcccttcaaaaaaccaatcctcccactcttccatattttagtcacaatttggaatattaactcataccaatgtaaatatatatttttccaggaatactctagttttcagaaggatcacagttttcaacataaaacgtttgtgaaatttaagttatcaactagcagaggatgtttaagatttcagtgtggaagaatgaacagttgtcagaataaatacttccatgagaaatgtatacctactcatgcataacacaaaactttaatatttgcctaagcaaactttatggcaacttttgaatacaagaaatatttattgacttccaataattttggaatgggtatacatattcataatttccagaagttcaatttgtatttagatcatgtttagctgccaaacattcaccagtacatgatagagagagagagataggcagacaaatataagaaacgcagagttggattctatctgtttgccactgtagatccagtctctacctttttctaccctgctttgctccctaggaatttgaattatattgactgataaatgaactcccttcccctccaacttctaattgatttccactaagaagaaagagggcaggagatttaaaggatcaaggagagtgactttggataatttattgctttggcacccagtctgagactcagcattctgtcacttccgtgaccaaaggtctcagttcctgtcatgtagctctgccctatcaacaaaatttgtcttgtcaccaactccagtaaccctctcgctcacttctcttcaaagaatattaaacaatccccactgttattagccttaggattcttcattatcccttatagttccctatgtttttttactatttgtaaatagtcctttttcatcctgtcttaaaaatatcttgctctgagccctagaactcctaagatttcaggattttgtcctggaatcttaagtacagtagatggagagacagttcttaatcactggaatccctgggattagtgggattttattttttattcctaattatgtctaccttttgtgatgtctccatttttaaatacatttatcttccatttgattactgcatatgttaataattgtagcactaaaaatggttaatagtcattatgtgtttattagcggtcaggcattatagtaaaaggctcgaacacattagtttacagcatccctgtgaaagaattactaaaattatcccctactaaagatgaagacattgagacttgcttaggtcaagtgactgttccaaagtcacacagctagtataataagtgagatttaaaccaaggcagcagggctccatgcttttaaccaccatacggtgttgtatagtacttcactatatacatttgaacctagacagaataaaattaattttaaaaaagtatttagcacattgtagttgcctgctatagatgccatttagacattaaaattttcatgtgaattgaattccagtgatagttacaaaaaagtgctttgacaattttttaaataggaaacagcatgttactcagtgataaagcacacaaaaatggtatgaaacttttaaaacctaaaggacctgacactttaaatgatcttttgtattggttcgagaagtcattaaagtcatatatatttagggaccatagcaaaactaaataacacatcagaattttgtacaaaattattttttgagtacttagtaatatgctatcatataaagtgtgataactttttctaaataatgacttaaaaaaatgaatcataaagctttacatcccatagcaatcaacaatatacctatatgggagtacagagtatatatattccatgtaaaaccacatgttttttttctttatattcatcctatcaaattaaaaaaatcaaaggcaaaattttgatgaactgatatctttcctcataaaataaaaacaggatgtgccctggttctatattctttaattttactttttgaatgcaagaatgagagaaagcattaaatcacaatactgttaggatgaattggttatattcagatagacactaattatgtttgactgttcttaaagggactgaacaaaatttgcatcagtaaaattaattcatacaaccactattcaatcatgcaggaaagataatagtctgaagtaaatgtttaaattttcttgtttactctaatgaaagaaattctttccttgtaaataacattcgtatgtatgaggaatgagcaaaaagatgaacttcatagatactccaaactaaataattttgttacttaactataatattaaaataattgaagaagggaaagcaaatgttcttctcagctttttggataattgaaaaaaagttaagctgcttttgaagttagactgcatctataagcttttcacatttgcaggcaccagttatgaataagtttgttctgaaacagttaaaaataaaagattttcttcatgaccaaaaaaataaaaaacagcattaataataataaaactcctcagcactggaagaagttggagaggctctctctcaggcttagaaaaaatgaggaagccatcaaaaattcaagaccacagacatagagaggtacacctgcttcaaacagcaggactgctgtgcctccattctccactttctccttctccctgccccaaacaatccctatacaaacataaattttagttaaatatatgtgtatatatgatatatattatatatacacatatatatatataatatctcagtgccatctgagttgtagattctatcattttttcctctgtggaactgttgtggagacaaattgagaagttagcaagtgcattattctggttctaagcaacagcaactttaatcagggaaggctgatgcaaaccctctaggaatagtatataaattgttagtgtagtctattctaatgcttaaacaacctttactgtattgacagtctcctactgctacactctccatagtgaagcctaagcccatttacccttgttctgtcagcccagctgaatgacagcagatcaattttctttctaaaggtccttccagtttagtttatatttgtagaattattttttctcacttttgccttctctagattgaatcatccaattgttttagttaactttgacattttcacttctttatctctagctgttaactctttatcttattcatattcttttttgtttgggtaacatgaataatcgagtccatgtgctatgcttttccttatatattgtgtgttctttaacttgtgtttgattaatagcttgtgttttcagattatcttcttatcaaaaccaagatctttctgaaatgctttaatactgatctttatccatgatatagttgttatttttcccttctgacgcttaaacttatctttgacttgttacctcacttaccaaattttctgaagttaatattcttcaatgttctagctaatgttttctaatatatactctcttttctgtagaagagtttttaagtgctgctattttactgggatttcaataaaatttatctcaaacatcctacatatggtaaagctcaataaatatttgctgaatttggtcatccatggtattgctagtggtttcctaaatcagcatgtggaaatagattttatgaatatgtcagacttctcaggaaattatgacagaattaaataatagtgtctgtagtatgttgccttctttctcagaaagatgtttgctgaattatatgaatcaattttaagctttattctttctgtaatcagtctatctatcaccacctacttctgtaccaccttctctttacttactacatctttaatttccaacttattcattctatcattagaggtttgattagtgcacagcttattgaatcattagagctgttacttagaatcctgatcatttaaggccattcacagattgacgatgtgcaaaattttaagtttactttgatgtgattcgataaaagaaaatgtctgggattgcttatctttaatctatgcatgatggaacataagtaagtctctaaaaattattttaataagagcttacaaatttctaggtgttttgtttcacatttttaaaaattgatatacttcaagagcttttttatgctcatagaaaattgaatgaaaactatgaagttcccatgtatcattggttcctctactagcacagccttccccactctctacatcccacatcacagtggtacatttgtagagtcaaacctacattgatgcatccttatcactcaaagttcatagtttacattagggttcgcacttggtcttgtatatcctactgtagattttaacaaatgtacagtgcaaagtattcaccactgtaatatcatgtagaattatttcaatgtcattaaaatcttctgtgctttgtgtactctttgcctattttaattgagttgttttcttattgtttaatgctaagagctctttttatgctttgaaaaacagccctttatcagatgcgtattgaatattttttccgaatgtgaggcttctcttttattctcttgatattgtcttttgcaaagcaaaagtttttaattttaatgaagactagtttatcaattatttcttttatagattgtgcctttagtgtatctaaaaagtccttgccatacccaatctaggttttcttctgttatcttcaagaggtttatagctttgtgttttacattgagatctctgatgcattttgagttgacttttgtgaaggatgtaagatctgtatctaaatttatttgtttttgcatgtggatgtccagttattccagcaccattccttgaaaagtctatttttggttcactgtattgcctttgcttcttttcaaaagatcagttgattatatttaagtggatctacttaggtgggctctcagttacacgccatttatcagtttgttctttccccaataccacactgtcttgattactatagcttcctagtaagtcttgaagttgaataatgtcagtcttccaactttgttcattttcaatattgaattggcttttctgtatatttcaccttactatataaattttataattgatttgtcaatattggcaaaatagcttactgttatttctattgagattgcattaaatctacagaacaagttgcggcaaagtgagttcttgaaagttttgagccttcctattctatgaaacatagaattagtctctacttatttagttcttcattgctatcattcactacagtttttcttttttaagtatacttttaaattctagggtacatgtgcacaacgtgcaggtttgttacatatgtatacatgtgccatgttggtgcgctgcacccattaactcgtcatttttattaggtatatctcctaatgctatccctctcccctccctgcacaccatgacaggcccaggtgtgtgatgttccccttcctgtgtccaagtgttctcatgttcaattcccacctatgagtgagaacatgcggtgtttggttttctgtccttgcaatagtttgctcagaatgatggtttccagcttcatccatgtccctacaaaggacatgaactcatccttttttatggctgcatagtattccatggtgtatatctgccacattttcttaatccagtctatcactgatggacatttgagttggttccaaatctttgctattgtgaatagtgccacaataaacatacgtgtgcatgtgtctttatagcagcatgatttataatcctttgggtatataccccgtgatgggatggttgggtcaaatggtatttctagttctagatccctgaggaatcgccacactgtcttccacaatggttgaactagtttacagtcccaccaacagtgtaaaagcattcctattgctccacaccctctccagcacctgttgtttcctgactttttaatgactgccattctaaatggtgtgagatgttatctcattgtggttttgatttgcatttctctgatggccagcgatgatgagcattttttcatgtgtctgttggctgcataaatgtcttcttttgagaagtgtctgttaatacgcttcatccaatttttgatggggttgtttgattttttcttgtaaatttgtttaagttctttgtagattctggatatgagccctttgccagatgggtagattgtaaaaattttctcccattctgtaggttgcctgttcactctgatggcagtttcttttgccgtgcagaagctctttagtttaattagatctcatttgttaattttggcttttgttaccattgcttttggtgttttagtcatgaagtccttgtccatgcctatgtcctgaatggtattgcctaggttttcttccagggtttttatggttttaggtctaatattgaagtctttaatccatcttgaattaatttttgtattaggtgtaaggaagggatccagtttcagctttctacatatggctagctcattttcccagcaccatttattaaataggagattctgttatgttgtgtgtttgttctcactggtttcaaagaacatctttatttctgccttcattttgttatgtacccagtagtcatttaagagcaggttgttcagtttccgtatagttgagtggttttgagtgagtttcttaatcttgagttctagcttcattgcactgtggtctgagagacagtttgttataatttctgttcttttacatttgctgaggagtgctttacttccaactatgtggtcaattttggaataagtgtgatgtggtgctgagaagaatgtgtattctgttgatttggggtggagagttctgtagatgtctatcaggcctgctttgtgcagagctgagttcaattcctggatatccttgttactttttttctctttgatctgtctaatgttgacagtgtggtgttaaagtctcccattattattgtgtgggagtctaagtctctttctaggtctctaagaacttgttttatgaatctgggtgctcctgtattggatgcatatatatttagcataactagctcttcttgttgaattgagccctttaccattatgtaatggccttctttgtctcttttgatctttgttggtttaaagtccattttatcagagactaggattgcaacccctgcctttttttgttttccatttgcttggtagatcttcctccatccccttattttgaacctatgtgtgtctctgcacatgagatgggtctcctgaatacagcacactgatgggtcttgactctttatccaattttccagtctgtgtcttttaattggagcatttatcccatttacatttaaggttaatattgttatgtgtgaatttgttcctgtcattatgatgttagctggttattttgcttgttagttgatgcagtttcttcctagcctcaatggtctttacaatttagcatgtttttgcagtggctggtaccggttgttcctttccatgtttagtgcttccttcaggagctcttgtaaggctggcctggtggtgacaaaatctctcagcatttgcttggctgtaaaggattttctttctctttcccttatgaagcttaatttggctggatatgaaatctgagttgaaaattcttttctttaagaatgttgaatattggcccccactctcttccggcttgtagagtttctacccagagatccactgttagcctgataggcttccttttgtgggtaacccgacctgtctctctggctgcccttaacattttttccttcatttcaactttggtgaatctgacaattatgtgtcttggagttgctcttctcgaggagtatctttgtggcgttctctgtatttcctgaatttgaatgttggcctaccttgcttggttggggaagttctcctggataatatccggcagattgttttccaacttggttccattctttccgtcactttcaggtatgccagtcagacctagatttggtcttttcacatagtcccatatttcttggaggctttgttggtttctttttactgtttttttctctaaacttctcttctcgctccatttcattcatttgatcttcaatcactgataccctttcttccacttgattgaattgactactgaagcttgtgcatgcgtcatgtagttctcgtgcaatggttttcagctccatcaggtcatttaaggtcttctctatgctgtttattctagttagccattcacctaatcttttttccagttttttagcttcttagcaatgggtccgaacatcctcctttagctcggagaagtttgttactaccaatcgtctgaagccttcttctctcaactcgtcaaagtcattctccatcctgctttgttctgttgctggcaaggaactgcgtccctttggaagagaagagatgctctgatttttagaattttcagcttttctgctctggtttctccctgtctttttggtttttatctacctttggtctttgatgatggtgatgtacagatggggttttggtgtggatgtcctttctgtttgttagttttccttctaacagtcagcaccctcagctgcaggtctgttggagtttgctggaggtccactccagaccctgtttgcctgggcatcaccagtggaggctgcagaacagcaaatattgtagaaaggcaagtgttgctgcctgattattcctctggaactttgtctcagaggggcaccctgctatgtgaggtgtcagtctgcccctactggggggtgcctcccagttaggctactcgggggtcagggacccacttgaggcagtctgtcagttctcagatatcaaagtctgtgctgggagaaccactactctcttcaaagctgtcagacagggacatttaagtctgcagaagtttctgctgcctttatttcagctatgccctgtccccagagttggagtctacagaggcaggcaggcctccttgagatgcggtgggctccatccagttcgagcttcctagccgctttctttacctactcaagcctcagcaatggtggataagcctcagcaatggtggatgcccctcccccagcctcactgccaccttacagttggatttcagactgctgtgctaacactgagggaggctccgtgagcttgggaccctccgagccatgtgtgggatataatctcctggtgtgccatttgctaagaccattggaaaagcacagtattagggtgggagtgtcccgattttccaggtaccatctgtcatggcttccctttgctagcaaagggaattccctgaccccttgcacttcctgggtgaggtgatgccccgccctgcttcggctcatggtctgtgtgctgcacccactgtccgacaagccccagtgagatgaaacaggtacctcagttggaaatgcagaaatcacccatcttctgtgtcgcttacactgggagctgtagactggaggtgttcctatttggccatcttggaacctccctccattcactacagttttgttttcttcccgtggattttgtatataaattggtagatatatatctaagtatctaatttttgtggatgctaatataaatagtaatgtgttcttaatttaaaattccactcattcattgcctgtttataaaaacaattgacttgtataataactttctatcttacaaccttgctatctttacatattagatccagaagggcttcttttgtttatttttttagatttactccgtagataatcatgttatctgtgaacaaaagcagttttgtttcttccctcctagtctatataactttcattttattttcttattttgttgcattagtaggacttctagtaaaatgttgaaaacagtggtggtgtggagattctaagcttgttctttatcttagaaagaaaacttaaagtttattaccattaagtatggttttagttgtaggttttattgtagatgttctttattaagttcaagaagttcccctattcctagtttgctgagtgttggtatcatgactgggtttttaatattgtcagatgttttttctgcatctattgatataattgtgtaatttttattcttttgcctgctggtatgattgattatctgaattgaatatgaaaagttgaacaaatctggcatgactgggttaaatcccacttaatatggtgtatatttttatatattgggtttgatttactaatagcttgttaaggaggtttgcattgatgtttatgagagatgtaggtctatagtttacttggactggatttgacagtagagtaatgctgaccttatatagagaatgagttaggaaccattccttctgcttccctgttctggaagaaattatagataattggtataatttctaccttagaagtttgatagaattagccagttaacccatgtctttttttggaattttatttattattgattctttaatagatttatgccttttcagattatctatttttgtatgaggtttgacaaattgtttttcaattaattgatccatttcatccaggttatcaaatatgtaggcacagaatttgcctaatatttctttattatcattgtaatgtttatgtgttctgtaattatgccacctcttctatttctaattttggtaatttgtgattctcccttttattctcagcctagctagagggttattaattttattgattttacataaaatcagctttttgtttcattgctctctattgatttcctgttttaaatttcattgatttgggctctaattttatttctttattctacctactttggatttaatttgcccttctttttctagtttcttgtggatatttacatgattgattttagatttttccttttttctaatatatgcattaaatgctataaatgtcctactaaacaatgttttctctgcatcccacaaattttgatgagtagtatttttgtttttatttagtccaaaatattttttaaatttctcttgagttttctttttttttttttttcacccatgtgctatttaggagtgtgttgtttaaattccaagtattttgggatttttaagctatccttctgttactaatttctagtttaattctagaacttagtctgggagtagacattgcatgatttatattatttttaatttgttaaggtgtgttttatggccccgaatatggcttgtcttggaaaatgctccatatgagctttagtgtatagattcaattacatgtaattgactggtgatgctactaagtttagtaatgtccttactaattttctacctgctggatttgcatatttctgttagacggatgttacaatcagctatgataatggattcatctattttgtcctgtagttctgtcaggttttgtttcacatattttgatgctttgttgttaggcacatacacgttaaggattgttacattttcttggagaattggcccctttatctttatgtagtgctccttttgtcctgaagtctgctgtatctgaaactacagccaacttcactttctcttgatcagtattggcatagtataccttcttccttctgtttacttttaatctacatgtgccttcatatttaaaatgggttcttacagacaacatgtagttgggtcttattttatgatccattctgacaatctgtcttataattgttatatttctacgattgaattttaaattgatgaatggtacagtcatactaatatgtatcatatttgtttctattttatatttgttgcttttatatttttttccaataatccacaatttttctgagttttttgtttttttgtttgttttttgagacagagtctggctctgttgcccaggctggagtgcagtggtgtgatctcggctcactgcaacctctgcctcctgggttctagcaattctcctgcctcagtctcccacgtagctgggattacaggcgcatgccaccatgcccagctaactttttgtatttttagtagagatggggtttcaccatgttgcccaggctggtttcaaactcccgagctcaggcaatccacctgccttggcctcctaaaatccaagtgctaagattacaggcgtgagccactgcgcctggcccttttatggttttgagtgttatatattgcactattttctctcctttcttagaatatcagtgatactttgttactatcttactggttgcgctaaagtttgcaatttacgtgtaaaactaagcaaaatccattttcaaataacaccatacaacttcacaggtaatgcaattaccttataataacaaaatattctttattcctccaaactgtcccttgtatcattgctgccattcattttatttatacacggtcatacatgcacataaattatacctattattttgaaggaatatatttctgttaagttaactaaaaatatgcaaaataagtttttattttacactcactttttccttctttaatgttctttctttacatagactcaagtttctagtctgtattgtttttcttctctttgggcaacttattttaacatttttttgctaggtaagtctaatggcaacaaattccttcaatttttttttttttgaaagtctttatttctccttcagttttgaagaataatttctcatggtatgtaattctaggtttgtgggtttttctctctcaatattttaaatattctattcaactctcttctatctggcatggtttctgtggagaaattggatgtgattcttttttctttgcttctctgtaggtaaagtgtctcccccacaccatccccctggcttcttttgtgacttcattattgattttctgaagtttaaatatgttatgcctaagcgtcattttctcaacaattatcctgcttggtattctctaagattcctggatatgtgatgtatattacattaattggggaaaattcttcatcattattccttaaaatattgcttctgtttttttctctcatgcttctccttctgatattcccattatgcatgttatatcttttgtatttatcccacagttcttggacattcttttctgtttgtttgtttttcagcctttttttctgtttgctttttaattttggaagttcttattctcctattcacatgctcagagattcttttcttagccatgtatagtctactaataagtccatcaaagtcattctttatgttatactgtttttggtctctagtagttcttttttattctttctttagaatttttatccctttttacattatcatctgtgcttgcatgttgtctactttttctaataaagatcttagcatattaatcatagttttatgaaattcattatttgtaattttaacatttctgccttatctgactctggttctgatgctcattcattctcttccagctgtgtttatttccttttagtgtgctttgtaatttttttgttgaaaggtggatatgatgtgctgagtaaaataaactgtggaaaacaggtctttcataatgcaattgtaaactgtggggagatgcgatgcattcaatcatactattattaagtcttagtcctttgggggccaggcaaggtggctcaagtgtgtaatcccagcactttaggaggcagaggcaagcggatcacttgacctcaggagttcgagaccagcttgggcaacatggcacaatcccgtctccactaaaaatacaaaaattagacggccgtgctggtgcgcctgtaatcccagctacttgggggactgaggcagaaggatcgcttgagcctgggaggtggaggttgcagtgagccaagattgcatcactgcacttcaacctgggcaacagagccagaccctgtctcaaaaaaataaatgagccttagtccttcggtgagccagtgtctacactgtgaacttcactgccgcttctcagttttgttttgtcattgctgctttttttttttccttcctgcattaagtgggacaacaagatagtatgtgttggagttggtatttctctttacccatgtggaagggtatagggaactgtcactgggtcttccctaacatgggaggctagcactggctacagttgggtattttccttcctccaggtatgtcaggctctgataaaacttttgcaggttaggctctgggaaaatagtttctcccaagggaaggacttgttaaaaacagaatgctctgaaatatttccaaactttcctttttccctcctcttgctggaagcaagatggaatgttttctggtatttattgtaaggacttcgtagggcttttgcaggtaaaacacaaaattgtggcaccgtatgtcactccacaccatgccccatgactggtcccctttggagcttttaactcaaggacttgtcctcagggggtctccagcaattcatcaattacagtttagattttcctattgcttcccatggaagtttctgctctgataagttgtggctctctgtatctgcctatctgtctttcaaatttggagaatgcgatttgtgctgtaacatgacttattattttatgaatctaagaagagttgttgatttgttcagcttttcgtttattgttagaatggagtggctatttctggttcagaaaacagaagttcgttttgtaatgttttaagaagagaattatatttaaaattgagagcttcttgggctatactatactatatcataccatatcttactcataattttgatttagtgcctggagcagaattggtgttaatgaatgcacaggggatgaaagaataactgaatgaaatgctaatatattattgatattagaattttgcaatattgttttcagtaataaattctctgaatatgcgcaaagcaaacttccatctccagttctatgattttacatagaagtgtccaaattcactgtttaaaacaaaactaacttgagcatttgaaactattattttaaataatattgaaagtttatgttcatgacttactttaagaacataaagtattttctgcttgatatagccagtagctccagatatactctacaataataaaaaagaaagagcagtcaaatataattcaaactactatatttctaggggcatgggcaggatttttgttacattattttacttatatactatatatttagggaagcaataagtaaaacaaaagcttatgtatatatttgaggtaaaaataatatactcttcaaatacctttatatatgcagatttttgaaaggcaatacttatgttattgtgttaattgcttaaaatatagttttgctatacagtgcctttatagattaaaggaaaatttctttaaatgtttacagtttatctcaataaaaacagtgagctatgaattactctgaaatgtaaagcttatgattctttgcttgataaaaaataatgagcatattaaacccaacacctaacctgctgcaaaacctcattgaagagccgtattcaatagctgtttgatatttctattagggttttattgtaggtaaagttgaaaaccactggatacagtccaatagagacttccaaagacccatgcagggattttattaacaccaatttatgacgaaagctgagcttgtataggctctaaatgttccttaaaatatttgtttctcttgagtagttcctgaagcagcaggcaaaaaacaaacacacacacacacacacacacacacacacacacacacacacacaatcagtcaaggccgaagcactcaagatggaggactttgcaatgtactaccaggaaattattcttttattaatttatatttccaaagaagagatcatttacacacaaaaggtcacttttttgcatgttttattgagattttgttcctgaaaatgaacttctttccttttagtgtgctgacaaacatcagaactgtcaaacatcaacatttgtaattataacttgagcttaaagtagaggcaaaagggaggggaaaaatgctgtggcagtttgaattttgacaaatttcaatgtagtaggaaattctgatattgaaatcaaaattagtattgtcttttcattttatggtatatagaagaaataagttcattttttaagataaaaatttgaatataatttttaatgtatgacataaaatctctaattcaagtatgtgctcagatggctaaactaccctcaaatttgcatagacaagagattttagcatgttacagcccaataacattttattcaatgatgctgagttagaatccaatgtgcttaagctgataaatgtaatgaataattagagaccctcaaatattcttattaatcaatctattatttaatttagcaagtatttccaaacataaattactttccaggcaccattctgaggcctgaggatacagaaaagaatgagacactgtcttgaaggaacttacattcttggggctagaaattaataatcaataaccaatcaagtaattaacaagatcattatacagagtcataatttgggttgatgtgataaagaatgagaggatgggtggtatgcttctttatatttagagctagaggtccctctaagacagtgtatttggacagtggccttatatatgacaaaaggaactacagtagttcattttatacactggaagatgtataagtggaatgctcaaaagagtggaagcaacaaggctgactgtggatttagcttgtcatgctaaaacagaagaaatgcaactgagttttgcatgttgattttatatcttgcaactttactgaatttcttttttaattctaacaattttcttggtggaggtcttaggattttctatatattagattctatcatctaaaaaaagataattttttcttccttttttatttggaggtctttaatttctttttcttgcttaattgctctacataggatgtccaatactatatcaaatagaactggcaagtgtggacatccttgtctttttgctgatcttagaggacaagatttcggattctcaccattgaatataacgttagctgtgatttgttttgtattatatataagacaggcctagtaagaggcctttattatgttgagagacgtatattctacacttaattttttgagtatttttatcatgaaaggatgttgaattttgtgaaatgcttttctgcatctattgagatgattatatgatttctattcttcattttgttaatgtgttagatcacattttttgacttgcagatgttgaacatccttgcatctcagtgatgaatcccacttgatcatagtgtatgatccttttcaatggcctgttaagctctacttgccagtattttattgaaggatttttgcatctatgttcatcaaggttattggcctataatttttattcttacaatgttcttgtctggctatggtatcagggtcattctggcctcataaaatgagtttgaaagcattccctcttctttaatattttaagaaagatagatattaattgtgttttaaatgtttggtagatttcagcaatgaatccatgaagtcctgggcttctcttcgtcgggagatattttactgattcaatctccttacttacgggaattttttttttgtcttcagtctccttacttattattagctttttcaagtttttgtatttctgcatgaattagctttggtaggttgcatttttctataaatttatccatttctactaaattattcaatttgttgttgctcaattacttatagtagcctcataatctttctaattctgcagtatcagttgtagagtcttcttctctttcatgtataattttattgatttatatatccactcttttttcttttagtctagctaaaggtttatcaattttttaaaaaaaaccaatatatttgatattttctattataattcttgtgtctcatatattctctaatcttcattattttttcttctaattttcagcttggttttttctttttacttaatgtgtatagcttattgtttacttgagatcttgcttattttcttaatgtaagcatttatcattataaacttccttcttagaaatgctttcactgccttctgtaagttttggtatattgtgctctcattttccttagtctcaagatacgtattgattttccttttgatttatcctctgacattgtttattcacaggcatgttgtttaatttccacacatttgtgaatttcccatttgtcttctattattgatttctaatttcatatcattgtggtcaaaaaagattctagatatggtctcaatattattaaacttgttaaagcttttcctgtggcctaatatatgatctatcctggagagtgctcactacaggcttgaaaagaatgtattttctgctgctgttgtatggaatgttctgtatgttcattataaccttttgatctaacaataaactgtcaaaaaagaagctaatgaaatgaccacatacacaatagcacaaaaaaatcttaagaacttggaataaatttaaccagaaagaggaaaatctgtacactgaacactgaaaaacattgataaacaaaatttaagaagatgtaaataaatggaaaaatatcctgtgttgaaggactacaagaaataataatgtaaaaatgtccatactacccaatgcagtctatagattcaatgcagtctctataaaaattccaatggtattttttattaaaatgcaaaaaaatcctaaatttatatagagctacaaaagacccagaatagccaaagaagagcaaagctgcaaagacatcacactactgattttagaatatatcctaaagctctctacagtcatcaaaaaagatggcagtgccataaaaacacatatagaacaatgaaacaaaatagagggctcaggattacatctatgcacttagtattatttgatatttgacaaaggtgccaagaacatacaatagggaaaaagacagtttcttcaataaatgttttggggagaactggatatttacttgcagaagaataaaattggacccttatctcatgccatatgtaaaaattgactcaaattggattaaaaactcaaatacaagatctgaaactctaaaattgctaaaagaaaatatatgaggaaagcttcttgccattggtctgcaaaatgattttttttcaatatgacccagagcacagccaacaaagagctatgccaatttgctggttgacctcaaattcactatttttctctttgtaaattggcccagactcacactaccaaattcagcttcttcaagtcacatttttctatgtgcattcatttctgtttattactgcagttcaaaaatattaatatcactgatcagctaggataagttactgtatagtttattttcttccattatatattgtatgacttgaactaaatatactgtgactagtatcaactaaatataccaaatatactaagactagtttaaagcccaatgcccggcacatagtaatcaatcaactagcagtactctgattagttgtattaattatggtcttatatactgtctaaagaggaatacagtgaggatatataatttatactaacattaatgttatccattttcaaagaaatgactaaatacatacactagatacaaaaacaaatctaacaaaagaatgaatatttggaacaagaacaaacttaaaagctaagacaaagccttatttgagaaaatttttattcataatgtacctgtgttatcaatctacctcaatttcatcttattttatgtttttacttttttgcaatgtatctttcttctttggagtacagtaaaataacattttgtacttacagagcatgtttcatcagaaaggtcaatgtgcttttcaaactcattaatccttacagcatccccaggggtgtgtaattgtacaggtaaagaaatagaaagctgagatgtataaacaattttatcctgtcacattgaaatgaaacggtcaaacccttaattactccattgtagatgcaaaaatagaagtttcaatggcattaatatgatgataaatactggtaaaagaaaaacttaaatgagttaagtaaatgaaacgtgccttagcacataacacatatgtgtttcattgaggaaaatgttgtatttgtagttattttaacgtaatatttttagaggaaatgaaggtcaggcccaagaaatgagtgaatgctaattttgactttgatctaatttgggacagctcattgacagttaaatactttagctttaaagttatgattactttcatttaaagtgaaatattacccaacttatctgtaaactgttaaaaaatttggtctattcaaaactgatggctctaaccttcttttttttaaagtggattattaataaacttaaagaacacagtggaaattctggcccaagcattcacaggcaatcagtaatagtagaataattttttaaatgatgagttaatgggtgcagcacacccacatggcacatgtatacatatgtaacaaacctgcacattgtgcatatgtactctaaaacttaaagtataattaaaaaaaacctttgaatgaaaaaaggcaaaaaaatgagtgttcaaaactatctagacagattataaattaataattactggatgaaatatgttatataaagagcaatcctgccgactccatgatcttagggtagttgtgggatgaatgggctttcctgtgagaatattttctaatatttcagcaactttcatttatttttagcagagaaaaatttacagacagtaggcacaaataatttatataattggtgtaaatgcattatattaaaagatattttaagaaaaattattgatttctttgaatgtaagaattatatgaaatgattagaatgtttttgtttttcttctgaccaatatgtcaaaacaacaaagtcacagccattttttagagaggccattttttagtttttggtgaatcttcttatacatattttcaacatttttataaatagttttctttatccctactggctctattaaatggcaagaaaataaatgttttctgtgacactttgcttaaaatatttagaataatgtagggaaaggaggttacactttgaaattctttcttgactcagagtgtaccacagaatgtatggagtgtacaactcttaagaatattgttcaaggatacatcagagctcctgcatgttgtgatctgtccttaggagctcttggtatccacgtatacaagtcaattatttgtttctgtaaaattgtaaaattccaggaatttgttattttatataatagctcctggaattgaataccttgtgctattgacttaaagttataagatagccctgaagagtcttggcaacatcatatttactcttattttttaaattcatttttaaaattcattcagaatttactgaatatcttctatgtggcaggcacctactgaacttgggaaggtaagataatctagactctgatcctactttcagagaattgatacataaataaataaacaatatttattaatgtagtaaatactatgataacaattagaacagagtaatattggagtatagatgaggaatgggattaattttggttagggatattagagaaacttactgaagaagagataattgagctatgttttaaaggttggatgagttcctaatggagtacaagaagataagggcattcatgaagaaaatatagtttttacaggagcccagagtgaaagtaatgtgttcaaggagttgcaagtaatatggtgaaaaggttttgtaaagatatattaaggttgcagtcattgacagttgttatattaatattttcctatagggaagtagtctccaaagtttttagatttcatatttgtatcaatgaagacattttgtaagcaaaatgtaagcatttacatatttatttatactaaatcatgttatactaggaccatgataaaaatacacaaaaaaagatattaatggggtaaattaaaatacaattaatagtactttaaatatttcttaaacattttatttaatgtatattacaaagaatttttactcttaatatggtattttaatatattaataattaccttttaataaaaaaaatatatttcattatttttgaagcctggtattgaaaagctatatttagttttttcttgtatttgattttaaaagttgtcttatccaaaggatatattctcttccaaaacttcattgatccaaaaaacaaaatatgtgtattattggttcccatgttatttccaggaattattccagccattttaaaaagcagatggagataaatgtacttcctcaacatagctagcgtattgttttttgataattattaagaaccatcaatgaatttagagtattttagcactgtatttaaatattgctgtaacaatgtgagttttttttgtttgtttataaatgtcttgctaattgtaatggttccatgttgttatttgctgatgtctgaaatcacaatacatactttgagtaaagttcacaatttgtattagtctgttttcacactactgataaaggcatacctgagactgggaagaaaaagaggtttaattggacttaccgttccacatggctggggaggactcagaattatggcaggaagtgaaagacatttcttacatggtggtggcaagagaaaaatgagaaagaagcaaagttggaaacccctgaaaaacccatcagattttgtgagacttattcactatacgagagtagcagggaaagactggcccccatggttcaattacatccccctgggtccctcccacaacacatgagaattctgggagatacaattcaagttgagatttgggtgaggacacagccaaaccatatcaccattaataatactggatgtaagtatttcaaatagcaatttctaattattttggtaatttctcatcagctatggggagattcttgttgatttcaaattatatatctacagaatggttcatggttcattctaggagcagaagtgtcaactccacattgcttcctttgctttcagtgtactactataagtttaccttacatatgtctagttaagtatgtgtcatctaatattaactaacaaagtttggatatggacctctgtcaactattctgtgctggaaatcccattttttttgagaatcctagagcatactacatagagttaaagtcagtgtgttaagcactaattttccaagttaaatttatttcttatttaaaataatataacaataatttaaaattctaatactttattctcatgctggtccactatgagcatcttcaagaattctccaaataaaatcaaagcgtgtataattggctccacaccttcagctgttctctaagttcattgtaatgtgtggtaaaacaaggtcacatattctgcaaggttattctattaagatgaaggaatatttttccccctgggatatttcagctctcctagcactgggcttgacacctgcactaaccaaaaggggtttactaatccatctggccattttttttgaatccaggggagtagggatgacaattctggattactttatatttatgaatttatatttttcataaaacatagaaacatgaaaatcaaactccagttattcccaagagatatcttaattgccttaagaaaatttgtgagtaaattattaaaataataatttccaattacaaagaggtatattattctcatccatgttgctttataagtcattattagaaaaattatatttattttttctaatgtaagttgtacatattttaaatagtatcatattgtaatatcttaaccattagtgatctaaataaaaatggtcttattctattactttatgttttggccagtgggtgtcattggtaaatgtaatgaaaaaaggaaaaactgaaaatttaaaagagtaggaaaaatataagaaatcaaattttgacaatattactttttgacaaggctttttattacatgtgtcatcaattgacagatgagtaggtaaactgattggataatgaataaatagataaatagatattgttttaaatgctagatacatatactctagtcactcaaggtaataaaatatgttgctttattgaaaaaaaagtcccattttcatcactgttaccaaggcaaaatcaattacataatgtggtagttagattgatgttgctaccatataatttccaattctttctcagtttacttgacagaacaacattatttagtttgtgcactattgttgaagcagttaaaaggaaacaaacacttttcagcaatgttatcaaatatatactttgtttttccttttgaagcttgattatttggcattgatattttgtctgaaacatagtgggtgattagtaattaaatgttgactaaatggattatcccattgatatatgaacatacagtaatattattcttatttaaaacaaaacaattttctccccatggatggaacatttgttcattaatagctggcaggctattaatttaactatatattttaaaaattcaaaagctttatgaggtcaagttgcaggtcaatttttatttcttgctgtatgctcaatcgtttaataacaaacacaatgtctggtaaagagcacccatcagtatatatttaccgaattaacaattgcttaacctcaaatagtaattgatttctttatggcaaattattcactcatatctagcctacttttcctgtgaatttgaccagagttttaagcttctcaagtgcttttcttttccagtagtttattatgctcagattacttcacgtgatacctaattataaagaacaacatattgttctttagaattaaagaaaaagtaacatcaagagtgttctatccagtagacatcatagatacagagctagtgcttacacatttccaaggacctgtacaaagatttaataactgaaagcaaactactgactccaaaacctgaaagtaaaactatatgaaaaacccaaacttgtactttaaatacatgtatttgtaaagctttaaaattccaagtcatctctctcctaacctataacaatagcctactattctcactccaacctggaatatcctctgtatatacagaagccaaaattgtgttctcaaagtgtcgtgtcttacccatcactcctctgcttaaaacttcttcctgtactgtaatatatctaaaatggaaaatggtccttaccatgaggctacataatgtgattcctgacaacttttctgaccttgttttatacagttttcattcacttccccctctgcaaatacacttgggtgtcatatttgattctgaagtcttttacaaatattgttagtttttcctggggttctctattctgagacctttatctgggctgcctctactcatgatttaagtttcaagtcaaaatttacttcctttgagaggatttttctcactagtcagtgagattatcccctgatccctcatgtagtcattctttagctcattatacttagtaattttatttacagcctttagcaatacatgatatatgtatttacgggtgattttcagtcccctttacatagaaatttaagccccatgaggggaaaatcttgatcttgttcacagttacatcaccaatggctagaatggtgcctggaatttagtaggaaatcaataaatgtttttatttctaaaaagcagacaaatcaaaaatggatttaaactcttgcataggatgaaagctgtttctgctgctgaatttttttttcagtttctttatagctgtcacatatctactcctaaaattctcaaaaggagcactcttatgaacatataattcttagatttcttctatgggtatatcatgggtaaaatttaactatacattaagtaaaattcttttcagggcaatatttatttttgtgtgattatatagctctacatcttattttatctgacctcataagagcagtttcatagtttattcaggacttggatgaactggatctcatatacataagggaaatggtgatttcagtgagaattgtactccactgatgatgtgtcagacatctagaaaatagggttaaggttaatgtaacttcaatcacattttaccaaagttattttcttttgtcaatcactgaaattcaaaatatcttgctattataacattttaagatattgaaaagttaagaaccactgttttcatgagacatattgaagtgttttttttcaaaattgtgaacttttatgtctttaaaattggattattgtaatgtcacccttaaaaattcttaaagcagaccttatataacttttttctgtagtctgtactaagtatctttatataactttttctatagtctgtactaagtatcattgttttcagaatattctccttcaagctgttgtgtgtgccttggatggaataagggtttatcttctttccatgttctacctcttgcaaacagagcagctgttgtcctgtgtaaacatgccaaatttaaattttaaatagatggaggcagcacaagacctactgattcagaacccttgttccagagtcaagaattgtagacccacttagactctatatgctgatggccaaaaagaaattgaatgaaagtgttcattgtttagcatagccattttcagagtaggatcttccatgcagagagttttagattgtacttatagtgatagctaataataaaattattttgaaatggcaaatacttctcattcaaaatgatattgtaacgtattttatttaaatagtttaaagaggaaatatttgatgtgaagacttttcaggaaatgaaataatgtcatcaacattattatgagacaaattacataaagacgtttgagagtctaacaagttgtagaacaggagtgagttttgaaaataagtttgctgaattgataatgttcatgccaaactcaatatatgtgcaattaaaaagtcataattttaaacctgagcaggccaataacaagtaaggaaattgaattagtaataaaaaatctcccatcaaagcaaagcagacatgatggctttatttttaagttctaccaaacatttatgccagtccttctcaaatggttccaaaataaagaaaagaaggaaatacttccaagctcattttacaaggccagcattaccctaatactaaagtcaggccgggacaccacaagaaaagaaaattacatgccaatatctctgataaaatagatgcaagtattctcaacaatatactaggtaactgaattcaatagcatatcaaaaaggatgattcaccatgatgaagtggaatttatccatgagatgcaaagatggttcaacatacacaaatcaataaatgtaatctaccccattaacagaatgaaggatgaaaatcatatgatcctttcaacagatgcagaaaaagcatttgaaaaaaagtcaacatcctttcatgatcaaaactctctgcaaattagatatagtgttccatatctacacacacagtgttccatatctacaacacaataaaggctatatgagaccatcccacagttaacataatactcagtggtgaaaagctgagagttttccctctaagattagagaaacaagacaagaatgcctactcttgtcacttctgttcaacatagtacttgacatcgtaaccagagcagttatataagaaaaagaaataaaagacatccaaatcagaagcaagtaaaattgtctctttcggcaaaggacatgctctcatacagagaaaattctaaagatttcaccaaaaacctgttggaactaataagcaaattcagtaggatgctggatgcaaaataagcatacaaagttagttctgttttttaaactttaaattttagatttggtgatacatatgaaggtttgtttcataggtaaacacgtgtcatgatagtttgttataaatataatttcatcactcaggtattaagcccagtacccagtagttatcttttctgctcctttccctactcccagcctcccccattaatagaccccagtgtctgttgttttctactctgtgtttataagttcttatcatttagctcccacttatgagtaagaagatgaggtatttggttttctgttcctgcattagtttgctaaggataattgtctccagcttcatccatgttactgcaaaagacagacataatctcgttcttttttttatgaagacatagtattccatggtgtatataggccacatttttttaatccgatctgtcattgatgggcatttaggttgattccatgtctttggtattgtgaatagtgccacaatgaacatacccgtacatgtgtcatcatagtagaatgatttatattcctctgggtatacacccagtaatgggattgctaggtcaaatggcagttctgctgttagctctttgaggaattaccatactgctttccacaatggttgaactaatttacactcccaccaacagtgtataagggttccttttctctgcaaccttgttggaatctgttctttcttgactttttcataattagcccttctaactggtgtgagatggtgtcttattgtggttttgatttgcatttctctaatcagtgctactgagcttttttttaatgttgttggccacatgtgtgccttctttagagaagtgtttgttcattttcccactttttaatgctattgtttctctcttgttaatttgtttaggttccttatcaatgctggatattagaccttcttcagaagcatagtttgcaaatattttctcccattctgttgtctgtttatgctgctgatagttttgtttgctgtgcagaagatcccacttgtcaatttttgctttttttgtgattatttttggtatgtttatcataaaatccttgcctgttcctgtgtccaggatggtattgctgtggttgtctttcagggtttttatcatcttgggttttaaatttaagtctttaatgcaccttgagttgtgtgtgtgtgtgtgtgtgtgtgtgtgtgtgtgtgtgtgtgtgtgtgtgtgtgatgtgaagaaggggtccagcttcaatcttctgcatatggctagccagttatctcagcaccatttattgaatagagagtcttttccccattgcttggttttgtcagctttgttgaagatcagatggttgccaatgtgcagccttatttctgggttctctgttctgctccactggtctatgtgtctggttttgtaccagtaccatgctgttttgtttactgtatccttgtagtgtagtttgaagtcaggtaacatgttgcctccagctttgttctttttgttcatgattgccttggctgttcaggctcttttatggttccatatgaaattaaaattattttttctagttttatgaagaatatcattgatagtttgataagaatagtattgaatctgtaaattgatttaggcagaaaagccattttaaagatattgattcttcctatttatgaccatgggattttttttccatttgtttgtatcttctctgatttctgtgagcagttttttattatttcattgtagagatctttcacctctttggttagctgtagtcctaggtgttttattctttttgtggcaattgtgaatgggattgcctttctgatatggctctcagtttggctgttattgaagtatcaaaatgctagtgaggctgtacattgattttgtatcctgcaaatttgctgaagttgtttatctgctggagcagctattgggctagggttttctagatatagaattatgttatctaaaacagagatagtttgacttcctgtcttcccatttggatgccctttattcctttttcttgcctgattgctctgtgtaggacttccaatactatgttgaataggagtggtgggagaaggcatgcttgtcttgtgcctgatttcaagggtaatgcttcttgcttttgcctgtccagtataatgctggctgtgggactgtcatagatagctcttattattttgagttatgttccttcaatacctagtttactgagagtttttgacatgaaggagtgttgaattttatcaaaggccttttctgtgtctattgagataatcatgtggtttttgtctttagttctgttgatgtgatgaatcacatttattgatttgcatatattgaaccaaccctgcattccagggatgaagccaacttgtgcatggtggattggctttttgatgtgctgctggatttgatttgcaagtattttgataaggattttgcattgatgttgatccaggatattggactaagttttctttctttgttttgtctctgccaggttttggtatcaagatgatgctggcctcatagaatgagttggggaggagcccctcctcctcaattttttggaatagtttctgtaggaatgacactacctcttctttgagcatctggtagaattcagctgttaatccatcaggtcctaggctttatttggctggtaggctgtttattactgattcaatttgggagctttttattgatctgttcagggaatcaatttcttcctgactcagtcttgagaggatgtatatgtccaggaatttatccatctcttctagattttctagtttgtgtgtgtagaggtgttcataatagtttctgatggttgtttttatttctgtggggtcagttgtaacattttctttatcatttctaattgtgtttatttggatcttctctctattcttctttattagtatagctagtaacctatctattttattaacttttcaaaaaaccaactcctgaattcattgatcttttgaatggtttttcatgtctttgtttccttcagttcagctctgatttttattatttctcatcttctgctagcattggggttgatttgttcttgcttctctacttctttcagttgtgaagttaggttgttcactgagatctttctaacttacttttgctgtggacatttagtgctatgaatttccctgccttagctgtgtcccagagattctggtatattgtatatttgttcccattattttcaaagaacttctttatatctgccttaatatcattagttacccaaaagtcattcaggagcatgttgtttaatttccatgtaatcacatggtattgagcaattttcattgtcttgacttctatttttattgcactatgatctgagagtatgtttggtgtgattacatttcttttacatttgttgaggattgttttatgttcaattatgtggttgattttaaagtatgtgccatgtggtgatgagaagaatgtatattttgttgttttaaggtggagagttatgtaaaggtctatccaatccatttggtccaatgttgaattcaggtcttgaatatgtttattaaattttctgcttcagttatctaatactgtcagtgaagtgctgaagtctcccactattattgtgtgggagtctgtttctctttgtagatctctaagaacttgctttatgaatctgggtgctcttgtgttgtgtgcatatatatttaatatagttaggtcttttgttgaattgaattctttgccattatgtaatgccctttgggttttttgatcttcgttggtttgaaatttgttttgtctgaaataaggattactacccctgttttttttctattttccattttctttattcctccatccctttgagcctctgactgttattacatgtgagatgggactcttgaagacagctacccactgagtcttgctttcatacacagcttgccactctgcattttaaatggggcatttagcccatttacactcaaggttagtattgatatgtatggatttcatcctatcattgtgatgttagctggttattatgttggcttgtttttgtggttgctttacagtgacactggtctctgtgtttaattgtgtttctgtattagctagtagaggtcttttctttctatatttagttctcctttcaagtctggtggtaatgaattccttcaagatttgcttatctgaaagggatattatttacctttcacttaggaagcttagtttggctgagtataaaatttttggttgaagattttcttctttaagaatgttgaatatgagtatcaatctcttctggcttgtagggttttagctgagaggttcgctgttagcctgctggaatttcttttgtaggtgacctgccctttctttctaagctgcctttaacattcttgctttcattgtgaccttagaaaatctgatgattatgtgtcttgggggtaatcttcttgtgtagaatcttgcagagattctctgtatttcctgaatttgactgttggcctctctaacaaggtttggatatttttcatggacgatatcctgaattatgttttccaagttgtttgctttctaccctttcctttctgggaagccagtgattcattgatttggcctcttcatataatctcatacttcttggaagttttgttcattcatttttatttttgtttatttttgtccgctgtcttatttcagaaaaccagtcttaaagttctgagattctttcctcagcttagtttattctgctgttaatacttgggattgcattgtgaaattcttgtatggtgttattcagctctgtcagacccattaagtcctttttatactggctatttcatcattcagctcctatattcttagttctgattcttattttccttagactgggtttagccatctcctgaatcttgatgatttttttttctatccatattatgaattctatttctatcatctcagccagttcagcctggttaaaaaatcttgttggagaaatggtgaggtcatttggaggacatgtgacaccctggccatttgagttacaggagttcttgcactggttctttctcatctctgcatgtggttgttcctttaactgcagtgtggattgagtggaatcaacagacttcttttctggatgttctcaccaggccaaggctttatgtagggcctttatttgaagctgtcttcttgtctctggtttcagaaggtggtacattagtgaggtatttttggtgttggatctttggagcatgatacagcagttggcacatgggcttattgttgagttggtagacccttgtttggttgtgtggctcccttgtgcttcctcacagttgcagccatgttccttctcattgctctgaaagtgtgggttcctctccccttgagtgctggctgtagattgcaacttgacactctgggctgcctggggcaatctcagtgtttttgttcctgccccaacttggaggtagaagaggaaaggatcttagtagtggttggagctgaggattgtttggttgtctcctgggggcttgtattaggctgttctcatgcttgtgtgaagaaataccagagactgagtactttatttaaaaaagtttaattgattcacaattccacatggctggggaggcctcaggaaacttaacaatcatggcagaaagcacctcttcccaaaatggcaggagagagaatgagtgccagcagggtaaatgccagatgcttataaaatcatcagatctcatgagaactcactcactttcatgagaacagcatgggggtaactgccatatcattcaattatctcccaccaggtcccccccaaaaaacatggggatcatgggaacaacagttcaagatgagatgttggctggaacacagccgaaccatatcattctgcccctgcctcctcccaaatatcatgtcctcacatttaaaagcataataatgcctttctaacagttccctgcagtcttagaacattccagaaattcaagtccaaagtctcatgggagacaaggaaagtcccttctgtctattagcctgtaaaatccaaagcaagttagttacttcctagatatgatgggggaaaaggcactgggtaaatacacccattccaaatgggagaaattggcctaaacaaagggactccaggccccatacaagtccaaaatccaatagggtagtcatcaaaccttaaagctgcaaaatgatctcctttgactccaagtctcacttccaggtcatgctgatgcaagaggtgggcttccaagaccttgagcagctctgcccctgtggcttttcagggtctagccccagttctggttgctttcatgggttggcatgagtgcctttggcttttccaggtacacagtggaagctgtcagtgggtctaccattctggggcctggaggatgtggccttcttctcatagcaccactaggcagtgccccagtggggactctatgtgggggctctaaccccacatttcacttctgcactgccctagcagaggttctccatgaaggctcctcccctgcagcaaatttctgcctggacatccaggtgtttttatacatcttttgaaatctaggtggaggttcccaaacctcagttcttgacttctatgtacctgcaggccaaacaacatgtgtaagccaccaaggcttggggcttgcaccctctgaagccacgacccaagctgtaccttggccccctttagccaaggctgaagctgaagcagctggtatgcagggcaccatgtctcaaggctgcatagaacagagtggctttgggcctggcccaggaaaccatttttccctcctaggcctttgggtctgtgatgggaggggctgccatgaaggtctctgacatgccctggagacattttccccattgtcttgctgattaacatttggctcctcattacttatgcaaatttctccaggggtattgaatttctcctcagaaaatgggtttttcttttctattgcatcatcaggctgcatattttccaaacttttatgcttcctcttgaacactttcctgcttagaaattccttccatcagatactctaaatcatctctctcaagttcaaagttccacagatctctagggcaggggcaaaattccaccagtctctttaataaagtgtagcaagagtgacctttactccagttcccaacaagtttctcatctccatctgagaccacctcagcctggacttcattgtccatatcaccatcagcattttggccaaagccattcaacaagtctctaggaagatccaaactttgccacattttctcgtcttctgagccctccaactttctaggacattccaaactttctcacattttcctatcttcttctgagctctccaaactgttccaacctctgcctattacctagttccaaagttgcttccacaatttttggtatcgttatagcagcaccccacactctgtggtagcaatttactctattagattgttctcaggctgctatcaagaaatatctgagactgggtaatttataaagaaaagagatttaattgacttacagttttacatggctggggaggccttgggaaacttacaatcatgtcagaaggcacctcttcacagggcagcaggagtgagaatgaatgccagcagggtaaatgccagacacttatagaaccataagatcttatgagaactcactatcatgagatcagcatgggggaaaactgcccctatgattcagttgcctcccactgggtccctatgacatgtggggataatggaaactattatagaattcaagatgggatttgagtggggacacagctaagctatatcaggggtccatcccacagagatgtaggccatcagttgctcagtgcaatcagcctaggatggagggtctgtgttgtgggcccaggccagaggttccttgtctggtgatgagcagtggtggggtgtgtatagactcgtggtgtgtgacccatgggatatggactggcctcctctccttgggtctactgcaacttgttggaggtatagatagacatttaggatcatttctccttcattagttcgagggtggcaagcgcagttctgcagcagaggcagtggcagagaggctttcaattgcccgttaaggctctgttcagggagttgccaagttgctactggctcgataactctggtggggtgactggggacacagagctggaggatctgcccagtgagaaaatacgggaatgggtacccatttaataatctggccacttttttgtaggactgttgcaatatacttgggccagctccagtctctagtcacttcaaattttcccatacctggtggtatcaccagagaaggctgtgaaacagtgaagatagcagcctgtccatctctctgggagcttcatcctagggaggtacaggcctgttgctgaccaaaagacacctgtaggaggtggctggctaccctggttggtaggtccagcccagtgaggaggaatgggatcagggacccacttaaaaaatcagtctggccactgccagactgattcagttcaattcctggttgcctcaaacacttcgatgaccaaaggctggaacagtgatgtcaggcaaacggcaaagacggtagcctggtgcttcctctgagattgctatcccagggagaattcaactctctttctgccagagaacacctgcaggtatagccagaggccccagttgggaggtcccacacagtgagaagtgggactggggacctggcttaaagaagcagtctgggctgggcatgatggcttatatctgtaatcccagcatcttgggaggccaaggtgggtggatagcttgagctcaggagttcaagaccagcctgggcaacatgtcaaaaccctgtctctactaaaaatctataaaaaaaaaaaaaaaagaagaagcctgtccatttcttggtagagcagctgtgctgtacttaggcatccctccacccctagtcagctgggactcttcaaagcctagaggctggatcagctaagtcactcaaacagcaaagatggtggcctgcccctccctctgggagctccatctcagggagaattcaaatctttgtctgctggaaaacatggaggtgagaggctggaggcccagtttgggaggtccttcccagtgaggtggaacgggattgagaaccctcttaaagtggcagtctgaccacattgtggtagagcagttgtgctgtgctggggggaacccctccaaccctggttggcttgtactccaaaacctgaaggctggattggctaaggcacccaaacagtaaggatggtgttccaccccctcccaacaggagctctttcttagggagatacaatgctgccattggtggctggctggaattctaagtcagtgggtcttatcttgtgagacaccaaggaagtaaatcctgcaggctgtcactgctcagccccctggattcaccctctttcctagtagtatacacaggggtgtaacctcctactttgctggaaagtccaaggacctaaggctccagggtctccacgcatgcctgagtggcttctctgccaagagtctgcatagctctgtcagattgaaggccctggtggagtgcagtgggttcacaaggagatctcctgacccaaggattgcaaagatccataggagaagtgtagttcccaattcacacattcactcagcacttcccagagttggggaggtttccctggcttcgtgatgctaccaggtggaccgttgccctgctttgcttttctttgttttccatggatcaagttgtttccttgattagtcccaatgcaagtacctggatgtttcagttgaaggtgttgtatttacttgccccttccattcctctttgtgagaaccatgcacactagctgcttctagttggccatcttgggcactccccacccagttctgtttttatacactaacaatgaactattcaaaaaagaaattaagaaagcaatcccacttaaaattgcatcaaaacgaataaaatactttagcataaatttaaccaaggaggtgaaagatctgcacattgaaaaccataaaacattgatgagagaaatcgaggacataaataaatggaacaatatctattgttccattgattggaataattaatattttttaaatattcctactacccaaagtgatctaccaaatctctatcaaaatttcaagagaaattttcacagacattgaaaaaaagcaattcaacaatttgcaaggaaacatataaggtactgaagaactaaaataattttgaggaaattactattattaaaaagtcaaaaaacagatgctactgaggttctggaaaaaaaaaaatgaatgcttatacatatattcagtgttggtggaaatttaaattggtttagccactgtggaaaacagtgtgtacatttctcaagaacttaaaacagaactaccatttgacccagcaatcccattactggatatgtatctaaaaagaaaatcattctaccaaaaaaacacatgcactcgtatgttaatcacagcactattcacaatagcaaagacatggaatctatctaggtgcccattaacactgaattggataaagaaaatttggtacatatacaccatggagtatacacagatgtaaaaaagaatgagattatgtcatttgcagcaacatggatgcagctggagtccattatcctaagcaaattattgcaggaatagaaaactaaatacctcatgttctcacttataagtaggagctaaacatcatgggcataaaaatgacaacaatagacattagggactaccagggacattagggagggaggaggggaaagagttttaaaacaaactgtttgttactatgctcattacgtggattatgggatcatttgaatcccaaaccttagcatcacacaatatacccatgtaacaaacctgcacatgtaccccgagaatctaaaataaaagttgaaatttataaaaagaatcttgaaaaagtagagcaaagctggaggcattgcactactgatttcaaattatattataatggtatagtaatcaagacagtattgtagggataaaaagaggtacataggtcaatgaaagagaatagaaatcccagaaataaactcatgtatatagggtcaactaatcttcaacaaagaaaaccaagaatacacaatgaggaaaggacaatctcttcaataaatactgttgggaaaactgaatatccatgtgcaagtaaaaagtgaaatgagatccatatccataccatatacaaagatcaatttaaaatggattaaagatttaaacataagacctaaaaccataaacctcctaaaagaaaacccaggagaaaaactcattgacattgatcatggcaatgtttcttggatatgacaccaaaaacacaggcaacaaaagcaaaatatgatcaagcagaatgtcatcaaactaaaatatctgcacaagaaagggagcaattaaaaaatgaaaagataacccattgaataagagaaaacatttgcaaatcatatatctaataagggagttcatacccaaaatgcatatagaactcaaataactcaatagcaagaaaacaaataatctggttaaaatgggtaaaggatatgaatagttatttccaaaagtgatctaccaaatatctatcaaaattccaaaagtatttttcacagaaaagaaaatcctaaaatatgtatggaattacaaaagatgaaaaatagctaaaataattttgaggaagtagaaccaagctggaggcttcaaaaggaggcatacaatttgtcaaaaagtgtatgaaaaaaatgttcaccatcactaataatcagggaattgcaaattaaaacaacagtaaaatacctcgaacattttagaatgactattataaaaaagacaaaatataaaaagggttggaaggggtgtagagaaaagggaacctttatatatggttcatgaaaatataaattggttcagccattatgaaaaaactgtacgaagcttcttcaaaaaattaaaaataaaactaccatataatgcagcaatcccacttctggatatatacccaaaggaaatgaaatcagtatgtcaaagagatatttacacttactcgttcattgcagcattattcacaatagacaagatatggaaataacctaaatgtccactgatggacgaatggatacagaaatgtgatctatctatctatcaatcatctatctatctgtcaattatctatgtctaaatcaatatctatataatataactttattcagcctttaaaaagaagggtattttgtcatttgtaacaatgtaggtttacctggagggcattatgctaagtgaagtaagacacagaagacaaatactacataatatcatctatatgtaaaatctaaaaaaagtccaactcataaaaacagagagtagaatgatggttaccagggacttgcatttcaggagcaggtaaaatgagatgttggttacaaggaccaaactttcagttatgagtaaattctggagacctaatgcataccctagtgactatgtttaataatgtatttttgaaatttgccaagatagtaggtcttagatacaggttgagtatcccttatccgaaatgtttgggaccagaagcattttagagttggagtttttcagattttggaatgtttgcatatacataatgatatattttatggatatgtcttgggaggtgactgaagtctaaacatgaaattcatttttgttttttatacactttatacacacaggctgaaggtaatttttaaaagtattttaaataattttgagatcggggtgaaatttttcacttgtaacaccacatcagtgctcaaaaagttttggattttgagcattttggattttaaatttttggattaggaatacttaacctatattttcagcacacaaaggtaactatgtgaggtgatggatataatcattgattgcattgtggcaatcatttcatagtgtgcatgtatatcaaaacatcacattgtatacctcatatatatttaatttttgttttcaattatatactacagtaaagctaaaaaagtcataattttgctgcatggagcaaaccttccaaataacattggtgcatagcttactgaacacactttaagagatttggaaaagtacgttaaaatgatctatagaaacctgatattaacacaggcctttatatcttttttttaaatgtggtttcctctgagattatctgcttagctcaaagttcagacagtttatgagcatctcacttgtgagactctggttattgtgtctatgctaagccacaagttagaccttggggggcacagaaaaagatatatgatacttgaaagtgctcagaagaagaaggggagagaagatcagtgtttccagagataccaggaaaactgccaggaagtctaaatcacactaaaattacatttcaaagagaactccttgcggattcaataacttttccaagaaagcagcaaaaaataaaataaaaaaaaataccttgcaattcacaattctttctagcatattatatttttatcaccaggaggaagcaaattaattacaatgaatagtattggattaatgaacatcataaaagatgccatatctaaccatgtttaaggaccttgaaagggtcttgtagaaacaccttcaatgtaatctgatgtaacactccgttaagcgatacttgagaatatttgaatattgcattttattcaaaatgctaagagtccctaagctcttgaactagcagattctgctgccttttatttcaggatatattggtttcaatcgttgtgtcataaaaattaaacttcaaatgacttaagcaataattagtattttatctcttattatgtgcatacatttttgctttttggtaaacaaattcatttgtctaagacaaaactatatgttgaaaattgtggatgattcttctgattaaaaaaaaaagttcttggacattttatgtcaatgtttaaaatgccacttacactaaagactgcaagttcagcaagtttgctagaagtttcctttaaaagattgaggctccccaattttgatgcaaatctaatgtgtgtgaagcacccacctgggctgctttgcatagccccatgggtcttgggagcattgggaactaatgcacacataaagcttatgctgcttgctttgccatggtaataaagttccttggtccctaccctggaatatcttgtcttctgtcaatatccataaaactatggtaggccaaaggtagtatatatgtatatgtgtatatagttcccaatttttcagtttgtaagcagggtattatctcaaaactgtcacagtttctaacatatactattcttttcaataagatttttgaaaaaaaatttaaaaccattttattatatataagaatactcagaatatatgtacttaataaatgtatcagattgctgggaaatgtgttaaaatgctgaatctatgtcacaatatagcagatttctgattcaaattttctgagggtaaaagtgttccattttagcaacaccttacataatacttagacctgttgaaatttgaaaccattcatctgaggaaattgatggctagaatgcttcttaggttataacataaatttaattttttaaaatgagtcaagtgaatgatagaatagcttttcttttctgagaaacactgcacgctgatggttaaaatgtgcttaatacactttggaatattatttctcccagttttggaaatattttttatttcttcatattttctgaggaatatctttttcccattgtattaacaatattgattattctgcagctggcagtagaatgtggttcaggtgtttgttattaggttgatatgcaaatgagttatgtttacagaagtacccactagtggtgatagaatatacatatatgtgtgtatgtctatttgtctattcatccatccatatctgcttgatttgaataatacacatcagagaaatcacaaatacctcatagttaaaatctgagttatgaagatatggctaaaatgtttcctgcagcccggttagctgccttaatacacaccatccttgcatcgtcctttattttcctgatcttttcttccttgcatcatcctttactattattattatattattattattattattgtttttaaacctttctttctgagcacatgaggatggatagctttctattagggttttggaatacatatttttgtttgtttatcatttatttcctttttaaaattttatttcacattcagggggtacatgtgcatgtttgttgtatggaccaattccataatggtggggataggactcctagtgtacccatcacccaaatagtgaacattgtacccaattggtcatttttcaatcccccctcccctcccactcagtacatattcgaaaagaagaatgactctctcccttagttaactcaccataggaaatggcatctatgtgatgaaaacattaccaatagcaaaatttaactgcaacattgtgaataaatgttaatttttatataaatgtttccatgagaaagggtctctcagagaataagctagaattgacaaagtggctgatggaaagaaagggtgagtaaaactattctgtggtataaggctagccattacatcaagagcaggtaaataatattcattttcctaaaccctaaatagccttactgaatgaaagaaaaatcaaaataccttttctgcaatgactaataccacatgtgcaaagatgaaggaatgtagcatgaataggggattaaccatggcaagtgaataccatggtcatgaaaagccgaactccaaaagcagtctttacttttcctttgtaaattataacacaaaataacaaattttaacacataataaatggcaagaataaatatctatgttcctgaaaagtcctcattttaatgaaggaatgaccctagctctaaagtagcgtgatgcattccaagcttcatgtgacacaatcatgagggataaatgtaataactttggccaaatttgctggatgtatttgcacattgggaataatggaaaaagcttcttattgcaggaagacagttaccagcttaaggatagaaatgatttactgccagttactgcagagcaagctgaagaaaaattcaataatattctttataatgcagcatattcaatctttcagaatttgacatagttgtactttattaatgacaaaatttaacatatccatggaaattttcttttggtgacatattagatatccttatttttgttatagacatcatgtccctgctcactatgttgacattcttctatacagtaaccatcagcctagtatttcctgtgtgccaggtattgtgctaagcacattccatacagtagctcatttgattctttaatctttcttttctaacaataatttttttttggcttacacttttatatatgtggaaatgggcctaaggaaagccagatgttggagtgtgatgagagatgatatggttagaaaattgacctgtaatatacccagactcattgtagaaactcagaattagtctgaaatgttttgcatcaattgatggtacctggtgaacaggcaggcatttagcctgatccttcaaaattgtgaattaagggaccattttaaaacccctgtgatgatggcaaagctgagattctaatgaagctgatattctagaccctcatttaggggacttggggtctgggaaatctgcaactctggtagaatacagtgttgtttctcactttaaacaattgcctccttgacaatttggctttcatgtccttgccattacagatgcttcatttttattttttcagatcttttcatcattcacataatcattcttttttgacaaccatacatcttcattttacagatgaggaaaataaagatcaaagatgttaaagaatttagccaaaattatataacctttaagtgactaagataggatacaaaccaaaaactatctgtctcggagcacaagttcttaactattatgcttcactacctaaaattatttttagctagaggcagaccttccacagataaggacttcaccaacagacctcctggacaattgtataaaaagaaaatagaaagttgctatttaaacacatctaaccacataattatatagaagttaattagtaagtagagagtaaaaggaaacataaaatggctagtccttctaatttttgttccttttaagtctatttcttcaccagcgatattagataagcaagcaccagttgctggcctcttctcatagcagtgttttatttcatatacacgtttttcttgctcagtgtttttggtatagcaaattttgccagaagggcagcattagttgatcaataggagcagattcaggttgttggggaaaaaaattgtagtcatgcttcaggtgcagcccaaaatcaataagaaagagtgcttcttaacagagtgaaatgaagaacaattacttactgcagctaaatgacatcctgtgtgggatcattgtctatactggaggctgataggcaccaaactgaggggctgcaggataagcagctgacagggttacaaatggagtattccaaatgatgatttaacctgaattgtgaattaaatctctagttatgtacactgtcagagtcaggaaaatgtttcattcttaagctcttgagtaaattcaaaaataagtattagcaggacttatagttttaatttactgcagagtttctcaacattagcactattgacatattggactggataaatctttgttgtgagggcctaccttatgcagagcagaatttctgacttccacctcctaaatactaatagtccacccccctcattaataacattaaaaaatgttccctaagaggcaactttgccctagttgagaaccactgatttaccgtattaattatttttacttgattcataacatgctcatacattatttctttcttgttacgattcttggatagatggaaataaatgtttatgtatatgcacctcaagggcaaaagtaagttttgtcatgaatagaatctaatttgaaagtaaacctcaaaatattcaggatctctttctacttgtattattgtatttgagtagatgtatttgtttcatttgaatactgcatggcagttattggaggtcttgctattttttgaaaatgattgctacatgtaggcaagaagaagtttgtgcagaaaccactttctataaggaacaggcagaagataactgtacctgacctaccattctggacattcaaatcttgtctgaactgttagttaagattctgtgagtccagacctctatataaaacaatttctgaaggaaatcttgtaatgcaggatttatacacaattaaaatgattttttgcctgattgaaatgacacttgaagtatacagtctttcacagctctatattaatcactctagctacccacatttgggatttactattgctcaaatttgtataataaactcaaggagatatgtcctttgatcgatgtgcatcatgtagtccgattatggaatgctacctcttttgtgtgtaggagtcagatttaactattatccactagggataggtcatattgactatctatttaggttggtgcaaaagtaattgtggttttttcattacttttcatggcaaaaatgcagttacttttgcaccaacctaatatctatcttttatctgtctatcaatcaatcaatctatcatctctgatgggattatttaccttagggaaacattcatcttacagtatactgcttgtcttaggaacatatgacatgcatgttataattcaagaattctgagcccaactgcaaaactattgagtcacttctatggtcccataaatatttatttcaactgatcataaggtaatttttacttatgagaaaattttagaactaatttcttagagctaaagatagcaaactgaatgctccagaatgactaatcccatactgtatatcgttgtatagtccacttaagcctaaactatatatgaaagccatgactaacatacagttggagccactgataaatttctcacttttattgaggaatttgtaaatatttggagtcaagtgtggctatgagaataaatcctttttaatgtactcttttgtaacacaatctctgattatatttattgtgttcttatatccctagcacacattttttctatttgaacatattcaaatagaaagtttttatatagcaactttaaatcaatttaataaaataatcagtatttctctataatatgctatgcaaaaaaaattgttcctaagtatgtattatctagaaatagcttcattcttttttaaattcttcttgtccagcatttataaattgcatctatctccttatggttctgtgtgaattatatctgagctgtcttcattcaagggttgtttccttccactcctgagtagatggtgctaattatgatatgttctgagttaaaacaaggtgtactactctaaggacacacgcagattttctatagagttccttgacatttgaaaataaaagtttaaagcatcttgattattgggatatgcaataattgacttctaagcttcttgcttgaatagactagtggagttttggtttttcatgatgtcttgccttcttcttgtgcattacactaagtagtacaaatattatgcatgtttttatataagaactatacaaagttttaaacaattattttgatagatcagatgtctcctgtgagatagaagagatggaaaaagtgtcatatgccctctgctttaaaggatggctgcaactttatacagctctttagattttagggatgaacttgaaaaggacatattgttggccagatgaagtgaggactaaggaggattctacaaaatgatgttttgaaacattctggatactagaatgctgtacagctttgtttgtttccttacaaaatgttcacagcatgctttgttagcaatctgcattcttttaaaattgtctgagatattatatagtaaattaaaattatttttaaaaagtaggtactgggaaagctggtgacctctttattcattttttgttcaacagatacaagttcaacaaataactactaaatgccagaaccagagctaccatgatctgctttcacctacgtagttgcatttgagggtctggaggcataattctctatcactcatccccatgcccagtcagtagattctcagttttcagagaaaaaataaatttcaagagaaaatatttgaggctctttggactagatgtattagattgtctatgaagaggcatggtttctcagactcatttggatggatacaggaaaatcattctcactgaggtagtataaattgtttttggaggcatttatttcatattggtgagaccctgagcataggatccagtaaaaaacaccctgatgctgtgcagtagatcacttttatatcaatagacttttctaaataaaaatatcctagggaaaatttagaaacagtattaacctcaaaatgtttcatcatttgttcatattttagggaaatactagtaaaagttttgttttacataaatcctgtgaaaaaaattaaatacattttgattggtcctaaagtatgttaattataaattcaacatgttaatatttttactatataaaattaaaattgatttgaagtctatatatttttcttcaggttttatttgtattttaactatataaacattgttattaaaaattattgttttgcatttttttcagagccttaaaaattttcttcttgcctattatgtgagacatctgaattactataatatggaactttaattataaccactgtttgtgacacatgtcttccttcattcttaacaagtgtatgcattctgaattgccttttattatgtatttttaccttgaactgattaattcccaattatgtaacctttctaaaatactgctttgtcatgtcacttacctcatcataaacctttaattgaccttcatttgatttaaaatttcactctttaaattagcagccaaaaacttaaacaatgtagacaacttacatacacaaaattttcttgatccatttatttctatgtaaacatcctacttcaccttagcaagtaagtttaatactagtagttctcagaataggtctcataaatatatacttactccttattcgtgatgcccaggatgcctttctgacttttcagtaatccaagatatagtcactctgaaggatttagttgagatagccccatatatgatccttctctcttttccccatttcactcaatcccttccttttttcactcatcttcaacaaatgtttgtcaaacacttactttatatcagaaactaaggtaaatgctgggagaaaaatttgacacaattcttgctttcacagagcacactgtctaaattagtgataggcattaaacaaataaatgcattatatgtatgtatatacatacatatgtataggacaattgctataaagagaatgtataggttgtgtttgcatttggaaggtttaaaatagtataatttgaattaaattctgggttgtgaaaaggcttaaaattttctagggactgagttacctgtcaggtaaaaatgaagggaagaacattccagatagaggctaaaagcgtaaaggacctaaaagacctaaggaaggagaaagtttttcatgtttaagaaactcaaagatggctaatgttgctagaaacccaatgattaaagaaaaaattgtcctaggaaggaattaaagagggagctagatcattcagagtgatgtaggccattacaagaatatttatcttcttgaaattcagtaggaaggtattgaaagaaaataagaaggtcaatggcatgattaaatttgcattaaaaaattatccctcttttgtggcatatgtgtgaaggcacaaaatagtggataaagtagtacaagataatggtgttgaactagagggatggaggtggagagtagtgggcagaatataaatagaatcgctgtcaactagtgatagagtgtagaggtagaaggagaatgcatcaactacaacttcagagtttctttgtggtctccactcatttatttgttcaacaaatgttactgaagtattaagatgaaaaccagacatgatgcaattattatgagtttagttagaaaaaaataagattgagataccagtaaaaaagtcatggaggtagatacacgaatgaaaattaaaagaagtttagattaaagcaaataagttaagagttgttcacatgaagttggtatgtttaaagttatgtgaatggatgagatttccttaggagagtgaaatgaatctggaccatgccatcaagacccaagcgtttagttggaaaagtgcccagcaaaggatattgagtagttgtgaccagagaaacaggagaggcaccaggagcgtgaaatgtcacaaataccaactgataatggaattcaaaatgaaagtgctgaactccattaaaatgcctcttaatgtgtaaagaaaatgtataaactgacaagtatccattttacttgacaacttagagattttcaagagcaaaagccaaattgcagtgggatgatgaacaaggtaggggtgatggtgagaaactgaagcaaccaaagaaggcaattcttttaaaagctctgtttcatgcttagaaattatgttgtaccacacatttttcactaaatctggtcatgacttaagatacgatattgttgttttagtggcttcattttgctcttttgatttttatttatagtagtctagttccttaagtaaaagtaagttcttgggggtaatattgcatacttagtttatttgaatcactcattgtatttatattttgtgggtattccataataatgaatagatatgaatgaatgaaataataaatagtgaagaaagaaccacagagaatgaaaaatattaataaacttagcatgggagatgcaatctcttttattaggactagttttagattttgacactcctcagatacctcttctctcacagttatttgtgggaaattgcccagtatactcaacataacacacaatctatagagttgatttcttagagaattcatttggtacctatgttagtatctgccaatttgtcttgatgttagagagataactaccacctctgtgaccatcatttggattcaccttagccttataattccaacatcaggacctttcaacatagtctctgttgaaaatacagaagacatcacctgtgtagacagggaagacttattccttctgcttttagaaaacttcaatctggggaatccagatctatcctaagccaatatcttattaccatgtctttccttttaactgcagcctattgtagcacagcatacctagcaaagatcagacatatatatgttgactttatcatcaaatgcttacttcttgatcttcatttctcagtaacacagcacaaaatatcttccacattctactctaagaatttttctatttatccatcctttttattccgtaaacgtaacagatataatttctgcatatccatcgttcatgagatttgccgaaatataacaaaatggctggcatgtacaattaaatattccagcaaaaatcttttggatgttgtttttcttacatcgaatgcagatcttgtgtctatgcatgaaaatgaaaggtgataggttctgtatggaaatattaaacactgctttagaaaatcttgaattggttgttgcctttaccattaacaatctttataatctaaggcaagtcacacagtctctctagtcagtttccttataaaatcaaggtattaaaatacattaactttaaagcctctcttgaatcttgaattaatattatatcaaaaaataaaaatatttatattttcagtgagcaagaagttaagatattaataaaatgaaaataattgacaataaaatgaaaataattgacaattattttagatctttgcaattgtaagcttcatctgactctcattatattttgtgctttgttgattttttttctatttaaaaatcaattttagatctttttaaggatgactaactttgaagctggtggcccatctgttttctctttgttagcagactttttgcgactactctgagtttgcaaagaaaatgatttgctttgataaagcagcttttcaaaaagaaaaaaaatagccttagatttttttttcactctatagtaagtgtttctaacactcataaactcatcctaagtaggaaaaaagtggttggctatttgaaaaattgctattattaaataagcctcttatctctaaggctcaactctttatacagcaaaagaatgtatttttgaaattctatgcttctttaaaaattggttctaacttgtatgtaatgatattctgaccataactttttgtactataattaattccctgctgtgtcttattccttatttatactatgtgaaagaatttcaaaaaattaggtggatattacttcaattcccagctattctgtatgtttatatttctatatatgttagcagtattcttttctatatatgttagcagtattcttttgatgttttaaattctttgaaggacgttcaagtagtattatgttcaccaaaccatcgtgcagaaaatgtaggttcttattatttgtcacatcattgccttgtgtatgtcccctgaatttccttaaatgacatttgttcaacccagaattgtgcatgttgctgaaggaaaacataacttatgtcaattattaaatcaattattagtaagagcctcagctttccatgtataaaaatgcctttgaagtaaggcatccaaaactaatctatcttaatgtacatttacaagaataaattgggatagtttgtatgaaagccatttataatattttacagtatatgacagatggaattctgaaattacttgtattgtttgtactatcctccaaaatttgctatgtatttagtaatatattgactttatcagtgggtcaagcttattcctaaaagtagtttgcattacattatactgatataaaacaacacattgatattatgaaattactgtatttttatttcacttccttgctcatattatctcttagattaggtaaatacgttacttttagaagtttccaaggagagcatacagagtaaaattacttgtaagatagaatcatttaagcaagaaatttagggctcacattatttaatcatgctaataaggactaaaaaaggatgaaaaataagtttgattcttaatttaatgatatacaatatatttgtttatgcatttattggactccagaatttctaccacataaagccacagcgattggctataaagtctatgaattattcacacgagacattatgtgaatctaaagatttttttaagattattaaatactattctcattcaagaagcattttattacataatatgtgctaggtgttgggcagcagggtgtctagacaagaggctcttttttttttttttatgttttgctatactaagccactacaattgttcacttttctgcattcctatgcaaatacagaaaattattctccactcctttccctctagcatataaatttaacttaaatctttaactcattcttttatttagaaatcacatatttctggaataccagttgtgcagaattatattttcatagatgtcttctgaattgagtccttaatcacactcctgttattgcttttataagcaataattgtctgaaattctcatttaaatcaccttttaactaaggagaattactgacacagagtgggtgatcacacatatacacacacacacactctctcacacatacattagtgttaaagacaacttactgttctacaagatttggttctgcctagagttcatttactctaattataaacagaacagtcaaaacatatgcctagtggcttctgggaaaactgttgtatgttttcacttgtcctttgaagagagagaggtgctgtgattttactctcttgggagctctgctggccttattagcattcaccttgcttatctcatgcatgtcttctaaccctgtttgtgtcctaaatgcccaccagtagaatttagtataccctaaagaatttagaagcgaggttgaaccagaagaagtagtttaactctggacaatgtgcaccattccacacctcttggtaatttgtgcaatctgaaaaaaaatcaggtcctgtctgccagaaccttttgatgtttcttttcggttattacatcaacttattacagggcttcctgcttgcaaagcagtaactacttctttacacagtctctctgtagtagagtgtttcctagacctttaacagaactctttatcactgaaaacagattccacgtctaaggctacaaacagacacagcaatggtgccaaaaccttttgaagagaacttctatttctcagtgatgacaggaaaagggcagcctgttatttttaaatttggtttgagtctacattggccctttaatgattgtacttgagaaagacgcacattttaggagtgcctgtttactttacatcaacacattgtgtcgtgatatatcaaaaggagcatttactttttaagtagtttttaaatgctttcattgtgtattactacgttggattgatttagtaaaggagatgatattttttaaaattaataattataagggcccagaagaatgcctggtatataataaggattatatgtgtttgcaaactaagtaacataaaaattaattataaaggcttaatttcactctcataatggctataaatgataaaaggatagaaatgtatgtataatggttttctttcttgatatgtatatcactgatcatttttatctgtttaatttaaggaagcattgtagtttagggcagtggttctcaactgggggcaattttgctgccatcccccaccccttggggacatttggcaatgtatggagacatttttagttgtcacaactgggtgacagagaggtaccctggcttctgtaggtacaggacaaggatgctactaacatcctgcaatgtacatgatggtcccaaaaacaaggcaataagtaatacatacttaaacatacagtacataaaatgaaaatgcttatttacatttaagatttatttataaatttcaatattttattcagtgagtaataatattcatacgtgcttttattcaaagcacttttcttacatgtaattatatttaccagtatagggacaatggcttcttgatatcacagcattgcatgtttctatgttgatgtatttgtaattaattaaattaatatatgtattatagagtgtattctgtcatttgttttgtttataatgcctcagcttatacattcatcatttattttctgaaataataaagtgatctactcaatcagtctccaagcaactagaccagtgtcaaatgggtcagtcagttgctgagtttttattctaaggaatatcttgctactactactaaattaccaaaattttttatttttataaattagataatattatgaccactgtcatttgtatttcagaagttaaaatatttacataaatagaagataaaggagttgagtgaaacatattttaatgcgagtatttttatagctctggattttacccaaagatgtatgtacccaccatttatgtttacacaatggggccgggcagcagttaaaaattgcagccatacaatatctccctttcaattcattttctacagtattgacaaaatacactgaaattgattttttttcatttgctttgatatctaatgctgtagatataatgtcatattgctttggtggttttgaaagatctgttaaataagccattttaataaggaaagtccagtagattattttccagactgtataaatattaatggagttctcagtaaatgccaggtactggtaggacatgtgtattcagcattgaacaagacaggcagagtccctacccttatgcaacttacattctatttgacctggtgtgttagtccactctcacattgctaatgaagacatacttgacttagaaaacttacttacaatcacggtggaaggggaagcaaatacgtccttcttcatatgatggcaggaagaattgctgagcaaaggggagaaacctcttataaaactatctgatctcgtgagaactcattcactgccatgagaatagcagcatgggggtaactgccagagtctctcccatgacatgtggggattacgggaactacaactcaagatgagatttggctggggacacagacaaaccatatcacctgggtactgtaatgggcagaggtaaatgtgtctattcttggaaataaaatatatggtattctcattgtgtatcttaacctgcaggtctcattaataggaaaccatgaacttattcagaagacacatttctcagtgtgaattatccatacaaaagttactacttagcttctactacaagaactgtaaccaagaataattctgattcactttaacataatttaatatttatctactctttcaattgaattcacattataatgttgatattttcattaatctttcaaatatttttaaattctgtttaacattagttatttttctaagtataataccagttttcctagatggctattgggggattgtttcaagtttctctattcctttaagaacaattcttgttgtaaagcaatattttttttttgttaagtggagaacatttgcaggaaaaatatattttaaagtcaatgaaaataatcatgtgcagagttcttatgtatgcaagcaattataacagaataattttgcctgataacattcatggcaactaccaataatttttacaaaacaaggaaaagaacttcagaaaaaataaaacattattaaacgttcattaatcagtgattgaagtatttctcccctcccccataaattctatcatcacatcatccagccttaacaaattttggctttgcacattggcatgattattgtatttctgtttttcaccaagagacaagtttttaatataatagaatccctaaatatcaggtttcattttacaatcaatgcttttaaccaggttgcagttgtaatgcagtttaaattgcccgtgcaatgtgtattgtatcatagcttcatatttgcctttctttaattgagttatatgcaatgttggtgctacatttgttactaaagaatgttttctaacagcttactgtacttgatgttataagaaaaataattttgtatacagaaagccaaggaaaaaaacagggtataattttaatattaatgaaataaatatttttaactgtcttgttttcaaccccgtgcttttttttttttttttttttttttttagtacagacagggtttcaccatgttggccaggatggtcttgatctcttgacctcgtgatccgcccacctcggcctcccaaagtgctgggattacaggcgtgagccacagcgcccagcccccatgcttttttcttaagtaaaaacccaatgctttataaaatctagagagggaatatacctatgtgtggatgacactgaatcattgagaaaaatgcaaaaggactgtctgtcaaatgccaaacaaggcaactgaacacaaaataaattgcaatgagaggctggtgtgacttactaatggatcacacaggctgaaataagtgaatgtggtttatttgttttaaatcagcatcaggtgttttgtttttcatttcttagtggtgtattaaataataatatgttttaaaattagtattttcttgcatttgatgaaatacaggctatatgctattgtaaagaaatgagaggaagacaattaaaaggtaacaatgaacttattataatgtgcacagtcgactgattaatcactagattttccatcctttcatcctcattaggaattctatggataggtaataagctagctgcatgacaactaaattgcgcagaatctgacataattacatgagtttcaggaggcttaattctgattttgagaaagatgtggctagacacatgcattaaaattaccttcagggatctcaaattcttcagaggtaataaacattggttaacatcataatatggaaattattttcctctgggccaaggcaaccaaatccatatatatatatatgtgtgtatatatgtatatgtatatgtgtatatatacatatatgtacacacatatatatacatatatatacacatatatatacacatatatatacacacatatatacatatatacacatatatacacatatatatacatatatacatatacacacatatatacatatatatacacacatatatacatatatatacatatatatatacccaaatcagatctatctatatctatctatcttagattcccatccttccgatccaaatgcatatgccaaaatgtattttaatattttgtgttaagaggatgtttcctatgtacttctaaacatattccaaaacatgtagcataaaataaacctagaattttagaattggaaagcaactgaatgattgttagagtttcttcaagatctaaattctattgtcttacattttattcatttcattcagtgagtggacttagaaactgaagcccagaataattaatttattcattccatgttacacagttcaatggtagcacaactagagtcttttggcttcaggttcagtgttctttctattagctcaaattgtcctataatatactaaagacacaatagggtaattagtgtagtgtatggtatgatatgcctcctacttttccctttctctgcctcaaacaaatacactttcaagactgaagtcttaatttttcctgttgctgagagtgttggcaactgatagctctcaagtaaatttctctccaataatttctctgcttaaaaaaaaaaagcaaaaccaaaaaaacctactcatccaatactatagcccttcccagggcctgccaatgtccaataactggatgatgggatataagactcccaccgacttgcctgaattggagaccactattaagaaccatcccaaattcagacctccctatgtgatcagtcgagatagtgtaattgcacagaatttaatttctcactctgcctgactctgctttcttcattctctatagttgttggcctaagaacactccccaatacatttcacaaacatctgtctcacagtctgtgttctgtggaaccaaactacaacaataaatataaaattacttgaattttctagagaaagtgactttctttttaaaatagagataaaagtgttccaagtgattaggttctaaaagatgaaataaatacctctcaaagtagtttcaaggtctgttagttacattatattgttactgtgatgatgatgattattgttgtgattaaggtaactacattccaggtaattaggcattttataatcaaggaggtcattaaatatttgtaataatcctttatgaagatatggatataaatataaaacttcatttctcagatgaggaaattggcagcttaggaagcttaggtaacttgccatgttcactaaactagaaagtgtctgacttgaagctgacttaaggtagcatttgggtcttatatgaacagccctatttcacatgatgtatgcagcaccttgtcctcagtgtggccaataaatatttatcacaagaataaatgaattcatatatatctgaccctacccatatgattaacccctgcacaatgcaatctcctatgtccactatgagctttggagataatagtaaatatcacagagaacttaaaaaaaaaaaaaaaaaaaaaaaaccaagggcaaaaaaactaacatgtcaaaaacaaactatgctaaataaacataaatggttgatttaaatgtgtattttcctttaaaaattgagagtaagaagccccatcttgcttcttttgatagtagatccacatgtgccttctaagtaccagatactgtaccagagaaggggtgctgaggctgcctgtgtgactgaattatttgatccttttcaatatgtctttttaaaactgtatattcaatttaatataatatgccaggagaattaaaatgatcacataaagaaaacaatgaatattccctcaaaggtaatattaaaatagtggaaatgaagtctactcctaccatttctactttcctaggcagcatctgttgaaatagaaatgaaaaagaaatgtaaccactggtgttatcattatggacttattaatgttgcattcatccccaattttttccacaatatttcataagcagcacccatgatatgtctaacatttggccacagatattgagcacaaggttgatttgggggttggttggtaacaattaaataaacatataagtttacagggatggaggaaaaagaaaagatcacatttctaataggtccatagcctagagtattgggaaagagccaagaagaagaaagtgagctagacaagttcccaaatgacgaaaatggaatcaaaatagtttattccttttactcctaaaaagtctgaggcatctcttgtgagtcttacaatgtttcctttctacaccaaattaccaacctacctatgtctactccaaatctaaggaaaagttaaaacagcatattagaattcacagaggggggtctgctgtaagtagcttatcacaaaaatataaataagtaaagatgacatcacaaacatcaagacaataaaaaggaaagatgacatcacagacatcaagacaataaaaaggaaaggcctgagtagcaaaatccttccctctgaaatcactgagtttaaggacgcctagtgggtctttgttttgtagaaaagaaaaggagggagacttatttcaataataatcattttgaggcatcagctcatattacaatgtttttctgcacgtaattaattttagaaaaatgtgatgaagttttgaaaaattcctatggaaatactcgaggaagaaggaactggtagataatcaagcagacggcctgtcctacactagcttaggataaaatcaaactctgtgctacaattttccagtctgtataacgggaataaaagaaactacctcaaaagactcttgtgaagagtgaatatatgagagcaatagcagagtgttggaaatacacacccaataaatattatgtattatctcaaactttattcagcaaatatttattaaatggttaatatgtgccaggcaattgtgtcaggaagaaagagtagaaatgaagagaaatggatgacttgagattatattttgtaaatagcaaggacctgattttaaggtgtatgaagaaaagagaaaagaataattttcaggtgttggcctgaatgtggtgccatttactgagaagggaaattcttggggaagaatgagtttcacagttgagaatcaagttttattttgtttggtttgatattatgccaaattagtaatattaatataagtaatattaatcaaacaaaaagtgatgatggctaaataagcaaatgagcctgcagctatctatagtgctcttctctcttctcccttgtctgtttctcttcatttttatcctctttctttgtagcaacaataaatccttcattttttgcatgcagaacaattaagccagccagtctcagtttttacctcaatgtgtttttctacacaaacatagtgctctcttcaggaggaatatgggtgctagcttgtaatctttgcttcttcacagcatgattcaatgagctatgccttgttattactagagtatacaattcttatgagcaagaagatggtatgtacttgtggacctgattttgattaataaattgcatccaaaagtctaaatgaaacatgtattgaaatttctaataagtggtctattggtcttcttagattcttgtagttacttgtgtgtttttagttcctttaatttcttgcttaccactttggtgatacaaatcatgatactgataattctataaactctctggacatatatttaagtaactatagcatattaagccaacaaaagctaatggcctcatatgtctatattcatcacttattaaaataatctgtattttcatactctggtatcgcttcaaatcatataaatcaccttttacttaataaaataatctgtattttctgtgaagctatataattcaaatttagtaaattagatgaacaaatataaaaatgccttttagagtaaattaaccatttaatcactatctgtaatagtattgcaccggaaaatttaatcccatggttaattgtattgataattttataaacctcattgaaaatttacgggttcagacacaaatgtataaatatcactctgtattgtatgtatgctatgaaagtgtttttttaagacatctttttctttctgtgtcttaccataggctacatatcgaaatcgaattgtgagccaaaatctcagcacaagggacagaaaagcaatacatactcccaccgaggaccgttttaggtattcggcagcggaccagacaagcccctacaaaaacaagacctgtcaactcccaagtctctgtttaagtaatttcctgaaggacaaggaactagcagaagttatcaaacattcaagaggaacttatgaaaccctcacttcagacgttacacagaacttacgggccaccgttgggcagagctctctgaagccaacagctaagacagaagggctctccacgttcttagagaaaccaaaggaccaagttgctacggcccgacagcattcgacctttacaggcaggtttggacagccacccagagggccaatctctttacacatgtacagcaggaagaatgtgtttctccaccacaatttacacagcactgagctgcaaactctaggccagcaggatgggtaattaaatcaccgtattcctgtctttgggtaggataaagatggttagtgtttctcgtgcatagttcatattaaaattgtcatgtactttttcttacattttagttataaacagagttgtgttgttgggttttttttcttagtcataaacaaagacttgtgggttttttttttccaagagtgaaagtttgagcatgttaattgaactaggttgcattgccttgaagactttactatataggtgtataataaatgggaccatcatgatcgtttatatagtccataatttatttattttttatctctatcacttactgatatgcattaaggtttcagaagataatatcaaatagcaatctgttcactgttaatggtgttactataaaagtagacctgatgaaaaatagataaaggaattataaagaattttaaattatataattaatagaaggaggaaaaaagagaaatgttaacgtcttatatttggtggtatatttatttgaagaatgtggcttgcttgcatgtaacctagagatgtgtttgtctctattacatacattcaagctcatcttgtgatactagtaagggggaaatggctgtattttttttcctttaaacgtttagttcatactagttcacaaaggatttcagacagagtaattgctagccaaatagagaatgacagctctgatctttgaaaaattttgcttttagtttttgttattgatgttgaagtaccgtgacataacacaaggtgataaagttggttgaattttgtcagatgatgcataaatactgacatgctatattctttgagccactgtcatggcaatataaacattttttcaaaatttcaaggatgaaacatcctaagaaaattattctttttctttactttccttattttttaaaatgttcttttttatgtaaatccaattttggtttatatacatcaacccatatctataattttatgaactgaagaacagaaagtcagtattttagtagccagcatacaatattctgactatgcagaaatctagatttggaacaaaagtaaagtaaatgtgaacattggcaatttaatcttagaaataagcttctaacaggaatatttaaaacccatttgatggcaaatatttctctttgacaaataaggcccaaatatgttataatatgttatatacttatgtgcactttagatcaatatatgaattgatctatggataattccatcatgttcaattagtagcagagcagaatcaaagagtacaattgaatacataaataaataatttttaaaagactaataggaatcaaggctgcagttttcttatacacatcagagctgttaagtacatccacattagccatagtccatgcaaattgaaactgtcatacctactgcatgatctgtttcccttgcattttctaacagaatctgtcagcgtgcacaagcaagatgaacaaagggaaattgagatagcagttttagcatggcatctgacaacttgcttaaattaaagctgtgtgcaaaatgcatctcctattataaaaatgtatttgtgccctgtgctttggggaaaagccattagacactccacccctgagctttaactactgaactttgatacatttgcaaacttagattggaactgataaagtaaggagtcgagtggatatgttgtacttgtaattttggttttccaaaggaacacacatgtgcatcaaggcagacatttgccaaatgttttctttctttgcgtgtttgtaattctgccaaaagagaacaatatacactgcaaattgcttgacttaatgagattgccatctaaagttcccaccatactttggaagctataatgatcatgcagatatacactttgggctgggcaatatttaagaaatgataggaaaatagaaaaatcatgattattaattgtggaattcagcttgatttgtcctaaatgttggtgtctgttgctagagtattttaaatctgtacataaataagcatgataaaataatcaaggattttttcccaggatatggaagaactatgtatcacaaataatgtttttgatttggacttttggagttgatagttttgttttcctggaagatagacttttgaattatactttataaaaataatctatttatagaagatctgtcatttaatagacattttaagagatgttttaaacgctagtattttcttgaaaaatcttttttaaagctgaatcattcaaaagaaaacctggattaaacagttcgattttaaaaggaagggtattttttggaaatatcatcttaaagctgttttgtatcagtattttcaacattgttataatattatttgtaatactaagtgtaactcaggcctggagaaggtgtaagcccactatgctaatgtacatcagtaactgtaaaacaggggttctttgtaagttcctcttgtgtatatatagtaacttataacaatggcatgtgggcattctttcagtgaattgctttctttgtactaaaatctctagttttctaagacagttccatgtataaaaatgatttatgcatttctccaaggcggtacatatccaaagacatgacaccagggggaaaaagtgcttgtttttctgatggaagcagtggtcttttcttttctttcctctttcttttgtgcatgtgtatgtgtagctaagcctaaataaccctgtaaaatttctgctgcaaattgtctcttctgaatttagaatgtgttttaaaggaacacttaggaagagaaataccttgaagaaaagctgtttccacctgaaataaactgttcccatttttataattattggaacatgaaactgtatttctatgaactcaatgatttttttccataaaattatatgctaagagagtcaccacaaaactatgaattctctcccgaattatttttgcttctttggagcaccatagtctttgttcaaatcacaacatgaaactgttgctgcaatgctaaagatgtgaatccaccactatcaatacggtcagggtaaaacctggagccacatgttattcaagttatttttgttatctaatgattgacatgaaaataaaatagtaagccaatattaatttgtaggcatagttgccccacttaaagtgtttacaaagattttcatgattaatctgggtttatgatttaatcctaactcattgtcattatttcctgaatgttgaactcccattataggaaattccacattttgttttgttttctttgtcttgtttaatagagataataaccatacacccctctccagaaaaaagtttttaaaaattattatgatatatttaagattcacatgcccaggataaatgattacattccactagccctctcaaaaactttcttggcaacttagttgttgattaaacagtaggaacagtttgctgaatggttaggattatctctgcacatcattcgtcatcatcagcttctcattataaagaaatagtaacccatagcagtggataatttggaatacttagcataatctcataattataatctaaatttttactactttttcactttcagaacttaacattctaaacagctatagaaggaagtggttcaaaataaccctaagattccattgaaacatatacacacagatgaaactagaaaagaaagggcaatacatgtgaagatgatatctatgattgccattcatgttactgaatcacatgccccataatcagaagcttttcccttattgataatattagctcaaatgtagcacccattcatttataccaggattttgattgctatctaagacttgactttatttaggcattattatcagatcctgttatgtattttcatatgcatatatatatttttgtataagaagtatttcaatcacatgtaatattcttgggaaatttacctctcctagagtttaagctttttaaaacatgtcttgtttctttctcatgtggtaaatttatcatgacaactctaggctgtagaaggcgtaatataaaatacaaactagttttggttcttataaaaggctgatttcagttaagactggtcatttttttaaaaagctgaattacactgtagtataaaagcaaacagtcaactaagcaaccaaacaaaacagctctcttctttaataatattcatcattgccaaatgtttatttttgaaattttgttctgtgccaacttgtttcaccatgttaaactgcatacatacccatgaactatttatttacaatacatttgatctcgttaagaccccagttctatttccaaggcatgcagcccaaaaccaaaaagttaaaagatgataacactctgtggttgaattacctatggaaaagaatgaaggcagttcactctgtttaagatgtggagaatttcctacaaatagttaaggtgaaataaaatcattaatagagagtaggttccttccatttgagtaagtgatctagaatatgggataccacggttctttttagagcattttcagtgtagcctcattaacttctccaatttaatacgacatacatacttcttccacctgaacataaaattcaagaataggagcatcctacatctttcattctttccaaacattacctctttagtaaattcgggttgctataacaaaataccatggactgggtgactaaacaacagtcacttgtgtctcaagttctggaggctaggaagtctaagattagggtggggcagaataaattattggtgaggatctgcttcctgatttgcatgttggagaaagggctctggcctcttcctcttctaataactacaataatttcatcatgggggccccaccctcataatctcatctaaacctaattacttcccaagcgccccaacttcaagcaccatcacactgggggttagggcttcaacatatgaatttggggggggatataaaaatttagtttatagcactcattttcaggtcaaagagcccacttccctaatcacatacttcaataactagttaggtaattattgttttactcttttgtagattagatcagagacattaggtaacttgtccaggacacacaacatgcatttttaattaaattggatttaataacccttgaactttccatttatatcatgcttatctccagaataggatctctcctaaggaggcagagtgatttaaacaaacatgtgctgcttcaatctcctttactcctaaacttccattgatattgctagggacaaaaaattaagcaatgatctattttaggaaatcaaaatactgttcattgaaaagcagttttaaaacaattattgacatttaataaatacagaattttcagagggcatctcttctatttcaaggttacctcccagaaaaactgacattctaattttcttctcttgaaagcaattagaaaaaatgctaagaaatgattttatattttttaaagtagagggccaatgaagtgtctaacaaaaggaaagcatacagtaaatgaaaaataaactagttatcagattgtcttatatctttccttcataggacattgatacagacatcatcaaattcctgtttgtattgccttatacatacttaaaaaacaagatatttacaaaaatattttagatattcctgtctaggaactaaaattacagctgatttagaatttgcttaattattcagaaggaattgaagtgaaatgaggaatacaaatttacttgtcctaaatttttaaataaaatgtattatattttgtagtcaattatatataccaaaataatgtctgaataagacgtaatcctgtcatgagttctctcttccaaaaaagaatgcaagagaattgattatcttagttagaccccatttttaaggaaaaaatacaccctgtatgatacattcttagatatatgggtttgagattattaacattgataatagtttttttaattcatcatctctaaaactctaaaactttagtgagaaagataataaatagaaaattaccctggaaattaaaatttttagcaatattgaatacagtagtataattttttgtggctcttgatttcctaagaaaaatagtgatttttatttaatgaaaatttctcaatttggttaatattctaagaaaagattgatatatttaagcatggtgattagaaaaatatgcatatttcctgctcataataaattttaaaacaacaaattagttgtgtggtacctgattgctttcaatatgacattaatttgttttgaacttgtcttgatgatagattgagttacacatgcattcatattgggcataaagcattgtgatttacttctaggttcttgagggttgtgacaattggaaaatgacaaatcagccacttatttcatcagctagttgacacaatttatatttctactttcctcaccatcaggctttttaaaatttctgatatatagcaatactatgcaatggtccccagggaccattagaagaatatactgctatatttaatgtcaatagatctataatatagtataaaaatgctatactatttttatcttcatttattaaaactcattacaattcaaaattcaaaatatatttcacaccattttgactttgtagtttaagaaaccctgtgacagcacaaaaatgcaatttttttttctaagttccctgtctttatcaacacgcacacacacccttggagttttaaaaactggtagaagatggatgattcagtacagttactgaagcattcgaaatgatacacgtatatgtttccatttggcatccaaactggccaacagggaagaacatacagttaaaatgctcctgcaatgcctcgaaaatacactccaacatcttgtgtttacagggcctcacagcttcacagtaaatagtgttcttctgcagtgtactttcatataatgcaatttaaataagctgaaacaaagcattatggtatattttataatttataattaatgtgatgttatagtttaagaatcaagccattttcctgatgataggaagaattatttttaattctaaactttattttctataaagcatgtcaataagcaatgtatatgttttttctattatattactgaaggtgttaaactttagagttgttttgaagactttatgagaactcaaactctatttctggaatttattggtttattttaaaaaccctttgattataattataatcaatcaacacttttgtagattaattatgtggatatttctctcttaaatttcagtcatgaaacagtagttttaaaatgtttaaaatgaaatattgatgtatctagtacttactattcatatattctttcaaatatcctcattttttatcttattttaagtgactcttgcatatctcattcccttttatggttcttacttctctaatatagcaaatgctttgacatttgtagtgatattatcagttgaacaggtatcatagcattttatgtacagaaatgacacaagtgaatattacagtttaagggggatttaaagttctaatcacttttcagaagatgtttgtgaaaagtgagaaccaacttttagatagaaagttatttgagttattactttatccaagtgtaatgtttgatttagtttcatttgtaggcctttacccaaaatttaacaataagaaagaatattgctttattttaaaacactacttatattacactggtagtcatatgaccaaaatctaaaaatatcaaaataataggatgttaagaggtgcttctgaattctgtggatccaacattatatattttccattaaagaagagctggaaagaaagggaaatatacatgtaaacccagtcttgaattcttctggtgaagaatgaaatgtgaccataacctgtaaatttgagctgctatcatttttcaactaaatggctgattttaaagagtctatattaggtcagatgctggccaaagttttatcttcatacaaacagaccagatagcttaagagtggacctgacatctttagaccgaaacaaatacctcttagtcgatttgataaagctgtagcaccatcttaccagccatcatcactgttttgtttataagttctatcatgagaatattatattggtaaagagaacatggctgggcctgggaaacatggggaaaccccatctctataaagaaaaaaaaaattagccaagtgtggtggcatacacctgtagtcccaacaacttgggaggctgaggcaggagcattgccggagcccaggaagtccaggtggcagtgagccgagatggcatgactgcactccagcctgggcaacagagagagatctgatctcaaaaaaatgaaaaaagaaaatacggctcatttgcagaggctttcatgtctccaaaagctgcaaatttagatattttaagccatatattcaagggttgttgttcatgtagaaagtaaaatgaagagtggcatttacaatcacctaagaatagatgttgtgtggtgggattatcacatatgttgttgaaattcaattccaaattgtaatgtaaaagttggagagccaattgaaagtattagtagaacacaggaagttgatacaggatatttccagatcaactgagacaaatcaacatctgattattcagtgagaataatatcaacccatgctttcagacacaagagctgaatgtgaagggttttggaagaatcttttcataacgaagcccagaaactgatgaagccattcacataaactcattcatatgacaggtaagctcattacatagctctaggcaatcacgctgttgcatttgaggtaaaattggagttactgtaaatatgcaatttggtttcatcctaaagaggcttatactaatctttcaaaggatgttgtacaaacacttcttagaaaggaactgtctaccttattggaaatatggattcaaatatatatactgtgaatcacccaactgtagaaggtgattatacactttcccaagatatttgatgaattgtaagggacttggaaatgtggttaggaaaggaggaatttgtatcattgttcttaaaagcaataacataaattgtagaattatggtctagtcaaacactgtgcccttaaagcagtcacatatgtccatttgtggtagctctaaaacatgttggagaaatgaatctgaaaatattctgtgaatagagcagttgaagacagcttaatgtctgagttcaaactccatctgacaatttcttgtcgtgtgcccttggagcattttttatctccatttttccttctatgaaatgggataataatgggataccttatatgattttcatgaagactgaaaaatagggcctatcacagactaagaagaatttagatgcttcatcaatcacttaccactcaatcaatcatttgcctttcctagtaagtgggaattctttgaagcatttggctttctccaagtttatcaacccatgagcactgatgatgctatcatagaaaaaactaagagaaatccctagaaaaatatcaaaaattctataatctctgaaattttcaaatttttcacgagtgtttttttagtatttcatgattaaaacactgttttgataatgaatggatttgcacaaagacttctgaaatttctgtattcttttaaaaaatgaaaacttatctttagtatcaagttctttggttaccatataatgtttcactaatgtttatcttgctgaagataatgttgcttccaaacatggggagcctaccacatgtttaaaacaaaaatgtttcaagcttttacagagctatttattttttactatgttttgtttcatacacacagaaaaacatttcctgttctgaaactgcttcattatctattaaaaacaaaactcatgagaatgcttgctgaagtgttagtaacttactgactttaaagagtaccatagtatataacaatgaccaaaagccactgtctcttaacagtatgttgtgctttagctgactactagaaaggtaaaatgtaatagcaaagattttggccattgtatttattatattgcattttaaagagtcagggtgttccaattctatttctccaatagtcctttaatgaaatagcagtcttataaatcacctctcattaggctttctctctgtgtgcatggaatccttaaagcttacattagtaataataaattctgaaatttccactaaaagttctgatgttggaagtcttcctaatctatactttgagtaggcaaaatgacaattgaacataggatttaaaattaatagggttgcagtcactcagaggaatgatctacactataaaaatctatccttttttaagaattaaggacaactttagtattcctgaataaaaccattctgttaactttattacattacatgaataatcagctttgttcatgcatttatgcgacccacgtttatgctggttacctaccatctgccaaatagtgtgatctgcacttagggtgcaaaacagaacaataattaacctatatttaagtgttttacatatatacacatgtatatatatgtatataatccacacacagtgaatagaagctttgtctagtagctgaaataaatttttattaattgtaataatgcctaacaattactgagtgatgttctgtacaggtaggcactatattagatactttacataagtttttttaatctaatctcacaagaaggctttgggtaaatattcatattattattcctattttgcctttgggaacaataaaaattaggaagttgtcccaagtcacacagccagtaggaggtacagatgactgttatatcaaactgtgctattctatattaacatagaacagagcaaaattatttcttccagagttattaagaaaggtttgtaaataatctgtgcagacattttacacttgaaacagaattttgagatggaaaaataggacaattatgagttatcctaaggtactttacctactagcatagaaacctatggacattgaatatggaatttagactgatagagcagtgaattccagctgtatacattactggttatataaacttggcaaaattgttgatttgtatatatcttaacttttctgacacgtaaaattgtggctaataatttctaccacaaaaatttactttaaagattaatttcgataatatagatgaaagaacatcacaatagcttacaggtcatttatgatccttctaattcattttttccactctctttgttctacaaaattagcatgggttctcaggcaattaggaacgtatatgactttggcaattcttatgaagcagccttaaccaagcactttatttcatttatttggaatatcccccattaggtataaatgtgcaagaattttgtggtattctcaaactgactcctggaagcaattaagaaatttgctgaagataaggttcacaggagtgatagcagggagagtgttagggctataattgctgggccaattcacttataattaacttagtattaaaaggttagctctgtagtcagaataatcttattgcaagttgtcctaactgtacaataattctagaaattttgagagaactcaaggttaccaagcacatctcataagattattgcaaacttgtttttaaaactaggggtaggaacaatataaaaagagaaactcatagacccattttctttctttctttctccctctctccctctctctctcttttttttcttttttgagatgaagtctcactctgtcgcccaggctggagtgcagtggcatgatctcggatctcagctcactgcaacctctgcctcccaggttcaagtgattctcctgtctcagcctcctgagtagctggaactacagatgtgcaccaccacacccggctaatttttgtattattagtagagacagggtttcaccatattggccaggctggtctcgaactcctgaccttgtgatacacccgcctcagcctcccaaagtgctgagattacaggcaggagccactccgctcggccaccacagacccattttttaatgaatatacaaaaataattccaaagaaagtattacacaactgcaccaacattaaacagaatatatcataatcatatagggctcataccaagagttcatagatgactaacataaaaaataaatgtgatccataataaaaacattaaagaaaaaactcataattatttcaattggtatcttaaaaaggctttgataatgactagcccatatttatcacaaaaaccataactaatttagaattgattgaatttgtaagggttatatactaaagtcctactttaaaatatgatggactgtctgttctagctccaacttataaagatcttggaaataatcattcccatccttacaacaagggaaagctaaacaatctgaaaatcaatgacttttcttgggccgagagcaagacaactaggttgcaagtcaaacaacaactctgtaatatggtaagcctcagatccgaagagtcatagccaagattcccttacccagagaagacaccactgaagatataaactggtaggatcacttagatagtaattttaatgaactgctggggtttgatactgaactagagtaagagtgagaaactcaccggaccacagttttgtgagtatcccacacttttgtgtattttttatccaggaaacccacaaggctcttgtgacaaagatccaagaattacctcctcctctctacgactagaagagaggaataataaccattgtaaaatattcccagagcattctacttaacaaaagcctgcccctccagggaaaagactttactggaaacatcccatctgggggaagggcatttctctcactccagctcattctggcttttttgtctcactaaagaggtggaagttgagacaaacttgtgaaggtcctgatcccgaaacaaaggacggagattttatcgtaagattttagaaggcttcctcactcttccgatttactactacaccaacagggctccaatagaacaatggcttatggctgaaattgctgcaagatttagagtctctgaagggaagtgcttaagaaaataaaagttaataaatgagacaaaaaaggagactagaggactattaagcatctacctcctatagctacagaaaatgataaacacaggccaactcctagataagttaacataaaacctcacactatttaccttaatttttattatcggatacatcatgtttggctttcagcaaaaaaaattaagcatacttaaaggcaagagaaaaacatagtctgaagagacaaagaaggtatcagaatgagactcagatataacacatattttggaattattggacaacaaatttaaaataacttatcaatatgttaaagtctctagtcgagtaagtagataaccttcaaggacagatggataatgtaagcagagatatggaaactaaaaaaaaataaaaataaaaagattcaaaagaaaatgctaaaaataaaacacattgtaacagaaatagagaatgtgtagggtgagctcatcagtagactggacatagtcaaggagagcatcagtgagcatgacagcaagtcaacaggaacttcccaagctgaaatgcaaagagacaaaaaatagaataaatagaaactgagtacaacacccaagaactgtgggaaaatttcaaaagatatgagacatgtgtaatatgttcaaggaggaaaaagagaaatgaaacaggcgagaatgatggcaaactaggagacattagccttcatcttcctagaaaaaaaaaaaaatagaaagctatccgagaacagaattagccccgagaaggctcaaaagtccaattaagaatcttcagcaacacaatggagcaaaaaatggacaatggcagcataaaaaggatcacggggaagataagcatacctgagatgtctagtgacacctagaaacaaagaagggaaggggttatccatagcagccacatggcagctgccaccacagtccttagtaacctgttgtgcagaggatcccagcagtcattgccactaaggatctcaacaacagctatggaagccacagactcccacagctttcacaacagagctctacttcagtggagtgctctgcagaggatactgggagctttaggaactgaggtaaccaacaatcatcaccagcataggccccctaaaaatgaagatgctgctgcaccacccaacagaagtgagctgctattgcaccatccagggactagggctacactgcccctcccaatgcacactctgaattctgaagccatggtggatctgcacacacataccccagaccccagctctgtatggcactctatgagtgcctttgcctcagacatcacagctactgccagagggtactagcctgcactctgatacctggagctcctgtctctctacatgtgcccaagctccagactccagttctgaggtcactctgcacatgcctgtgcctccagttcctgactctgcagccactgagagtcagtctgtgtctaggacactggagccatggctgcagtgggaacttctgtactctagaccctggagacattgtacatatgcttgtgcccacagtttcaaacccagctgcctagctgttccacaagcaaccccaccttgcacaccgttaccaatgacacagtgagagtgcctgcatgttaagaattagtgtcaccactggcctgagccctagagctgaagttcctccatgtgcattcacactccagaccccagttctgtggccactccacagagatcacatatcagacaccagtaacatcaccattgcaagtgtgtctgaaaaccagactcagcaccaaacgggatccccttagccacaacttcccttgcagaagaaacaaaatactcatgacaccagcagctgtagatgctgctgcagatattcatagccttggccactgaagacatctgcaaatttttattgacactgatgacgcttaacaaaaagtgcactattgtgccattactgaagcaagaactggtgcatcccattcagtcggcaccctcactttcactcataagcaggtgaaaattgtccattaaatctggagaaggttactgttacatcaaatgtgcagacatcaatgtaagcaacaacaacaacaaaaaaaaacataaaaatcaaggaactatgacaccaccaaaggaggacaataattttctagtaattgacccacagaaatgagtatctgcaaattgctggacaaaaagttcaaaatattttaaaataaagtacagagagctgcaggagagtgcagatagacaactcaactgtatcaggaaaacaatacatggaaaaaataaggtcaacaaaagagataagaaaagaaacaaattctggagctaaagaatcaatgaattatataaaatgcaataggaaacatcaaccatcagaacaaagagtctgtgaagttaaagacagaccactttaaattagtcagagaaagaaaaaaaatgtaacaaacaaaaataatagaaagggaaaagaatgtgaaagagtgaagaaagtctatggcatatatggaacctcatcatatgccccagtatacaaatactgggaacaagaaaaaaaggaagagcaaaaaaaaaaaaaaaaaaaaatggcagaaagcttacttaatgaaataatggctgaaaattgtccaaatctgagaagacatatggacatctagatatattaaaaacaaatatttataaacaaagtaaagccaaatatatcttctctgagacacactataatcaaactgtcaaaaattaaagaccaaagatagaatttttgaagcatcaagaaaagagatttatcatatataaaggaaactccagaatgctttctgccaatttctcagcagaaaccttgcagcttgaagccttcaccagaagcagatcctgaggccatgctgtttgtatagcttgtagaatcattagccaaataaatctcttttctttataaattactcagcctcaggtatttctttaaagcaaaataaaatggactaagataggcataaatttaaccaaaaaggtaaaagttctgtacactgaaaattgttactgttagtttatactgacttaatcttcttactgattattgattctgtgatatcagttgtaatgtttcctctttcattcagattttatttatttgagtcttttggcaagacctagactccaataagtcactttcccaaatgcctcatatcttgatactatcatcttggggtttaagttccaaaatatggattttagagtgccacatacattcaaactgtagagtatgtggaatttaacaaaaaggtgaactcataaaaacagggagtagaatgatggttatctaaaattaatgatactatacttcagattcaggaggctcacagaacaccaagtagtacaaatttatttaaaattgtatagctagacatataatattcttaataaatttgaaagataacttttttaaaagaagcaatagtaacattgtaaatggtgatgtttgacatggcatttattggtgaaatatgttgaatcatcaaccaggatagacaagctgttaattttcagtttattatccaaattttcttcagcatcacataatacgtcatgagtatgttgacttattatactatttgagaaacaacttttcaacttgtcatactgcatctcattcaacattttagtcagtataattttgtatggtgacattattagtctcataccaatgatatgcctgtttgttatcttggtgataaactctgctactaaataccttgtattttgtagctttttatttaatttgtggggttttttttcaaaaataaggacttcactgtgcttgtttaaatagtaaaatagccccttaagaaaacatgaacagaccaataatgagtaatgagatcaaagcagtaattaactttcctttcaaagaaaagctcagaatctgatggcttcacagctgaaatctaccaaatattttaaaaagaatgaatactatttctattcacactattattaaaaaattaaagaagaggcactatttttaaactcattctatgaagctagcatcaccctgataccaaaatcagacatggataaaacaaagaaagagagctacaggccaatgtccctgatgaacatagatgcaaacatcccaataaaatgctagaaaactgaattcaacaacatattgaattgaacaacacattcaccataatcaagtggattcatcccaaggatgcaagaatgtttcaacaaatgcaaatcaataaatacaacattttacattaacagaatcaaggacaaaaaccatataatcatttcaataaatactgagagagcatttgacaaaattcaacatccatttgtgataaaaaaaaaaaaagtctcaacaaactgggtacagaaggaaaaaactcaaaaacaaaacaaaacaaataaaggccatgaatgagaaatccacagctaagatcatatggggaaaattggaaaccttctctctaagatctgggacaaaacaaagatgttcacttttactcagcttagtactggaagtcctaaccagatcaatcaggaataagaaaaaaataaaggacatccagattggacaggaagaactgaaactatccttgttaacagatggcatgatcttatatttagaaaaacctaaagattccaccaacaaaaaaaaactctattataactgatagacaaattcagtaaagttgcaggatacaaaatcaacataacagaatcagcagcatttacgtatgccaacagctaacaatctgaaaaagtattcaagaaagtaatccagtttgtaatagctacagaaaaaatacctagaaataaatttaacaaaagaagtgaaaaatccttacaaggaatattcaaaacactgatgaaagaaagtaaggaggacacaccaaaatgcaatgatatccacacttatgaattgggagcattaatagttaaaatgacagtaatactcaaagttacttacaaattcaatgcaaatcctatcaaaacactaatgattcttcactgaaataaaaaatcaatcataaaattcatatggaaccacaaaagacccagaataaccaaagcaatcttcagcaaaaagaacaaagctgaaggcatcatgctaccttcaaaatatgctacaaagccgttgtaattcaggcagcatggtgctggaataaaaacagacatgtggaccaatggaacagaatagagaacctagagataaattcacacattttcagccaacttgtttttgacaaaggcaccaaaaacctacattgtagaaaagacagtccctacgataaacggtgctgggaaaactggataaatgtatgtagatgtatatgaagctagaccctatgtctcatcatataaaaatctaatcaaaatttattaaagccttaatataagccttgaaattatgaaactaccagaataaaacatttaggaaacactagggcattggtctgggcaaagatttttgggtgagacctcaaaagcacaggcaacaaaaacaaaaatacacaaatgggattacatcaagctaatgtattgccaaggatataatcaacaaagtgaagagacaactcagagtgggagaaaatatttgcaaactatcgtctgacaatggtttaataaccagaatatttaagaaaacaactcaaccgcagaaaaataaataatccaattaaaaatgaacaaaagatctgaacattcatttctcaaaagaggacatacaaatagctaaaagttatgtgaacaaatgctctatatcactaatcaccagggaaatgcaaatcaaaaccacactgacatattatcttaccttttttagaatagctaatattaaaaagatgaaaaactaactgatgctggtgaggatgtggagaaaatagaactcttgtacactgttggtgggaatgtaagttagtacattagtacatagtgactctcatggaaaacagtatggagatttcttacaaaactaaaaatagaagttttatatgatctagcaatcctggtactggatatttatccaaaggaaaagaaatcagtgcatcaaaaagatacctgcacccacatgtttattgcatcactattgtgttcatcaacagatgaatgaacaaagaaaatgtgctgtatatacaacactgaatataacttagccataaaaagaataaaactctgtcatttgcagcaacatgaatggaactggaggttattacattaaccgaagtaagcctggcacagaaagacacataccacgtgttcttactcatatgtggaagctaaaaatgtggatctttgcagaaagttgattggtggttaacaggcagagaagcgtgggagaaaagggagaagaagagtggttggtcaatagatacaaagatacaattacatagaagaaataaagtctattgtttgatagtatagtaaatgggcaattatagttaacatacctcccctccagcaaaaacataatttgttgcatagtcaaaatgctggaggcggggtattggaatgttcgcaacataaaggtgtgaatgtttggtgagatgaatgtttcaattgccctggtttgatcattacacattgcatgcatatatcaaaataccaatgtgtcccagaaatatgtacaactattatgcatcaattctaaaaaagaaataagcacttttaattgtcaaatgcctgtgacttgtggttgagtgtgatttctactcttctagagtcatgttgcatttgtatgttgtttctcacatacagcacataatggaatagtataatttggattatcatcccttctcatgcaatatccactcataggttgctttcactatgaacatgttatttttagtgtatgtcccttgtatcactagtgcagtgaaatgactcagaagattttaattcttcataattaattttctaaataagaactttattgggatataattcacataccataaaattcaacactttaaagtatacacgtcagtgatttttagtatattcaagcagttgttcaattattcattattaaatttatcatatttgtccttagggcaaaaatgaaatttttttttcatatgacaacatatatgtaaaagttacctaattggaccatcagacatattttaaaatacatgttctaataaaatataaaaaagaatactgtaaaaaaccaaaaattaatattaacatatagtattaatttaatattaaaatataaaatcttgacataataatttacttctgacatccacaaactaagttttggaacattgaggacagtaaagtagatgggggaagataataagcagcacatacaacttgctactttaaaatgagtatttcccatgacttttcacatacactgagacaacctgtttgtttgcataagaggagattaggaaagtaatttatgaaagaaaaactgaggctaccagcctaccatactcccttagtgcattacagtgctcacctctacattatatctataattacatccatatttcattaaaatctgagaataaactcaatcaactgactgctttctactttacactgtcctggaggactgaaaaatctctaaaacactgctaatgtggtttctcagtaacctcatcactgtaagtgccagtatcacacaacacgtgatgttaaaaaaaaactatatatttttgcaattgccacctcttgatgaacgattactgccatctcactgaactttagggttccatgtaaccacagttgtgtggcaagcactagagatgtagcaataaatttggtgttctttgcctagatctctttacatgtataaagggtattctttgcaggcttctgtttctgattgattttctacactcactctctccttcctctgtctctatcaacttctttgacttttttttcctccatccttaagcattatcttaaaagtctaaaatgattacttaaacagttaagatgactaaccaatgctggacttggtataaccattaaaattcttgatgattagttacattgatggtattgtaaatgtaacaatattcactggaaatgggataatttgtaaagcatgatgacagttctttcatcagatatcatattagaatgtgtttatggtcaatcagtacctgaaaatgattaggttgagaggctttaaatattggaaatttatattttctcttggcaaattttatgaaatgtctacttagtggtctgcactattttaagcccttgaatgtatagtaatgactagaagactactcttgagttcccttctctcaaggatatttcattccaacaatgcaggaaaatccacatagtattttcttttcttgagaaatgtcccttcttaggtcctgaatcgaggtgttcatgttttactttcttcattatagcaggcaaagggatgcatcctcattccttttctctttagatatcacagcaattctagaccttttcattaaatctaactgcaaaaagggatgcaatcgctcttcactggtcctttccttgtgacattaatttaagtattcaagagtcactaagttttggaattttgatagtattcggtatggaagagaagacagtacacttgatttgtcggtaagataacactggctgctttaacaaataaactccaagacctctattccttcaagtaaggaatagaagagtagcccctgaggatggatgcctttcttccaagggctgaatcagagacccaaactcttttcacatagtggctttaccatttacaacattttgacttccaacataagtgtgtttttctataccaatctggcacaaaggaaaacaatatgaagcatcctgtataagagattttttttagaaatcaggtttgtaaatgatgcacacaacttctgctcatattccatcatctaggacttagtctatggccatacctactaggatgattaatttatgtgtcatctggagtaggacatggctgctagtttaaacatctctggatttgtctgtgagaatgtttccaggtgagattagcatttgaatctataaatttaataaaagtagattgccctccccaatgtcggtgggcatcattcaatccactgaaggcctgaatgaaaggaaaggtgaaggaaggaggaatttgtgccttttttcctgcctcactgcttgatctgggacattcatctcatcttccttggactagggcttacatcatcaatttttagactgacagtgaattataccactagatttcctgggtctcctgcttgcagacagtagatcttgggacttctcagcctctgtaatcatgtaagccaattcttcataataaatatccttttattatatacatatctcattggttctgtttctctgaagaaccctgactaatacatttactttcaagagaggcgagattcaggaaatttctaagactattcatagtagcagactgatgattaatacttacacatctctatagctatgaatcttcttaaataatctttatgacatcagtgattttgtctgtttataccactcagcacataaaggtgctcagtaaattaatgaataagcaaattaaaaaagaacaaatagaaaattgattaccttttgattcaagtgaacaactgacctttctgctagttgacattcaatagaactatgaatcacacaaaggttagatttgtattctcccacttattctaagagagaataacatttaaagaaagaagtgaaaaatgaaatgaaaaataagccttaattgtatatctaccagatactctttttttttttttttttttttttacacagagtctcactcttgttgcccagtctggagtgtaatggtgcaatttcggctcactgcaacctctgcctccaaggttccagtgattctcctgcctcagcctcccaagtagctgggattacaggcatgcaccgccacacccagctaattttgtatttttagtagagacgggttttcaccatgttggccagattggcttcgaaccactgacctcaagtgatccacccacctcggcctcccaaagtgctgagattacaggtgtgagccaccgcacccagcatatattcctatttctttaacttcttccacataagtgttaaaggagaaagagggaatctaacaaaatcattacacagaaattggaaacttattatgttccacgagaattaaaatatgatgaatatgatgctgcccatcagcaaggagaaattcctatgattgtttgttgcagtgacttttttcttttttaccaagattaaccctctttaaaaaaacactgtgtttgaagacttttataacctctgctgtttgctgcaaccccaaaactggagaaacatcttggatccaaattcccagtcagtgcattgaagtgaaacttacagtattatattcctaacactgtcaaggtcaagttgctagctgaccatggacacagcccttactgcacccaacaaactagaagaaatgctcttatatctaaaagttacatattctctcaatttccagtaatatggtagatggtttagaagggccaaactgaaaaagctgttatgacacagaggatatttttacatgtaaaaatttaaaagacattaactttataaccaaataatgtgtgcaacacacatcactgattcctcctgtcattctgacttttattactaaggtatgtgaaaatgcagtaagcattagggatgaggcagagaaggaggtaaaatttaagaagggggatcaggagagggtgaaatcacagatgatctgcacatcacttatgggacccaccactactactgccaaagcctgtgtgtgtcacccggtggcaaaaggaatggcctgcctgaagcctattgctgccatggctgatgaacctgcctgctccagcagcagggccgtggaatgccaatgtgcttcccctaggtacctgaggaccagtttgcatggcatgcctggacccagcaaagccactttatagcctagaaaaacaactacagcctatgcagataccattgacattgattacattggaagaagtcatacaaagactataatagcacactcaccagaaacaaagccaaagcaccctgccctgcagacactataaatgcatctccagaaaaaaatatttttcctaagaaaggaaagaagtgactgttaaaccagaggcacagatatcaaagtagaaacacaggacacgtgaaacagcaaggaaacatgacacctccaatgaaacacaattcttcactaacagaccttaaagaaaaggaaacctaaaaataatcctgaaaaggaattcaaagtaaagattttaagaaaactcagtgagacataagagaacagagatacaaaatacaaataaatcagcaaaattatttatgatgtaaatcagaaattcaacaaagagacagctgtcaggcctctgagcccaagccaagccattgcatcccctgtgacctgcatgtatacgcccagatggcctgaagtatctgaagaatcacaaaagaagtgaatatgccctgccccaccttaactgatgacattccaccacaaaagaaatgtaaatggcggtccttgccttaagtgatgacattaccttgtgaaagtccttttcctggctcatcctggctcaaaaagcacccccactgagcaccttgtgacccccactcctgcccgccagagaataaatcccctttgactgtaattttcctttacctacccaaatcctataaaacggccccacccttatctcccttcgctgactctcttttcggactcagcccgcctgcacccaggtaaaataaacagctatgttgctcacacaaagcctgtttggtggtctcttcacacggacacccatgaaatttggtgccttgactcggatcgggggacctcccttgggagatcaatcccctgtactcctgttctgtgctccatgagaaagatccacctaggacctcaggtcctcagacccaccagcccaaggaacatctcaccaattttaaatcaggtaagcggcctcttcttactctcttccccaacctctctcactgtccctcaaccactttctcctttccactcttcaatctctcccttcccttaatttcaattcctttcattttctgggagagacaaaggagacacattttatccgtggacccaaaacgctggcgccagtcacactgggaaggcagccttcccttggtgtttaatccttgcagggatgcctctctgattatacacccacctttcaagggtgtcagaccacgcagggacgcctgccttggtccttcacccttagcggcaagtcccgcttttctggggaaggggcaagtaccccaaccccttctctccttgtctctaccccttctctgcttttctggggacagggcttaatttcaatttgtttcattttctgggagagacaaaggagacacattttatccgtggacccaaaactccggcgctcgtcacggaatgggaaggcagccttcccttggtgtttaatccttgcagggatgcctctctgattatacacccatgtttcaagggtgtcagaccacgcagggatgcctgccttggtccttcgtccttagcggcaagtcctgcttttctggggaaggggcaagtaccccaaccccttctctccttgtctctaccccttctctgcttttccagggacagggcaagtaccccaaacccttctctccttgtctctaccccttctctgcttttctgggagaggagcaagtacgcctcaaccccttctctttcacccttagcggcaagtcccgcttttctgggagaggggcaagtacgcctcaaccccttctccttcattcttagcggcaagtcccgcttttctagaggaggggcaagtaccccaacctcgtatctctgtgccccaatcccttatttccgcaccccctctctctgcaccccaatcccttatttccgtgccccgaccccttatttctgcaccccatcccttatttccatgccccgacccttatctctaagctgcaaccccttttcccacttttctggaaggtaagaacccccaaaccccttccctccgtttctctactctctcttttcgataggcttgcttccttcactatgggcaagcttccaccctccattcctcctactactcccttggtctacgttctcaaaaacttaaattcaacgcacacctgacctacaacctaaatgccttattttcttctgcaatgctgcttgaccccaatacaaactcgacaatagttccaaattgccagaaaatggcactttgaatttttccatcctgcaaaatctaaataattcttgtcataaaataggcaaacggtctgaggtgcctgatgtccaggcattcttttacacatcagtcccttcctagtctctgtacccagtgcaactcgtcccaaatcttccttctttccctctctcctgtcccctcagtaccaaccccaagcctcgctgagtctttctaatcttccttttctacagacccatctgacctctcccttcctccccaggctgctcctcaccaggccgagctagatcccaattcttcctcaggctctgctcctccaccctataatctttttatcacctaccctcctcacacctggtctggcttacagtttcgttccgtgactagccctccccctcccgcccagcaatttactcttaaaaaggtggctggagataaaggcatagtcaaggttaatgctcctttttctttatcccaaatcagatagcgtttaggctctttttcatcaaatataaaaatccggcccagttcatgacttgtttggcagcaaccctgagacactttacagccctagaccctaaaatgtcaaacggccatcttattctcaaaatacattttattacccaatctgctcccgaaattaaatgaaactccaaaaattaaattccggccctcaaaccccacaacaggatttaattaacctcgccttcaaggtgtacaataatagaaataagttgcaattccttgcctccactgtgagacaaaccccagccacatctccagcacacaagaacttccaaacgcctgaaccgcagcagccaggcgttcctccagaacctcctccccaggagcttgccacaagtgccagaaatctggccactgggccaaggaatgcccgcagcccggaattcctcctaagccgcatcccatctttgtgggaccccactgaaaatcggactgttcaactcacctggcagccactcccagagcccctggaactctggcccaaggctctctgactgactccctctcggcttagcggctgaagactgacactgcccgattgcctccgaagccccctagaccatcacggacgctgagcttcaggtaactctcacagtggaaggtaagtccgtccccttcttaatcaatacggaggcacccactccacattaccttctttttaaaggcctgtttccctcgcctccataactgttgtgggtattgatggccaggcttctaaacctcttacaactccccaactctggtgccaacttagacaatactcttttaagcactcctttttagttatccccacctgcccagttcccttattaggctgagacactttaactaaattatctgcttccctgactattcctggactacagctgtatctcattgcctctcttcttcccaatccaaagcctcctttgcatcctcctcttgtatccccccaccttaacccacaagtataagatacctctactccctccttggtgaccgatcatgcaccccttaccatctcattaaaacctaatcacccttaccccactcaacgccaatatcccatcccgcagcatgctttaaaaagattaaagcctgttatcactctcctgctacagcatggcattttaaagcctataaactctccttacaattcccccattttacctgtcctaaaaccagacaagccttacaagttagttcaggatctgcgccttatcaaccaaattgttttgcctatccaccccgtggtgccaaacccatatactctcctatcctcaatacctccttctactacccattattctgttctagatctcaaacatgctttctttactattcctttgcacccttaatcccagcctcttttcgctttcacttgcactgaccctgacacccatcaagctcagcaaattacctaggctgtactgctgcaaagcttcacagacagcccccattacttcaatcaagcccaaatttcttcctcatctgttacctatctcagcataattctcataaaaacacacgtgctctccctgccaatcgtgtccgactggtctctcaaccccagcaccttctacaaaacaacaactcctttgcttcctaggcatagttagtgcggtcagaattcttacagaagagctaggaccacaccctgtagcctttctgtccaaacaacttgaccttactgttttagcctagccatcatgtctgtgtgcagcagctgccgctgctttaatacttttagaggccctcaaaatcacaaactatgctcaactcaatctctacagttctcataacttccaaaatctattttcttcctcatacctgacacatatactttctgctccccagctccttcagctgtactcactctttaagtcccacaattacattgttcctggcccagacttcagtctggcctcccacattattcctgataccacacctgacccccatgactgtatctctctgatccacctgatattcaccccatttccccaaatttccttctttcctgttcctcaccctgatcacgcttgatttattgatggcggttccaccaggcctaatcaccacacaccagcaaaggcaggctatgctatagtacaagccactagcccacctctcagaacctctaatttcctttccatcatggaaatctatcctcaaggaaatcacttctcagtgttccatctgctattctactactcctcagggattattcaggccccctcccttccctacacatcaagctcgaggatttgcccctgcccaggactggcaaattagctttactcaacatgccctgagtcagataactgaaatacctcttagtctaggtagacactttcactggataggtagaggcctttcctacagggtctgagaaggccaccacagtcatttcttcccttctgtcaacataattcctcagtttagccttcccacctcaatacagtctgataacagatgagcctttattagtcaaatcagccaagcattttttcaggctcttagtattcagcgaaacctttatatcccttacggtcctccatcttcaagaaaagtagaatggactaaaggtcttttaaaaacacacctcaccaagctcagccaccaaattaaaaaggactggacaatacttttaccactttcgcttctcagaattcaggcctgtcctcagaatgctacaaggtacagtccatttaagctcctgtatagatgctcctttttattaggccccagtctcattcgacaacagaccaacttagactgtgccccaaaaaaacttgtcatccctactatcttttgtccagtcatactcctattcaccgttctcaactactcatacatgtcctgctcttgttttcactgctggtttacactgtttctccaagccatcacagctgatatctaccttttatacctgtttttctccttctcttattccatttagtttttcagttcgcacaaaaccgtatccaggccatcaccaatcattctatacgacaaatgtttcttctaacaaccccacaatatcaccccttaccacaagacctcccttcagcttaatctctcccactctaggttcccacgccgcccctaatcccgcttgaagcagccctgagtaacatcgcacattctctctccataccaccccccaaaaattttcaccaccccaacacttcaacaatattttgttttatttttcttattaatataagaaggcaggaatgtcaggcctctgagcccaagccaagccatcgcatcccctgtgacctgcatgtatacgcccagatggcctgaagtatctgaagaatcacaaaagaagtgaatatgccctgccccactttaactgatgacattccaccacagaagaaatgtaaatggccggtccttgccttaagtgatgacattaccttgtgaaagtccttttcctggctcatcctggctcaaaaagcaaccccactgagcatcttgtgaccccccactcctgtccaccagagaacaaaccccctttgactgtaattttcctttacctacccaaatcctataaaacggccccacccttatctcccttcactgactctcttttcggactcagcccgcctgcacccaggtgaaataaacagccatgttgctcacacaaagcctgtttggtggtctcttcacatggacgcgcatgaaaatagctatcataaaaaattcaacaaagagacagctatcatactagctatctagcatgtggggcatgctacgggctgtgtccatggtcagctagcatcttgagactgttgagagtataatgctataaatttcacttcaatgcactgattagcaatttggatcaagatgagtctccagttttggggttgcagcaacctctaccattctttaggagagaccacatttaagaaatcttgcactgaagagtttaatgaatgaaataaaaacacaatctaaagcttcaacaatagactagtcaagcagatgaaataatatctgaatttgaagacaggtcttttgaaacaaactcagaaaaaaaacataaaaccaaaaagcctatgtagtatatgagaaaatattaagtgaacgaatattcacatttccttaattctaaaaggagaaaagatgaaaaagagcatagaaaacctatgtaatgaaattggagctacaagtttcccaagtttgggaagatataggcatctagatacttgaggcctaaatatccccaaatatagtcagctccaaaaggtgctgaccaaagtgcattatagttttatggtcaaaagtcaaagactcaaaaagataattctaaaaacagcaagagaaaagtgtcaagttacatgtaagagaatcaccatagcactaaaaatggatttcccagcagaaatatttcaggccaagaaaggatgaaatggtatatttattgtgttgaaagaaaataattgttatctaataatactataccaagaaaagttatacttaagtaatgaaggaataataaattacttttcagacaaacaaaaactaagggaattcatcacttgactcactctataagaaacatttaagagaatccttcatttggaagagaaaggacatatctggcatcaggaaaatgctcaaagtataaaattcactagtagaacagataaaaaatgagaaagataaaggaatcaagcactatcactacagaaaaccaccaaaccacagagatgaacaataagaaagaaagaaataaaaggtataccaaaaaatcagaaaacaattaacaaaatggcaagagtaagttctaacctatcaataagaaaattgaatataaatggtataaattctcaaattaaaagatatagactggctgaatttttttaaatctacctataaataatacccaacaacacccaaaagtatgcaacactggagcatccagatatagcaaatgtcattagcactaaagagaaagatagaccctaacagaacaatgattgtggacattcacatcccacttacagcatttcactaaacatgtagattaaaaaaatcaacacagaaacactggacttaaactgcactatggaaaaaattgatttaacaaacatagaacattttatccaacagctatagaattaacattcttctcagcagaacatagaatgttatttaggagagactatattttaggtcatactgtaagtcttgacacatttaaaataatcaaaattatatttagtatctttttagatcacaataaattaaaactagaaatcaataacaaaaggaactttagaaaccatgcaaatacattgaaattaaacaacatgcccctaaatgaccaacacatctataaagaaattaagaaaaaatttaaaaaattttcttgaaacaaatttaaatggaaacaacatatcaaaaccagtggcgtaaaacagcaagttctaagaaggaaagttatagcaataaatgcctacatcataaaagtagacatgttttggccaggtacagttcctgcctgtaatctcactgcttttggaggctgaaattggaggatcacttgaggacaagagttcaagaccagcctggacaatataatgaaacccccatctcgtaattatttgtatgtatatatatattagttgggcatggtgttgtggtggtgtgttcctatagtcctagcttgtgaggaggctgtcgtagaagtatggcataagctcaggagttcaaggctgtagggagctgtgattgcaccattgctctccagcccgggcaacagagcaagattctgtctcaaaaataaaagatcttagataaaaaaaaaaaaacctaatggtgtacctcaaggaactagataagcaagaacaaaccaaaccaaaaattagtagaaggaaggaaataggatcagagcagaattaaatgaaatagagacaaaaagaatacaagatatcaatgaaacaaaaagttgcttttttttagaaagataaacaaaagtgataaaccattaactagattaaaaaaaaagagagattaccaaaataaatcagaaaagaaaaaggatatataataactgacaccacagctatataaaggataattagagactattacaaacaactgtacaccaaacagttgtgaaagcctagagtaaatggataaattcctggacacacataatttaccaagagtgaaccataaagaaatagaaaacctgagcaaattaataatcagtaatgagactgaatgagtaatgaaaagttccccaataaagtaaaccatagtactggatggctttactgctgaattctatcaaactttaaaatgaaaactaataccaattcttattaaagtatccaaaaaaactgaagaggaggggggagttttcccaaacctaatctacaaggccagcattaccctgataccaaaaccagacaaagaaacaacaaaacaaaactacagaacagtatccctgataaacatagatcctcaacaaaacacaagcaaatcaaatccaatagcacataaaaaagataacacaccataattaagtgggattcatatgaaggtgtaagtatggttcaatatatacaaatcaatgaatgtgatataatgtatcaattaaataaagaataaaaatcatgtaattatctcagtagatgtggaaaaagtatttgataaattcaacatcccttcatgataaaaacagtcaacaaattaggcatagaggaaacatacctcaacacaataaaggccaaatatgacaaacccacatgtaactcataatgaataataaaatagtgaaagcctttgttctaagaaatgtaacaagaaaaggatgctcactttcacgacttttattcagcatatactagaagtcttagccagagcaattaggcaagagaaaaagaataaagcacatacaaattggaaaagaggaagtcaaattttctttgacttgaggaagaacatttgaaagaaattgaaaaggcaaaaagaatggaaagacttctcatgcatgtgaattgagaacagtaatattgttaaaatgatctaactgtccacagcagtctacaggtttaatgcaatccttacaaatctaccaataacatttttcacaggtatagaagaaaaaggcaattctaaaatttatgtggaaacacaaaagaccccaaaaagccaattaaaccccaaagagcaaaaatagcaatgctagaggtatcacatcacatgtcttcaaaatatactacaaagctatagtaaacaaattagcatggtatttgtgttaaaacagatgtgtagaccaatagaacagaatcgagaacccagaaataaatctacatatttacagccaagtgaagtcaagaacatacactagggaaaggacaccaaagatgaccccatagaatggtattttgcagacttaccatttgcctctatgtaagtaacctcataagttatagtccatacagcaagaaaaacacaaggccggggtcagaatgtaaggctgccatacaaattacacaaagaaatatggagttggagacctgcttattataacacacaaacctaatcatatttcacaataatgttcctctcttctgtcgtactggaaaagtgcctatggattaaagtgtgttcggcgtgcaaaaggattgctcctgttttaacttctgctgctcgccagaggttatgaaaaccgtaaatccttccacatttgcacataccaccccttctcattttacttcgacatctacttctgccaagtccctacaggcatatactaaagctccagaacttaaaaccatcatctgggtcccagatcaccaaaatagcccatttttttttttcatattctaggctgagatttgtgtccacttcctcaaatgcctaaattgttgggtcttccacatgacaggaatttattaccacctgggtgacagtctaccacactgatttggcatagttaccactgttacaagacttcaaacttctcattcagctttaagattaggagagacatcttatctctcactcagatccaccctattctttacaatccaatatcttctacctttgaacaaagataaaatagtagtcctcagaaattgccctgcacttatagcgtcatggcacagccatccttatgaccacattgactggccagctagtatatttggattcagcaaccttaccaaaggtatttattgccttgatagtgactatattaaatttctttttttcccaaacctagtctctcttaaccttactatgaggaagagagtgatgataaagactggtagattaagctagatagtagcactgtttggtgtctgggttaatatattgaaggtagctctttcaggaatttttcttctggaagtaatatggagctgcaggaaggaagggaattaaaaacaaatcctgaccttttggtctgaaaaaattgaaaaaaaggtggcaacatttactgaactgtaagactatacaaagaaggttttttgtttgtttgtgtgtttatttggcaaatacaatataattaagacttatcttttggatctgttaattttgagaagctttttagacatccaaatggaaatgttgaggaagtagttaatgctattgccctggatatcaggagataagtcagagctgtaaattttaattctttgccatgcaggttctctttaaaccactggacttggtaagattatctagagcagtaatttgtgggaaaaaaagtagataatgaagaagtaaatactgtgggaggaaacattaataacatgtactaggaagaaatggccaatgaggtaaatgaaaaacaagaagactataatatcctgaaagccaactgaggagttgagtattcactatatcaagttatgcataaatatcaagaagtatgattaacctttccagctagacatctctcaacatgctggtcagaaaacatttatgtacaactcagcatgttaacattttttaacattacaaaggactctgtctgctgtcacaacaacttgtgaattatagtgcccattttttcaaagctctggatattactaagacatttaactgtccaaagtccctgatttcacatatttcctaggtacaaaattcttataattcacaagtattttatcatatacatctgtaaagctcttctcctagttgtctcctttccaaaacatatttgattaagctaaaaataaaccagttcaaggtatgttcaaacacaaggaataaaatcttctaccagatgtgattctacaatgaaatgtttgaaaatcagtttgggtaatattattaagcatcttgaatttcaggatgaggttttggagatgtttattttttataaattctgagtttctgagaaattattctggcagcgaaggcaggctaaatgagagaaataagacattagaggcaagggagctggctatttgattatcatacattaaaaaaacaaaaatctaatgtgggctcaaagaacagaaatgaaatacaggggaagatatacagctaggacttgaaaatgcaggaccaagattcagtggggtgcttggaaatagaggaatatattggagtttcacaggcagacaggaagtgattgaaatactgaagttagtaaaatgaaagaagagaaatgagaaaggaaagaataaaagatgagtatcagatttcataatgtctatatttatgggttagaggataaagaagagttatttaaaagactgaaaagaatggcataagaaattgcacagagagaagataatattgttaaaggaaaatatattttcatatttgactgttttggaggcaaaggaagacatagttgtatttgtagcctacaacagaatgaacttatacacttattgtccaaactgggacatttttgagagtgaaaaaagatgccaaataataaccatgctatttgatttacaacaggcataaagtagtactttccccagaatgctggatataacagtcactctgaataagaggagacagctaggggacaattgcagactatatccttgctaacaggagagtaagcacttggtaaactcagacaagagaggagaaacgaaatcaagcgcataagcagagtagttagctttgataagaaagagggagtgttcttcctaaacatcaatagaaaagtaagagtagcaacacaatggcccagaggcatttttaaatggaaagagggcactaaaggatttatctttagagcacctcagtcgttttagtacggtaggcaggaaggtcacctaatgaaagtaaaaggtactgctggggatttgaagattgcagaaagcttttcaaaggcccactgttggagatagtggaggaagtcaatatacactaaatgcaaagatcaccaagcagaatcaggatcccatgcacttttgtgacattccaaaaggataaacatatctcataataatagctactgtctagtgaatatttactatatgctctactgtaacatgcccacattgcattagtgacctttttttaatctcaaaacaatcctgtgagagaggtgttatcatttctccattttacaaaagaggatactgaggcacagagtgactaagtagtaagctatccaaggtcacacagctaagatgtgaagaggtatggcttaaatgtagtcaatctggcttcagagatgagggtcttgacctgtaagcacactgcttctcaaggttaatgttaactgtgtttagagtcataatacagattttagagtgggattcatctttagaagtaagtaaaatggttttgcaagatcattcacatatccaggggaagccaaatagaaagcattgcccagggtgagtgtttcttcctggtcacatttgttgaggctccaccatgatctgaaatgatgctgtcatttgatgacaaacgggaggtagtcgatctgtcacaagaaggtttatactatgttggcctatcattctacagacaaaaagatgatttgagtatgtagggtatcatttactagtgtggtatttcaaagaatatcaatcaggaatccctgaaagctgaaatgtgttttcctaaagtgagaaagctgtacaataattcttaaatcctttgttgttgtggaggaaatttctatgggtttcatcataaaaaatattttatactacagctaccaagaaaccctatcaatctaagttgtaacattcgtttttttatggtttggttgctaggtaataaacacacactgaaaaatgcagtttgagggggaaaatgcctcaataaagagaattcccctaaggcttgggtgacaatctcaactaatattgtacatctaaaaaaatcaggcacaggggtttctaagaaaattacaaattgcaccacagctttccagggaaggtaatttttagtatctctacatttcttcattccaatactttgttcagtatttggcctatggtatgtgttcaataattattcaataaatcattctgtgattgaatacatttttttgtttttattttgtgagttctatactatatatggaagatacatggactacttaaatgaacacactttttgtagtaaatggtgttctattttcagaaatattactttttccccactaaaatttataggtttatgaacagctgatgagattttatgtatttatttggtatgtgcatatgaaaatggtagctttgcatatatagatattgctactcagtcatctaatgttcagggtgactttgatacatcttaattactttctagaaaaataatacctataggccaaattaaaaaaaaaatacgaaaacctatgtcatttatagaagagatcattggtgaaatatggcgtaaagaacaggggtcacagaatcaaatatctaaaggtttttggaagtaatataataagtgaaagggttgggtgagggatggggtaggggacctttagtttcaatggcaaaggctggtgaggatgtggagtgacaaggatggttattcattggcattgggaatgaaaatgacactttggaaaagtttagtggtttcttccaaagctaaaaatagacttaccatatgatcctataattgagtttcttggtatttacccaagtgagttgaaaactcacattcaggaaaaaaaaaaaaaaacctgacatgaatgaaccctaacagtttccttcataattgtcgaaacttggaagcaaacaagatgtcttccaataggtgagtagataaacaaaatatggtacacctatatactgaaatattattcagtgatgaaatgagctacaaatcacaaaaagagactggagacacttaaatacatattgctaagtgagagaagccaattcaaaaagcctatttactatatgattccaactacataacagtctggaaatggtaaaactatgaagacaataaaaggatgagtgactttggggaagggagagagcagtgaataggtggagcatagggcatttttaagacagtgaaactattctgtgtgatgtttaattaacattaataatgttaatgtgtaatgtctatgtaatctactataatggcaaatacatgtcattatacatttatcaaaatccataaaatgcacaacacaaagagtgaacacgaatacgagctatggactgtagttaataataagatacagataacagttaatcagttgtaacaaatgcaccacagtaatgcaaaatgttagtagctggagaagtcaggaaggggatagttgagggaggataggaagtatatactgtactttttgctcaatttttctgtaaaccttaaactgctttaaaaaagactattattttttaagggtgacattcaagcaaaaatttgcatcaggttaaggatgaagctctacaaatatatacaattgctgtattaagaataattgttttccaggtaaagaaaatttgtttcctaaatcaagaaaatatatttcatgaagctgtgccaaattatccaaatatatgaggtagacaataaaatgttcatgtcttatattgaaataacatagaatttctgaagtaaaggtatttactaataatttattgaagtatttattttatagcctggtatatttgattggaaaaatataatagtagctcatattcaatgattttattggttaaactttattattcttaaaaaagtaaaactcattaccatttttacaggaatgtttctgagagaaaaaaaatcttaattgtggatatcacatataacataattttcattttgcttataaagatggataacatattataagtgatttctttttaaattgtaattaataaaaagatacaggcattctcatatttgtttataatgttatctggttatatataacttgatagataatatacaatttaactacagtttactaaatatagtaatgtaagtaaatatagtttattaagtatataacttaaatatatatttaacatatatgtgtatacactatggaaaacaatgttctatataatgtgtactaattaatctacaaaagagagctaatatttatcttcaattataagacatgcttatttcatattttaatatcaccaaaatgagaatgtgtctttaagttaacatcaacttaaattagataaattttagtaatcatatcattgaaaagattgtatgatattttggctcaagcctagtttagttggaacatttcaagaatgtaagtttctagttctattttaagagatgcaagatcaatacggaggtagaaaagaatattgtaattcacttataaatttcagtggtgcactggatgagaagggaaatagggagtatgtaaggacatggggagagttttcccattttttagttcatttggaagatacctgttttcttttaagcataattgtgacatataagtgctataccagttctttggttaatttttaaaggaaataggagcctggattcttgttttaaagtagcttagaggctgggcatggtggctcatgcctgtaaccccagcactttgggaggcctaggtgggaaggtcacctgaagttaggagtttgataccagcctggccaacatggtgaaaatccgtctctactaaaaacacaaaaaaatttagctgggcatggtggtgcgcacttgtaatcccagctactctgaaggctgagacaggagaaccgcttcaaccaaggaggtggaggttgcagtgagccaagattgcaccattgtaatgcagcctgggcaacaagagtgaaacttcatctaaaaaaataataaaaatgataacaataaaaaataaagtagcttagagtctactgacaaagatagatcataggacatgttatataacctttgactactaccatagaatcttgagactttatgtacagatgagtgctaatgtttgtattaatttttattgtgaatcttagcagtattgatctggggatatttatgagaggaaagggaatgtaaaacaaaaattcgaagattagagagattgaattttgacattgaggagagtataaagtgtttcaggttggagaaatggctagtatgcttgagatagagagattggattccgtttttcaaattatgattttaaaaatctagtcttcaacagtaagacactttgttaaccttttactcaatgtcaacaaaatggaaggaatgtatgtttaagtcataggctaaatatttgtaccttcatagcttatcttaatgggaaatcaatgatttcctccatatagtattttcataagcccctaagcaagccgacttattcacaatgaaatactttcaaattagcaatatgatgcctatatgtttttcatctagtaccagccattcaaagtatgtcaccaggttaaattatttgattcttttcacagcttataatgatttgctgattagcatgcagcacttaaaaagttttataaaaatatcttcaaaaataccatagatttatttttcctaaggaaatatttttggagtgtgtaatatacagtatggccatattcaaaagcagtaccaattttaatttgccaatgcatttgatagagattatcttgtttttcccaaactcttgaaccaacttgtctggttgaactcttgacttcactacttacttgcttaggcagaaacacagcttgtctataccttggtttaccctctataaaatggagatagtaatgtgtagttttaagtgagaaaatatctagaagttatgtgggcaaggctacattggcagaaacaaatgaaattttacaacaaatctaggaaataaacactaataatacatacagacacgtgtaatggagatcaatattttaatggtatttaaattaaataaaattaaaaaataaaacttcaatattgatgccctatttggtttaaatttgatcacaccttttgggagaggaatttgcatatatctgtttccaaatggagtaatttgatagttacttttctatttcagtgatatagacatttttcttaaactaattaaggaagattgataggctttgctcagactttgaaataatgtttttacttattttaagcaagagggagataaaaatggttttaataaaattagcttgcctcctaacaatcaggctttctctagaatgtacatttccattcccagagcaggattctgctagagcacagaggccagatacatctttaaggaacatgaattcagattcctcttcccagtgcttgctcaagtgggattctaaacacttgggagcaagtgggtactatgtagatgtgcttggcatccgtgtggattatggaaagcggtcatctattttacagctgcataaaacagtacatggatttcatgatgcagaaaagcagtagtttattcctcattttccatcatgtaaatttttactaaatggacttgcatgaagagttaccctccctttaaaacacaaataaaaaatgccatcattattcactttcatctttctaaggtttttcttgcaggaaacaaagaaggagaaaagacagaagagcattctttagagtaaaatttctaggctgcactgcaactaattttaaatgctgcaagagaaaagtttatagcagggatagagaaagcaggcatagtttgaaaatgaattttatgtattcattcattcaaaactgaagagagaatcaaaactgaagagagaataaatatttttccaccctataatctaataatcatgtataaacaatggtatgatcaaagcttacttagcccataagaaagcttatattttcaaatcaatgtacaacttcacaaaagaattagaaaatcctttcctcataagcaacaattagacatatatgcattacaccaaaaaaggaaagccaattgtcaaatatattaactgaaatactttttttactttaattatcaacactgattactgttttgaatttatttatttctgacactagggttattaatagtagtgtgtaaaagaatctgattttcagaagtatgttagaatttcacacttacattttctagcaagataaaatcctcagaatacctgtaatcaaaataaggcatgtttaaaagtctgtgactttgcttaaagtttttgaactatatttggaagatacatactgcaaatataaaagctggacttttacataccaacatagtatatgatcagtgccaaatggatccaacaacaacaacaaaaatgtgtggttacaggatgcagaagacagggtctacgttttcaaagatgacttcataaagaacttgtgctaaaccttgaagagtagataagatatgtaacaaataagacagagtcgttcaaaaaaaaagcatgctgggacttaagctctactaaatgtttctcaaacttggaactattagcacttattattaattattattaaccactaacaaaaactctttgctgtaggtggctgttccatgcattgtgggatgtttagcttcatcttgtaatctacctacttagaagccagtagcacaacccttccttgtagtggaaaaaacaatgtctctaaatattgccaatgtccctgtggggaggaggatgaaaattacccctggttgaaagcgcctgagcaatgggaatgcaagttacataataggacaaaagacagcgaaaccaatattgatgcactaatgttaagataaaagttgtggtgagcccaaaatgtcaggctaaggagtgtgcaaatcttataaacactgagggaactctgaaggttttaaagtaatggattagcatagtgaatgctgagctttaagaatataaaatttgtacctgtgtgcataaatggtattttgtaggaaaaacagaataggcagagagagtgatgagcagtccagctcagttatcctattgtgggataacaagcataggaacagagatgacagaaaagtaaaaaacaaaaaacaataacaaaaattaaaggtcagggatgggaggacattgtaataaatacttcaaggaacaagtgatatagaatatgtgctattcaccttatagaactgggagacccttgttaccaaaaactaatgtgatagactacagaaaatcctggaattatattccagatatgtttgcattatctaggcaatgtgaaatgttatagctacttttcacaggtgttcacctctcatatgtgaagtcatgagatttcttgaaaattttctgaaggcttttcaaaaatcttaaaaagtctttaaaatcttatgaaacaccagtaggcccaagttgcagtttggtacagtgagtctaattcattataggtgttttgaaacttcaaggtcatttatcattttgtgaggaaatatattttaggttagtgcgaaagtaattgtgggtttgctattactttcagtggccaaaactgcaattacttttgcaccaacctagtatttttatgtccttaaaaccttgagattccatctaggggagtcataatgtgactgaaagtcagctaagtaagcagaattagggtttttggcagtaacccagtttgatgtttttgtttgcttgatctgcgataacaaaaaatcacagtctgggtggattaagcaacagaaatttattttctcactgtcctggaggctagaagtccaggaagattttcgctaacttagtttctcatgagggctcattgtggcttgcagacagccaacttcttgctatatcctcacatggcctttcttcagtatttatgcacagaaagagaggcagtgagctctctggtgtttttttcctatgaggatactaaccccaccaaaacctcatttaaccctaatcactgtgttagacggttcctctgcaaataactgccccactgggggatttgacttcaacatataaattttgggctgacacaaacatttagttcataacagtttctatcattatatgtagagctaaagattcttccatgctattactgaaaaataaaattaagatctttctagttaatatccaagcgaattgaaagcagatgtccacaaaaaaatgtacagtaatgtttatagcggtattatttataacaaccatatgatgaaccccaggtctatcaactgacacatggataaagggtatacacatacaattaaaaatagtcactgataaaaaggaatgaagtactgatatatgccacatcatagatgaactttgaaaatattatgctatgtgaatgaagccagacacaacaatgcacatattgtagaattccattcatatggaatgtcctcaataagcaaattgacagaaagagatagtagattagcggcttccagagtctgtggggagggggcaatgggaagttattgctaatggctagaaaggagttgaaaatattctgaaatgagatagtggtgatggttgcccaaatttgtgaatatactaaaaaatactttaaaattgtgaatttaatagcatgtggtttatatttcaataaagattgtatgagttaaaaaagtaaaataaagatattttcagaaaaacagaaacaagaaaaacatcataaaacctcctaatggaaaagaaaatgaataaataggcaatgctttaagctatttgctttttcttctttatatcaatattaaagaaattctagattcttacttgtgtgttccattacccccatatattaccaatgcataatactagtaaaccttttgagatataaagaagacttataatccactgaggttgtgaaagcctaaataggctgtatttgtagaaataatttagtgcaagagtatgatccttacttataatgtatcactacttataaaacttttcaaatagatttactgaattataattcctgagattggccattgaatgtcattttttgttttcagtgtgaagaaggaatgtaaaatctctacatttaattttagctttctgttcatgatttgtctcatattttccaacaattcctgccaatttattcaataaataaaacatgaattgattttactgtttggattctcattgcacttgaaatcaacactaaaaatgttctataaagccaaatatgccctccacttccctcttacatctatcttatgctcagttctcttatgccactccacttcactcacttttcatcagccatatggttcttcagtcttgcctataagagatccatgattcttacgtcttcattgaggttctgacatcaagctagatggattaatccatggaacaaaactatctatgaatcagttacccatgtatgtaatactctttcttccaaggaaagtcaaaccattattctaatggccaaatccatgaatttatttgtcatcttgtttccctatttctctgtacctcttataagcctacttcatcagattccaaatgatggtgattgaggtgttgaatatgtttagaagttggaagagagcgaaaacaatacagaactctctctgtagagaagatatttaaaggtcagccacagataaatatgacactttgaaggaatatatgtttagatctagaacatgtccacatttgcatgtaacagcatttaacttcttcattaaaacaaagataaaatatctacctcaaaagtctgttgtgagaaataaattagatcatatattaaacaagaggaacaaattagcattcaaatgtggatgctgaataattagatggaccttcactgcctgactgtttgagcaagcatactagtcttaaaggactgggtaatcttcatttatgaagaaccttatggtgtagatgttcagaatcactcataattagcacaaatcacacaaggtaaacacatacatacacaagttctactgaatatgtaatacattaaagttctgaaaaggtataaatgggcccattttctgacagcagaatacttaaaaccatattaagtgtggttaataactagtactctgaaaaggggaaaattattcccaagactatgtctgttccagagtaccctgagtgtcctgtatgtatcatcagtcacatcatcatctggggataatttcctcacttgattctcattccttctcctatattctggtttatcagtaaaataagtattaaaatatgtacagaaaaaattatacagttaaattaactatgtgaaattctgatcttggttctgacagatggaattgttatagtcaatatatcttttgcagatttagtgtacctgagatcacgacttactttttttaaagtaggatatatgaatcaagtaccaaatgtaaggttttgtgaaatataaactatttttattatgttgtttttacagcttattaaatgccaagaaaacagttatttaatgctaagaaaactatcgttgtatgattttatgtgtatgagaaatcaaatgttgctcttcaagaacacttgcggagaagtcaagtagttagatagacgagtcttgagacattgaaagaggtcaggactatatatcaaaaatgaactaaaatttttagtatataaataattttcaacttaagctctattatctgatttaaaagacaattttgacatgttatttgcttttcctttttcatactgaaaatatggagagagatccactttaaataaggcaaatactgttttgattttataaatctgtgttactcaaactcatctttgacactttcatgttttctcaaagaattaggaaggaatgttgtctagcagtgcagacataaatatgcagtataaatatggggcaaatttgcatttttggatcccagcaaaattttgcagaggcacttcttttaggccttggctacaaacaattctcaattcctatcttgagaaacacttttctgttctttgtagctccttatagaataacactagcagtttatacattttatctaattcatattatctttgcataaagctcatattcaataaatgacttaaatctattcacattttggaatactcagcacttataattgcaattgagaactttctcttaaaattttcctgtcctcattcatgctttcatccatccatcaatttatccacccacccacacatccacccatccatctatccaacagttactgagtgtctactatgcatcaggcactgttacaggtgcatgcaatatatcagagaataacacaaagatatttgcccttgaggagttcacattgagctaaggggacaataaaaataaatgtaaaaaaagaaaataacaaaatatacaggtaatgataaattatacaggaaaacagtataagtagaggagggcaattaggtttacaagttcaggcaatagtgtgagtggaacaggtgcaatattaaatgacatggtaagggtagggttcattgaggagttaaaatttgagcaaagacttgaaggaggtgtgagttgaccaaacagctatttaggacaaaaacattgtaggcaaagaggagagctggagcttagtcctgagatagtttactttgtatattccagaaagtgtttggaggccagtgttgctgcagtgtagagatccaggatgagaaaagtaggagaaatcagagaagccatgggagcctgggtcatctaggctagtcctctaagtctagtcatcttgactaacaggacattttaaggattttggattttactgagaggaaatggccagtttttgccagagaactatcatgagcttacttacatttcaaaaggattactttggtttttcttttaagaatagattgtacaagtggtaaggatagacttatgaagacaaattagaaggtcattaatttttttttttttaaagtatgagattatgtgggttctaccaaactaaaaggaatagaaaatgcatgaactggtcaaactctggatgcatttcaatgttgaaaccaacaggatttcttggtacttcctaatagatgaaggatgattttgaggccaccaggctgagaaaatagaaaggagggagttaggatttgtgagatgtgggaagctgctggagaaacagattttggggagggtggtggaagaggaaaagctgtggcttccttttgaaatttaggtttcaataaatatctaagtggagatgtcaagaaagtagatggatagatgagtctggtgataatgaaagaagtcaggactataaatatgaaattaggaattaatacataagatggtatacaaagctaaaagactagatgagatcaagaagttgatgattacagataaaaatggtaaaagaccatggattgacttttgaggtattctacatcagaatttcttgtccataaagggcaagagaaggcaatgaccgaaacatattaagaaggagcaaccagtgagatcgaagaaaaataatgaaaatatgacatctgcagctactagtgaagtttatcaacaaggaggaagtgattatctgtgtcaaacgctgcttataggtcaagtatgatgaataatataaattgaccattggatttagcattgtggttacagatgacttcaatgacagtgcttctaacaaaaagctgtttgataaactcttccttccttttctgtctcctaccagtcgatcttcatatatctttttccaattatgattacagtcattaatttttcctcatgttttaaatgacaaaagagtatgtttgtcattgaattaaataggaaagtcagatatataaataaaataatctcacatttcttcccacacaaacatctccataacttttaagaaccttatcttaaaatcttggagagttatctttcacttcattcttcatctcatctgaaatagaaaaacaaaaaattacattaatttaagggtcaggttttttgtattgacaaaaatgcatcctaattacctaaacagaaagataaatatagatatgtcattatttttcaattttatctctaaattgacaaataataattgcatatattcatggggtacatagtgacgtttcaatacatataatttacggtaatgagaccagcataattagcatattcatcacctcaaattgttattacttcttcatgttgggtactttcaatatccttcttttgattttttgaagctaagttatttttatctatcatcatcctacagtggcatagaacaccagaacttattcctcctatctagctgtaattttgtctcctttaacgaatctctcactgtctctccatttcccttacccctcccaatctctagtatcatctgttctacttttagttctgtgagatcaacggttttttttctagcttccatatgtgagtgagaacaagtggtatttagctttctgttcctggctcatttcacttatcataatgacctccagccctatccatgttgcctcaaatgacagaatttcattattttaattgttgtacattacatgtctgaataacaagttaatgaatcttgtttgaactgatagacattcaactatgtccagcttttgttctatagataacgctacaacaataaatattactgttcaaatatctcgagatattaatgcttttgtttcttttgtatagtttttcaaaagtagaattcaaagtaaaaaatgatgtatattttataatttaatgtacactgttgcatttctatttgtaattaataaaagtgtttctttgtctttactaatgttggatgatattagtttagtttagtttagttttagtgttttcttatctgaaggaaaccttaattgttgctatagtttgcattttcctaaatagcaatcaggtcaatcaccatataagttaataattaggctttcggttttgcttttctctgaaatgcctgttgtctctcttctcccacttattttttcttgtattatccagaaaatgcttttttctcatgtaatgttctactataattctttttgtctcttccacatatgtagttatgtcttcctggtcaatcctagaattgtatacttttgctttctctttttttcttaatcaggctttcccggcaactgtctactgttagttgtttctgagcaagagctttttctttaatttagtgttagtttggttgtcacaagaggatagtactgtgcttggcagtaaaacaggcacagttaaagaagtaatgtttctttaatgggaaaagaaatggaaacttaggaagataattacctaaataggagacagttctccatgctcatacatagtagtacaagcttaccagttttttcaaagtttcctcatagaggcatatgactgctcatgagggaggaaatacctaagagagaaactctgtttgccaccctaaaggaatttttaatcatcctgctgccacgaccttcaacttagcatacccaacacttccaaaaatgagcaacaagctacataagttcccgatggtcagagtcaacccaggtgtcaatgcatccccaaatctttattacataaatggactaagaatttctgttttcccaagtctttttttatatatatttttatattttttcttttcaatactgatttcaactttgattctcctttcctgtttaggcatccaatctaaattgttgaatatatttgtactagtgacaagtaactttcccccatttatgtttgtactttttttttctattaagtaacaaaaggatattcccaaaattttagcatggaatatacctaccagtgtttttgtgcagctaggttatgaccatgtgactttttgtcagtaaaatgtgagtgaaagtagtatgtgcactttcatatcatctacttaaaagaaacatgcatacccattctttcactctttctcctactcacgtgctgaaatgtgtatgtggtcttggtcagccagctttgaggatgatgagggcaatgcagtctacactaccagatagcaaagcataagaaagtgaaattttggtgactgtaacagaaatgcctttttggccctgaactgcctatctaccactacacagtaaaatgaaaagaaacaaaaacagaaaagataaataaaaaaacatgaaatactcatatcttgttttgagccgctatactttggagtttttcctcacaataagttagtcaaagatttggcaaattttttctgtaaaaggcaagatagtaaatattttcagcctttcaagacatatagtctctgttgcaactacccaactatgcttcaactcttcccttttagtgtgaaaggagacataggcaatacataaatggttgcacacaaatggatgtgttccaaattttattttaaaaaaacaggtgactgtttatatttggcctataggcatagtttggtgtttcatgatacagcctgtaacataactaatacaatcttcttcattatatacaatatatatattttaaaaattatgttgaatatacactgtctaatttacataaattacgctaggctaaacatatttacttttttgtttaatactgtatatttaagatcaataatgttatatttacatattctgctaattacttctgattgtttcctagatttcaattgtaataatcaatttagagataattgatatgttactatattgagtcttctgatatacaaaaatagtataactcttcatttttaggtcctttttagtttctcttggaaatgttttatagttttcagtaaagcaaattcatacccatgttgttaaatttatgtctaagtaagaggggttttcacactattgtaaatggtattttaaaacttctatctctagttgtttaaggttagttatgaaaatgtacttaaatttacacattaaccatgtataatgcaactttattaaattcatctattagttcaattgtatacatattatatatattgtatatataattgtatacatatatgtatatataattatgtatatacaaacacacatacacacaccacattatctttatccatttgtctgttgatggacattgaggttgattccatatcttagctattgtaaatagtgctacaataaccatgaacttggaggaattttttgatctactgatttcctttcctttggataaatagccagtaatgagtatttgttgctcgatcttatggtagttctatttctagttttttgagaaatctccacaatgttttccatggttgtactaattcacatgctcactgactttgtatcacagtttccttttctacacattctcaccataactgggttgagatgatatctcattgtggctttgatttacatttattggaagattagtcatgttgagcacttttttcatgtatttgttatccatttgcttgtcttcttctgagaaatgtctattcagatattttgcctactttttaattgtattatttggggttttttgttgaattgtttgagttccttgtgtattctgaatgttaggctctttgcagatgaattgctggaaaatattttctcccattctacaggttatctcttcattatgttgattgtttcctttgctgtgcagaagctttctcattccatatagtctctttgtctatttttagttttgttgtctgctcttgtgaaattttaggcataaaatctttgcctagaccaatgcactgaagagttttccttaagtttcttatagtagttctataattctgtgtcttacatttaagcctctaacacattctgagttgtttttttttttatatgagagacagggctctagtttcatccttcttcatatggatatccagttttcctggcatcatttattgaagaggatattctttttccaatgtatgtttttgatgactttgccaaaaatcaactggaggtaaataggcagatttacttctgggttacatattcttttccattggtgtatcagtttttatagcaatatcatgatgttaggttattgtgatggttaatattaggtgtcaactcgactaaattgagggatgcctagatgtctgataaagtattgtttctgagtgtgtctgtgagggtgctgccagaggagattgatgtttgaatccatggactggaagaggaaaacccaccctcattgtgggtgggccccatctaatctgctgccagcgagactagaacaaagcagaccaatgaagggacaagaggcttgctgggtctctcactccctctcttctcctgtgcttgacgcttgcttcctttctttcttcccttggacatcagactccaagtattttggcctttggactcgggaacttgtaccagcagcctttacagtgctcttacatcttcagtctcagacttaggtttgcactattggattccctggttttcagacttgaagtgagccaacgctactagcttctctctttacccagcttgcagacagcctatattgggttttcaccttgtaattgtgtgagccaattctccctaataaactctctttcatatacacatatatcctattggttctgtctttttggagaaccctgaataaaatgcagggttattagatatttgtagcacagtgtcaagtcaggtagtgtaatacctccagctttgttctatttgctttgtgttgctttggctattcattttgtggttccatacaaattttagcaatgatatttagcatgttattagtattttgatagtgtttgcattaaatttacagattgcatcacattgtatggtcattttaacaatatttattcttccaatcattgagtgtgtaattttttttatttgtttgtgtcctttttgatttcttttgccagagttatgagttttctttgtagaagtctttcccctccttggttaaatttattcctaggcattttattttatttatttagctattgtaaatggggttacttttttatttctttttcaactagatcattattggtgcatagaaatgatattgatttttgtatgttgatttttttcatttctatgcatttatgggatacaagtgcaattttgttacctgcatggattgtgtagtggtcaagtcagggcttttaaggtacccatcacctgaaaaacatacatcatatccagtaagtagtttctctttgttcaccttcttgccactccctgacccttgtgagtcttcattgtctatcattccactttctatgtccatgggtatttcatgtgcgtccgtgtgaagagaccaccaaacaggctttgtgtgagcaacatggctgtttatttcacctgggtgcaggcgggctgagtccgaaaagagagtcagtgaagggagataagggtggggccgttttataggatttgggtaggtaaaggaaaattacagtcaaagggggtttgttctctggcgggcaggagtggggggtcacaaggtgttcagtgggggtgctttttgagccaggatgagccaggaaaaggactttcacaaggtaatgtcatcacttaaggcaaggacctgccatttacacttcttttgtggtggaatgtcatcagttaaggtggggcagggcatattcacttcttttgtgattcttcagtaacttcaggccatctgggcttatatgtgcaagtcacaggggatgcgatggcttggcttgggctcagaggcctgacattcctgccttcttatattaataagaaaaataaaacaaaatattgttgaagtgttggggcggcgaaagtttttggggggtggtatggagagagaatgggcgatgtttctcagggctgcttcaagcgggattaggggcagtgtgggaacctagagtgggagagattaagctgaagggaggtcttgtggtaaggggtgatattgtgggtatgttagaagaaagatttgtcatatagaatgattaatgatgggctggatatggttttggatgaattgagaaactaaatggaataacagaaggagaaaaacaggtataaaacgtctaagaattgggacgactcaggatatctgattagagagtgcctaaggagattcggcatagtcctgccagcaaagattatttatttacttcaagagttaagagtggcagtttggggatagcaccaggagatatcagctgtgatggcttggaaaaacagtgtaaaccagcagtgtaaacaagagcagggcatgtatgagtagttgagaatgatgaataggagtatgactagacagaagatagtagggatgacaagttttttggggcatagtctaagttggtctggtgtctggaatgagactggggcctaataaaaaggagcatctatacaggagcttaaatgggatgtaccctgtagcattccaaagacaggtctgaattctgaaaagggcaagtggtaaaagtattgtccagtcctttttaagttggtggctgagcttggtgaggtgtgtttttaaaagacctttagtccattctacttttcttgaagacggaggaccgtaagggatataaaggtttcactgaatactaagagcctgaaaagctgcttggctgatttgactaataaaggctcatctgttatcagactgtattgaggtgggaaggctaaagtgaggaattatgtctgacagaagggaagaaatgactgtggtggccttctcagaccctgtaggaaaggcctctacctatccagtgaaagtgtctacctagactaagaggtattttagttatctgactcagggcatgttgagtaaagctaatttgccagtcctgggtggggcaaatccttgagcttgatgtgtagggaagggagggggcctgaataatccctgaggggtggtagaatagcagttggaacactgagaagtgatttccttgaggatagatttccacggtggaaaggaaattagaggttctgagaggtgggctagtggcttgtaccatagcataacctgcctttgttggtgtgtggcgattaggcctggtggaaccgccatcaataaatcaagcgtgatcagggtgaggaacaggaaagaaggaaatttggggaaatggggtgaatgtcagttagatcagagagatacagtcatgggggtcaggtgtggtatcaggaataatgtgggaggccggactgaagtccgggccaggaacaatggtaattgtgggagactcaacaaagagtgagtatagctgaaggagctgggaagcagaaagtatatgcatcaggtgtgaggaagaaaatagattttggaagttatgagaactgtagagagtgagttgagcatagtttgtgatcttgaaggcctctaaaagtattaatgcagcggcagccgctacacgcagacatgagggctaggctaaaacagtaaggtcaagttgtttggacagaaaggctacagggtgtggtcctggctcttgtgtaagaattctgagcatgctaaccatgcctaggaagcaaaggagttgtttttttatagaaggtgctggggttgagagaccagtcggacacgattggcagggagagcacgtgtatttttatgagaattatgctgagataggtaacagatgaggaagaaatttgggcttgattgaagtaatgggggctgtctgtgaagctttgcggcagtacagcctaggtaatttgctgagcttgatgggcgtcagggtcagtgcaagtgaaagtgaagagaggctgggattaagggtgcaaaagaatagtaaagaaagcatgtttgagatctagaacagaataatgggttatagaagaaggtattgaggataggagagtatatgggtttggcaccatggggtggataggcaaaacaatttggttgataaggcgcagatcctgaactaacttgtaaggcttgtctggttttaggacaggtaaaatgggggaattgtaaggaaagtttataggctttaaaggccatgctgtagcaggtgagtgataacaggctttaatctttttaaagcgtgctgcaggatgggatattgggtttgagtgtggtaagggtgattaggttttaacgagatggtaaggggtgcatgatcggtcaccaaggagggagtagaggtatcttatacttgtgggttaaggtgggggggatacaagaggaggatgcaaaggaggctttggattgggaagaagggaggcaatgagatacagctgtagtccaggaatagtcagggaagcagataatttagttaaagtgtctcagcctaataagggaactgggcaggtggggataactaaaaaggagtgcttaaaagagtattgtctaagttggcaccagagttggggagttgtaagaggtttagaagcctggccgtcaatacccacaacagttatggaggcaagggaaacaggcccttgaaaagaaggtaatgtacagtgggtagcctctgtattgattaagaaggggatgggcttaccttccactgtgagagttaccagaagcttggcgtccctgatggtctaggggtcttccgaggtgatcgggcagtgtcagtcttcagccgctaagctgagaagatctgggaaggagtcagtcagagagccttgggccagagttccaggggctctgggagtggctgccaggtgagttgaacagtccgattttcagtggggtcccacagagatgggaagcggcttaggaggaatcctgggctgcaggcattccttggcccagtggccagatttctggcacttgtagcaagctcctgggggaggaggttctgaaggaatgcctggccactgcggttcaggtgtttggaagttcttgtgtgctggagatgtagctggggtttgtctcatagtggaggcaaggaattgtaacctttttctattagtgtacaccttgaaggcgaggttaattaaatcctgttgtggggtttgagggctggaatttaatttttggagttttatttaatgttgggtgcagattgggtaataaaatatatattgagaataagacggccttttgactttttagggtctagggctgtaaagcgtctcagggttgctgccaaacaagtcatgaactgggctggatttttatatttgatgaaaaagagcctaaaccctgtctgatttgggataaagaaaaaggagcattaaccttgactatgcctttggctccagccacctttttaagagtaaattgctgggcaggtgggggagggctagtcacggaacgaaactgtaagccggaccaggtgtgaggaggggaggtgataaaaagattatagggtggaggagcggaggctgaggaagaattaggacctaactcggcctgttgaggaacagcctggggaggaagggagaggtcagatgggtctgtagaaaaggaagattagaaagactcagtgaggctcggagttggtactggggggacaggcgggagggaaagaaggaagatttgggacgagttgcactgggcacagagactaggaaggggctgatgtgtaaaagaatgcctggacataaggcacctcagaccatttgcctattttacgacaagaattatttagattttgcaggatggaaaaattcaaagtgccattttctggctatttggaactactgttgagtttgtattggggtcaggcagcattgcagaagaaaataaggcatttaggttttaggtcaggtgtgagttgaagaggttttaagtttttgagaacacaagccaagggagtagaaggaggaatggagggtggaagcttgcccatagtgaaggaagcaagcctagagaaaagagagagtagagaaacggagggaaggggttcgggggttcttaccttccagaaaagtgggaaaaggggttggggcacagagataagaggttggggtgcagaaataagggattggggtgcagaaatatgaggttggggtgcagaaataagggactggggcacagagatatgaggttggggcatggaaataagggattgggatacagagataagaggtcagggtgcggaaataagggattggggcacagagataagaggttggggtgcagaaataagggattgggacacagagataagaggttggggcgtggaaataagggattgggggttcttgccctgtagaaaagcaggacttgctgctaacagtgaaggagaaggggttgaggggtacttgttcctgccccagaaaagtgggacttgccgctaagggtgaaggagaaggggttgaggtgtacttgcccctctcccagaaaagcagaggaggggtagagacaaggagagaagcggttggggtacttgccacttccccagaaaagcaggacttgccgctaagggtgaaggaccaaggcaggcctccctgcatggtctgacatccttgaaaggtgggtgtataatcagagaggtgtccctgcaatgattaaacaccaagggaaggctgcctttccagtccgtgactggcaccggagttttgtgtccacggataaaacatgtcttctttgtctctcccagaaaatgaaaggaattgaaattaagagaagggagagattgaagagtggaaaggagaaagtggttgacggacagtgagagaggttggagaagagagtaagaagaggccgcttacctgatttaaaattggtgagatgttccttgggctagctggtctgaggacctgaggtcataggtggatctttctcatggagcacagaacaggaggacaggggattgatctcccaagggaggtcccctgatccgagtcatggcaccaaatttcctgcgcgtccgtgtgaagagaccgccaaacaggctttgtgtgagcaacatggctgtttatttcacctgggtgcaggcgggctgagtccgaaaagagagtcagcaaagggaaataagggtggggccgttttataggatttgggtaggtaaaggaaaattacagtcaaagggggtttgttctctggtgggcaggagtgggggttgcaaggtgctcagtgggggtgctttttgagccaggatgagccaggaaaaggactttcacaaggtaatgtcatcacttaaggcaaggaccggccatttacacttcttttgtggtggaatgtcatcagttaaggtggggcaggacatattcacttcttttgtgattcttcagttacttcaggccatctgggcttatatgtgcaagtcacagggcatgcgatggcttggcttgggctcagaggcctgacagtgtacacactttttagcactgacttctgagtgagaacatgtgatattccattttctatgtctggcttgtttcacttaagatgatgccctccagttttatccatgttgctgcaaaagatgtgattttatcctctttatgaatggaatactaaacagtattccattgtgcatatatcccacatttgctttatctaatcacctgttgatggacacgtagtttgagtctatatttttatcatgaataatgctgcaataaacatactagtcttggtatctttttgacaaagattccttttcttttgagtaggtatctactggtgaatttgctagattgaatggttgttctacttttagttctttgggaaatcttcatacttatttccatagaggttggactaatttacattcccaaaaacaatgcataagagctcccttttctccacatactaatcaacatctgttattttttgtcctttagtaatagccattgtaactgaggtaagatgatatctcattgtggttttaatttgcatttcttggatgatttatgatgttgatcatttttcatatacctgttggtcatttgtatgtcttattttgaaaaatgtctactagtgtattttgctcactttttaattggattatttttgttgttgagttgttttatttccttgtatattctggatattagtccactgttagataaatagtttgcaaatattatctcccattctgcaggttgtctgttcacactgttaattatttcttttgctatgcagtagtatttttgtgtattttttatttttattgtctgtacttttgaggttttagtcgtaaattctttgcccaggccaaagtccagaagagtttaacctaggttttcttctagtgctttcagtttggggtcttacctttatgtctctaatctatcttgggttgatttttgtgaatggtgaatgataggagttcagtttcattcttctgcatatggcaatccagttatcctagcatcatttattggaaaggttgttccttcctcaatgtatgttcttgttggtttatcaaagatcaaatggttgtacatatgtggctttatttctggtttcttcatttggttctattgatctatatgtctatttttatactagtaccatgctagtaccaagtcagaacaaagctggaggcatcatatgttctgacttcaaattatactacaagggtactacaattatactacaaggctacatagaataatttgaagtcagaacatgtgatgcctccagttttgttcttttatacttaggattgctttggctatttgggctctattttcattccacaccaatcttaggaatttttttttttaattctgtgaaaagtgacatttttattttgatagggatcatactgactctgtaaattgctttgggaggtatggtcatttttatgacattaattcttcggattcatgtacatgggatgtttttccatatgtttgcatcatctacaatttcttttatcagtgttttgtagcttttctagtagagatctttcacctccatggttaagtttattcctaggtatttttttttctagttattgtaaatggaattgccttttcaatttcattctcaggtggattgcttttagtataaagatatgctcctgagttttgtatattcaatttgcctcctgtaactttactaaatttatttatcaaatccaagaacttttttggtagtgtcttcaggtttttctagatagaagatcagcaaacatggataatttgacttcctcttttacaatttgaatgccttttctttctttctcttgcctggttgctccagctaggacttctttaactctcagttttccatagagatatctgctgttagtctgttgggtattctgttacatgttacttgacatttattttttgctgtttttaaaattctttgtctttgatttttgacagtttcactgtaatatgcctcaaagaagacctatttgaattgcatctatttgggaatctttaaatttcctgtaacttattacctacatctcttataagactgagaaattttagctattatttcactaaatagtttttctatgcctttggaaaaatccctgctccttctgaatctctcagaattcaaatatttattcacttgatcctgtcccatatgaacatagagtttttctttttcttttttttcttgtgtaattgggttatcttaaaagacctgtcttcaagtacagaatttttttcttctgcttgatctagtctattattgaagctcttaattatcttttttgtttcattcattgaattcttcagtcccaagatttctgtttgatttgatttctgttttataatatatatctttttgttcaggtattgcatagatttcctttactttggaatgtgttactggagaattattgtattattcgaaggtgtcaggtttccttgctccttcatgattcttatgtccttaattgatataattgatatcaacacatttggtgtaatggttgtttcttctaattttatgtactgactttcacagggacatacttttttctgtagatgtatctacagtgccagttgggtgggggtcttttggctttgattctggatgtgtgcagtaatgtgatttctgtcatttctttggctgtaataaactttagtggtatctgttgaggatggggatgtcaggtggccagtccttaggtccccaggtggcactcttgggttggtgtcagtggcagcagcagcaggctgagtggtctagttcccaggcctcccaaagttgtgtgcagacactggaggtggcagcaagagtggtgggtctatccttaggttcctgaaggtgctactgttggccaatagggcctgctgaaccttagtgcccaggatcttatgcccacagtatgtggcctatgtgcagcataggctgcattgatgacacttctgttctcaggtactcaggcagtgtgcatgagtattgtttgtggtggtgggtaggatgggccagtcttcaggcccccaaaaggcacatgcaggtgcatggtggccctaccactggaggagacagcgttgttgtcagtgagagcatttccagagagttggcttccatgctcttggaaacatgtgtcacctccctttgtcctacaggcagcattcctgttgcactgaacctcatgttgctctgattgtaggacactacatgggctagattgctgggttcttagctgtacctccactaggtccagccaatattgtgatgctgcaacactctgggtggttgtcagtgcagcttccagaatgtggagttgcaggggttattaggatgtaatctggtgggacctgggctctcaaaatggcaccatgttgcagcagtttggatctcagtcgcagtgtgggatgtagagtgaattctctctcaggaacaatgcagtcacatttactctaagctacttcttatactaggattagggcctatggtagccaaggtgctctcctgtggctaaattgcaggcatttgtgatacaagtgtggactgctggggagctcttgcttcccttttcgccaaaacaaggagactctcctggctataaactcatctcagctggtccagctgcttaagtctcctatttttctgtgcctgtgatggtccctgtctctccttgatgaattccagcattgtttctaatgctctaattgatatatgcttatctactcagcattttggtccttctttgtgcacacactgatttttttaacacttttattgaaatattattttcaaaaatgatatttaccattttaaggtgtatgatttggtggttcatataaatgaaatcctgtaatatgtgggtttttcttctgacctcttttactaagcataacttttacaaggtttattcatgatgtagcaagtattagtacttcattctctttttgtgggtagataacatttcatagtctggctatgccacatctgtatatcaaggggtcagctgatgaacatttaagtcccactttgactattatgactaatgctgctatgaattttcatgtacaagtttttgtctggacatatattttcatttatcttctttgggtatgtaattagaagtggaattgttgggtcatatggaaattcaatgtttagctttttgaccaactgccaaactgttttgtaaagtgcctgtactattttacaatctgaccagcaatgaataagtgttctaattttcccacatccttgtcaatacatgttattttatatctttttattttagccattctagtgagtgtgaagtggtatctcattgtagttttggtttgtggacccctaatatctgattatactgagcattttatcaatgcttattggctacttttatatctcttttggagaaatatctattctaatcctttgccaattaaaaaaatcaggttgtctgcctttttacatttgagttgtaagtgtcctttatatattctgaatgttagtcccatttttgaccaactgccaaactgttttgtaaagtgcctgtaccattttacagatatatgatttagagatacatgatttaagatatgatgataagatatatgatttagaagtattttcacccattccatcatttgtctttttactttattgatgatgttctttgtagcaaaaaatatttttatattatgaaatcaaatttatctatttttttcttgatatgctttcttgtcttgtctaagaaaacattgcctaacctaaggtcatgataatttacacctacattttttttctaagagttatatggttttacattttacttttataactatagtccatttttagttaatctttgtgaatggtgtgagttagaggtttaactttatacttttgcacatggacatccagttgttccagcactacttttgaaaagaatatttcttcctcattgaattttcctgatgatttatcgagtataattttagcataaaagtcatgatttgtttctagaatgtcagttatagtccattgatcttcatgtctgtcctgtggcagtactatagtgtgtcttttctactgaagatttgtagtaggttttgaaattgggaagtccaattcaattgtgagtccctcaaatttgctcttctttgtcaggattattttggctattcagggtcccttgaatttttatataactaataaaatcagcttttcaatttttgtaagaaagaagtcttagagtttcataatgattaactcgaaactgtctatgaatttgaggatcactgttattttaatattaagtattttatatgaatatgggttgctattcctctcattccattaattttgtttttaaatttatttctacatgattttatagttttcaaaaatattcaacaacatttcaataaattttatagttttcattatataaaacttctaaatttattcttaagcattaaatattttgaaagtattgtaaatttaattgttaattttatttttggatttttattgctaaagtgcataaataagttgatttttgcatattgacctagtgtcctacaacttgctgaacttatttattagttctagtagtctcttttttccagatttttaggattatctatatgaaagatcatgtcaatgtgactaaaggtgattttacttctttctttctgatggtctgcagtacaatgttggataaaagtaatgagaatagataactttgtcctgttcttgatcttggaaggaaaacatccaatcttttaccattaaataaattgttacctgtaggttctttgttgaagccccttatcaggttggagtagttcctttttgttcttactattatgtatgtccatcataaaagggaagccattatccttagcaaactaacacaggaacagaaaaccaaatactgcatgtattaagcctattaacctaatggatacctaatgggtactaagcttaatacctgggtgataaaataatctgtacactaaacccccatggcacacgtttacctatgaagcaaacctacacttgtaaccttgaacttaaaataaaagttaaaaaaagaaaatatatcaaatgtattttctgcatcttttaaggccatgatatagtttttcttttttattctattaatatggctaattacattaagtgaattttttaccatccttgcattcctgacagttttccttcatatattttgaagtcaagcacatagatatttagggttactctgtcttccttctgtccttcttgatttctataaatgttctttgttctgaaatttatttggctatatcaatatacaggaagatttattatgatgagtgtttgaatagactattttttccatgcttttccttttaactatatttttatattcattataagttgaggtaaacattttttagttttccaaagaggtgacagaatttatctggctgttcagaggaagaaatggcattctagtttgtaaaactttgtctctatggtttataattttcattgttcttgtaaatttatggccttaaaaacatctttactattattttagcaagatttcaaggaagactagaagttaatacatgtgtagaactcagaatcttgccagcaatcctcgtagttttggaaatcacttaacctttaatgccttaaattcctcagctatgaaatggttaataatagtagctacttcccaagactgttaggatgaaatggtaaatatatgcccagtactcagtgtcaggcatgtagtgttatacaaatatttccattagcatcattataacaaaattgcttttttaaaaagatacgtttgtcttcttgagctaagaaacctctttctgacatgtaaatatacttaaatttcagacttaaacacaggtttagtatctatatgttaatataggcatttttctgtaaatctatgttttcatatttgtttctgtggtaggctttgaagtatttaaggatgggacattggttgttgtttctgtagtatctggtatagttcctaccttagagtaagcttttagaaaataattttaaggtgtataattacatacttctcagttgctagggggaaccatctccatgtctactttgtcattctggataggctaagtttcccccaacaacaatggcaagtcacgtctcatccacttaacaagtctacgttaggcctggctgtggctgtcctcctgtgtcattctctctgtggtgaactaggtgaacgaagcaaccgcgatctggaacattgctggaaattgagggaaaagagatcatcactccaaatcacctactatcattaaagtttcttacttggaactgaaacttatcacttccaccaacactttattttcaaggttaagtcacaaggtcatttctgatatcaatgagaaggcatgtataactctcctgcagggagaggcagaaaaaatattcgaacagatatacagtcagccatttccaccaaaccctgctttcttaccattgctggaaactatgtatactttgtattactcctaggtataactaatcgcattatacacaatgctttctaaagtggtatataattttgtcttaaatatattgtttgaaatttcaaatagcagtggtaatactagttctactatctttcagtttgatagcacacctaaattcctacagacaaaatactgctttatcagtttgctcttgtttagaggcccattcatttgtttatcattttagttgccttctttagaccttttcctagttcttataatttgtcagagttacagcatgagaattgcataaacattgcaaatgcaaagaaggacatgttatttgctccaagatagcagagatttctcctagcatatctgataacctctatgattatgtttattaatttttttcctgtggtaagacaacttaatatgagatgttcccttttaagtaatttttaagggtataatatgatattgttgacaacaggtacaatgttgcgtagcagatctctagagcttgttcatcttgcttaactgaatctttacgcccattaattaataactcccttttactatagctctgttaatcacataatttttccatgtggaaaataaatcagagattcttagagccttacctggattcctataagatagcattgaacaaaatatcctataatatttgttcttagaaggaaaataaaaagctctcaagtgaagtgtcatgcatttttctattgtgaggttcatttatgttatgttatttatttatttttgtgattaatgctttctatgattgagtgaggcagtacatttttgtccctctaagctgcttttattggatggctgttgtacagaaataataattactattggaactgcatctgcagttcttcatctaaagagaatttaggcagaaggctttcctcttcattttttttcttagttttttattatattttattttgtatcctaaccctcagagcctgtaatgctcttcatttttaaaaaaaaaacaactttttttcttctagatagccttatattatttcggtttaccttctgtattgtaatcatgtttccattgattccttaagtggttaaggtagttttattcagcatgtgacattttataatatatttttctcacattagctgtagaccttaggcaaactacttaatctctttgtgcctcagtttcttcttttgaaaaatgaggatagataatacttacctcagcataagtacaatgttgagtacatggtaaatgctcaataagtgttagccattatttgtattaccattgaaactttaattattattccataagacatttttctttgttccttcatgtattagtccattttcatactgctatgaagaaatacccaagactgggtaatttataaaggaaagaggattaatggactcacagttccacatggctagggaggcctcacaatcatggcagaaggcaaaggaggagcaaaggcacatcttacatggtggcaggcaagagaatgtgtgcaggggagatgccctttataaaaccactagctctcatgagacttatttactatcatgagaacaccatgggaaagaaacctgttcctatgattcaattacctcccactgggcacttcccatgacatgtggggattatgggagctacaattcaagatgagattagaatgaggatacagccaaaccatatcattctgctcccagcccctctcaagtctcatactctcacatttcaaaaccaatcatgccttcccaacagtcccccaaagtcttaactcactctggcaataactcaaaagtccaagtccaagttctcatctgagaaaaggcaagtccataatccagtagggcagtctttagccttaaatttctaaaattatctccttggacactatgtctcatgtacaagtcatgctgatgcaagaggtgaaaaatgaggatagataataattatctgaatataagtaccatattgagcatggttcccacagtctagagcagcttcacccctatggctttgcagggtacagaccttcttccagctgctttcacaggctgttgttgagtgtctgtagcttttccagatgcacagtgcaagctgtcagttgatctaccattctgtggtctgagggacagtggccctcttctcacagctgaactaggcagtgatccagtagggactctgtgtggtggcttcaaccccacatttctattctgcactgccctagcagaggttctccatgatggttccacccctgcagcacacctctgcttggacatacaggcatttctatacatcctctgaaatctaggtgaatgttctgaaaactcaactcttgacttctgtacacctacaggctcaacacaatgtggagctgccaaagcttggggcttacaccctctgaagccatggccagggctgtttcttggccccttttagccacagctggagtgactgggatgcagggcacatggcaagggcagccctggacctggcccaggaaaccatttttccctcctaggcctttgggtctgtgatgagacgggctgccgtgaaggtctctgacatgccctggagacattttccccattgtcttggtgattagcatttgattcctcgttacttatacaaatttctgctgtgggattgaatttctccccagaaaataggtttttcttttctactacattgtcaggctacagctttttcaaacttttatgctttgctttctcttgaacactttgctgcttagaaatttattctaccagatatcctaaatcatctctctgaagttcaaatttccacagatctctagggcagggacaaaatgccggcagtctctttgcatagcaagagtgacctttactccagttctgaacaagttcctcatctccatctgaaaccacctcagcctggactttatcatccatatcactatcagcattttggtccaagcattcaacaagtctttaggaagtttcaaactttcccaaattttcctatcttcttctgagccctccaaactgccctaacctatgcctgtcacccagttccaaagttgcttccacattttggggtatctttacagcagcacccccactttactggtaccaatttgctgtgttagtccattttcatattgctatgaagaaatatctgagacttggtaatctggaaaggaaagaggcttaattgactcccagttccacatggctggagaggcctcacaatcatggtgtgaagcaaaggagaagcaaaggcacatctggcatggtgtcaggcaagacagcatgtgtaggggaactccccttaataaaactatcagacctcataagacttattcagtattgtgagaatagtaggggaaaaacccacctccatgattcaactacctccgactgggtctctcctaagacatgtggggattatgagagctatggttcaagatgagcttaggatggggacacagccaaaccatatcacttcatttctgtagtatataaactgttgtccttgtgagaatctcaattttcatttaaagtatgttttttatgccattattatttttacttttatatctatatgtttatatggatattttgtttttggtttagacagatacagaaaaaaatcatctctatatatcagatctcatttaaaataaaaatctctcaatttgccagattaactaactacattcaccattctcccagtaaaccatactggctcatgccatctgtatgcttgtagttatcaattactctcctatctgacagatcacttatactttaaccagttcattgtatcttaacaaggcacttgtgattatgcaaatattagttttttctttttatacagaaatcactcagtttacttaaatgttatatcaaccaataaaataagtgcaaataataaatttatttcctcaaaacctaagttgaatgctttgaaaagacttggtaacagctagttgctaaaaaaaatgaagataaattaaatatggacgaggcaatataaagggttagaaagaacatcataaaattataagaggattctaaactcagattactttggaaatttctggacatctttttccctcttaaaaaacagtgaaaattatagttgatgttttataagtatgaaaacaaaagcaaaaagcaagacaaaataatagctgtactcaatgaacctgtttagaaaaaatatcttgtgtctacatgaagattgtcagatgaataaatatatatatatgttaggttgacataaaatgtttaagtttgtgtacatatattttatacttctatggttttaatcaaccttttaaattagggaatgaaatacatataagagaaataatgggcatttaatacctttacattgtacttgatcttagagaagacatgcattttgttacttttgtattttattttctgaatgataatagtcatcaaaatgatgaaagtcaaaaaatggaataatgaaagaatgacttgatcaatcatcagattgcatatatccaaggcacatttttactaaattttcaaggcatatattgttctctttttaaaaagattggattagtgagtagaacaaagaaaataaaagctagattaaatttcttgtctttcttttgaaattataaacatttatcaaggtagaaatattgtatgagaattagaaactctgtattgatattaaaaacttgtttgtgcttgtaaaatttattcactcacatatgaaagacactcctcagaataccaaattaaccacattcaaaaccctaaagatataaaggcaaaaaaaaaaaaaaaaccatattggagaggctctttaaggggtggaaaatagagtaagataggagcatggctcatatggtaacatacaactctctagaatatattttaacactcagaagtttttaaatacaatttttgcttttcagtaaataatgcattgtatttagtttttatgtctctttaagtcaggaaagcttcccaagctttcctgatcttaaagttttgatcaggtgttttttagaatacttcaaactagtctgatatttttctcatgattagaatgtggttatcagattttgtgaggaagaccacagagataaagtgtcattctcatcacatcacaaaagggtatatactatcatcatgatttatcactgttgatgttaacctatatcacctgtaggtagtgtttcttagatttctccattgtaaagttatatcactccccttctttacaaactgtactttttggaagaaagctactatgtacagcccagcttgaaatgtgcagtcttccttcacttccttcagggtgaagtatctgcacagatttgtctcttcttccattatgatttatatatttaaacacttattttagacattgtgttataatccaatactactttattaactttgttcaaattgtttcagttttagacattggttttttttttccgttggctcatatatctttttacatacccctgtccctccctcctccctccctcccctcctcccttcctcctttcctcctttttcttatctctttctttctttctctttctttctttctttctttctttctttatttcttttttctttctttctttctttttctttctttctttctttctttcctttctttctttctttccttttccttttctttctttcttttttctttctttctcttctttctttcttcttttcttctttctttctgtctttctctctctctttcttcttctctttttcttcttttttgagcatttgattgctttctggcactacaagatgctatagactcatcctgtatatttcttcacccacttccaaaatcagccatttctttaaagaaatggttccttttatttgtaaatggttttagaaactaaggtcttggctctagatgtgctcaatgttcctgtgatgctgctgcttctagactctctcagctgacagaggaaggaaatatatatgcatacagtaacttgtgtacatatacatatctatacatatttacaaatttatccaaatgtatctatattcagtcaacataaattcataaaaatgtctttaactctagcccattaccacaagaatcattttactcctctcctcttggtttcctgtaaccacccctcaccctcagtgagaagccaccatccatttcatccatttgcttaacttgcagtaacatgtctagtggaaataactcatcagttagagtatagtgtacctgtagtttcttttgtctttagtcctctagtctctgttcatctccaaggtcagtacctttttctcacatccatttcagtgtttcataaatttctattgcagttagattctcttttacagtctgcattccattctggtattccctaataccttaaatggttttaaaaaatgttttatacattaaaatttactcttagtgttgtgaagttccatgggtcttgacaaatgcatagtgtcatatattcaccatttttatagcatatagaatagctttattgctctagataatttttcatttattcgcttctcccaaagcacctggtaaccattgatttacaaaccatgtctataattctgctttttccaaaatgtcatataaccatacagtttttagtcttttcagaatgacttctttcacattgcaatatgggtttaaggtacatcatgtctttgtgtggattttatacatacatttttatgtaaatacagtagtaaatgtgttttccccaactttttttcttggttaaaaatctatattagggactatttcatgtctctaacacatgaacacttcatttttgaagctatggtatagcattccagagaacagataatctactttatttaagtatcaccttattgatgtttccaattttttgttattacaaataggtcttcactaagttactgcataccgttgaatttgtatatgtgtacaattattttatagaatatatggcatgaaacattgattgattggaggttatgtatgttgttaattttattcaaatttttattttgaaataattgtagttttacagatgttttacaatggttatacagggtttcttcattacctgtcccctagcttcttcagtgttagcatcttccattaaccatggttgtgtagttaatatttgatgtataatacatttttcctccaaggaagctatacaaatttacaatatttccaatactatataagaatgactctttttctgcagtctttttaagagtggatattacttttaaattttgtcaagtttatgtgtaagtacattttgttatttaagtagcattttcctgattttttgtgaagataaatatctttttatataattgttggcaatttttataatactttcatgaattttctgttcattttacttgatcatttgtaacatatattcctctttatgttttatcagcctcacctgcctccaacatgctcaactattagacacaagcaagtctatgaatatttccaatgttctatttcctgaggcacacctgcactcagagtctccatattttcccatcatttctatggtgccttgaatgaggcaccataatagagggagaggaactggcttcccaaagaggccaatacactcaactaataggggcaaatatttaactccctattagaggaatcttgacaaatagggcagaggaagcaggaaggaacaggcaggtaaatttatttttccttttactggacagatgaacttggtttttgaattgcttgtccctgattttattctcttctccctgccttctttctctcagtctttctgccttgagattgcatcttccagtaaaccattgccacatgagactgactctatctctgttttctaggcggtttgggttaagataccattttcctctagggcagtgttcttctttgttaatttgtaatataccatcatatataatgtcaattaattccttttttatttgtgctaaataattctgccagtttacatttgtctatgaaatttattgtacagtgcttctcactgtataaaagacatatatttttagatgttttgttttgttactcttttcatttatggctcctagatattcttatgttacttaggaaggctttctgtattccaggattatttttaaatttctactgtggcatcatattttaactttaattcatttaaaatgatgatgggaggcagaaattgatttagacttcaaaagtgatcctctaatttactttatccccaatcctttttgctcagcactaaaaagtctctgttaaaacgtgtgtgaaaaaatcataaaagctacacacaactatcaaaaaagaacactttgcctttgtcctaacatgacaaaccgaagaacataacttagatatacgttgggcagggtgggggaaaggggaagcaaaaaaaaaatctgttgaacttctatttctgaaaatgtattttcttccttaattcctaattataatattaagcaatatcttgctgacctacacttatacaaaattatcaatgtacatttggcagagaggcaaggttaactcaagaccacaaaaattcacctgccacttttgtgtcaaatagaaaaaaaaataaagttgtcccctgaaatggtttggctgtgctcctacttaaatctcatcttaaattcccacatgttgtgagagggacctggtgggaggtaattgaatcatgggatcaggtctttcccatgctgttctcctgatagtgaataattctcatgagatccgatggccttataaggcagagtttccctgcacaagccctctgtctctttgcctgcttccatccatgtaagacatgacttgttcctccttgccttctgccatgaatgtaaggtttcccagccatatggaactataagttcattaaacctatttttcttcccagtcttggatatgtctttatcagcagcatgaaaatggactaatagattaaattggtaccagtagagtgggttgctgctgaaacaatacccaaaaacatgaaaaagactttgcaactgggtaacatgctgaggttggaactgtttgaagggctcagaagaagataacaaactgagggagagtttggaactccctagaggcttgttgaatggctttgaccaaagtgctgataatgatatggacattgaaatccaggttgagatggtctcagatggagatgaggaacttgttgggaactggagcaaaggtgactcttgttatgttttagcaaagagactggtggcattttgccctatcctagaaatttgcagaactttgaacttgagagagatgatttagggtatctggcagaagaaatttctaagcagcaaagcattcaagaagtgacttaggtgcttttaaaagcattcagttttgtaagggaagcagagcataaaagtttggaaaatttgcagcctggcaatgcaatagaaaagaaaattccattttctgaggagaaattcaagtgagctgtggaaattagcatacataatgagttgccgaacattaatccccaagacaatggcaaaaatgtctccaggacatgtcagagttcttcacagcagcccctcccatcacaggcccagaggcctagcaggaaaaagtggtttcctgggccaggcccagggtgcccattgctgtgtgcagcctagggacttggtgccctgcattccagctgctccagctgtggctgaaaggggccaacatagagcttgggctgtggctttagaagatgcaagtctcaagccttggcagcttccacatggcgttgagcctgtgggtgcacagaagtcaagaattgaggtttgggaacctctacctagatttcagaggatgtatggaaatgcctggatgttcaggcagaagtttgctgcagaggtagggctctcatggagaacctctgctagggcagtgtggaagggaaatgtggggtgggagcctccacacagagtccctactggggcaccacctagtgttcctgtgagaagagagccatcatcttccagaccccagaatggtagatgcactgacagctttcactgtgctcctggaagagccatagaaaatacaagccattggaaacagctgggagggaggctctaccctgcaaagccacaggggtggagctcaagactatgggaatccacatcttccttcagtgtgacctggatgtgagacatggagtcaaaggagatcattttggagctttaacatttgactgtctcactggatttcagacttgcatgaggcctgtggcccctttgttttggccaatatctcccattttcaatggatgtatttacccaatgcctatacctatattgtatctagaaagtaactaacttgctttggattttacaggctcccaggcaaaagggacttgtcttgtcttggatgagactttggacttttgagttaatgctgaaatgagttaagaatttggggactgttgggaaggcgtgattggttttgaaatgtgaggacatgagacttgggaggggccaacaatggaatgatatggtttggctgtatccctacccaaatcttatcttaaattcccacatgttgtgggagagacctggttggaggtaagtgaatcatgggggggggcaggtctttcccttggtgttctcatgatagtgaataagtctcatgagatctgatggctcatgagatctgatggctttataatgtggagtttccctgcacaagccctccctgtctttgtctgctgccatccatgtaagatgtgacttgttcctccttgccttcttccatgattgtgaggctttcccagccacatggaactgtaagtccattaaacctattttccttcccaatcttgggtatgtctttatgagcagtttgaaaatggactaatacatcccctctgaatagaatcagctctgtaggtaggcagcttggcaagctttcatcatcattgctcatgttagaacagggcttcacttcgtggccaagacagccccacctcaaacacggagcatggagatcagagctacgcagcatttctatgcataccagcctccttagccacgtgcattagcacagaaagcaacttgttcagacctaataggggctctgttttaaggcaaagttctctgtgccctcttcctcaaataggtatggcaggaattatttactccttgaagaaaaatgtaagataatttgagaacattcagaaaagaaaagaggaggaaaaagacatgcgtatcaaaattctgaggtctttttctgagaccctaaactccctggagtctcctcaaaggttagaggggctttcctcaggtggactcatctccttgttatcttgtactgaaggttaaatgcagcacccactcccttttcaattcatgtgagcatccttattccctatggtcttttattatcacccacaggagagtgatatgggacattccatttttgttgaattttaatattcaaaatacctatagaaattaatgtacttgcttttaaggacaaagtatgtggtattctaccacatactggtaaagtatcattttcatgtccttatttcatttactttattggttttctaattttatactcaattcctaactccattcctatcttctcccatccaacttccatcattttatttacacaaatgtatatctgaaaatatatcttgctggatttatgttgtaaatattattgcctatattacttttgcattcaacataatgtttttgagctcaattaatttgattatatgtgaatctagttcattgtttaaaaatgatacagagacaaatgtatatacatatataatacatatcatttgtgtatgacacaaccttgccagtgaatagtacttttacttatctgttctttcagtattggatttcctgtgtgtttgtttctaccctgaggaatatactaattccctgtagttttcatctctttatagtccattgtttaaaaatgatacagagacaaatttatatatatataatttgtatatgaaacaattttgccagtgcatagtacttttaattatctattctttcagtattggatttcctgtgtgtttctaccctgaggagtatactaattccctgtagttttaatctccttatagcccttcctctcctgggatgccctttcttagcatggttagattttttttttactccagagatattacttcctgaactgagaaatcacaactatgcagacatcccttggggatgtatgcatgaggaagagagaaagcacacactctccataataaaccattcccacccaaaatctgtgccgttagaagccatttttgaatccacttttaaagtattcataactagatgccaaatcctctatataaactttcaaatcctttaacccctgaagtattcatttctagttctttcaataatactgccagaataacccttatgccactgaatcaactccatttcatcatgttatgtttctccctaagagactggccacccttttgtttcaggtctatcaccctttctgatagttcattgctgcatttcagcagcttaccatggcaaatagtaatactgtttttttctgtctttactgatgacagtcattcagcctgaataattatatttcctttaatatatttttcttaagctaaggtagtgggagtcattactggctgttgtcccatacacacccactgtggacatccagctttaaatgcaggtgtactgcaattgtattacctcaacagctggcatgttttaggtaacattaggcactaagatctactctgtgcattccttaaatatgacaattgtgtgatgataatgaaatcatggactcaagtcactgaagagaaagttttgtaatataaaatgcattttaaactttaaataaagacttctgcatttctaactttagaatccacaaggaaatattcttgtaaatttttaaaggagatgaatattcttaaatggagatgaaggatattcttaaagggaggtgaagatgtaaaaaatcctacctattcagttttccagttaagcatcagaataggagaacagaagataagggatatacaaaatcaacaagtaatttagctctttcaccagtttccatggcaactctactatataaaactaagaagaaaatgcattcaaaaaactcaggctttgctttggccttgatcattgacattttcaacattactgtcttcaatacaatgtgtaaagcaatcaaatacatatactggatataattttgacattgcatacaaagaattttatgaactttaatatgttatagttggtgtgtagtgggagggaaaaaaacagagtttctttttaaaactcaaattaaaaaattatgaaccttgtctatttgacaatgactgaaatgaattagttaatacattcccagtttaaaagggatttacacaggctgagtctgtttcctctgttctcagacaaaatgtttttcatgccattcccctggaatttctgtgctgactgagtcacttaagatgaatgacttgtccaggttgtcccaatacagtcaatgtcagccttaaaagccttctgaatggatcttctgagactttgatctttgaaactaaagatgcactttgagttgtggagtccttgtggctctgaaaggaatggtaatcctgtgacacttaggacttgattctcagatggcagaaccctaatgcacacacatgaacacatacatctcgttcctttgtcacagaaatgtccacagttctactgtataattccatctgagaacagtttcttcaaatggtgttttcctgccaagtgtgttttagcaggttatatttttgactgatttctgggatcttaatccagacccctgataacatttgaaatgtttaaatgggaaccttctatatagaatcataggatttgatattttaaaaatgttaatctttctcacatgttcttattacttattaaatttgactttatctttccatttgaatttattctcaataattatttaataattctcgaaaaatgtggttgaacgcatttattgccaggccctaaagaggggattgtagctaacataggttccctactactactaattgacttatgttcagggttctggaaaaaaaacacaatttatatcaacgatgctagaaaaagcttctgggaactgtaccctactgaaacaaatatatatgctctgtgaagaaaattaactgactctaacatgggggtaataattgcatttcctaaaatatcagtaatacttatgacacaatctatacaaagactgcatttcagaagaaccaaatatgtatcttttaatatatacatatgtatgataaattgtatttgggttcctcatccatgaatatgggtttatctacaaacggtttaggttttatccgtacttacatatttaaagattatattactttttgtagatgctgtaacacattattacaaacttagtggcttaaaacaataaacaatgtactattaaacagttctgaagattaaaagtctaaaatgttctagcaaggctccattatttctggaggctccaggggagattctatttccatgcctttcttaacttctagaagctgcccacatttgatgagttctggtcttgcatcactccaaccttcgtttccatattcacatctcctttgattatactactcctgcttccctgttatcaggacacttgtgattgcattgggcccatgcattcgtctattcttatattgctataaggaaagacctgccactgcgtaatttatatttaaaaaaagaggttcaattgactcacagttctgcagaactgggaaagcctcaggaaacttacaattatggtggaaggtatctcttcacagggatgcaggagagaaaatgagtgtgagcaggggaagtgccagatgcttataaaaccatcggagctcatgagaactcactcactatcatgagaacaccatggaggaatctgcccccatgagccaattagctccacctggtcctgactttgacgcatggggattatgggtatattagtctgttcttttgctgctagtaaagacataaccaagactggatagtttataaaggaaagaggtttaatggactcacagttccacatggctggggagcctcacaattatggtggaagacaaaggagaagcaaaggcacatctacatggcagcaggcaagagagagtgtacagagaaactcccctttataaaaccatcagatcttctgagacttattcaccatccccagaacagcatgggaaagacccacccccttgattcaattacgtccccccgaatccctcccaagacttgtgggaattatgggagctatgattcaagatgagattttgggtggagacacaaccaaaccatttcggctcacttatataatccagaatcatcttcccattttaagaccctaatttattcacatttggcttcaaacaatagaaatttatttcttgcttatggaaaatacaaagttgattcttctgattggtaggcaattctccaggaagaagtgatttaatgatgcaggtttcttctacatcatggctcaattatcattaaaagaacatttccaagttcaccagagaaggatcatgaaggaaacagcacatccaggaatgctttagtggaccaggcattgatgtaatgtttatcacttccgcccacatgtaagggacatgaataattcaatcacatgcctacatataacagtaaaatgccaggcatggtggctctggcctgtaatctcagaattttgggaggttgaggaaggtggagtccaggagttcaagatcagcttgggcaacgtggtgaaaccccatctctacaaaatacaaaaaaaaaaaaaaaaaagaaagaaaagaaaaaaagaaacaaacaaaaaaaccaaagtaataaattagcgtggcatggtggagtgctcctctaatcccagctacttgggatgctgagatgggaggatcgcttgagcccaggaagatcaaggctacagtgagccgtgattgcaccactgcactccagcctgggcaacaacgttagaccccatttcaaaaaacaaaaaagaataaactataaagctagggcatatagactagatatgtatctagcagaaagagacaatcaatttggtaaactgatatctggcttgagctggtcaacaggttgaccagtaaaagaaaggacatttcaacaacttttaaatgaatgctagtttaattatataataaaaacataaatagaaaataagatgaatgaattcaaaatttcagtattatgagataaagcgttagtttaaggctaaaataaatatctttaaaatcaccacaggataaccatgtttagctgtttagtattgagtcccaactggtgtaagcatgcccaggaatacagatagacatggataaagaaaatatttccttctttaaaggatagtttcatagaagctcagagtttaaagaagtaatacaattttcaaaaatattatattaccatataggattaaaatttacccgcttatttaatatagagaaactgctaactaattaactcattttatgaggaaatttttatgtgagaattatttttttattttcctgaagaggaatcatttgtttccatttgcagattccaaatggactcaattaacactcatttacaatctatctaaactgggatatttttcagccaccttggaaatcaatgatgattttgtctcctaactcataatctactagtctaagattactgctctgtttaaataatttctccaacagcaatggattgaggagacatcatgtaactcatgaatagttgctcttcctattcataataattttgtaagttgctttgtaaattacttccaggagagaaaacacatgacttcctttgacagtggtatctccattgttcagaacagtggaactaaacctgaatgaacagcatgacatgttgtttctgctgtcagtctatatacgtgttcttggaatcttcaagatttgcacaggtttacatgcaagagaagaatattttgtaatccagtagaattaggatactgtaggcatatatttttaaaatgtatgtaacaattgtctgtgacaccttcttttctctactaacacagcaacatctgacagttcattaaaaagaaaaccagaaaatgaaccacagtagtgaggactgtattaatttggtatttatattcattatataataatactaatccaattatatggaacaaagtttgaaagaaaaaaatgactgcaaggattggcacaatgtatgaaagataagagaaactggcgtaagtctttaaagagtatttccctttgcaatgaatactcaatgtaaggaaaaatttaaacattaaatgattatataaaagcatgaggtttctattttcctctgggttttgtaaaagaaacatgaagaactgttgtgaaaattgtgacaatctagtaattttttctcatttcaagtaatactccatacttttccttctcttattttactactacttccttattatttatgtgcataattctcctgataaaacctttgctgttttcactatacatggtgctggggcagtaaatgttttctctcctaatgtgtccctatgtgttattttaaaatcgctataatgagccaaaacatgaaatttactggtcattttctttattctgaaattatgaaatattccatgatgtgtatcaaatttatattgtagtacaaagaaaaagaaaatgagtccaaaaaggcaattctgacattacatttagaaactggatttagagtatttcatcagcagtgataaacattctagtagtattttgaggcttattatttaatatgaggtaaggcatatgagaagagcatccttttgctggcacaacttttaaaaagcattcagaagcactgcaataaattaaataggagaaataatatagatgcattgtttttactcattcatttattttcagcacatacccaatcaacattttagttaatgaaacagatttttcaccaatgaagtcacagcctcaataaattcagagttcagcactgccactgtgtagaaatgagggaatcaacttagacacatttctacacatggtcaaatttattgtctgatgctgtttcctgttctccagttacattctattagtggcattccatgaaagaaaaactctgatgtgggtgtcaaataattgatactaaatggaaagagtttctctgggctatgtaaagtctaacttgggagaggcaattgatacgatataatgtgtggtaaactccaataacaacaggcaatactcatgaaattctgtgcaagaagaatctatttggctgatatgtctgttctggcattagaagatgactaatacttgtcagacacatagatataatttggctaactctccttaataatatatagattgagttcacctggatgaaaaaaaaatgttttcaccactaacaatgtggccttagacaaattgcttaacctctctgtagtagtccattctcaaattgctataaagaaataccggagactgggtaatttataaagaaaagaggtttaattggctcgtggttccacagactgtacaggacttcctgacctggaatattggactccaagttcttcagttttgggactctgacttccttgctcctcagcttgcaaaaggtttattgtgggacctaaccttgtgattgtgtgagtcaacactacttaataaactcctgtttgtacatatgtctctcctattctgttcctctagagaaccctgattaattgcagatgctatctcatcatggttttgatttgcattcctctgatgagcagtgatcttgagcattttgtcatattattgttggctgtttgtatttttctgagaagtatttgtttatgtcctttgcccactttttaatggggttgttttttcactggctaagttccttatatattcagcatattagacttgatggatgcatagttttcaaatattttctcccattctgtgggttgttatagtttcttttgctgttcgaaagctccttaatttaataatgtcctttttgtcaatttttgttcttgttgcaattgattttgaggacttacatataaattctttgccaaggctaacaataataatagcattttctaagttttcttttagcatttatagtttgaggtcttatatttgaatcttgaaaaaatcttgagttttttttttttttatggtgaaaggtaggggtccagttaagttcttctgccagttatttcaggaccatttattgaataggggatcgtttctccattgcttatttttgtcagctttgtcaataagattagatattttcaggtgtatggctttgtttctgggtcttctattctgttctattagtctatgtgtctgtttttgtaccattatcatgttttttggttatcgtatagtttgacgtcaggaaatgtgctgcttccagctttgttctttttggttaggattgctttctctatttgggctcctttttggttccatatgaattttaaaatagtttttttaatatatttctgtgaaaaaagacattgatagtttaacaggaatagtattgaatctatagattgctttgggaagtatggccattttaatgatatcagtttttccactccatgagcattgaatatttttccatttatgtcatctctggtttctttcagcagtgttctgtagttctctttgtagagatcactcacctttttggttagatttatgcctaggtatttgtgtgtatttgggaggagtgctgttttgtgggactgtgtttttgatttggctctcaacttgaacatcacttgcgtattgaattgctgttgattttgtatattggttttgtatcttgaaatatttctgaaatcacttttaaggtccagtagaattttctaggtatagaattatatcttcagtgaaaagagatagtttgacttcttccctttctacttgaattcctttaatttctttatcttacctgattgttatggctgggacttccattactatgttgaataggagtggtaagagtgaacatccttatcttgttccagttttattggagaacacgtccagctttttgatgttcagtatgatattggctgtgggtttgtcagacagggctcttattattttgaggtatgttctttcaatgactaactcaatcagagtttttaacttgaagggatgtttagtattatcaaaggctttttctgcatcattgagatgatcatgtggtttagttttttatttctgtttatgtgatgaatcatatttattgatttgtatatttgaactaaccttgcatcctagggataaagtctacttgattgtcagggattagctttttgatgtgttactggattttgtatttatgtttatgtgatgaatcatatttattgatttgtgtatgttgaaccaaccttgcatcccagggataaaatctacttgactgtgggggattagctttttgatgtgctactggatttggtttgctagtattttgttgaggatttttgtgtctatgttcagcagcaattttagcctgatatcttcttttttgcatgtgtctttgccaggttttagcattagggtgatgctggctttgtagaaagagttaaggagttcctcctctttgattttctggaataatttcagtagaattgatactagctcttctctgtatgtctgatagagttcagctgtgaatccatctggtccagggctttttatggctgttagattttttatgaccaattccatttctgaattaggtattagtctgttaaaggtttgaatttcttcctgattcaatgttgggagattgtttgtttgccagaatttatacatcttttctggattttctagtttgtgtacatagagatgttcacaatagactctgaagatcttttgtaattctatggtatctgttgtaatgtcacctttgtcattttttattgtgcttatttggatcttctctctctttttctttgttaatctaagaagcaggctatcaattttgtttatcctttcaaaaatcagcttttgttttctttaatcctttttaagtatttttgggtctaaatttcatttagttctgttctgattttatttatttattttcttctgttagcttttgggttactttgttcttatttttctagttcttctaggtgggatgtgagatcattaatttaagatttttataacttattgatgtagctgcttagagatataaactttcctcttaacatttttttggctgaattcaagagatttgggtatgttgcttcttgatatgttttcatttatttcaaatatatatttaaaaaagatttctgccttcattgtttaccaaaaagtcattcagaagcaagttgtctaatttctatgcaattgtgtggttttgatagatcttcttagtattgacttctatttttattccaatgtggtctgagagtatggttggtatgattttgatttttttttgaattttgagacttgctacatagctgagcatatggttgatcttatagcatgtttggtgtgcagatgagaaaaatatatattctgtggttgctggagggagtagtttgtaaatgccaactagttctaattggtcaagtatcaaattaaaatccagaatttgttagctttctgcctcgacattctgtttaatgctgtgactagggtgttgaagtccacttatataattgtttggctttctaaatcttttcatagctctagaaagaatcttatgaatctaggtgctccagtgttgtgtgcatatatatttgggatggttaagtcttcttgatgaattgaaccccttatcatatgtagtgtctttgtttgcctgtttttaatgtttttcattaatgtctgtttcatctgctatacaaacagcaagctctgctttgtttgtttgttttctgtttgcatgatagaacttttttcaagcctttactttgagcctatggatgtcattacatgtgatggatctctgaaagatagcagagagatgggtcttgctattctttccaacttgccactctaccttttaagtgtgtcacatataccatttcaaggttaatattgatatgtgagatgctgaacctatcatgaagttgctagcatgttgctttgtagtttttattgtgtacttgctttatagtatctatggactatatactttggtgtgtttatgtggtagaggtatctctttttgtttttcaatgtttagaactcccttcagaatctcttgtaagtttggtctagtggtaatgaattctcttagtaattgcttgtctggaaaagattttatttctcctttgcttatgaagcttagttgggtgggatatgaaattcattgctggaacttctttttctttcattttttttttcagaatgctgaaaataggccttcaatctcttctggcttttaatgtttcttcttagcagtccactattaacctgacagggttacctctgtatgtgatctgactcttttttgtagctgcttttaagattttacctttggcactgacttagacactctggtgagtatatgccttggtgatgttcattttgtatactttcttacaggtgttttctggatttcttacacctagatgtgtacccctctagcaagattaggaatttttttgattaatcccttagataaattttctaggttgatactttttcttattctctccaaggaatgccaataatttggttgctttacattatcctttttctcgaaaactttattcatttttttttctttctgtgtgactgggctagaacaaaagattgtctttcaagctctaacattatttcctctcctttgtctagtctattgataaagttttcagttgtgtttcaaaattccttaagtgaatttttctgttccagaagttccaatagatttctctttaaaatgtttatctctttcttcatttcctgggttgctttaaaggtttctttgtgttaattttcaaccttgccctagatctcattgagcttcctagtaatccatgctttgaattcttcatctgttatttttgagtttccattttctttagggagcattactggagaggtgatatgattctttggtggtatcacaacattcagattttacatagtaccataatttattttcctttcttcctttccctataataatattgaagtttcctttgttgttgcttttttgccccctcccaaccccatgttagttcattcttacattgctataaagaaaaatctcagattgggtaatttataaagataaaagttttaattggctcatagctccatagtctgtaaaggaagcatgatgttggcatctgcttggcatctgctttgcttcttcagaggcctcaggaaacttacaatcatgaaggaagatgaagggggagcaggcaaatcacatggctaaagccagggcaagagagagtgatgggtgagatgccacacacttttaaatgaccagatctcacaataactcactcaatatcacaagagcagtaccaaggagatggtgatgaatcattcatgagaaacttccgtcatgatccagtcactctcaccaggccccacctccaatacagggaattacaattgaacacaagatcaaatatgtatccatctaccttggttacagccagctcttacccacaagtaccatctattagcctgtgggtcaaattgtacatcccaatataaaaccagttgactgatgtacacagggctatagaagcaaagccaaaaaactctaaacaacattctgtacaatccacatcccctagcaaaggggtgatatagttttgaatatttgtccctgacagaatctcatgttgaattgtaacccccagtattgaaggtgagacatgatgggagtgattgcattatgaaggtagtgtttcatgcatggttcattgccatctccttagcactatcctcataataattattaagttctcatgaaatctgctcatttaaaagtgtgtggctccctcccctcattctctcttgctcctgttctgtgcatgtgaagtgcctgctaccttgtcgccttccacagtgattgtaagtttcctgaggcctacccagaagccaagcagattccaaggctacagtaaccacaagagcatgttactggtataagagtagacacatagaccaatataacagaacagagaatgcaaaaatgaagctgcacacatcagttcaaatggtttttgttaaacagtcaaaaaataacagatgttgatgaggctacagagaaaagggaacacttacacactgttggtgggaatgtaaattattttggccgctgtgttagtctgttttcacactgctataaagaactgccccagactgggtaatttataaaagaaagaggttaaattgactcacagttccacatggctagggaggcctcaggaaacttacaatcatggcagaaggcaaaggtgaagcaaagcactttcttcacaagatggcaggagggagaatgaatgcaggaggcactgccacacacttataaaatgattagatcttgggaagactcactcacaattacaagaacagcatggaagaaaccgatcccatgattaaattacctccgcctggtctctcccttgacatgtgaagattacggggattacaattcaaggtgagattttaggtgaggaaacagccaaaccatatcattctgcctctggccctgctgaaataccatgtcctcaatacttttccatcaattctcaaaaatcttaatttattcaagcattagcccaaattccaagtcttaagtctcatctgagacaaggcaagtcccttctgtctatgagccagtaaaatcacaagcaagttagtcacatcctagatacaatggggatacaggcattgagtaaacacacccattccaaatgggagaaattgcccaaaacgaagggcctacaggccccatgcaagtctgaaatccagtggtgtagtcgaatcttaaaactgcaaaatgatctcctttgactctaagtctcacatccaggtcatgctgatgcaagagatgggctgacatggccttgggcatttctgcccctgtggctttgcagggtacaggcctcctcggctgctttcatgggctggcgttcagtgtctgtggatttttcaggcatagggtgcaagctcttggtggatctaccatctggagtctggagaaccatgcccctcttctcacagctctactaggcagtggcccagtggggccactgtgtgggggatccaacccccatatcctttccacaccgttctagcagtcgttctccatgagggctccacccctgcagcaaatgtctgcctaggcatccaagtgtttccatacatcctcagaaatctaggcagaggttcccaacctcaattcttgatttctgtgcacctgcaggcctaacgccatgtgtaagccaccaaggcttagggcttgcaccctctgaagcaatgacctgagctgtacattggccccttttagccacagctgggatgcagggcaccaagtcctgagactgcaaaaagcagcaagggcctgggcctggccacaacaccaattttttcatagatctctggacctatgatacaaggggctgctgcgaagacctctgacatgtcctggagacattttccccattgtctgggtgattaacatttggcttctcctttcttatgcaaatttatgcagcaggcttgaatttcttctcagaaaatgggtaatatggtttggctgcgtcctcacctaaactctcatctcgaactgtaatcggaattgtaatcccacatgtggggggaaggacctcatgggaggtgattagataatgggggtggctcccccatactgttctcatgatagtgaatgagttctcacaagatctgattgtttttataagggactgtgcccctttcactctgcatttctctctcctctcaccacgtgaagaaggacatatttacttccccttctgccatcattgtaaatttcctgctgcctccccagccatgcagaacagtgagtcaattaaacctattttctttataaattacccagtgtcacatatgtctttatagtcaggtgagaatgaactaaaatagtaaattcgtgccacagcaggtggaatgctgccataggataccccaaaatgtgaaaacaattttggaattggtaacaggcagaggctggaacagtttggagggctcagaagaagacaggaggatgtgggaaagtatggaacttcctagagacttgaatggctttaaccaaaatgctgatagtgatttggacaatgaagtccaggatgaagtggtcttagatggagatgaggaacttgttgggaactggagtaaaggtgactcttgctatgctttagcaaagggattggtgacttttgcccatgccctaaaaatctgtgaaagtttgaacttcagagagatgatttagggtatctggcagatttgggaggattgttggaaaggaatgattgtgttttgaaatatgaggacatgagatttgggtggggccatgggcagaatgatatggtttgactgtgtccccacccaaaatctcatcttgaatcgtaatcagaattgtaatccccacatgtgtgggagctcattaaatgatgggggcagtctcccaagctcttcacatgatagtgagctctcaaaatatctcatggttttttcaggggattttccctctttgctctgcttttctctctcctgatgccatgtgaaaaaggatgtgtttgctttccctttgccatgattgtaggtttcctgatatctcctcagctgtgaagaactgtgagtgaattgaactactttttaaaaataaattatgcaatctcaggtatgtctttatagcatcatgaggacagattaacacaatgggtttttcttttctattgcaccagcaggttgcaagtttttcaaacttttatgctctacttctcttttaaacataaattccaactccagaccatctctttgtgaatgcagaaaactgaatgttttaaagagcacccaagtcatatcatgaacattttgttgcctagaaatttcttctgccaaataccccaaatcatctctttcaagttcaaagttccacagatctagggcaagggcaaaatgccaccagcctctttgctaaagcatagcaaaaatcacctttattccagttcccaacaagttccttatctccatctgagaccacctctgcctagacttcattgtccttattactatcagcattttggctaaaaccatttaacaagtctttaaaaagttctaaactttctcacatctttctttcttcttctgagccttcgaaactgctccaacctctgcctgttacccagttccaaagtcatttccacattttcatgtatctttatagaagtacccccactctaccagtatcaatttactgtattagttcgttctcacactgacataaagaactgcctgagactgggtaatttataaaataaaaaggtttaatagacttacagttctgcatggctggggaggcctcaggaaacctacaattatggcagaaggcaaagaggaagcagggcaccttcgttacatggcagtaggaaggagaataaatgcaggaggcactaccacacacttataaaacacatcagatcttgtgagaattcactcactatcacaagagctgcatgggggaaaccactcccatgattcaaatacctccacttgatctctcccttgacacatgagaattatagggattacaattcaagatgatattttgcactgggacacagccaaaccatatcagcaagtatagaaagtgtcgagaccagctcagtcgttaagactgtaacacagcggtgctagaggaattaaagacacacacacacacacagaaatatagagcatggagtgggaaatcagggggctgacagccttcagagctgagaaccatgaacagagttttacccacatatttattgacagcaagccagtgataagcattgtttctatagattatagattaactaaaagtattccttattggaaataaaggtatgggtctgtctagttatctgcagcaggagcatgtccttaaggcacagatcactcatgctatttttgtggtttaagaacacctttaagcggttttccaccctgggtggaccagatgttccttgccctcattcaggtaaaccaacaaccttccagcatggacgacatggtcatcacgaacatgtcacattgctgcagagattttaaacaaaatttatggccagtcttgtggctagtttatggccggatttgggggcctattcccaacatgtccaccttctttgatttgcaaagcgataaaagcaaaggcagctttgtcatggcgagctactccttgcaggagtcaggatcagcatctgcagactatacaaacacaaacaacacagattaaaagcacaatcaacattgaaatcacagagcttccaagtgtttttatccattttaatgggttattagctgctaatctgtctgcagctccttcaaacactccagttcctggcattaagttcaggtgtgcctgggatgctttaaatttttttctttttattttgtaatatccaaagagaagtttgtagagtgtccttctagatgattttttattctttcccaaatttgtatcttattaatagttattaatagtttccacaaatccttatgtttagctcctacaatgggccatatcatttgaggttgaggtgccactataccaccatggttccagataataggaactcttgacatacttcttaccatttctaccatctgactgttttgttcagaccagctgaacatagtgtggctgtggcacacagactgaggggtgcaatttaagctaaacatccccttaggggaccaatcaataatgattccataggaatcattgcacagcacctccacctgttctgcaatgaaatcttcccaaacaactgttcattttttctgactgggtccaatcctgtttacaaataggtttgtgagggcggtatgccttaattataggagcagatttattatggtaaatactgagatcagaaagcatgtgtaactgtgtcatagagtgattacatccaggcattattgccagccaagattgataaatatgcccaataagtataactgttctctgtgtcagcccttgttgaaggaatactcatgggaatggtgatcaccactatcatagctatcattaaattactcattgtgactaattgtcccactttccttaggttttcttccaccatctgtgacagcttcttgatctgtccccaggtaggtggctgtgtcgacgggtgttactcgtgacagttggggtcctcctcagcatcagtcttgacatggctgcaagcggggtggtccttaggatccttccagaatctcttccttgacatctggctcatgataaggtttcaagtgtcttgatggtatccaaatcggctgttgattcagtcctggagaaacacaggaataaccaattaaaaaattgacagtttcattttaggaaaatgattatcgagaatactcacagtcagctaaatggatttgccaagtaagactatttataaaagccttctgtatttttgcctttgtgagagggacaataatttttccaggatcatatctgtgtaatttaacaatccgagttctcccatttcctaccatagtagcgatttgatccaaataaggaattagagtctgtgaattagtatgtggaagaaaaagccattctactaagtcctgctcttggataataacatcagtaggtgaatcctgagttggaaaaattagcaaatctagagtcttctctggatctattctatttatttgggctttatggacttactttttgattagctgtaactctgcctcagcctcctttgttaattgccaagggatagtgagaataggatctcctctaaggatagaaaatagattactcatggcataggtaggaatgcctagagcaagtcgtatccaattaatgccccctagtaatttttgaaagtcatttaaaaattttcaattgatccctacttatggctactttctgtggcacaatggtagagtcatttactaaggtccccaagtaggagtagggagtagtagtttgaattttgtcaggagctataattaaaccagcacaagaaatcaaattttgcaagtgatcataacattggagtaatatttctcaagtgagggcagcacaaagtatatcatccatataatgaataatgtaacactgtgaaaaatttttaggagtaggttcaattgcttgccctacgtaagtctggcaaattgttgtactgtttaacatgccttgtggcaacactttccagtgaaaatgcttagcaggctgcaggttgtttactgcaggaattataaacgcaaaccattcacagtcttgtccgctaaggggatagtaaagaaagagtcttttaaatctatgacgactaaaggccaattttttggaattatagcaggagaaggcaatcctggctgtaatgcccccataggttgtataactgaattaatggctcttaagtcagttaacattctccatttacctgattttttcttaattacaaaaactggagaattccaaggggaaaatgttggagctatgtgcccattttctaattgttcagtaattcctctgaagcctccagtttctctttatttagtggccatcgttccatccaaattggcttatctgttaaccattttaaaggtataggttctggaggttttacaatggccaccatcaaaaatgatagcctaaaccttggcaggaactttgtctttctgctttaagtggttctttcaaaccttgcaaatttttgcctagtcccacaccagggacataccccatttcatgcatcacatgttgactctgagggcaatataattgttctggaattagaacttgtgctccccattgttgtaataaatctcttccccataaatttataggtacagaagttataattggttgaatagtcccaggttgtccatcaggcccttcacaaagcaaaatataactgctttgatagacttcagggggtttaccaactccaactacattaaattgagtgggttgaactggccactcagacagccaatactgcagagaaataattgaaatgtccactcctgtatctaccaaacctttaaatttctttccctgaatagttatttcagacgtaggttgtttatcagtaattgattcacccaataagctgctttgccttatttgtgcttccaaatcctcctgttcatttaatttcacttttttccatttccacatacggcacaatcaggagctgtgctatgtgctctcctggctctgctttccagggaacagaagtagatacaacaatttgaatttcccctttgtaatctgaatcaatgattcctgtttgtacttgtaccccttttaagtttaaactagaccttcctagaagtaatcctatcatccctgctggcaagggtccatagacccctgttgggaccttttgcgtgggttccccagacagaagactcacagcttttgtgcagcataaatctactgcagcactaccagctgtggtgggggacagacattgtacaggggtgagggaatggcctgagctggaaatgccctggtttctaatggggcctgagacgggcccctcatggcatttcccgaaatcagggtcccaactttatcaattagagtgacattgattacccaatgttttccttttttacattttggacatacttcaggctcagcagttttctttttttccctatctgcctgcctgacttgctgattttttctacattcttttttaatatgaccatgcttccagcagttaaaataagctccaggaaatggagtatttcctttatccactctcagtcctgcctttgcctgtgccaacaaagtagctttatgctgattacctccaataccatcacagaccttgatataatcaactaaatgtgccttccctctaataggtcccagagcagcctggcaattgggattagcattgttgaaaactaataactgcaacactatatcctgagcagccgaatctgcaattacctttttaagagactcctgtaactgagctataaaatccatgtatggttcttttggtccctgtttcatagcactaaaggaagggtattgttctccacctgaagtgattttttcccaagcttgaatgtacactcctctaagctgctctatggcatcatcctgcatgaccactcgtgcatctaaaccagcccagccactgaaccccaaaagttggtctgcagttatattaatttaaggttgggtctgggcaatgtgagaaggctgaatggaagcttcatctgccaccaagttttaaattgtaagaactgagcaggagttaaacaagctcgagtaagagcatcccagtcagtaggaataatccaactggaaataacaacattctttaacagtcccattacaaaaggagaacctggtccatattcattaatagctttttaaaattctttaagtaattgaaagggaaaagactcaaatgtggctatatttccctgttgatctggggggtgtattctaacagataactgccaagcctctaaatcaccctctcatctagcttgctgaattcctgcctgaatagaactgagagcagttgctcaaggtgctgcttgaacagtcactggggcaactacttttttcccagtgtcctccagaaaagaaagatctggagggtcaggccactctttttcttcaaaataatgagggggtgcagaagcatagagatgaatctcttcctcttttgctgctttagctttagctggcaaacaaacctgctctgtcatgtcttctgttactttgttatactctccttcctcatcataatcagtgtgaaaaggttctgaggtggaacaaaccagagcccacacttgtcccattgttaccctgatgcttctgagctccccttcttatttaccatggggattgctttaaagagtactcagatgtcctacagcttagttccacattctccaaccgtcgctccagtgacccttcgacctgggttcgagccccaacatatggacaccacttgctgagaccaacttggtcatggagaccctaacccaggagcgctagaggaattaaacacacacacacagaaatatagagggtggagtgggaaattagggggctgacagccttcagagctgacagctgtgaacagagttttacccacatatttattgacagcaagccagtgataggcattgtttctatagattgtagattaaaagcattccttacaagaaacaaagggatgggccaaagtaaagggatgggtctgtctagttatctgcagcaggagcatgtccttaaggcacagatcactcatgctattgtttgtggtttaagaacacctttaagcagttttctgccctgggtgggccaggtgttccttgccctaattctggtaaacccacaatcttccagggtggacatcatggtcgtcactaacatgtcacagtgctgcagagattttttttatggccagtgttggggccagtttatggccagatttgggggcctattcccaacagcaaagcattttggagatttctcaaagaactgtgagttgaacctaccatttgactgtgcaatgccattactgggtatatacccaaaggaaaataatttgttctactaaaaagagtcatgtactcatacgctcattgctgcactattcacaatagcaaagacatggaatgaacccaggtgctcatcagtggtggattagataaggaaaatgtggtatatgtacaccatggagtactatgcagccttaaagaagaatgaaaccatgtcttttgcagctggtaaccattatcctaagtgaactaacatagaaacagaaaaacaaatattgcatgttttcacttacgagtgagtacacatggcataaaaatgggaacaataggcactggggaatacaagaggtgggagaaagggaagaggataagtggcaaaacataccacttattggatactatgctaacaacctgggtgacagattcattcatacttcaaacctcagcatcatgcaatatacctatgtaagaaacctgcacatgtgcccactaattctaaaagaaaatttaaaaaataggtatgtaaatatgacataaaagttatcaatttagatacatccaatttgtttatttttttcttttgctatttgtgcttttggtgtcatatctatgtaggctaatcaagatcacaaggatttattcctatatttttcttctaagcatttcatacttatagctgttacatttatgtatatgatctcttttgagttagcttttatttatagtgtgaggttgaagattcaacttctttcttttgcatgtgagtgtccactgctttgggcactacttgttgaagataatactctttcccccattgaatggtcttagcactcttgtcaaaaatccgttgaccatcaatgtataggtatttttctggatgctcaattatattctcaatccatatatctgtctttatgccactaccacactctgtcgattactagagctttgtataaacttccaaaattttgaagcatgactcttccaactttgttcttccttttgcaagattgttttagctattttgacttttaatataaagtttaacataagcttgccaatttcagaataaacaccagctgagcttatgatagagattgcatttaatctatatatcaattttggaaatatttccatattaacaacattacattttcctatttatgaatatggcaatttaaaaattttgtcatctttttaaatttccttcaaaaatatttatttcacagtataagttttgtaccttctacattaagttaaattgaagagttttctaaatttcattatagaaataatttagttaagataaatagaattgttttctaaatgtcctttaattgttcatcattagtctagagaaatacaattttgtgtattgatcttatacactgcaacattggtgaatttacttattctagtagtttatttttctggattcctaagaaactccatacataacctcatatgatctgtaaatagatataattctaattctacctttctaatttatattatttcattttattttcttgcctaattggcctggttaggatctcttatacaatgatgagtaaaagtggcaagattgggggttcttattcctcatcttaaagtgaaagcactcagtattaattaaatatgacatcagctgtaggttccttagagatgccctttatcaagttgagacagtttctgtttattttttaatttgtttttatcataaaaggatgtcagattttgttaaatgtttttctatgtttatttagagggttaagaggcttttctcctttgtctatagatacaaggcattccatgcatttattctgattgctaacccaaccttttatttctaaaatatatcctacttggtcatgggacagtattttttttgtatgttgcccaatctggtgtgttagtattttgttaatttgtgcatatatattcctaagagtcatggatcagtagttatattttcttgtaacttgtaagttgtattttctttttccctggttttggatcaaggtaatactattctcacagaactagttaggtagttgtttccttttcttctatttttggaagactttgtacaaaaaattgtattaatttattctttaaatatttggtagtatataccagtaaatcattttatatctaagcatcagtttatgggaagatttttttaaattagtaattcatcttttaattattattcgtttattgagatttttatctttattttttgagtgagttttgggttttagtttctttctaggagtttgtctttcaaaatttttattatgatgtgtttgtgtatgaatatgttttcgtttataattctctgagcttgttgaactctttggatgtgtaaattaatgtttttcatcaaacttgtggagttttcaggtattattaaaaaaaaaagtctttgctgttttctcccctctccttctattactcccattatgtgtattttgttttgcttaatgtgtcccacggttctttgagtatctgttcatttttctttattcttttttccactcttctttgggttgcacaacctctattgatctattttcacatttgccgatgtttttcttctgccaccttaaatctactcttaggctattctggtatatttttcactgagttattttactttcaactcaagttttcatttgattgttttataactttatatctatttatattatctatttgatgcttgattatcataaaacattctctttgattctttagcatgggattctttagttcttcaaaaatatttataatagctgttttgaggtactatatttgtttgtttaacctgatatctaagtcttcttgcatgcagcttttgttgtttgctccctactctacctgtaagggtcacactttcctttatatttagtaattttatattgaaaactaggcattttaaataatatattgtagaaacatacctcatgcctttcagggacttgttgtttttaatttatctatttattgattttgctgaacaattttgtggaaatctatttcatcaacaatgtgaagcctgcccatatcaggaagatattatagatattatagttcttgactgggtgctggggcacagggagccttttttttttggcaatatccaaagtggaccaaccatcatgctgaactggttggggtacacaaggaaggagagggttgcggctcaattaccagagatgcttaatgatctcattgagatttagtagaatttcctgaataaatgttacttcatctcttgtagacccttaggacaatttccaggtacatgaaatggttgtgtatgttttttttttttaaacaattttcaccagtttttcccagcaacatttattcaatagggaatcatttccccattgcttgtttttgtcagttttgtcaaagatcagatggttgaagatatgtggcattatttctgagggctccgttctgttccattggtctgtatctctgttttggtaccagtgccatgctgttttggttactgtagccttgtagtataatttgaagtcaggtagtgtgatgcctccagctttgttcttttggcttaggattgacttggcaatgtgagctcttttttggtttcatatgaactttaaagtagttttttccagttctgtgaagaaagtcattggtagcttgatggggatggcattgaatctataaattaccttgggcagtatggccattttcacgatattaattcttcctacccttgagaatggaatgttgttccatttgtttgtatgctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttttacattgattttgtatcctgagactttgctgaagttgcctatcagtttaaggagattttgggctgagacgatggggttttctagagataaaatcatgtcatctgcaaacagggacaatttgacttcctcttttcctaattgaataccctctatttccttctcctgcctgattgccctggccagaacttccaacactatgctgaataggactggtgagagagggcatccctgtctcgtgccagttttcaaagggaatgcttccagtttttgcccattcagtatgatattgtctgtgggtttgtcatagatagctcttattattttgagatacgtcccatgaatacctaatttattgagagtttttagcatgaagcgttgttgaattttgacaaaggccttttctgcatctattgaggtaatcatatggtttttgtcgttggttctgtttacatgctggattacatttattgatttgcatatgttgaaccagccttcctcaaacaaatttacaagaaaaaaacaaacaaccccatcaacaagtgggtgaaggctatgaacagacaattctcaaaagaagacatttatgcagccaaaagacacatgaaaaaatgctcatcatcactggccattagagaaatgcaaatcaaaaccacaatgagataccatctcacaccagttagaatggcaatgattaaatagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatgccattactgggtatatacccaagggattataattcatgctgctataaagacacatgcacacgtatgtttattgtggcactattcacaatagcaaagacttggaaccaacccaaatgtccatcaatggtagaatggattaagaaaatgtggcacatatacaccatggaatactatgcagccataaacaatgatgagttcatgtcctttgtagggacatggatgaagctggagaccatcattctcagcaaactatcgcaaggacaaaaaaccaaacactgcatgttctcactcacaggtgggaattgaacaatgagaacacatggacacaggaaggggaacatcacacactggggcctgttgtggggtggggggaggagggagggatagaattaggaaatatacctaatgttaaatgacgagttaatgggtgcagcacaccaacatggcacatgtgtacatatgtaactaacctgcacgttgtgcacatgtaccctaaaacttaaagtataataaaaaaattcaaaaatacaaaaataaagtatgagaacaaaataaagacattttaccaatgcaaaaaaataaaaaaaaattaaaaaattaaaaaacataaaaaaattggattttaatcatcctgaaatattttgtaattatcttgttaaactctttcactgtgttttcctagttccactgtgatattcctagttttacattttcctaagtcactatttctcatacagggataattttgtccctctagagacattgtcaataactgaaggcattgttgattgtcatgagtcgggtagttataaacctaaagagacatttctcaaaagaaaaaatacaaacggcaaataggtaaatgacaaagtgctttacatttctattcatcaaggaaatgtatatttaaaccataatgaaagattacctcacatctgttagaatggctgttttccgaaagacaaaagacaacagtgttggtgagaatgtagagaaaggggaatccttgtacactgttgttaggaatctaagctaatacagccattatggaaaacagtatggagtttcatcagaaaactaaaaatagaattaccatatgtcttaatccttttgagctgcaagaactgaataccacagactagctaatttataatgaacagaaacttattggctcacagttttagggcctggcaagtccaatttcaatgtgtcagtaggtctggtgtctgataagagcctcgtctctgcttccagtctagtgccttggatactgcatcctctggagaggagaaacactcttctttacatagcagaagagcagaaaagctaagagggaatgagataaggagaaagagagagagaaggagacagagagagagagagagaacccattcctaaaatcccctttctaaaagatattaaacccactcatgatggaagggctctcatgggttaattacctctcaaaagttttacttcttaatgcaattacaatgacaattaaatttcaacatgcattttggaggggacaagctttcaaacaatttctcagtatatttcaaaaggaagtagattcagtatgtcaaagagatctctgtacttctatttccgttgcagtctttttcacaatagctatgttatggaagaaactcagtgtccaccagacagaggagccccacctgacatccctgcaaaggcaatcgcccagttaactagacctacaataagctctgcctgcccagagtcatcactagctggcccctccagagtcacagcctaaagaaagagtgaaagtctatttttgccaaagaaaacctgtatagtccagaacagggagctgtgtcctcaaatgcacagacaacaatacaaggacaggaagattatgaaaaattagaaaataatgacgcctccaaaaggaactgaaaatattctatctatagattttaaaaatggtgatctatgtgctcactaacaaataattccgaataattctctttaaaatgttcagtaaactacaagaatacataaatagattcaatgaaattgttaaacaatacccaaagtgaaaaatttgtcaagaaaatagaagcaataaaggagaagcaaatataaatcctagagataaaaaatacaatgatggaaccaaaaaatttaatagaaatcttcaatggcagacgtaaccaagcagaagaaagaatcagtgagctgaaagaatatttaaagttaaccagaggagtaaaaagacaaaatgattgcaaagaatcaagaaagcctacagaaattatgagacaccatgaagagtccaaaccttcacataataagaggtatagagaagaaggaagcaaaaaagagcactagaaagtatatttaaagaaataatgattgaaaattttcttaatttgatgttagacaccaacatacaggtataggaagtgcagagctctctaaatttaacccaaagagaagtttataaagacacatagtaatcaaagtaccaatatcaaagacaaaaaaattctgaaagcagcaagagacaaatgcgcattacatataaattagtgccaatatgactatcagatctctcagcagaaaccctactggccaggagagagtgggatgatatagttaaagagctgaatgaaaaaaaattactaaccaagaatattctatctagcaaagccgtttttcagaaataagagacaaagaaaaacttttccagacaaacaaaagctaagggagcttttcactgccagagctgttttacatgaattgctaaacggagttatttaaactaaaacagaagtttctaattaataacataaagcataagaaatcacagaattcaatggtataagtaaaacagagacatatttagaatacagtaggactttaatgacggtaaaacaattttattcctagaacaagggctaatataacaactatttaaaaaaaaactacagctaatattacccaaggatacattttataaatgatggaaattctgtcatcaaaaacacaaatggaggagggaataaatgtttagggttgtatacattcaaagttagcttgttattggcttttaatagactgttataagatggtctatgtaagctgcatgataatgacaaagcaaaacacttaataaaagcacaaaataaaaatagaaatgattcaaagcatatcactataaaaacccatcagaccacaaaggaagacagcaagaatgaaaggaataaacaaagtgtctataaaacgaccagaaaactgtgaacaaaatggcagtaagtccttacctatcaataactacctttaatgtaaatgcatttaattattcaataaaaagacatagagtgacaatagctaaaagaattggctgggtgcggtggctcactcctgtaatcccagcactgtgggaggccaaggaagagggatcacctgaggtcaggagctcaagaccagcctggccaacatgacaaaacagtgtctccactaaaattacaaaaattatccggccatgttctcacatgcctgtagtcccagctactcaggaggctgaggcacaagaattgcttgaacccgggaggcagaggttactgtgagccgatattgcaccactgcactccagcctgggcgacagagtgagacaacatctcaaaaaaagaaaaaagaaaagaatcaagagctacttatatattgcctataagagattcacttcacttttaagaacatacatacactgaaagtgaaagaaagaaaaaaatatattccatgctaataaaaactaaaagagagcatggatagtcatacttatatcaatgtagactgtaagtcagaaactgtaaaaagaaacttagaaacttattacataatgataaaaaacaaatttatcaaataaatattacaattgtaaatatatcttcctacaacattggagcatctaaatatataaaacaaattttaaaggattttaagagagacgtagattgcaatacaatagtaggggacttcaatattactctttcaacaatggacatattatccacagagtaaatcaaggagaaaatattagatgtaaaccaaaatattaaaaatagacctaacaaacatgtacagaatattccatttaacaacaacaaagtacacattcttcttaagtgcacacacacaaaacattttccaggatagacatgttatgacacaaaacaaaatttagcaaatttaagaagactgaaatcacaacaaacatgttttgcaataataatggtataaaactagaaataaaatacagtaaaaattatggaaaaatcacaaatacatgaaagttagaccacatgtgcacgaaaaaccaatgggtcaatgaagaaattagaagggaaatttagaaacatcttcagacaaacaaatataaaaacaacatgtttccaaacttggtggagatagtggacacaaaaaatagagttaaaaaaatgaataagacctattctttgacagcacaacagggtgactatagtcaataataacttaattgtattttttaaataaagagtgtaattggattgtttgtagctcaaaaggtaaatgcttgaaggcatggatatcccattttctatgatgtgcttatttcacattacatgcctatatcaaaacatctcatgtacctcataaatacatacacctactatgtgcccactatttaaaattaaaaaaaatagagaaaaagccaatatgttccaaaacttatgaagtgcagcaaagagaaaattttataccaataaatgcctacattaaaaatgattcacaaataaactacttaatgttagttctcaaggaaatagaaaaagaagaaaaaactaagcccaaagttaccaggcagacgtgaataataaagatcagagcagaaaaaaatgaaatcaagactagaaaaatcataccaaagatcaacaaaagtaagagttagtgtttttaaaaaataaaatcaacaaacgtttaacaaaattaataagacagaagacacaaataagatcagaaatgaaagataggacattacaactaatatcatggaaatacaaaagatcacaaaatactacttggacaattacacctcacaaattagataacctaagggaaatgaatacattcctagacacataaaacctaccaagattaaatcatgaagaaatagaaaagttgaacagaccaataatgaataagaagatttgaattattaaaaaagtttcccatcaaacaaaagcccagtatctggtggtttcactgctgaattctacagaacatttcaggaaaaactaatactaatccttctcaaatttttccaaaaattgaaaagtagggaatattttctgattcattttaccatgccagcattgccctgataccacagccagacaagcacatcacaaaaaaagaaaactacaggccaatagccttgatgatgaacataaatggaaaaattctcagcaaaataccagcaaacctaattaaacaacacatgaaaaaaataatccatcatgataagtgggatttatctctgggatgcagggaaggttcaacatatgcaaatcaaaaatgtgatacatcaatttaacacaatgaagaaaaagcatatgatcacctcatcagatggagaaaaaaacagttggcaaaattcgttatctttttataataaaaactgtgaccaaattagatatagaaggaatgtacctcaacacaataaagaccatatatgagaagcccacagctaatatactcaatgatgaaaaactggaagcatttcctctgaaacccaaaacaagacaaggatgcctatactattgctacttctgttcaacgtagtattggacatacttgaaagagccacagtaaatcccaaacagccaaggcaaacacaagcaaaaggaaaaaagctgaaagtatcacactatgtgatttcaaacaatgtcataaatctagagtaattaaaaccacatgatactggcaaaatttgacattctaaccaatgaaatagaaaagagagtccaaaaatgaacccatgcatatatagtcaattgcattttaataatggtgccaaaatacataatggaaaaaggatagtctttttaataaatggtgttgtgtatgttgcatatccacatgcagaagaaagaaaataaacctttatctcacaacatatataaacataagctcaaaatggaccaaagacttaaagataagaccagagacataaaactgctgtaagaatacacaaagataaaatgacacgatattgattgatctgagcaatatattttttgtgtttgacccaaaagcatgggcaacaaaagcaaaatagacaaatgggattatagcaaactaaaaagcttatgcacagcaaaagaaacaacagcatgaagagagaacttattgattggaagaaaatatttttcaagttattcatcctataaggggttaatatccaaaatatagaaggcactcagacaattcaagagcaagaaaacaaaaaagaaaatttaaaaatagtcaaggaacttgaatagacagtcctcaaaaaatgtacaaatggacaagacctgtataaaaaatgttcaacaccaactagtcattaaggaaagacaattttaaaaccacagtgaaatatcatctcacacctgtcagaatggctattattaacaagacgaatgataaccagtgttggtgagaatgtagagaaatgggaacccttgtacacagttggtagaaatgtaaattagtacaatcattatgaaaaaccatatggagattcatcaaaaaactaaacattgaattatcatatgacttaacaatcccacttctgggtatttacccaaaaaacctgaaatcagtttgctggagagatgtctgcacacccatgttcattgcagcactattcacaatagcaaagttctggaagcaactgaattgttcattaacagatgaatgaataaagaaaatgttacatgtatgcacaatggagtactattcatccataaaaaatggtatatttttaaatgctcaacatcactaatttttggggaaatgcaaatcaaagccacaatgaggtatcatctcacacctgttagaatggctattaccaaaaaagacaaaagataacaagtattggcaaggatgcggagaaaacacttttggtggaaatgcaaactgccatagacatatggaaaactgtataggtttctcacaaaaccaaaaatactatggtatgagccaggaatcaatcttctggatatttactccaaatttttgaaatcaatttgtcaaactgatctgaaatcatatgtttgcacacccatattcattgcagcattattcacaatagccaaaatatcagatcattgaaaatgtctgccaaaagatgaatggatgaagaaaatatagtaatgttgtgtaatggagtactattcaactttagaaaagaagggaatttcatcatttgcaacaacatggatggaattggagaacattatgcaaagcaaaatcaggcacagaaagacaaattccgcatgttctcactcatatgaggaatctaaaaaactcacaaaagcagagactagaatgatggttacttgtgtaagggaactgggcggggggagtggggagatgatgatcaaagcacagaatctcaataagattgaataaatgtattctttatttaagacttattgtacagcatggtgaatatagttaataacagtgcattgcacatttcaaaattgctaagaaagtaaatttcaaatgttcccaccacaaaaagtaaattttttgaggtgataaatatgtgaattagcttgatttaattattccacattgtattcataaattgtaacatcaccttgcactttatgaatgtatacaattataaattgtcaacttataatcaaaaagttaacttctgatggattgcgtgttctgaaaatattactcacatatttacagtagttgatatatatatagtgagaggcaggagtctcagatggcttcagagattcccacttactggcgtacatactctgctaaatcctttcccttaaatgtgagcaggatttgtgagtacaatagtatatcactcctgcaattattttgttacatggtaggagagattttgaagatgactttaagatccatgattacttgaagatgattttaagatccatgattacttaaattcattaaaaaggaaattatctcaggtgaggctgacctaatcagctgagtccttaaaagagatcagaaagatttgaagcaagattttcctgctggccttgaagaagcatagtccatgttgtgagctgcctatagaggatttatactgcaaggatcttaacttggcttctagaaactgtgcatttcctggttgatgccagtgagaaaactaggtctccagtcttatatctaaaaatcactgaacttcattaacaaccaatgatcttgaaagaggatcccaagcctcaggttacattgcagcctagtcaatatcttgattttagtctggtgagaccctgtgcagagcacctagctaagccatactcagattcctgctccacagaaagtgtgaggtaataaatttgtgttgttttaagctgctaaatttatgtaattttttttttatgaggcaacatgttcattcattcattagggacaaagaaaataaaaaaaatagttgatcagaggtatcaataagtttttggaaaattaaaataagccaataaaaattggtaactaaggacaaaagaaaataaatctaatgtaccaacagaagcaggaaatgataagaagaccttattcaccctgcagagtaacagaaaaagaggcaaaggacatggaaatgaaggtactgaaggggactgattgaaaggacctactttccctctcatccctacagaagaccagagatttattttctgaagaaatttaattggaatccttatacttaggctattgggaactatagatcttgggatgtgttttagtactgcatattggggttgcagaaccatcttcccactgccacagaggtatacttcaaagacaggtgaatggtggactacattgttacagaaattgctcaatcccaaaaggaaggatattgaagtactgacgtttgggggtattccaaagaaaaggccattttcctgttgctctattaacataagtcatgtgttaataattcctactcatgtcctcagaacttttgacaatctcctctgtgcttcagtcttcatttttcatgtgagaccaaaaatagaaagatattgaagaaagtttaggggtaataggactccaaaaacaaacaggaaacatgataacaaaactcagtagtgacagcggatatagaagatatagtaatgctttcaaaattatgaaaaaataatgactttttaaactaaaattttatacccattataaacttaaattaatggtaagggcaaaataacgtcatttatcaacattcaagttttcaatctatagctctcatacactgctttatgagcttcctagtgggataaggttggaaaaagaaagaagaaatatagatagcatttacccaagaaaaaaatcaaatgcccagcatttgaaactctataaatttaaaaataaaattcatagtagaaatatcataaagctgttgaagattagagaaaaatgatgatatacacatggaaaattagagatacaaaaaataaaaaaattgtaagagaaaggaaatataaccaatgtaaattacctgacttaacaattttcactatttatgtagtcaaaataatgtgaatacccatagtattgattcactcacagttgtgctaaaattacattgagcaatagggaataaggagttgagaagtataatggtgttaattcctgaactattataatagaaaacaaatatgtatctaaaactgataaatacaaatttgacaatatcatcatatttacttatgcttataatgttatcacatcaaacaggtttaaaaatcaaggaacaaaagatgtggaaaggaagagtgatagaacaaagaattgcttcttcctgtaataaactttataatctacttcattttctttaaatgtgtaatagcatcatttataaacatgaaaattataagaaaatgagattaaatactgtttatcatatttaatacaatattatcccatgtttgatgaaaaactaaagatataactttttcacacagttaataaaaagtaaagttgagacacaagtttaaactcattgttctgcctttaaagtcagtcctcaattccctacactatattcccagtataataagagacaagtaacaataatacccattaaatgttatgaaagattgttagtttgagacaaaaacatctgtattagttttctagagctggcacaataaataatcataaataacctgttttaaaataatagaaaatgaatttctcatagatctggaggccagaaacagggttggttcctttgagattccctgaggctctggttccatgcctttctcttagcttctgatttctgctggcaatagttgggatttgtagacacatcactcccatctttgcctcaatcttcacatcacctcccactctatgtgtctttctgtcttctcttccatctcatacaaagatttaggattggcctgagtaatctaggatgatctcacctaaagatcattaattcagttacctctcaaagacatgtcttacataaggtcacattgacacataccatgtgaacatatcttttgggtagctactattcaacccactatagtgtttacatcttatttttacatccttagtattgttgatttgtctgtcttgatggacactgccattgaggtaattgagtttccttatgtgtattattatacaggatttgcagttagtatatttttctccaagatacaggatccagtattatctttgagaacagctaaagttagaatctgtatgatgtcatctcagagtacaaaaaaagccatgtgattttattgtcaaaagaacagttcctcctttgaattactaaagagctgattacaaaaaaaaataaaaatttgtaaatgttatttacaattctctcttgttttctaatgaaggtggctcctaggtattcagagggactttttttttttttatgaaagaggcaatgtttctgaataagtgcatttgggggaaataagacagtaaaattagtttgcttttaaaaaaaggaggcacagcaaaggctcagagaaaataaagagaaaggaagggtgaaaaagcaagactgcatgtacaaagagacaggtgaagaatgccatgattgtggacagttagatgcctagtgtggaattacaacagagaattaaggaagttttatgtcatggaggaagtagtgtaagtctgcatactttgaaatctctgttcaatctatattagctgctgctgctttataagatgcattattttaaagggggtgccatgaagtcctgcttcaaagttggtttggaagaaaatagaggctgccaatgggacatggattgcacttaaaattaaagtttatatttcccatagatggttaaataaatccaaccagttgttttacacttaagatttgattttgctgacaattggaagggggtgtcgagggcactactcatgctctcaatggggataaaacagaaggaggaaagagtaaaaaagaatgagtcatctcatggcataactggatattttattcagaaatatacctggaaaataccccttgttacaaatatgaaaccgacatattatatattgcatcatttgacttctctaggcaaattccttcaaccatgaggattagtgtatactctgtgatcaagtaacagacataataggaataacttctatctcttgaaattgcaatattgtatgtatcagtcctcatggagtactaaaatttatcttttgattaaaataaaccataagggaaatctgtaagttctatgaaatgtatgttggggatattatgaaacttttgaaaagcctgagactttgatttaacaaagcattttattgtttcctatggctctaaactaacataaaaataattatcttaagcatggtatataagaatgtataataaggaaagtgtaataaagaaaaaataggtatgttggggaaaaagcacatttgggaataatggtttccaagttgtgacttctggaatgttttattgcaaaaagcctgtctcttttaggtagccaatcgtgattgtgttaagggcgacttatttgttgttacttacaatagtgaaagttccattcactattgggtttgatcctgaccctactatttactaaagtgtatgatcatgtgaggttatataacaactctagatctcaatgtgcttatctgtataaaaagagtaactgtaccaatcatatagggttttgtaaggaatagatacagctgaggtgaaaacaatataatatgaagtagcagacattacaaacatacaaataggcaataaaaatagtatatgtgaattactctgataaagaagatacaaatacaagcaaagcctaaagagggacttctaatcaagacttgggaatatccttaaaagaagagaaaccagagaaaattttctgaagaatctagtacttgaatgagtaacagggaattgagtagctaggtgagagggcaggaagtcgccctgtaaagtgatcagagatggggtagttctgagatggaagaaaacaaaatattgattataataattatctatatttttctttggcattcataatgtgacttagctatttaatatctgtgtttcctggtgtattgtgagtttcattagaaaagtaactcatatgtcttgtccatcacagaaaaaaaaaatggcacccagtaaatttttctggtatatttggcaatcaaacactatttacattgtcgtcaaatactttactgtctagaatatattttgagaaaaatgaatcgaatctattttgatcacctttcatcacataaaaatttataagtgaagtggttttaaaataaatttggtgcttcaattttcagtctttatattttgtccagtgacctcctttcttttagagaagaaatgtgatctaactaaactaatattctgaaaagtttgttaaatttattcccattaaagaatacatgaaagattgaaattttaaggggtgttatttagtgaaaaataaaatataatattttaaaattctacaatatcagctataaactgttttttgataaggcaaggaaagcacactcctttgcttcttattgtaataaagtttatttgatttttttccttttattagaagttaagagttcataaaaggggggggaactgtacaaagaaaggttatattgtgttatctttgcaaaagaataatccataaaaacgtcatgtgttttattttatttgttaatatgttattggtgctaacttacttatgatcttatactatgggaactcctgtagttttgtgttttgtttcattttaaaaagggtatactagtttccataactgtaagaaacagagacttcagattttcctaaaaacactagatttaataagaaaaatttagagatttaaattggaactttgtgtttaaaaatagtaacaattcttcactatctgttttaattttaaactctctaagtttattgccctaagtttgtgttgtacatttattttactgactctattttttattgtaaaaattactcagggctttgggaggctgaggtagaaggattgcttgaggccacaagttttagaccagcctgtgcaacacagcaagaccttgtctctacaaaaaataaaaattaaaattaaaaaaaaaaaccaattagccaatgtggtggcacatgcttgtagccctagctccttgagaggctaaggtgggaggattgcttgagcagagttagaggttatgatgagctctcttctggctactgcatacgagtctaggtgacagagcaagaccctgtcttacaataaataaataaataaataaacagattatggaatagctcaaagtcttaaagacttttaggtatcaggtgcctttgctacttctgctggcttgagtttcctagtgagactgcacagttgttgctgtgcgtacgtgcgtgcgtgtgtgtgtgtgcctatgcgtatgtgatttagtaagcaatttcatcaaaatcttagagataataaaatattaagattcatactgtagcaacaaatttatcagtgtaaataaacagatgcatttcttttaaaacacatcttgtcaaaactgacataagaagaaataaaaaatttgattagattcaacttcatttaagtaatttaatctgttacaaaactgtcttacaaagaaaactctggattggattcagatggattatagggtgagttttatcacaaagtaaagcttgacatagtagatcttacaaaactttcagaaaataaaggagagaacacatgctaacttgttctatgaggatggaatgaccctggtaccaaaacttgaggattatatcacaagaaaaatacagaccaatatcactctgaaaaatagacactgtttttgcaaaatatcagaaaatcaaatgcaactatatgtaaatatcatataataatatataatttatcatatatttaataatttatcatgaccaagttgaaatgtaatattttctgtgtttatttgctgtttttggtaacatttgaaaaattttcttactacattagtagtttaaagaagaaaaactactagatcatgtgagtacatatagataaattcactttagtttatgtttaaaaatagcattattctattcttacgaagtttaagtcaaaataatagtattacaaatcagaataagattgccttaagaagagggaacttactgaaatagtcataatgggccattctggtatgatggaaatattacttatattgattaatgcagtggtttattaaaatgaaattataaccttcaggatgtgcagcttatacaaatttcaccttaatttaaaaatataaaattaatgaatacaaaataattacaaaaattctgcactatttttaatcacctttcggattctgatttcctatgttgtaataaaaatgacaatgtttataaaagttctttgtaagttataaagtattcaaagttgtttagcattttatctcattgctatgttttatcaaggtaatcaaattttattaaggacttttagcttattcaaatatttgcattcttgatgcatttggtaaataacttcaaacttctttcctatctgtaactgtgtgtatcattaaaacttttcatattctttaaatgtacagttgcttttagagtgtaactttaagagttctatatcttgatcttagcacatacatttataaaaatttcataaatcgtatgaattcataaaaaattaaatttttccttagatgaaagttatcatttcttttaaaatgattattactttcaaaatctattatactgcctgtctgaacagtgggttttgttgctctgaatatggagttacataagcattgtaataaaaatatttttcagaatttttaaatgtggattttcaataattattaaaccacagataattgggagatactgggttgtatatactggggttggtataaatttgtaacaaaatttatggaatcaagtagaattgaatttttatctctttttgaataaatgttaaaaacatttattctcgcttgtaatcccagcactttgggaggccaaggtgggtggatcacgaggtcaggagatcgagaccatcctggctaacacggtgaaaccccgtctctactaaaaatacaaaaaaaaaaaaaaaaaaaaaaattagcctggcgtggtggcgggtgcctgtagttccagctactcgggaagctgaggcaggagaatagcgtgaacctgggaggtggagcttgcagtgagcagagatcacgccactgcactccagcccaggcgacagaacgagactccgtctcaaaaaaaaaaagaaaagaaaaagaaaaaaaactaaatttattctttgagtagctctggctgtgaacaatatcccccaaattgtttttctcatctccttttccactcaatagcattacttgcctaagttaattctacttaagctatttaagaacattgtaaaatgtgaatatgagaagtctctgtttcagatggaagataaactatgtttgtaatcttaaggcaaatcatttacagtaaaatataatgtaattcaataagcatataataatttaagaatgtctattgcaaacataattttttcactctattttaaaagttttatttatctattgcatttttaaattcgttgagctggaaataccatagaacatttgtcctaatagttaaatttattttcttttaatatcttctgttcacaacaagtaaatgcttattgaaatacattttccaaatggaaacttgaatatattttattgaattgtacatttatatatgtttttaaaagtccatattattaccaaaatgttccttataaatatagattattattgatgtgtatttcatattgtacacccaagataaatttgatagtttataaccagatacattctattaatgtgttctctataatcttctactttggttctaattaaattctacaaaagcaagaagaggatgttaataagcaaatagagtaatacagtgaagatttctgaaaaaaaaggttgtcttattttcccttgaatatattattaatgcatataaatgttggagaaaatcatattactacctaatattgaaaagacaaaagatattttacttctgagaaacctttttactgtcatttttatttactttcaattaaaagaaattaagtagagaagaggaaacactatgacctgtggtagattgattgcaaaaatggaatttattctgcagtcttctctgattcctcattttgggacattcttagtcttctgctccatacatcataaggcagattctattttcctgctccttgaatttgatttttcctgtggcttgctatagctaatagggtgtggaggaaataacatggtgccacttacaataataggcctaaaaagacttcggaacccttcctctcccatgagtacaagttgatgtaaatctataggaggatgacagaccacaggaagcagagctagtcatctcaacctaggccgtcctaaattagtgagacgcgagcagagccattatctgttaacagaggaatgaatgagcccagccaaatcaaggaagcctgcccatattagttaaaatttccagagtatctgtatctcatgagggaaaataagtggttgttaagttactaattttatagtagtttgttaggcaacaacaggtaattgatataccatcatgtaattaaatgtactacaataattctacttcattcaaaaagtgagtcacataaatctctatcttgaagttttaaaaaagattgtatagttctgtttttcatctgcaactgattttttatacaagctatagtaggaattaatttcttaatgcaactataagttttccaagcatgaattactttggaatccattattttctccactgaactgcaatttctacaatacccccatcccttattataaaccaagttatcatatatatatatatatatatacatacacacacacacacactcatatacatatatcatgagtattgatgtgtatttcatgttgtatacccaagataaatttgatagtttataaccagatacattctgttaatgtgttctctataatcttatactttgtctttttgaacattgagtgtaatattttatacaggtttttatgtagatacagtttatcagatttggatagtttccttccattcccagcttaaaagttttgatcatgaatttgatcatatatcatgagtatatgtatataagtgtgtgtgtgtgtatatgtataaagtaagaaggacacacacttatatacatatactcatgatatatgtatatgagtgtgtgtgtatatgtgtgtatatatatgtatatatatgtctggattctataaagttttttattgtcctttttacttacttctgtgccactgctacataccttaaatactagaggtctttatagatgttgatatctagtaggagaagttccccaaaattagttctttttctttagaattacctcagtaatatttaatcttttgctcctccctgtaaattttggaatcctattattgaattttgtgaaggaccttgttgaaactttctaatttgaaaatgtaaattaattttgatagtatgataactccatggaattggatatttttgttcaagaaatttccatttccatttatttaaatcattttttatgtctttgaaaaaaaagttagtttactgctaaaacataattcatacttttactggaattattctgagatgctatacattttaactactgaattacaagtatttttgtattatatttgctaagtgagtattattgtgaaagcatattagtcagagtttatcagagaaacagaaccaatagaatatataataaataagagatttattataaggaaatagcccatataattatggagactgtaaagtcaaacaatctgcaagccagagatccaacaaatctagtgatatagttcaaaagcctgagaacaagagggctgatggtataaattgcagtccaagtctaaaggcctaagaattaagaacatcaaaggcaggagaagattgatgtcccaactaaagcagtcaagcagagagtgtgtaagtctactcttcctgcgtagttttgttctactgaggtcctcaatgaattgaatgatgcccacccacattggggaggtcaatctgttttactcaagtccaccaattcaaatgccagtctcacctggaactctgtcctcacagatactcccagaaatgatgcttaattagatatctagccattccatggtccagttaagttgatatataaagttaaccatcacagaaaaaacacaattaaaacttttaaattcaattttaaaatttacaccagcaaaattgccagatttttttatttctgtaaattctctagattctgttcaaatatttatttagatgattgtgaaatccaaataatagctgtttttcttctcattccacatatatatatttattctcttatatttaaatatataaaatacatatataagcccattcatatatgtgtatacatatgtatatatggaatgaaaatataactatatatatttgctgttactggttattacatcgctaggtaggactttcaagagtatgctgaataagcatagtgttagtaaacatccttgtctttttcaacattgagtgtaaaattttatacaggtttttatgtaggtacattttatcagatttggatagtttccttccattcccagcttaagagttttgatcatgaaaactgttgaattttattgtatgcttattctgcaattaccaaaataattatatgttggctttgatttgggaacagtttctttaggatttttgcatctatgtttatgattgagatagattgtaattttttcataggtctcattcagattgtgaaattaagattagcctcatataatgcatttaagatggattttccctttcacttttcttgggaaataatagtaaaaagaaaaaaactttttgacacttgattatttagtattggtctcctaaaaagtcatgtaggactgctttgttttgaggactagattttttaactattatttaaatgtagtgattacagataccctcatatttcctatttcttctgaagtaatatttcttaatatgttctacaattgttcatttttagtattcaatttagttttatatagttttaattttattttttctaatttattatattccagtattagtgatacctctattacattcctagtacttttaaagtttgctttctttcttttccttagcatagtacagaagcttgccaatgttattactgtttcacataattttttttatctcctcgatttttctgtttattcatttattttcttatatttcttcttcttcttccactttctttgaggttattttgttgttatatgtgtgtatacaatatatatttatgcatgcatctatacatgcatatatttatacatgtatacatataatatatatatttaatgcatatatacacaaatatacatacatacaagtgtatgcacacatatagagagcatatgtacttcctaaaatgtatttgtaataccaaaatccgcacttgtggaacttttgtagtcattcaagcgcatgcacagagtagtgaaaaatttcaatcactcaacatacacattcctagatgaagttaaagaagatactctgccttcttgtttaaattttcatactgtaagcaggtgtcttttatgtgacctatagaatgccatgtttttttatatttttgtgcttttaattggttagttcatcactgtttaagtggccgccaggcatagagttgagttgctgtctagtgtttgtaggcacaagaagattgtgatgtgccttgtagggaaaaatacttgtgttacataaggcttgaattatagtgctattggttgtgagttcaatgttaatcaatcaaaaatatatattaagtaaacagaagcacacataaataaagctctctactaatcagtagatgaaaatatgaccagaatctctcatcatgaacctacctctgtacttttcccaggagcaatgcttcagtatttgctaatttagtgatcacaccaccatgaaaatattagaatcaactatactcttacatttatgcacacatacatgtgtgtattacatacatctaatttctagttatctctattgccttaatttccacataattaggattaactttgtatgtcttttgtaatactctaagaatttattttattttatatcttatttattttttcaccttattattggtttacttagacttcaccttgacttagaaaagagtgaaggcaatttacataaatgtatacataataatataaaactaaaaataagggaaacaactcaggggtgtataaatgctgatcctttaatagtattcatgccttttgacttaataacgttgttagaaatggaaaaataactagtgagtactaggtgtaataactaggtgatgataatttattacataaaatatttaacaaacatgttaagaatgttaagttttaagctagctaatttgaatatcttttgcaaagtatcattttggctaattttgatagaaaaaaaataacaattttgaagatgtcctcatcctttatgagcttttttcacattcttttatttttttttcaagttctatatgtaatatctatactaagtttctattgagaattttggatttatatcagacttatgattctaactatattgcttagtgtaagaaaccttatttagtctatccatttctgagtgccttattataaattgaactataaattgattatgaaataccataagaaacatttatttgtggttgtgataagatttggggaagtggcactaaattcacacttctcttccttagtatatatgcatttttaccttgtctttctgaccacaaacctcagagtatttgaatgttgctttttcatttcagtgatcctgcaggtcagaacaagtcttacttcatatcttatacaacaactttgggagaactgagataccaaattaccttccaaattatactttagtgcaggaggtaagaagtgaaaaggactaatctggcattacaggaggtgtgtgatgtagcattttctcccttgtcactctgttgcatttcatcttttagatatcgatggcatttgttcacttcatgttatatcttttgtcatcaggcttttgagacaattatgatgcctgtggattaatcacctaaggttttccagtttattttataatttatggtgatatctgaaaggtgataattaaaaatctaatcatattcgatgtctaaaatagactctacaaaataatggcaagttgttttgctagtttccactgtctgtacttcaggagatagtttcaggatttcagatcagatttggtttgtcaaaaaaatttcaatattgttattatccccattgtcctctttccattcgtgatttaaagaaatacagtaatatattttattttcatttacctaacataatgggtagaaagcaattttatacagtattagttaattgtcatggaaacagattttctttaacccatacataagggcatttaaaagatgaaaagaagtgtagaaagcctgaaaaactgtttcgtctactgataatgcagcaagttatagcctgaatgacattttcttgggttatttggatatagtgtttgtattcttagaagattggaaatatgttgttagccacatcatggaagtgttttccacatctatccttgttattgtttttaagtatttaaaaatgttatttttagttaagagattattttttgttagagtttcaacctttttgttctgattaaattaattaagttttcatttagaagctatactggaaagtggtcagttgtaaacaaaagaatgcgttatagtctgtttaagctaagaaatgacttaatacaggaagttatgtggttaaatagttgttggaatgtcaaaagtcagtatctaggctaaggttttaggaaaatttttagcacccagatatattctggctctgccaaaatcagtaaaactgctccatcactgcagaaaatgatgaatcaagaatctgctagcttcagaccattccaccacagccatgatctgtgttagccaaatggatgttctatattcttagctttcttttacctgacctaaatcttgaaaatgcatctgattgctatacagtacattatattcaaaactctagatgaaaagaaatctttggtgtgcactttttcctgtctgtaatctgctcctgagatattgcaggaatagatgttggatgagccaattcccagtatttgccacagtcgacagctattcaacaaccacacatagcacgcatactctgcttcttgtgcttacaaactgaacaacaattacagcaacagcctactaccaactaaactaacatcagcagttcactgaatgttcttatcctattcttcaggggagacaactcatctgtcacatttatatatctgggtgtttttaattctccatttatttcagtcacaatcctcaattttttgcaatctatgaaataaaagttaaatttaaataccactagcccatcctatatagaataatactgtaaaatgggaagggaaaagaaagaattagtaaaattatataattatatactaaaattacaaaacagtgggtagttcatatggtcttcgttttcacaacaaccatgagaccataatttgcatgtatgataatttttttgcacatgttccatgcattttttttgtccccactcagaatctttgctgaactgggttctttatctcactaaatgacctaggttattttatattgatatcatattaataggttttaccattaggtagagagctaatagttccccctccatgctccctttgtgtaggaggaacctcacttttctgtgatgatctgaataattctccccacgaacacatcaactttttttgtttcttgtttgctctaatagcccctataccatagtgctgcatcaggggcttagcacttgtctgatctgtaggttggcacactgaaatatcagttttggcactagtgtaacctatcttgatgaagagaaggttctgtaaagtccaagtataaatctctacccctgccagcatgtcctctttttctctgagctcctttagtgacctgggaagctgtagagagaagaagaagaatttccacagaggtctactcaaatatcttaagtgtttttctaaggtgagaattcacacaagacacaacttctcacactcatcctatttggagtgtcctatcagcacagcttctccttttcactcatctttcagtcatgttctttccaggtctttgtctataaagcctaattataaacatatgctcatgaaatcagaaaagttccatacatctaaccacttatctttctaggaaaagtgaataattgtatgttctgcttgaaattctgccctttggaaatatttccttccctctcagtttcccagcatcaccttcagtgggattataatgctacacaaccatgctttagtattttcttacccactgtggcaggttccatttttagcttcaattttaattcttcactgcttcatgaacaagattcatggccatgttactttttaaattactctcactaagccatcagagtatgagtctttactcattttcttagatctttctttgtgtctttgcccaatagaatgcagctgaagtgctgatgttctagttctgaccaaggtcttacatatttccatatactttctcgcacctttgtcattaccatgaggaatatggtgaagcttccctggacagcgaagcctgaagctgaatgccccatctagctgcagtgagaataaaattcacctaactgagcatagaaaacatcagctaaatctcaagacccaaatatacagatttgtgtgcaataatgagtgattattattgaaaaccacttcattttagagttagatgcaccgcattattgtggcaatagctacacaatatactcagtagcaagatggaagggaagtctttatgaaatcataatcgtgagttaaggaaagggtgttagtgcagcaggactgagtgaaataagagttgggtcactgagtaaaaacatacttataaggataaagttagataaaatgtcaagattagcagtcttgaagcattcttcttcatagaaacagcatagccaagaaaaaactgtcagaatcaactttgtcgaaaccctggaaagcactcaaagatttagagcaatgcaaataatatcaaatcgaaacaaaaataggcaaattttaaatgtaggaacaccttgtggcgtttttatttgacctttctctaatactccttagctcagtgatggtcttaaagatggcatcctgtgttcccaatatgaaccctgttctctggatctagagagaaagagcagaccttacttaaaaagagctgtatttcttcattctaacctgctcgatggctatttgaaggattcatgcaaggtacttgtctgtgttttgcctaactagcaacgacggacataaagactgtgcacattcctccaaaaaaaatattaaaactgtaaaattgagaaaaaaaacccataacgacttgtgacaagagactgtgattgaggcatacagtagagtacttaaagcttggaagaaaaagctaggtaaagagtttcttcgggttatcttgtcatttcaaagtgcatatatggactagagtattagaaagctatgcacatggccagaataggacataagctaaaaacaatgagaagactttatacttttctgtctggctgatgtctagtctcaaagcaaacctggctgatcattgaaagaattccctagcacagaacccatcttcaaagattgggtgaacttttttcttcttcttcttctctttttttctttctttctatcccactctcactcttgctcttgttctcaatctttctcatgtttttaatctcattgtgtcttttttttgctccttcttgtcaaagaaatatctgtcaaaacatagtcaaacaaaatctaaagagacttcagagaatacacattgcaaataatacataatttacaaaaatgtcttagaaaagtcactaaacaaacaaataattacagcctatagcaaacaatatgccacttcaggaaaaaaaattactaagtaggcaaagaaaacagaaatgatagtttactcactgggtaaaagaacagaaacttcccctaaggaagtagagacattagatttactaagatactttaaataaactatctaaatatactcaaagagttaaaggaaattatggaaaaagagctaaagaaaatcagggtaattatttaggaacctaatgagaataaaaatgaaatgatataaattataaaaactagatggctaaaaagtagaataactaaaattaataattcattaaaaaaaggattcagcagcaattttgaacaggcaaaacaatgaattagtgaactttaatataggtcatttgaaataatcttatctgaggaacaataagaaataaacaaataaaagtgactggagcctaatagacctgttagacatcaccagaagaatcaaaatattcatatgggagctccaacaggagaacagagaaagggtcagaaagaatatataaataaatgtgatgagaaatttacctattagatgaaagaataaatctacacatctaagaggctcaacaaactcctagtaaagtaaatgcaaggatatctacaccaagacacattataattagcctatcaaaagacatagacaaatagaatcttgaaagcagcaagaaagaagcaactcggccgggcatggtggctcatgcctgtaatcccagcattttgggaggctgaggttggtggatctcgaggtcaggagttcgagaccatcctcaccaacatggtgaaaccccgtctctactaaaaatacaaaaattagctgggtgtggtggcacacgcctatagtcccagctacttgggaggctgaagcaagagaatcacttgaacctgaaaggcggagattgcagtgaggcgagatcacaccactgcactccagcctggcaacagagtgagactctgcctcaaaaaaaaaaaaaaaaaaaaaaaaaaagcattcctcatgtacaaagaagttgcaataagattaatggcagatttatcctgagatgtatgaaggccagaaggtaatgaatgtatttaaagtgctaaatacactttaaatgtatttaaagtgctaagggaacaaaaagaagtcaaaaaacaattctacatcttgaaaatctgtcttccacaaatgaggggaaaaataagacatttctagataaaacaaaacctaacaaagtttgttaactataggctagacaactggatgttaacatgaaaaatatgaagctggactcctactttacaccccacacaaaattaactcaaaatggatcagcagcctatatgtaagagctaaatctataaaactccaagacgaagacatgggggtaaaccctcatggcctagaatttgggaataaattgttagacataataccaaatacataaacaacaacaaaaaaacagattctacaaaaattaaaaatctctggatattaaaatacattatctacaaagaaaaaaagcaacctgtagaatggaagaaaatatttgtaaattacttatataataaaggcctagtatctagaatatataaatacatttataagtcaaaacacaaaggcaacaccattaaaaaatgggcaaagtccttaaatagacacttcccaaacaagatatataaatggccaaaaagcacaaaaaaagactgtcaccatcattagtaattagagaaaagtgaatcaaagccacaatgaagtatcacattacactgatttgtatgacagtaaaattaaagaaaaaaataaactagtgttggtgaggatgaggagaaattgtaaccctcataaatttctggagggaatataaaatggtttagtcaatgtggaaaacaatttggtggctccccaaaaagttaaacataaaaccaccaaggtatcctgtagttttacttctaagtgtatgcaatgaacatttatagaatgattactccccatagccacaaggtggaagcaacccaagtgtccatcaacagataaagaaaatgaagtatatacatacaatgcaacattgttaagcaataaaaaggaatgaaattctgatatatgctacaacgaagatgtacctagaaaacactgtgttgagtgaaaacagccaaacacaagaagacagatattatattattctgcttatatgaaatatctagaattagttaaattcataaagacagagagtagactggatgctgcaagaggtttagaagaggatatcataatgagttttcacttaatgcggacaaagtttccattttaagtcatgaaatattttgacaaattgatagtggtgacgtttgcataacattgtgaatgtaattaatgccactaaattttacccttggtaatgaggaaaatggcaaattttatgtaaaataaataaataaagtgaagcaaacaaaaatatgtctgaatatatgtttactgcagatatctggtaataaagctgtacttgtaatgaaattctgataaccttttttggaaaaagctactaatcaaactttggaatctattgatatcaggaaacatttggaggctagtctaatccaaactgtcttctttttgttttccaaataagacttcggattcgtgagcatccttgtattaagaattattgtgtagttttagtaaaaattacactaagaagctcatcatacatattcccagtctgattactccaaattaaggtatcctatacaatacttagcaccgatattaaagagataatttaggagtttgaaattccatctccatgacttctcttagtaagccaaaactggaacactattatcaactttattgtaaatattaaaatagttttgatcaaaatatttaagaaattatttttaggtggtcatagaaactccctgcttttttgaactttcttaggattgaaacataaagatatgactttctttctttaagctctatagcacaatcataagaagcttccaaacacagagtcagtatattcattgtcaatcttattctattttggtagcctcatgatccatcaaaaccttgacttcaataggtatttcataccaactagcagttgttactgtaagtaattgattccctggtctgtgatatgatatcataaaattatgtcccatctgctaatattaacttgattttcattagtatcaaaccaatcagatcaaagaagcaaccacagcttcttctttttctaaagctgagtggccacaaacatttttcataccactgtgtggtttagattatgcagaaagtattaataggaggatataaaattattgaaggggctagaggagcaagttctagactgaacttacttgaagctaagttaagccagtccttttgctactgccacatatgggaaagctgctgctgctactttaggaacaacctatgcaagagagtgaggctatcaccattgcagccagacatgtgatctagaaaaataatgtcattgctgtagtaagctgtggattcaggaagcttctaacttcagaactattccataactgtttggaccaaatttagtaaaataaatattcttcaccctttctctctttcacataccttaattctgaattggtagaactggattcagaattcaaattttaaggagattgaaaagaatattgagcaaatgctatggtttgaatgtgtcccacaaattttatgtgtttgaaacttaatccccaaattcatatgttgatgatatttggaggtggggcctttgggaggtatttagaattagataaggtcatcagggtggggctcccacatgggactggcagctttataagaggaggaagaatgacctaggctaacatgttcttgtcctcttgttatgtgattccctgtatcatgttatgtcacagcaggaaggccctgacaagatgccaacaccatgctcctggacatagcctccagaactgtaaaaaataaatttgtttcttttataaattaccagtctcaagtattctgtacaaaataagacaacaagtttatactccacataggaaaagaacacaaacatgttttgcatttgtttgccatttctttgaaaagatgtaggaccaactgattttgataaaagaaatcctagtcaatgctaaagaaaggttttcatgaactgtctgaatttgaaatcaaaggtctacaggagatagggctattacacatattgaagggtaacttcaacagttaggagatgcaaaatttctttccttaagtgggtagcacatttagcacatttgatttggtgtttttgtttgtttgtttttaacatggccataaccatttgactatattaaattccaccctagaaattcaattcaacatagaaatttgagcaatattctatagttagatttctaagccctgattatatttggagcattgtctacagtttagatgctccctccaaaaattcctactgctgttcagggagaatatttatgaacgtctaagttcaaatgcattatccttatttctcattaattggcctttctacacatagctccagaaaattctgatctgtacaatgcattagcaccaaaattttatcaccatggtttcttctgtcatgcagtctaaatcattcatagtcattttgattattattaatttgagataaaactgggataattagaatagttacaatattttcttacacagataataagaaccactgaaattcaatggcatcaggaaaaatatcataagcttcattaatagatgcagttctgccattatttttgttgatgtattttaaatgtgttttgaaggaatgatgttcttaaatatcgttggtatttgtacgtgctgcaatgaaaaccatttcatttttcatgggtgactatctgaaaattgatcatgtacattctcagagtgcctaaggccatttgttttcctattttctttctacataaggtttagaaaccttggtaaattagcatcatcattaaattgtgtctcatcacaaatggaatccttagtattagtgtgttagccattgatccttaagttaagctgtatttgcattttcaaaaaacagagttaaactattattttgccattttaagctttcaaccaggaatgtaaaactatgtggaaaaaaactctttttatggtgttcttgccactgaaatctcaatttcaacagactggtatttatttcaaaatattttcctgcaacatggttcagagaattatcatgataatatgatgttgaatccatatatcttactctaaactttatctattaaaattttattttaaacttacaaaagggagaaaagaaaagagaggggtgaagattgagagaaacagaaaacataaaaagataatgctaaatcaaagaattttcatataattttaaattaatatgggaaatgaaaatgacagtgatatttaaagaaaattgcaactggagataatgtacatgataacctacttacgattcctttgtttctacaaatctttttttagaagcttacagaagatcatgtaagaaaaacgttctcttttttttatcacatggaatattttctgtgctttaaactatctcatttacttcatcaatcttcatctaagggaaaattctaagtgtaatgtgtcatagaatttaaaataatactttaaaaagtgaaagtatttttgacatgtgatgaaacaaaacatatgtgattaaagataacatttcaaaatattattactaccatagatatatagaatttgaacataatagaaaatcagtataggaataatgaaattaggatctggttgaatcctttcacactgaaaaatccctgaaagtgttacatatgaactttcttctttagttagtaaacatttatataataaattatggttttggccaggttcagtggttcacgcctgtaattccagcactttaggaggccaaggcaggcagatcatgaggtcaggagatcaagaccatccaggccaacatggtgaaaccctgtctctactaaaatacaaaaaattagccaggcatggtacatgtgcatgtaggcccagtgactcaggaggctgaagcaggggaattgcttgaacccaggaggaagaagttgcagtgagccaagattgcacaacagcactccagcctggtgacagaggaagactccatctcaaaaacaaaagcaaaagcaaaagcaaacaaacaaacaaacaaaaattatgtttatacagtagagaaagagttggaactatactgaaggaaaggtaaagttagatagttgttccatgatcctagaattagtttcttttggtcattctttttgttttgtttgtttcttagtgtggctacaccttattatgaagcattcactattagatgctttatatgcagtatgaaaaaagcgggaaatcaaaaaatacatacactacgttatccacatagagatatttttgatatatttcatatccatcagaagacaatgttgtggacaattgttgattcatcagacagcttacttcaaaagatttagaaggaaggggaactgatccagcctcttggaggacaacctgtatccgactcatgactggcaataaaaactggtagttaaacttaggacaaaatagattgccttcaacatttcttagtttgagtagaaataactggatgtaaaaaactgacttctgattaattaaaggcaaaaatgaaaggtaaaactaccaaattagtagaagaaactttagaatatctttgtgacctggagtggagaagaacttcaaaaattaaatttcagaaataaataataaggcattataaaaaaaagtttaaatcaaaatatgggaaatgaaaatgacagagatatttaaaggagataatgtacatgttaatctacttatgattcctttgtgtctacaaattttttagaagcttacagaagattatgtaagaaaagattttatattcaacacagtatagcatagactaatttatttggcagacgatcaactggggataatatttgcaatgtctaaaacagaatatttgtgttgcttctacaaattaaactgaaaatttcaactgtcagaaaaattggcaaatgttatgaatagctaatttatggaaaaggaaatcctgaaggctaacatgcagatgaataaatgctcaaattaattgtaaatttcatctataatgaaattttacttttgtgtattagacacaaaatagagagctgggtaatgccaagtattggtgaaaatactagaatataggaagtcacgtgatgctggtaagagtgcggattgctgcagccattctgcagaactataaaacacaactcacatgtagtatttacatattttatggcacagaagtctactcttgggtatatatcccaagaaatgatcacatagggccataaaaggcacataccagtaataaagacggggcagagaaattctagtcagacagagtgggtccctggcaaagccccaccccaagccaaaaagcctgacaccactgcccaaagtgaaaacttatcatccctgttttcctgatcaaatgttgtcttttccaaaaccacttatggccctgcccctccttccatcctgtgactatacaaactccagactcagccggcagagacaggagaggcagctgaacgtcggaaactatggctggaagtcggagagaagcaacttgacttcagagggacagattgatggcgtaatttcggagaagaatccagctggagatggccggacttcagaggaagactaccttcttgtcccattttcttttcagctcccattctcgctgagagccactttcattggcaataacatctcctgcacttcattagtgtaacctcatttctcctggacaccggacaagagctcaggagccacggctgtggatacaaaaggctatcacattggccttttacacttgctggaggaagacagtcgcctcacacgaaaaggcagagggtccactgagctgttaacacttaagtcatctgtggacaccagagctaaaagagcactgtaacaccacctctggggcttcaggggttacaggcactcccctagacgcttccatggggcccaaaaggagtttgctccttctggtgcccaaaagcgcttgccctggctcctgcacccgctcacctgcacacttcctccagcaaggggtagaatgcagtgggtccgaagcagctggctgattcctgcattcatgcactccagttcctgccttgttcacttgcatgctccgtcctttgaagagttgaaagctgcaggctgggtaaacaaggcacccttgttgcaattctaacgaaggggtcagggaaatatcctgcttcactaggatgcacattttgtcattgtgatggcgacacaaccaatgtggccatccgtgggagagaggtgagataaaatgtgagagtgaaaagtttgaagtttttaatagatgtacacatggctccaattattactatgaaaacatttttgtttattcaaagtagcaaatagcaatgtgatacataactaattcaatttacataaataaatatatatttgtaccaaacaacattgtctggtttctatagacataaaacaaatattatgtggcaacagatgagattagttgggtttatctattggtgtgagtttttgaacgtatttctattagctgaaataatgttcctgcctcctaatctgatttaaacctccaacttctttgataacaatacatataaaggtttgtttctaatagcagcatattctttctattctgtcacattttataatttctttcataactaatctttttttttttttttttttttttgagaacgaatctcgctctgtcgcccaggctggagtgcagtggcgcaatcttggtttactgcaagctccacctccagggttcacgccattctcctgcctcagcctcaggagtagctgggactacaggtgctcgccaccacgcctggctaatttttatatttttagtagagacggggtttcaccacattagccaggatggtctcgatctcctgacctcgtgatccgcccacctcagcctctccatggtatactggacattgtggaagatatattgtagaggctggattttgttatcctcctctgaaaagtattaatttttgttgtaagaggcaattaccttcagtgggctcatattctaaactgtctctccatgatgggggcagcagccaaaatctccattgaattctttcagccagtcagctgaaacaacaggcctctggtgaaaagctttgtagagtatgcctaattcatacatcagccaaatatttggatagaaatttgtactcagttatttggggtcaccgtctcagagcgctttcatttctaatacatttttactcacatgctagctacccaggcaacagtaaccttcattcattgtctccaaatcaataatactgtggcttttttcttgagttccagctaatattagaaaaaatatttagtcctgattttacaatttcttttttaaattaatgaattaattaagtttgttctcataagttatttggggtttggttaaaatggggtagcatttggttacatgagtaagttctttagtggtgatttgtgagattttggtgcactcatcacctgagcagtatacactgcaccatatttgtagtcttttatccctcgcccctcttccactcttccccgcaagtccccaaatccattgtatcattcttatgcctttgcatcctcatagctttgttcccacatatcagtgagaacacatgatgtttggttttccattcctgagctaattcacttagaattatagtctccaatctcatcctggtcactgaaaatgctgttaattaattcctttttattactccatagtattccatcatacatatataccacagtttctttatccactcattgtatgatgggcacgtgggttggttccatgattttgctattgtgaattgtgccaccgtaaacatgcatgtgcaagtatttttttgaataatgatttcttttcctttgggtagatacccagtagtagagttgctggatcaaacggtagttctacttttagcatcaatgattttggtctttagttttcttttttagttatgtcctttcctggttttggtattagggtgatgctggctttataaaatgaattagggagggttccttctttctctctcttgtgaaatagtgtcagatggattggtaccaattctttgaatatctggtagaattctgctgttaatccatatgatcctggacttttttttgttggtaattttttttttttttttttttttgaggcagagtctcgctctgtagcccaggctggagtgcagtggtgcaatcttggctcactgcaacctccgcctcctgggttcaagtgattctcctgcctcagcctcctgagtagctgggactacaggcgcccaccaccacctctggcaaatttttttgtatttttaatagagacggggtttcaccatgttagccaggatggtcttgatcttctgacctcgtgatctgcctgcctcagcctctcagagtgctgggattacaggcgtgagccactgcgcccggccagtaatttttaaattagcatttaaatctcgctgcttgttattgatgtgttcagggtatctaatttttcctgagttatgctagaagggttttttttttccaggaatttatacatcttttctaggttttctagtttatgtgtgtaaaggtgttcatagcagctgtgaatgatcttttgtatttcagtggtgtcagctgtaatatctcctgtttgatttcacagtgagattatttggattttctctcttcttttcttggttaatcttgctaatggtctatcaattttatttatcttttcaaagaagcagcattttgtttcatttatcttttgtattttttgtttgtttatttgtttctatttcatttagctctgctctgatcttggttatttcctttcttctgctgggtttgggtttggcttgttcttgtttctccagttccttaaggtgtgaccttagaatgtcagtttgtgcccttttggtctttttgatgtaggcactaagggttatgaactttcctcttagtactgcctttgctgtatcccagaggttttgataggttgtgtcattattgtcattcagttcgatttaatttccatcttgattttgtttttggcctgttgctcattcaggagcaggttatgtaatttccatgtatttgcatggttctgaaggtttcctacggagttgattttccagttttattccactgtggtctcagagagtgcttgatataatttcaattttcttaaatttattgaggctcattttatggcctataatatggcctatcttggagaaagtttcatgtgctgttgaatagaatgtgtattctgtggttgttggatgaaatgttctctacatacctgttaagtccatttattccaaggtatagtttaaatccattgtttctttattgactttctgtcttgatggcctgtctagcgctgtcagtggagtattgaagtcccgcactattattgtgttgctatctcatttcttaagtctttcagtaattgttttataaatttgggagctccaatgttaggtgtgtatatatttagggttgtgattttttcctgctggacaaggccttttaccattatataatgtccctctttgtctctcttttttttgagacggagttttgctcttgctgcccaggctggagtgcaatggcacaatctcggctcaccacaacctctgcttcccgggttcaagcaattctcctgcctcagcctcctgagtagctgggattacaggcatgcaccaccatgcctggctaattttgtatctttagtagagacaggatttctctatgttggtcaggctggtctggaactccccatatcaggtgatccgcccacctcagcctcccaaagtgctgggattacaggcatgagacatcgtgcccagcccctctttgtcttttttaactgttgttgctttaaaatttgttttgtctgatacaagaatagctttccctgctcacttttggtgttcatttgcataaaatgcctttttccactgctttactttacgtttacttgaatccttatgtgtaaggtgagcctcctgaagacagcaggtagttggttggtgagttcttatccattctgcagttctgtatcttttaagtggagcatttaggccatttacattcaatgttagtattgaaatgtgaggtactgttgcattcattgtgctttttgttgccgtgtacttttgtcttttgtttttgctttttaacatgtaattttgttttatagtcttttgtggtttatgctttaaagaggttctattttgatatgtttccaggatttgtttcaagatttagagctccttttagcagttcttgtagtggtggcttggtaatggcaaattctctcagcatttgtttgtctgaaaacgactgtatctttccttcacatatgatgtttagtttcgctggatacaaaattcttgggtgataattgtttcattggaggaggctgaagatagggccccaatctcttctagcttgcagggtttcttctgagaaatctgctgttaatctgataggttttcctttataggttacttggtgcttctgtctcacagctcttaaaattctttccttcgtcccaactttggataacctgatgacaatgtgcctaggtgcagaacttattgtgatgaatttcccaggtgttctttgtgcttcttgtatttggatgtctaggtctctagcaaggttgggggagttttcctcaattcttccccagaatatgttttccaagcttttagaattctcttcttcctcaggaacaccaactattcttaagttttgtcatttaacacaatcccagacttcctggagactctgttcatatctccttattcttttttctttgtctttgttggattgggttaacttgaagaccttgtcttcaaactctgaatttctttcttctgcttgttcaattctattgctgagattttccagagcatttctcatttctaaaagtgtgtccaaagttccctgaattttttgttttttctttaagctatctgtttccttgaatatttctcccttcacttcttccatcattttttggatttccttgcactgggctttgcctttctctggtccctccctgattagcttaataactaacctcctgacttctttttcagttaaatcagggatttcttcttggcttggatccactgctggtgatctagtgtgatttttggggttgttgaagaactttgttgtgtcatattaccagggttggttttctggttccgtctcatttgggtaggctctgtcagagggaagttctaggggtgaaggctcttgttcagattctttcatcccacgggctgttcccttgatgtagtactcttcctctttccctatggatgtggcttcctgtgagccaaactgcactgattattgtctctcttctgggtctagccactcagcaagtctacccagctctgggctagtactgggaattgtctgcacagagtcttgtgatatgaatggtctatgggtctctcagctgtggataccagcacctgttccagtggaggtagcagggggtgggtgcaatggactctgtgagagtttttaggtttggcggtttaatgctctatttttgtgtgtgctggtttgcctcctaccaggaggtggagctttccagaaagcatcggctgtagtagtacagagagggaccagcagtgggtggggcccagaactcccaagattgtatgccttttgtcttctgctaccatggtggatagggaaggaccatcaggtggggatgggctatgtgtctgagttcagactctccttgggcgggtcttgctgctgctgctgctgtgggggatggagtgagattcccaggtcactggagttgtgtatctaggaggattatggcagcctctgctgagtcatgtaggttgtcagggaagtgggggaaagtcggcagtcacaggcctcacacagctcccacagaaaatgaagggccagtctctcacagagcttccacacaaaatgaagggccagtctcactcccaccatgacaccctcaacagcccctagtctgtttccaggtggagggtgtgatggggttgaaaacttgccctgggctacccgcctcccagctgtgagagaaaagggcttgtttcttccccggcctgtggagactgcacaccagatctgcccccctccctggagttctggccgggaggcttcttaccccattcaaattgttacaaaattcagctagagatttctttatccctgtagagttttgcccctgctcctctggtcagccacccaatggatccctgtggtgccaggcaggaatggcctgctaggggacacagcgagctcccagggcccttcagctgcttcctctattcctgtatttcactcggctctcttatttggctcaggtccaagtgaggtcagaaacttctcccacaaacaacttcagcttctccagttgggttgtgtgttctggagaggagggtctgcctttcccacttccacaattggggcacacacagtatttggagtgtgttctgggtcctgcaggagcagtccacttccttcagagggtctgtgggtcctctcgggattgctggtttgttcttgcagtccacctggagctaaaattcacagtgcaagctactgcatgctgctctgtctggagctgcagtctagtcctgcctcccatctgccatgatgattgattttacaatttctatttatggaaagatcattccaatacaaactactctgtcatttgtggcataatacagtatttaatagataaattaattaatgtgaatatgaagaaaaatttccagaaagtattaaaaataatttttctcctcagggttatatttatcataactccccaaaattttctacatcatgaaaaattttattttgtaatattaaacactgtgataagaatctaaagaggtaaaatctgaaaataaattattaaataatatgcataaaatctatactcgaatcttaaactggcaagatcccttttaatatggctcatgtcttattttaacctcaaattcagttttacactctacactccatccacatggaccaaattgctttgtgtattccccaaaggcaccaaacttcctattcttcaaaggtattataacttatctaacttcccctatttatgtgcagaagcacacataagtttgccttttgaaaccccaagaaagttcaaagaaataaatgtaattagtcttcaattcacttatcaaacttattttgtttttcagcattctcctgaaatttcacatcttatggaaggctgtcctaatattttcagacaatattaatgttcccatattactcatttttcgtctgtcaagttagcacacttacaagtttattataatcattttcattatcttcaaaatgcagcaaagatttctcattcagtaatttagcctcagcaaactttacaaatgctcaataaatatttattgagagaatgaatagataagtgaatggataaataaataaatggcattttatatctctccaagaaaaactcctctagaaagaggggttatgtgggaattgtggagacagtagaaatatttaggagtaataaaacattcctaaaattatgctgtctaggtaggcacttcctaacctcaccaaagattactctagtttgaaagacagtatagaaaaagaaataatcatttatgcactagttacaagatacaatgaactaattatttgatttgatgattcaaacatttaaaaatactaatccaatgggataaaagttttaaatggtctttcatggacctagaaatctataataattatttaaaaagtgatatgtgtctcactaaggtttctgagccattatatcatcaattctccaatattaaagatacttgaatctgagaaacaaaggacaaaggacctttgaagaactaaatgagggataggaaatagattaacactactgtgaatgaaacagatgattttttttcaaagtaaatttattttcactacacgtaatttataattcaaactgattttcaaaagacgttaatggcaccacagaagtaatattagaattgagttaatacataataaacagtgctgcctgatgtacatgattttgaaattgatttactcaaattctagaaagattagagtaaatatatactctatattgtagtgcttttcttatgaaattatgttttataccagaatttaaaaaataaaaaacaatttgaattgactttataagggccattttatgtaatttatctgagcttagacgtaaagtggaaaccaggggtgacaaaattaaaaagctgaagctttcaaaatgaaaaagtttcatttttaatatttgttaaaagttgaaacatgatgttttatagccaccactcatattacattattgcttactttacacttgaccaacacacattaacataattattgaaggtctacaaactgaaatatcctagatatcttaagtaatggatattgttttaatttgataatatagagaaaatattcattacatttattccaaaggaaattaatgaaaattatggcattttagataattacattagatctataacaatttctaagaaggaattcaattcaaaatatcttagtatgagttatctgttgctgtatgacagttgctacaaagttagcagcttaagacaacactcatttattttctcaatgtccgctagggcagaaggcagggcagactcaactgggggatctctgttactggtctcacattgctgatatcagagtgttggcaggatggactctgctctggaggctctaagaaagaatcccttttcagagtcatctaagttattggcagaattcagctctatgacttataggagtaaagttcttcttttcttacttactgtctgccagggtatgctcttagctcgtagaggccactctccagtccttgcttatggttctcactatcagatgtcaagaatagcattgtcaatctcaggcttccaatttctctgacttttccttttccaactagatggagaaaactctgtttttaagtattcatgcaatttaattaagtccgcttgataatccaaaataatttccttattttaaagtaaaaatgtaacatattcacaagacataaaatattatactcacagttcctagtgttatgctgggaaatcttaggggtctactcctacagtcttgtctatgatcctcacttaggaaaacaattatttagatttatgctaataaaatatgcaaatcctataaatttccccttaaaaatctgaaaaggacttttcttttggctcaattttcacttttaaaatgctatttttcatatcatttgtcctgctaagagaatcatttagaaggaatactcattcaggtaaatgaatagctcatggttttgaagtttttttacctaaagataacagtagaaaagcaatgataaggaaattgttgaggcaggaaatttagatcaccattcccatctaaatcaaggaatatgtccaaatcagtatatgtcatgtttctagtcatcagagaaatcaagggaacccacaacaatgtcagataatctcacagagatttgtcgtgcaagatgttttctgacggatggcatccctgggagcgtatttgattatgttcctagtatttcacttgtaaacaaatgtttgtgttgttatctttaataagcctctaagagaaatcatagataatttggaatagcttttttaaatgggtcaagtcttcctgataatttcagacattgataaagacagtttcttctttctgataattagatgtttccttaaacttgaaaaacatgcaacaaaacttaagagctaatatgattgaaataatggtgataaaatggtctcataatttaggtatcgtttctgtagatgagaactgctaaggtagggagggctatctataaaataatatgaaatgcagcatttaaaccaatatatgttctgtggtgtcagtgttcttaacagcaggctaattatgtcttaatactgcatgaatcataatttcatggaatatgttaatataaaatcaaattagagtaagattatttcaaaatttcagtctagtgccatttgataccatactccctagctataacttttctactatccagttgaattctccttgtgaaaaaatataatggaagccctagccatgtgcaactggaaggatctaaaggtgaactgtgctgagacaatacctgttacaagcagagggattatcacaggtgccgtctcaaggcaactccaccatgcccatcctgttctgaaggaggcctttagaaactagagtttctgtctttgattcaggacatctccaaggcagcattacttccaagggaaactagtgattcttcagaggccaggtggtcaaggaatgtgaggctttgaggtactcagatttatccctgcttgattcatttccagaaggtagaaaaagcgacataaacctgtctgaatttcatactggatttaacaaagtgcaaggcacacaagagacatacagttaatgttaggtattgattggctgagaatcaggccatatttttaacagaataaactaaggcaaagtataattatcagactccccatatccaataaaatgtaaatcattaaggagggacctactgaagtatcattaggattaaaactatttgcgagggatgagaaatataaaacttatttacttgaagttactgcttcaaaaaatttaaaatcatgtatccagctagaattgggagaaacaaataatataaatgtaaacattttatcattatgactagacaaaattaatattgctttgtattattatataaattatttgtgatgtttaaaactgacaaaattgtcataaatagtcgaataatcaaagtgttttcagattttggatttctgtcttaaatttgttggcttgtgtcatttcttatgtactaactgtgatataggcactttaatatggcaacatttgtctgagaagggtcctccagtaacatggctaaaagcaccaataaagcacacacttcatcctgctgtgtctgctgcttctgagatgatgaaagcatgtgtcatttttggcttgctatacagcattaaagaccttgaagacttttaaaggggattataaatggtggactgtggtaataccttttattagtttccatttgttggattccctgttatctgtaaatgttattagtggctcaaatgtaacattagtgccaatgggtaaaaccttttaaggggactgactaacttctggaagacagggaaatagttctatctgtaacttttcttcataagttaaggttatattttgtttttattatcagtctggttagtattaagaatattgacttataaaatatttgacttctagtaaaatatttttattatttgaaataatttgcagctatcaaaaggtactttccatgttgaaaactgagtctggtatgagggtgaaaattgggaagaatctggttatgatgtgaaaagctcttggcttataaacattatctacagtttcaggtaaaaaggcaatgggtcagactaacaagtcaaatgtctgggctctgagcacagctgctgaagaggaattactccagttattcagtttgggtaatttggtaatgcatctttggttgtatatttattcatatctttattcaaaaatatacaaggttatgtggcaggcagtgaggttgcagggagtggggaaaaagtttgtgcattcttagtgacaatggaaaaatggaccaataaataaagaatgcaatggagtggggtttgctataatagagaataacaaaattgggagattattggctaaaacatatgttgctagaaacagaactcacctctacctagcaagagagagttattcagaaaatcccggtgaggacgtggtatttaagttgaaattaaagtcaggcagaggaagagtagggaaataagctttctcaaagagaacagtgcatgtgtggagaccttaaggcattacaaaatagatgtgttgctattgaacaagtgaaagaagactagtgtgattggatcttcaggaaaaatgaggccagagagaagatacgatataagaccttgaaggccaccataaagagtttagatgttaatctaaacacaatgagaagacactgacaattattatctatgtatgtctctttgaaagaatgactttttcctcagtgaagactgaatttgagagaagaaaactcataagcaaggagacaaaaggctgttgcacaagctagggaaagaatactgatggtaccattctttccctagcttgtgcagcagcctttttagagttggactgattgacaaaagtagatagatatgttacatcgtttggaggttgaatcaacagaatttgctgattaattggatgtagacaatgaggagaaagcagaaattgagaatggcttgcagtacagcttgagaaattacatgtataaagaggcatttaccagctgggcacggtggctcatgcctgtaatcccagcactttgggaggctgagacgagtggatcacaaggtcaggagattgagaccagcctggccagcatggtgaaaccccgtttctactgaaaatacaaaaattagctgggcatggtggtgggcacctgtaatcccaggtactcgggccattgcactccagcctgggcaacaagagcaaaactccatctcaaaaaaaaaaaaaaaaaaaaaaaaaaaaaagagacatttaccaagatttggaaaaatgctatcaagtactataataattgaggttgacacactgaagttacctgaccattataaatcatagaggataatcgcatgaagaaaatattttcatctgttttaagtatttcattacttagattgttactatcagtctaatatgcattatctgctatgtacatttgtcattcattttccagtctagtatgcactaattcaaaagtatttttatagaggggtctcactatattgtccaggctggagggcattgcatagtcttaggagtgatcattgcacactacaggttcaaattcctgtgctcaattaatcctcctgcttcagcctccatctcagtagctgactacaggcatatgccagcactcctggccaaactattttttttaaacatgagaaaaagcctgatataaaataaatgtgtgagccctgagtgtcacaagagaaatttatacctacctctcacctatttctcactctattttttccacaagtatgaacaaaaccttcttgatattcattgttgtggttagtataaattattaaaactgctcagaaaccttgacaatgtcaaaactcacagcgttaaaaatcctgagaaacaggttatattgataaaatatttatggtgaaaactgaagactttagtaactggtgtcaaaatttaattaaactatttactttagaattctctatctgttttagctagcctccatgatgtttgaaaaatcctgaccttctgatatccataccttgtacaatcagtctcctcccactttgtatcaggactggtcgctatgaccaaacagaatggcgtgtcacttagggtgggccattgaagatggtgtggtcttttcctctctgattggttgggagctctggggaaatctggatgtcatgcagtaagaagttcatgttttgaagaactaaggtttctgtaacgcaactaatgagagagaaaggcatcttactaacagccatgtgagtcaggaagtagatcctccagccctacatcaaacctctggaagactgcagctttggccaacagctggcctaaaacctcattagaaaccccgaaccccactcaccaactaagctactttaaaattcttgtcttccagggctatgtgataataaatgtttgtggttttaagccacaaaatggtttgggttaatttgtagcactgcaacagaaaactaatgcactattttttttcctaaaaaacagagaaaataaataaattttacaaatctgtgaggatttttatattttggattaatttatcagagaaaatattaatattaatttttattatattaataattcagagaaaatactaattgaattcaactattgttaaaattatgttcaatatgtcctttgtttctctctaaggcttcctgttaattcttgattttgttttgttgcatattgagggggaaataaaggtgccatgaaatcatgctcacagtaataaatcacttttgtggaggggctgatatagagattgcctgggaaaaatgttttaggactttcaataggatgtctgtagctacaattatgaaaagataaaagaaatggacagtgctgcttgggctcaagagtcatagtcctaaatgtcttattaaggaaattgaaggatatggggtagaggaagaaaatgaggaaataagcaaaaagtgtaaggcagtataatgggctgcatgcttgtgccccccccaaattcatctgttgatactctaacccccttgggatggtaccaggaggtgaagctttgggtaaataattaggtcctgagggtgaagctctcatgataggattagtgactttaagagcacgaggcgtgacagcttttttcctctgcctctttctctctctgcagttcaccaagtgagggcaacccagccatgttggcaccctgctctcagatttttcagcctccagaactatgagaaataaatttcttttgtttaagccatccagtttatagtatatttgttacagcagcctgaactaagactggcagcatttggagagtgtatctgctaacaccaggtctatgaaatgcacggtggggaaataaaagagaggagaatgagcaattcagaaaaattatggcaaaatctcattgaaaaaaatcacaatgaacatttgcactgtaaaagaaaatgaaaaccaatttaccttactttgacacactgtgttaggcagctagagctgccataatagaataacatactgggtggcttaaacaacaaacgtattttctcacaattctggcggctaatagtccaagatcaaggtgttggtgtacttggtttttcccgaggtctttcttcttggcctgcagataaccatctcactgtgtcctcacatggcctttagtttgtgcttgagcctcgctggtgcctctctctgtcctcttctataaagacaacagttagattggattagggattcatgtaaccctaattacctttgtaaaggccctatatccaaatacagtcacattctgaggtactgggaattagggttccaatgtagggattttagggggacataatttagtccataacacccacccttctcagagatgtgactgcgatcatctttactcagattaaagagtatccctgatagctaagatttcatcacatttgttccaaaagtacctggctgagagagaaacaaaagtgttccttacacaaaaatattctctaataaactgattacttaaagatgaatgctacttcaacagtttaccatacgtaacatgagaatgtatccccatccatcttaatcaacactttggtccctctttaagtgaggccacagtccagaaaagagagatcactctgctagtttcaaataggtggtgtttaatccagagaaatatttccgaagttgttgaaaggacttcaaaaataaaggaacaaagaggggtcattacaggaagaaaaagaaagaaaacttaataatgaggaactgtcgccactcctactctagaatctataagcctacaactgctgctctattgggagatattgttacacttggatttggagccaaaaaaaaaaaaaaacaaaaaaagagcacaatgaccagggctgggagtgtgaacaagtgtgcctctgcctgggctgcaagaatttgtaaatatcttacccttgttgtctcaagacaaccttcagcaactcatacttagacatcagacggaagtttctttctcctttctgccttgtgatttcctaccactgcttcctactggcaatgcccagaggaagcacccaagcaagggagcctgggaaacatctgagactctcagcttagcagttagaagttgagagataaccagtaaatatctagtacagtagcagcacagtctatggccaattgtactgtatagttaaacaatgcaaatacagtgcaatcattgcaaacaaaataaaaatgttgtgagtaatacaatgactgatttgaatatcagaagattaagaagacattacaaattaaattagttttcagatacttttgtaaaatgatcctcataaattttataaaattcaaatgtgatgtttaggatgtgatatgattgtatttgataatattggtagaaaaactatgtaaaaaattaaaatacttttaaataaaattagcacgttataaaactaacttaatttttgttaaatagataatggtcttcactgatttttattatttttcgttttattttgtaagataaatgcaaatcaagaaattaaaggtatttactgtgcaaataaattccattttctaagtgggggatttattttaattgtacttatcctgctgccaatttcattcagataatgaggaacttctgtaatgcctatcaacacgctacaaaaacattttttacagaacatgttttgtggaaaattagtgtaagaataagtcagagttgtcaaaatgactgcttttttatgggctgagggaatttggtttattttatgtccaacgtgaattttcaggatggtgattcaggagtgtgtgattaggtacagtagttttgtagggctaaaatatgaaccaaagaacttgtatgttactcttctaggcagtgattctgatatatatgctgtgggttttgggtcaatattagtatgtttgttgcttatgagttcctacagttttgtactcccatgacttagagcaaggttagcctagagtatatttttgaagcaataaaataatgttttattgaaagtctgttcttgtgtatttcactgatatccacatgatttcttctactttttttctatattgctaagggaggtaggcagatggtaaaataaatgtttcaagcatgttaaatttaaacctgacatttctgattaccttggcagatactgccattgatttaccacaatgtaattttgggagaaatgattttaatgtttttaatgttttatataaaatttagttttaacactaaaaatcaaatgaaaaaatacatttgtatgatacatagctaatagctgtatatatgcttaatttaatatcatactgttaaaaattatgaagtaattttatgagttataatcaggattctcaaactaatactttcataaacttaataatgttatcaagtttatgaaattataagtgaaaactcacacagagacagatttctgagctgtgacctttttaatgctcaaatataagagaggtctcttaggggtttcatttctgaaactatgactaagccatgttcggttgtgccaagtgactcattaatcataaaaagaatatttaggatgcatgtggtgatccatctgggcaagtgacctagagaggaaagaaatttgcttatctctacagtgtctacttgagaagtctagtgttttatctctgccttcaaacactcattgtcttcctgggaggaagaaatggacaacttaatttttagactaactgcaagagtaccatggccattctgaaactttgctgagaagagaaataatgagacataggataataatttatatgtgctttatgtataagaggataaactgttctcatctttggatgaatagtagagctggagttaactggatcaacttttaacaagaaaatccctttgcttccttactagtgagtctttcataagcatagtaatgttatcaagtttatggaattattagtaaaaattcatgtggagccagatttctgagctatgacctttataatgttcatataagaaaggtctctgaggggttgtatttctgaaagtatgactatgaaactatgaaaatattcttggaattgaaatattcttggaaatatattcttggaatttttagacaagatggtggcattaacagattttgaaacctgaaagtctgcctcaagcatattcaagagaggtaaaatttagaaaaatactattaaagtacatgtctatgtgtaaaaagaagataaatactttcataagcatattaaaatgaaattcaaacctctacattttccctgaagtcacaatgtactataaaagctagtattaaaagcttgtgtttttgtctaagtgaatgctggggtcaaatatataccgtgaatatcagaaaaatgactctgagctctatgtttgaggtggagtgtggtgttatgcttcttaatcaaaaataagaaagaaatgtctctatccatcacctacgagtctgtagaaaatttacggttgcttatatccagaaaaagaaccaaatgcatacactaaagattccaaacagagccagcctctggcctgaagctgttaatacaaggcttactttagagatatgaacgtcaaatatcttgcaattaagtaactaataaaaattattgaacaaagaatagaaacctcttcacaaaagtttgtatttcaaacagaaattgcaaaattcattaagaaatactgtgccatgtaatgtaaatccaagatgcaaaacaggaaacaacacattcaagaaaataaagagaatataataacttaaaaagaggttaagttgtgattaaagttttcagattataagtagaaacgacatctattgaaggttttgagttaagaagagttaagtttaaaacaagttatctgggaataataatggaaatatggtaaatggaatagtgaaataaacaatggttttagcaaactgaaaagaggatcctgatttagataaaaattttcaaatccatctgcatgcaaagtggataaatgaaagtaaggaaaatataggaaaaaagttacagacaaaaaagataatctaagtattttcaaccaatggctataaagattttccaaaggaaattatggaaagactggagaagaagaacaagaattaagaaaaaaatgactgaaaatttccagaactaagtaaagaatctaattcttaaaaccaaacaagcaaacaaaaaacctcaatgttcggtatggttacaaaataacttcagaggctaacagcaggttggtggctattgaatctcatgatattctcctgccaaaacaggtagaagcaagtgtacataataaaactcacggataacctctgcaacaaaaataaatgatacaacattataataaacaccaaaggaggaggggataatcccaaaccatctacagaagcaagatcttaatagtgtccccaatcatgtagaaagaaatggagagaagtcaaagagacttctgatgtccctgaaaaccagagaccctgttgtagtttgaaatgtgatttctcaaaaagatacatggaagtcctaaccccagtatgccaaatgtggtcttatttggaattggggtctttacagaaatcagattaaaaccagataattagggtgagctgtaatctaatataacggctgtccttataagaaggggaaatttagacacagagacagacacacacaagggagaaagtcatgtaaatatgaaggcagaaattgggttgatgaatttacatgccaaggaaaaccattgccaggaaaccaccagaagcttaggaaaatatatggaacagattctccctcatgtccatcagaaagaaccaaccctttccacaccttgatctcagacttctagtttctgaactgtcaaacaataaattaaggcacccagtctgtggtactttattatggcagcaaaatagcaaaaaagatatcaaattgccaaagagtacacaggccaaacttgaggaattttctacttggtatggaatgctcaaagattcaatataaaaacagcttctgaaaaaagagggggctttgaagattccagtttgtgggtgagtacaaagggactactaaaatgtcatctcaatcaaatgatgtacgttctatggaaaagctttaccttaagagaaacactggccatatggctcattcttttcatatttccattcacgcaattctgccaaaaattctgatagtttatctgttctataatagcagctatgcctggttatgcctagattgtcagcctcttgacttgccgtatcagtccattctctcattgctataacggaatacctgagactgggtaatttataaagaaaagagctttaattggctcatagttctgcagactgtacagaaagcacagcagcttctgcttctgtaggggtctcaggaaactcctaatcatggcagaaggcaaaagaggagtgaggtgtctcacatggtgggagcaggagcaagagagagtgagcagggaggtgccacactttaaatgaccagatctcatgagagctcactcacttcatgaggacagtactgcgggggaatggggttacaccattcatgagaaatccatccccatgatccaatcatctccctccaggccccacctctaatattggagattataattccacaggagatttggtggggacgcagatccaaacaatatcactttcacccaaaattggcaaatgccaatgctccctggagaaaaactaaatgcagaattgaattttggatccatcctttggccctctcctttcagtattattagtctttcttattctggcattatgatatatctaaaaatggatgtatatttttacattaacaattttttgaattattcatgatggaggtgtttgtttaagtttttgtactcaaaattagaagttagtgttgtcttatgttgcaactgataatatatattccaaaatgatttctagacagtgctcctctcagtctctctttctttttcatatatatatataaatatatatttatatgatatagatgttgcttttcatagttttgataagaagaattaaatgtgacatttgacctgacctataaatttgaatatagacctctataaaaattaattaatgcaatgaagtttctaaaatatagatactattttttgctactgtatcttaaaagggcttcaggtcagccacacaatttatacttgtgtcatttcctctttttaagataaatgtatttaattcatagtgctaaatttccatcaagaatcacgacttcacaccacaactctccttaaaataaatgaggaaaattttttcctcagcatttattcatttagatttatcttcgggagaaataagatagaagtctgtaggtcctcattaaaattcaggtaagcctgctgatctgctgtttttgaagtgatcctagattctgtggttaagtttgatataattttacaaatttatatctgttctgtgttaaatctttaattaacatattttatgagagtaagaatagtgaactttctttaggatatcttgagaactaaatatcttgcattagttatttgtgctaatttacagtattagaaatatctgaagcagtccaatatacccacgcccttctatacaaaaatatgtgaaatgtatcaagagctcataatatataaaaccaattattcacatctcttacttttttccagaattgaaaaacgtatacaaaatggtttatcttaatttctctaaagtttgtattcaaaagatgaacccatttacattattaatgttaccctaagtgaaaagaaaagcaagaacccaaatgtttcccccactcaaatcctgtaccaaaatacacaaatataaattattttttcctaaaacgtctttcagtgaaccgcagttcagttcaaggtaaagactacctagcaatacaaaaatgagcatatacagtttatttcctaattcatcctgttacatgttttttctttttatctattaataaaaaagtcattgcagtacaacaacatttactgtttacaaacagtcatatagcaattcagttaaaagttttataaattgtttgattttataaataggattattttccacttattatacaaggggtttagtacattatattcatgaacactaaaatgagtttggtgactaattcccttttctgctaccagactggaaaatttcccataaattgtatttgtgttctgtttgtcagagccatctgcttagccttcactccactttttgtttcagccaagatgaaattaaaattgacagaagtgtctactatgaaaaaaagcaacacagataattggggagtggaatgaagtgtgcaacattgttttgcatccagcacctttcttctaatagtgttctgaattcaaaggttctgagagttgccgagaagaattagtttataaagagcatgtttaaatgttttagaagtgttaaagatgtataaatatacattttatttaatgaaaaaattagcaatttaaagtttcatactaaaaaatactcattcctaattgagaacaacggttaactctcatattttctcctcccttgtacagacctaagattctgaagcaatgttattatttaatgataaacactgaactatacttttctaacaaaggttttaatgatctcaatagattgtagctctggttcatagtcacagggaaagctgagcttatcagttcattataagagaggaaatgacgaagaaatagtgacctgtgaagacctaatttaactttatattaaattatttgaagatggaagaaaagtaatgctatgacatctattggaagacatttaaggaaaattgcaattgtatcactctctagaatgaaatatatttctcatatttctcatcacctggctttaagtaagtgatatcagttacaaccaaaagagattcatccttgttctggcaggacttaaggaagattaactttccttaagggaggttgcttgataatactcacttgagattagtcattttaatatagctatcacccaatgatatagtttggctgcatccccacccaaatatccccttgaattttaataatccccatgtgtcaagggtggggccagatggaaataatttactcatgagtgtgttttcccccatactgttttgagtaagtctagtgaatatgtctcaggagatctgatggagatcccctacccaagctctcttgcctgctgctatgtaagacatgattttgctctacattcgccttctgccatgattgtgaggccttcccagccatgtggaactgtgagccaaaaaacctccttcctttataaattacccagtcttgggtatgtctttattaacagggtaagaacagactaatacagtaaattggtactggtagagtggagtgctgctataaggatacccaaaaatgtggaactgactttggaactgggtaagaggcagagattggaagagtttggagggctcagaagacaggaaaatgtaggaaagtttgaacttcctagaggcttgttgaacggctttgaccaaaaggctcatagtgatatggacaataaagctcagactgaggcagtctcagatcaagataaggaatttgctgggaactggaacaaaggcgactcttgccatgtttttttttgttatgatttttgtttttattattattctttaagttctagggtacatgtgcacaacgtgcaggtttgttacatatgtatacatgttcgcaaggacagaaaaccaaacactgcatgttctcactcataggtgggaattaaacaatgagaacacttggacacagggtggggaacatcacacactggggactcttgccatgttttagcaaagggactggtggcattttgcccctgcgctagggatttgtgaaactttgaactcgagagagatgatttagggtatctggtggaagaaatttctaagcagcaaagtgttcaagaggaagcagagcataaaatttggaaatatttgccacctaatgatgcaatagaaaagaaaaacccatttctggggggaaattcaagccagctgcagacatttgcataagtaatgaggaacctaatgttaatcaccaagacaatggggaaaatgtcttcagggcatgtcaaagaccttcacagaagccccactcatcataggcctctccaggcctagaagggaaaaataatttggcccccctgctctatgcagtctcaggatatggtttcctgtgtcacagttgcttcagctccagccgctctggttaaaaggggccattacttcagagggtgcaagccccaagccttggtggtttatacatggtgttggggctgtgggtgcacagaagtaaagaactgcggtttgggaacatccacttaaatatcagaggatgtgtggaaatgcctggatgtctggaagaaatttgctgcaggagtgaagctctcatggagaaccactgccaggacagtgcaaaagggatatgtggagtcggaacttccacacaaagtccccacctggggcttctcatttgccttctgctatgattgtgaggcctccccagccatgctgaactgtgaatcgaacctgttaactttataaattacctagtctcagggttgtctttattagcagtgtgagaacatactaatacacctatttcatacagtttaagtaattcaactatcattaaatagtaaatagtcactcacattttatttggcttcatagctgtaaaactatgtaagaatcaccccttcataataattggtagagaaggatccaaaattaaccattaaatacatagtttttaaatacaaaggaaggcaacttttagttttgttgtatacaatgaaaaagatactaatatttgtgatcaaaacaacacaattgcatcagaatgcttgaggttttagtttttgcagaaatatatatatacatgttctcatatatatatgttcttatatatatgttctcatatatatgttcttatatatatatgttctcatatatatatgttctcatatatatgttctcatatatatgttctcatatatatattctatatatatgttctcatatatatattctatatatatgttctcatatatatgttctcatatatatgttctcatatatatatgttctcatatatatatatacacacatacatacacatacatatatatatgaatttataagtctaggcatttaaacttttattttctttaaactgcaataagtcctcacttaatgtcacccatgggttcttagaaattatgactttaggaggaaggaggggctggcatggtgcctcatgcttttaatcccagcactttgggaggctttgggaggcagacccagcaggattgtttggggtcagaagcttgagaccagcataggcaatatagggagaccctgtctctgcaaaaaataaaaacaaaacaaaataattggttgggtatggtagtgtgtacctgtagtttcagccactccagaggctcaggtgggagactctcttgagcccaggagtttgaggctgcaatgaaccattttcatgccaccacactctagcctgggtaactatggataccttgtctctaaaaatgaaaacaaaaacaaataaacaataaaaaataaagaaacgacacacagcaatcacttttaccataatctaactggtatataaggaaaagttaattccctatggcatatttattgtcacagaaagtcaccaaaattgtaaataaaaacccaaaactactgattttaaacatagaaataaatatgaactctgcatacatttaagaaagcttaataaaaacaagataattatttacccaatcactctagttcgaagacatgtgtgactggagcctatccctgcagctctgggcctaaggcagaactgagcctggacacaataccattccatcacaggagcactcacacttcactgccacacttactcttcgggacaatttagacacgccaattaatcccatgttcacatctctgcaatgtgggaggaaaccggaatacccagagaaaacccatgctgatgtagggagaacgtacaaaccccataaagacagtggccccggcctggaatcattttttttttccttatcagccttataagaaaactatttgaacaaaactatgttattcaaggatctgcaggctatactttattgaggtatgattaacatgaaaaaatgacacatatataatatatatatctccataagtgtgaattaagtatacatttttgatactattactactaagaccataaacatatccattaccttccaaaatttcttcctaccccctttattactattttttgtttgcaagaacacttagaagatttaacctctaaccatcttcggtataaacataatattgttagctataggcattatgctgtgtaaaaatctccataatttatttaccttttgcataactgaaactttataacttttaagcatcacaatccccacctccctccagccctgacaactaccattacatcttctgcttctgtgagtttgactgtttcagattctaccttggttattttgaataatgctgaaataatcatgggagtactgatatctctttgagtttttaaatatttactcagaagtaggattgttgaatcatatgataattctgattttaattttttaaggaaactcaatactattttttatgaaggctgtaccaatttaccttgccaccaagaatgtacaaggggtccctttttcttcacatctggctaataacttcttagcttttagtgttttaaataatagcagtcttaatgggtgttttcttgaggtcttgatttgtgtttctctgataaacacgttgagcaaattttcacatgcctcttggcatttgtatgtcttcttttgaaaaatgtctatttaggtccttggcctatttttcctttgagttactagtatgcaagaataaaattgatttttgcatgttgattttttatcctgcaccttcactgaattaatttattaattctagcttctttagtggactatacagggcttttatttatataagattacaccatcagcaaaaaaataaaatttttctttttttccaactttgatacttttattcctttttctacttaatggtagtggctagaacatacagtactatgttgaaatagatgtgatgagagtagggattcttttcctcttccttgtcttacagaaaaagctttcaacttttcaccattgattatgatattaggtgagggtttatcatatacagactttattatgtttaggtacatttcttctatgcctaatttatttagaacatcatgaaaaaatattgaattttgtcaagtattttctcttgtaggggcaacaggctggggctggtgatgtgggtggtaaaagaatttaccaaggtagtcataggtaaagaaaggcagattaattagtaaaactacaaagataagttacaagagagcaatggccagcacggcagagaaggggctgtcttccaagaggtaggggataagaagaagctttagagggtcatgctggaggggccacatgcagataaggtgtgcagataaagtcatgctgctggggctatgtgcagaatgaggtatttgggaagaggatgttgtgccaatgggttgtctgtgattagttgtctctcaaaacaatttttctcctctacctgggaccctttccttgttgttgattacttatcaggactctacagtttttttgagaggacaatactgacaaatctttggcaatgggggggaaagtctcatctttcaactagttcctgctagcctgtggcatagagttgtccctacttctggttgttggtctgtcagaagatgctgtgggtcatcgtcctgaactgtgggacttaggatattgaatcttgctggagggagagactcatcaaagagggggagcatgtcaaggcaaaagtgatgtccaaatgagtccaagggagatttgtaaaggtaacaggcatcactggggagagtctgatataccattcacagtatcatttgaaggtaaaattactgaatttaaaaagacacaaatttaacaaccaacagaaggtgaatatgcaagggctgaagagaagggataataacatacctgtcagtgtccccaagaatggaagcaaccaggattatcatccccaggtggatgtccatgaagattatccttgtggtgctttttcctcaattccatcggcttgttccctgagctttttgacatgatacctgattgattaacataagcacaacattctttctggagggctaaacaaatgagcccttgggctgctgtaagcaaatttaggccacagcggttttggagaacaactgctgctagggggtctctctgatcttgcaggacttcaaaggtgtcagagatgctttgaccttggtggagagttcagctgagagagtatgacaagtatgggctgtgaggctcatacctgttattcccatacctaatccgtagcaatccctaggccagtgagtatagggatcagatagattgaccattcttccctgctagaactgtaaagcgggattgagagggatttattggaaggagcaatttggatgtctggggctaagtaaactagtgtacaaattgctgtcccattggttggaagacaaatatatgcaattgatctgcagaggaagaaagcttcctcagatttaaggcatggaattagacttagagtgaagaaatggagtgtgttttggttttctgaagtattgagtagctagagtagtacttgtaagaggattcaaggcttggatgttaaagttagcatttgcgtgggttttgttgtcacagaataaatgaaagcattgagtgtctagaaacattcaagattttgggttgctaagtgtgagaatatgtgggcaattattagaggaatttgcaaccttgcaatattgccattaagttaagtcaggacaagtgtctggagaggggcatcctgtgcaaaagtgaaaggtgacattttggagatttggggcattgaggtcagctgggcctgatgttctaactagtatcaaattatgttttccctctgatatgtattttatattggtgcaatttatagttatgatgtagttgcaaagggggttaaaaatgtttcccaaggggttggagtttccgggaggtctgctttagcattgcagcttagatctatggttataaaacaaaatgttcaagtggtccctccacatttggatctggtaacaaggttgtagaattaagtgtttggcaggggctaatacaccaattctggtgcatgtagaaggtgtgtttgatacttgcaaatagttatctgatatccagtgaaaggccttcaagtttaggagtttcattgcctaatgcggggtatgtagagttattccttgaaccagagttaaggaataaatgtatacaccccacatcaatcaggagagccacagatgctagcacttggaggcatggaggctatctccatgccactgggttcagggtttctgataagtaagcaattggtcattgaaagtgtcccagtggctgagttagaactccaagggcaatactgcttttctcatgttctatgaagtaaaaaggctttctaaaatctagcaaggccagggctgggtcagtggtgattgcttatttgagggttttcacagtattgtccatttcaaggctccaatataggggttcctcctctggtccttgtagcacctcattaagatgttttgctaaaagtccaaactgggatatccaagtgtgacaagcctaccatttccagaaaggactgcagctgctgttgagtggatggaatgcaaatgtttaaaataagatttttgtggtgatctgagagactcttggactctagggttaatgttagtcccaagaatcgaacctcctgagaggaggtttgagctttagaaggagaaattttataaccacaggaggccaatctctgaagagtattaatagtatttaggtctgaggtattttcaggtggacagcaaataagcaggtcatattagttcattttcacactgctgaaaaagacatacttgaggctgggaagaaagagagatttaatcagacttacagttccacgtggctatggaggcctcagaatcatggcaggaggtaaaaggcacttcttacatggtggtggcaagagaaaaatggggaagatgcaaaagtagaaaacctgatgaaaacatcagatctcatgagacttatgtacaaccatgagaatagtatgggggaaaccgcccccatgattcaaattagctcccactgggtccctcccacaacacatgggaattatagaagtacagttcaagatgagatctgtgtggggacacagccaaaccatagaattctgcccctggccccttcaaatctcatgtcctcacattttaaaaccaatcatgctttcccaacagtcctccaaagtcttaattcatttctgcattaatccaaaagttcacagtccaaggtctcacctgagagaaggcaagtccttctgcctatgagcctctaaaaacaaaagcaagctagttgcttcctagatgcaatggaggtacaggtattgggtaaatacaactgttccaaatgggcgaaattggccaaaacaaaggggatacagggcccatgaaagttggaaatccagtggggtggtcaaattttaaagctccaaaatgatctcctttgactccaggtctcacatccaggtcatactgatgcaagaggtgggttcctatcatcttgggcagctttgcccccatggcctaccaaggtacagccttcctcctggcttctttcatggcctggtgttgagtgtctgtggcttttccaggcacatgatgcaagctgtcagtggatctaccattctagattctggaggatggcggccctcttctcacagctccactaggaattatccctatatggacactgtgtgggggctccaaccccagatttccttttggcactgccctagcagaggctctccatgagagccatgcccctgcagtaaacttctgcctggacatccaggcatttccatacatcttctgaaatctagtctgaggttcccaaaccctaattattgacttctgtgcacctgcaggctcaacaccatgtggaagctgccaaggctagtggtttgcaccctctgaagccacagcccaagctatacattggcccctttcagccatgactagagtggcttggatgaagggcaccaagtccctaggctatacacagcatggagaccctgggccctgcccatgaaaccatttttctctcttaaaccttttggtctgtgggagaggctgcctcaaaggtctctgagacatttcccccattgtcttggggattaacattcagctcctttttttttttctttttttttttgagacagagtctcactctgtcacccaggttggagtgcagtggcacgatctcggctcactgctagatccacctcctgggttcacaccattctcctgcctcagcctcccaagtagctgggactacaggtgcccaccaccgcgcctggctaatttttgtatttttagtagagatggggtttcattatattggccaggatggtctcaatctcctgacctcgtgatccgcctgccttagcttcccaaagtgcaggggttacaggtgtgagccaccgcacccagccagctcctttctacttatgcaaatatctgcagccagcttgaatttctcctcagaaaatgggattttcttttctttcacattatcaggctgcaaattttccaaactcttatgctcttcttcccttttaaaactgaatgcctttacaagcacccaagtcacctcttgaatgctttgctgctagaaatttctttcaccagataacaaaaatcatgtctgtcaagttcaaagttccacagatctctagggtggggcaaaatcttatcagtctctttgctaaaacataacaagagtcatctttgctccagttcccaagttcctcatctccatctgagaccacctcagcttggatttcattgttcatatcattatcagtatttttgtcaaagccattcaacaagtctttaggaagttctaagctttctcacattctcctgtcttcttctgtggcctccaaactgttccagcctctgcctgttactcagttccataatcccttccacattttcgggtatcttttcagcaataccccactgctggtgctaatttattgtattggttcattttcacactgctgataaagacaagcctgagactggaaaaaaaaaagaggtttaattggacttacagtgccacgtggatggggaggcctcagaatcatggtgagacacaaaaggcacttcttacatggcagtggcaagagaaaaatgaggaagatatgaaagtggaaactcctgataaaaccatcagatcttgtgagacttattcactaccataagaacagtatgggggaaactgcccccatgattcaaagtagctccctccaggtccctcccacaacatatgggaattatgggagtacaattaaagattagatttgggtgggacactgagccaaaccatagcacaagtcatcaacctattgaagcaaggcactattaggggaaagttgaagggtggacagatctttggcaagagcctgtcaaaacaggtgtgagctagctctaattccctggggtagaacttttcaggttaattgtttggcaacataaatggaagagtctcaccattcaaaggcaaatgaaaattcagagtccaggtataccagaatgcaaaagaatatattttttacatcttgagtggtgaacaaagaagtgtaagacggaagttgccctagtagggtgtaaggattgggaacaatgggatgtattgggattactgctttattgatacccttcatatgttacatcattttataggtactgtttgacttttttgagtgccaagatgggcatgttacatggtgacttacaaggacacagtagccccatggccaaaatgttttgtattaggggatgtaggcctatttcagcttccgactttaaaggttgttggggctccctagggaaagaagtgggattctaaaggtgggtttttataggatctgtgaacaaagtacatccgggagtggaagtatatcatacctttggaggaacttgttgtagaaaggaaggttgtattacctttgggcttttgaggtcaagggctagttaggctaatcatggaaaaacaaactcagacaactgatggttggttaggagctttgtcattattgaccctcaagttgcaggattgagcaacttggcaagacaagaaagaatgagtgaaaatgtttttcccaaagatacatgccaaaggagaagtaaatcattcctgttttggttggctatctatgctagtgatgaggatcaaggaccaaaatgtagttccaggaaaattaattagggcagaataagtggctactgtatcaacaaagaactcagttcttcctcctacaacgtctagggttacccaaggctcaaccatagtgatggaaaacacaggagcctggatggcctctgggccccatcaatcactaggacagatagggaatggccctcactgggattcctcccttctttcccttgtgttcccatcagttttgtcaacattgaggaacagagttaagggcatttgcctttgccattctcccaagttgacccacacttaaggttgccggtaaagggatgaccctctcacactagggagagagagacagtcctgtttctagtgccccacttgtttgcagtgtgggtaggggctaggtggtggttgctggggactagttgacaggtctggggctggtttcagccatgttggctaacaaccctgactggttatagtgatagcaaatgaatgatcctttgttggtccctggaccatatcccagtggtttttctgggcccctttatataggtagggaattagcaatagtggggaccatatagtcacctgccacttatctctttctcattccttccaatcctgttaggttttcaagacctcctcttaggtattaaggaccttgaaggctgtgttcagcaatgtgaggaaaggagcttgtggtctctgatctagcttttaaagcttgtgtccaatgtctggagaagcctggctgataaagtgaacaaacaaaatagtgaggccctctgagcattcagggttcatattagtatattttctcatggcttccaccagcctggaatgaaataaggctgagttgtcattttgcccttgtgttatctctcttaatttcgcatagtttccaggtttaagtgcagctcttttaatgctctcaattgaatatgcaaacatgattatggagtaccctgtcagcatctccctcctggtagcatcacctaggatcaacatcaggcactgctatcctacaaaagccagattctcgagggttctagttgttaaactcatctgccaatttttcagctagtacccaaatgtggtaatttttctcatgagtgcaataggaggtaaacataatatagatgtgttaccaagtaggattgaaggaaccagtaaatcacttgaactcttttatgaaaagggagggacctggctaaaggaactaagtttggtttctatttgagaaaggtcagacattaagaaagagacatggattctgatggttcctagatccttcattgccacatcccagagtggcagaagtttttctggggccatattgtgatcataagtggtccaagatctagatcaagtatgtgaaggggagaaggttctctgataagtgggaggggttgtggggttgcagatgtgaggggaaggagagggattagaggctgatggtctaggggaaggaggagaggaaggaacagatggggtagatatacttgaatgtgaaggtgatttgtcaacggaagaaggctcagcctcaactagtctagccagtttgagataatgggagagagtaaaagaaggatagtctagaatttcggaagagtcagtggggccagagaatttggccaagcacaatcaacaagtttggcagaggtcaggatcctgggaaagtcatgaaagcctggacataaggaacttcagaccatttagaggagttatggcagaaaaaaaagtcaagcttaagaaaagtgttgggtgaaatctccccacctggaggccacgtggattcctggtccagaaattataaagtggccttgcagtattacacaggaaaattagatgtttctttctgagagtctgagagtcaaatttatcccaatgctttaaatgtagcccaggggtaaatctgaggaaatgtagggtctttgtcccatggagggactgggaaagaatgtccactggggatatgaactgtgattcctcttggggtgtcctgatgagggaaaagggttccactgacgtcctctgaaaaactctgagatgcactttccagaggagtgtcccacctattggaaaggatctcccagtgctacaaccttacactggatgaacactgggtgagcaaccccaggtcagtccaggtaagaattacactgcatggccagcccagttatgctgggtgctcagtacaggtacaaaagaaagaggtttatggcagactcactgtcctggtgctgtttaggattacctggcttaagacgtccagagcaaagaggctggctatctacaggctataatttagagtgagaaagaggggttctgagttccccaaaacacatgtgaattcaccatggtcgagcttactcttctgactgtgccacacatagggattggggacttttgatcagaaagaatagaagagacctttcctcccttccagacaaggcagccaacctgttcaaccctggccttcaggctacatcagggagtggccctgaccagttgccatcagttgccagaggatactagagagtgtccactggaatactgaaaagaaaagcaaactctaaactctcatccagagtagtatacgtagggaattagcaacagtggcgaccatactgtgggcctgccacttatctctctctcattctttcctatcctgttcagttttcaagacctccactcagatattgaagaccttgaagggtgtgtccagcaatgtgataataggggtttgtggtctctgatctagcttttaaagcttgtgtctactgtctggagaagcctggctgattaagtgaagagccaaaacggtgaggtcctctgggctgtcagggcccatgttatgactggtggtggtcaggcatctttccatgtgaaccttctggtccaccttggagtgcccctggctagggactgtcagttatctctgggcttggatgctgtccactgagaggttggagttgaagaagaggacgtagggagaatggggtaatttccctgtatgagccaccaaaatgttgcaggtgtcactgactgaggctggttgggcagtaaaagaatatgccaagaaagttataggttaaaaaaaaggtcgatttgttagagaaactatgaagatacattgcaagaatgcaatgggcagcatggcagagaaggggatgtctatgaagaggcaggagctggagggaggttttatagagtgttgctggagggactgtgtgcagataaggtataaaggatattgtcatgctgctggggctacatgcagaatgatgtatttgggaacaggatgttgtgccagcagtttctctgtgattcgctgtctgtccgaataattgttctccacatgggaccccttccttgttgcttacttatctatcaagactccatagtttttctctctattgagataatcacatgatttttatccttcattctttttatgtggtgtatcatatttattgagtttcatatgtcagactgttcttacatatcaggaataaatcccactttatcacggtgtgtgattcttttaataggctgttgaatttgatttgccagtattttaatgaagatttttgcagatatcttcatcaggaatcttgatttgtaattttttttttccttcctgcctgatttgggtatcaaggtaaagttggcctcatagaatgagtctggaagtctttcttcctcctcatatttttgaaagagttggtgaaaatttggcattaattattctttaagtgtttggtagcattcactcttgaagccatcttattctgggcttttgtttttgtggaaatttttgattgctgattcaatgtccccattcatattttttctgttcagattttctatttcttcatggtagacaaacagtagtacacatgctcatttcaatgtataatgtgattagtctgtgggagtaaagcaataaaggaaactctccatgtgaattggagaagtctacaatgagaactgggcaatttcataatctgtaaggtggacatattgaactacatattcttcatggtttctttcagatctgaagtttggtgagtttttttctttttaaaatttgtttctgagtggccactacatgttatagaaaccatcatcttgtcacacagcacagtctatgaataaaaggctgagttatcactaagcaggagaaaaagcattaaaaagtgtcccattaaaagggacttttaatcaacctaataaactctaattctgctgactttttaaagatctaaggtcattttaatacatgctgaaaagggtcacaattaattctttgatcttttttactcactgttaacttatataaattcagaactacccagaaatggcatattatttccctgtgattcatatattaacaaaactactagaatgtctatgaggaatactaagtatctcagaaattcttttcaggtagtacaattttagagaataaatagatcaaatctatttcctcctcttgctgacaaaggttgttaccagcattttcagtgagtgaaaattatggctgtactatgtggaatatgaacaatttctaggaagctccaaaaattctgggcagcttgtatgaattttaggagaatttctttttcttgatgctaggaaactcttgtcttgatttctctacaatcttcaatctataaatcaccatgtccagatgattagaagaagggaaattagattctttctttagtacttctgttatgttgaaaatttcttctctactactattcagtcatacccaaaacgggaatgatttctacaacctcatgggaatcataaataaatgtagattctgaattcaaactgcatatcattgctgtttaaatatcaagtgactttaagccagaatatgcatttagtgataacttatttataattgaattataccaaaagatttttcattcagcatgtttttatatttgctttcaattgcatcttaactaaccatatatctaagcattgtaattacgtgttagaacatttgtagatcatacatgtaaacaatttcttcctcttattgcattgtctaccaaaagtaacagaaaaagaggggtttgtttgtatatgtgagtttatatgggagtacatgaataaaagtatatgagtagaaaaataaaattgaagatcacttcactatgacatggcagtggcattttccttcatgattagccactaatagaatatttttattttatttttatacagaaacatttattatttttatgttaactaataatcttgattgacattacaaaatatgtactaccggcttttttacttaaataatgatatctttttgcaccaatgaatttctttctttcctaactgttggaagaatatgttgtatgtaatggtatcaaatgtcatgagagccattttcaatgtaccatagttaataccatgcttctggtcacttaggtaaaaattctctaacggcttggggactacattgagccacatggagtttagtggaattcaaagagttttgtagttgaaagatctgagcatatggtgaagagtggatgtcactgtttattagggagaggtgtaaaattctggtgactcagaatgtgatgttgcaaaatgggttaagctgtgtttgttttataaaagcaaaaaaaccccaaaaagcatatactatgaacagccatgtttaaatacagattattaaaatgatcatagtgaaactagaaattatttaataataaaatgtaaatgaaaatcactggattaatcaatccatgatgtaaagcatcatcaaagtaatacattaaataattgttgatcttggtcttagtccttgttaacataaagccatagctgaaagatcttactatcttttgggttatttctgtggtttcaaacttaaatgttatgttctatcaatacttgtgatgacatgactgtgataattaacggcagtggtacatttctaaattaatttggcattccactaattaactgaggaaaatatcaatatttcttgttaggttgtgtgtctgtatccaaaagcttataatcacttctggttttgaccatgatgggccaacagaaatcagattaaccttgacatcttaatgaggcagaaaattggacaaattgctaaaacaatggctttcaaatttggggaaacatacattaatctttgagagaatgaaaacaaatggggaaccttagcctgttgccttgagagagtttctagtcagcagtgcagaaaggggaaacccaaacagatcatagcaaccttcctagggaggaaacagagttcagagttagggaggccaaggcaggtaaattttgtaaagtaatggagaggaaaaatctggagatagagagagaggacccaagaacttcagagggttttcctcaagtcttcagttgagtgctgatcagcatgttcatgtgggacaattctcaagtataaatgttaaaagcaattacctaacttcccaagttaagaaattagaaaacaaagaaaagaaaattaaaaccaaagcaagcagaagaaatttaataataaaaataatagcaaacattattaaaagagacaatgcagaaataataggaaaaaaatataggcaaatctagtttttaaaataatcataatgatagctctctatacactctgaccaagaaatatgcagagaaggcaaaatttaccaatgacagaatgagtgagggaatatcagtgtaaattctacattgtacagatttaaaaagttaattcaaaaatattactaacaggtttatggcaataaatttaataacatagatgtaacaggcacatttattactaaagtgcatatgggaggcaatacacaatttgagtagacttatatctactaaagatattaaatttgcagttaaaatatttccctgaggaaaacatcaacttctgctgatttcataatttactgagatattttaccaattctctctgtaatttcattttttcagatgaacatttccctgatactaaaactagataaaaaggtatttcaagaaaactacagactgatatttcttatgaatacagacaaaaaattattaacaaaatttttgcaagatgaagtcaacattacgtgaaaaggtagcatcaagatcccgtggggtattttcctccaaggaatgcaaaatcagtgtaacatttgaaaatcaatataattcaccatagtaaaatgccaaaaaatgaccttcttaaccaatataataaagttgagcagaggggagaaacaaaatatcattagacagcaaaaaaagaaataccagtgttttagttcacagaaacataaccagctatctagaatatcctaaggaatctatataaaagactttagaagtaatgagagaattaagtaagttttctggatacaaagtcaatgctatctacagcaattgattctatttattaacactagcaatgatcagcaaaaaataatatcttaattagtatcatttacagcagcattaaaaacctgcaataaggtagaaatatatttgacaagtgcagtataattttagtacattaaaaagtacaataaattccttagaaaaattaaagaggatctaaataaatgacaagatatactatgttcatgagtcagaattatcactattcttcaaatgtcaattcttcccatattaatgtatacattttaacataatacctataaaaacctcagcaggctgctttgtagaaaatgatgaatttattctatagtacatatggaaatagaaagaacctaagatagtcaaaaacaattttgaaaaaggacaaaatcaaaggtcttacactatttgatatcaatttatattacaaagctatagtaatgaagactgtacgatattgttgtaaaagtgaacacataggtcaatataacagaatataatgcccagaaatatgcatatatatatatatatatatgcatatatatatatatatatatatatatatatatatgcatatatatatatatatgcatatatatatatatatatatatatatatatggtcaattaacagtcagcaaaatgacccttttcttacattacatacataagtttagttgaaatggattattgccaaatgtaaaagctaaaatcctaaagcttcttgataaaacaaaaattgtaaaagattttaaaataacacaaaaagcatcaaaaaggaagaaaatcactatatttggctttacaccatttacaactttcattatttgaaagattcttttaggaaagtaaaaaggcaaaccacaggctgggagaaatattatctcatgcccaacaaatatatggtattataataatagcatatgtaaattatccttacaatctaaaataacagatttcaatagacactgtcaaagacggtgtgttgatggcaataagcatgtgaaaagaagctcaacatcatcagtcattaggaaaatgccaattgctgccaatttatacccactggaatgtctaaaactaaaaagactgaccatttgaaatattgtcaagcatgaggaacaactgctgctctcatctctcctggagggaatgtaaaattttacaagcactttggaatactgtttggtagtttcttagaaagttacactcaacatgtgacccagccattccacatttaggtgtttccttaaaagaaatcaaagcgtacgttcatgtaagcattttttgcataaattttcagagcatctgtattagtaatagtaaaaacaaaacaaaaaaactctaaataatacaaatgtctatcagtaagtaaatggataaataaattgtggcatattgatataagggaataatattcagatattttaagtaagttaaaacatacaacatataaatattaaaataattatcctgagtgataaaatgcaaactaaatcaaactacacagtgtatgatttcattgatgaataattttagacaatgcaaactaatctatagtgaaaacagtgtagtgattgcctgggtaggaggtagtggatcaaaggatctattacaaatgggtgaatggaaatgtttattataatgattgtagtgatatagaaatataaataaatacataaataaataataaatttatatgtaaacttagcaagttgtacactttaagcattcgtagtttattgtactacaattatacctcagtcaactgtaaatatgagaaggtagtaaaccttttcacaccaaatagtaaaagtttcaaactactccttctcaaccagataatagcccaatggtcatggtaaacaaatgagagtgaaaaatgaatctcatagcaggaagaacctcctgagatgttctgttttctccctgctttatactggtataaaatattattataatccttatttcataatggaggccaaaagagccaagtgacttgtgtaagtcatttatcaaagtctataaaagccaagacagaagttaagtctttaactccttcttattcatgcccacaagttacattttccattaagccatgtaactagaaatatcatattatattatctaaattcacatattatataatattatctaaattcacatatcacaagagaaagtctaaaacagaaagccacttttaaagaaattagtaatgttaccagaaaaaaaaacatgaatctgatatatgcacactttcatttgtttttttaaagttccaataacaaaataaaatcattttttggatgtcaatatggtttttccatttaataaagggagggtcctttgttgaggcaacatttgaataaaaatggagagaaagacttattaagggagagtaacttaacagtaaagtattccagggagaaacagacacactgtgaaataactaagtcccagaggagaaagcctgcttgacatgttctggaacaaagggactgctgtgaccagaataaacagggtagcaggagttgtaaatggctaggatattaagtcttacagagacaagctagtatctagatcatatcaagtatggtaaaatatttggaattttatagaaaaataaattccatttgcattcaagtggtcactggtctaaatgtgactagaaaaaatattcaactaacatgtgcaaatgtgacaatgagctatctttcctgagaagatgtgactcttgagactgtgacctgctcatctcttaatgatctcatagttccaggatagtatgcgtcagaatgattgatagtagaaaatatcaccaacaaaaattatggtttccattttctgacattagtaataagaatgtattatttaacagtaggtgatacttcaaattacaaagtatgtgtattaattaccaggattaagaatataagctcttgatcacaaatgacaacacatgcagtttggagagatgcacacttctgtttgattggcttcaggctttaagccaaatttacttaaaatcttcattaataacagttaaagagtttccaaaaaataaaaaagagcatcagatagtttacgaaaagggatatgggtgaaaacaacttgaaagtgatataaatagagatacatgcatataagaaaaggaacacaagaatctccaaaaacttatgtttgttactatatgtgaaatttgtttgttactatatgtgaaattaatggagagcttgatgagttatttttgggtggcattagttatttgcacgtatgctaacgtatttctggggtgacaaaccattccagtttgcctactgactgtcccatttttagcactgaactgccagcatttagggagactcttccatccttggaaacccaagatggctgtctactctatttctagtaatcctgaaagtgagtgtgctacaaatggttgtgaataatgtttttttatttttgttcagaaatattttatacacaaaataatatgtaatctatcagtagtgtataatgaatggcactagtaaacccacaacccgcttaaaacatttgaaattactgctctctttaaagtcactgtgtttcctgttcctttcccacccttctgcttcaagaagttattgctttgattaaaattgtaattaactgcttcctgcttctctttttcttttaaatatttttatcacaaatttaaccacatccaaacattacattgtattgattatcattgttttggaaatccttacgattagtaacatactgtacatatttttctggcaaacgtttttatggttcaacattatactaaataacttcattttaccatgtgatcatcccagaaatatatttattcattttcatcattgtgcacaaataataaaataaacagtgcttatctggtactcattattttccagaaactgttctaagctctttgtgtatacaaattctttattttcttttctttttttttttattatactttaagttttagggtacatgtgcacaatgtgcaggttagttacatatgtatacatgtgccatgctggtgcactgcacccactaactcgtcatctagcattaggtatatctcccaatgctatccctccgccctccctccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacgttttcttaatccagtctatcattgttggacatttgggttggttccaactctttgctattgtgaataatgccgcaataaacatacgtgtgcatgtgtctttatagcagcatgatttatagtcatttgggtatatacccagtaatgggatggctgggtcaaatgggatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgataagcattttttcatgtgttttttggctgcataaatgtcttcttttgagaagtgtctgtttatgtccttcgcccactttttgatggggttgtttgtttttttcttgtaaatttgtttgagttaattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttctggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagcttcctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccatgctgttttggttactgtagccttttagtatagtttgaagtcaggtagtgtgattcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctagatattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatacacaatcatgtcgtctgcaaacagggacaatttgacttcctcttttcctaattgaataccctttatttccttctcctgcctaattgccctggccagaacttccaacactatgttgaataggagtcgtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaagggttgttgaattttgtcaaaggctttttctgcatctattgagataatcatgtggtttttgtctttggctctgtttatatgctggattacatttattgatttgcatatgttgaaccagccttgcatcccagggatgaagcccacttgatcatggtggataagctttttgatgtgctgctggattcggtttgccagtattttattgaggatttttgcatcaatattcatcaaggatattggtcaaaaattctcttttttggttgtgtctctccctggatttggtatcagaatgatgctggcctcataaaatgagttagggaggattccctctttttcaattgattggaatagtttcagaaggaatggtaccagttcctccttgtacctctggtagaattcggctgtgaatccatctggtcctggactctttttggttggtaaactattgattattgccataatttcagctcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggattggtggtgatatctcctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctcggattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcattttgttatgtacccagtagtcattcaggagcaggttgttcagtttccatgtagttgagcgtctttcagtgggattcttaatcctgagttctagtttgattgcactgtggtctgagagatagtttgttataatttctcttgttttacatttgctgaggagagctttacttccaagtatgtggtcaattttggaataggtgtggtgtggtgctgaaaaaaatgtatattctgttgatttggggtggagagttctgtagatgtctattaggtcagcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatgtgggtgctcctatattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgtacgtgagatgggtttcctgaatacagcacactgatggatcttgactctttatccaacttgccagtctgtgtcttttaattggagaatttagtccatttatatttaaagttaatattgttatgtgtgaatttgatcctgtcattatgatgatagctggtgatttttctcgttagttgatgcagtttcttcctagtctctgtggtctttacattttggcatgattttgcagtggctggtaccggttgttcctttccatgtttagtgcttccttcaggagctattttagggcaggactggtggtgacaaaatctctcagcatttgcttgtctgtaaagtattttatttctccttcacttatgaagcttagtttgactggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcaaggagtatctttgtggcattctctgtatttcctgaatctgaacgttggcctgccttgctagattggggaagttctcctggataatatcctgcagagtgttttccaacttggttccattctccccatcactttcaggtacaccaatcagatgtagatttggtcttttcacatagtcccatatttcttggagtctttgctgatttctttttattcttttttctctaaacttcccttctcgcttcatttcattcatttcgtcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccatagctcagagtaatttgatcatctgaagccttcttctctgagctcgtcaaagtcattctccatccagctttgttctgttgctggtgaggaactgcgttcctttggaggaggagagacgctctgctttttagagtttccagtttttctgttctgtttttcccccatctttgtggtgttatctacttttggtctttgatgatggtgatgtacagatgggttttcggtgtggatgtcctttctgtttgttagttttccttctaacagacaggaccctcagctgcaggtctgttggaataccctgccatgtgaggtgtcagtgtgcccctgctggggggtgcctcccagttaggctgcttgggggtcaggggtcagggacccactcgaggaggcagtctgccggttctcagatctccagctgcatgctgggagaaccactgctctcttcaaagctgtcagacagggatatttaagtctgcagaggttactgctgtctttttgtttgtctgtgccctgcccccagaggtggagcctacagaggcaggcaggcctccctgagctgtggtgggctccacccagttcgagcttcccggctgctttgtttacctaagcaagcctgggcaatggcgggcgcccctcccccagcctcgctgccgccttgcagtttgatctcagactgctgtgctagcaatcagcgagattccgtgggctgggcgtaggaccctccgagccaggtgtgggatatagtctcgtggtgcgccgttttttaagccagtctgaaaagcgcaatattcgggtgggagtgacccgattttccaggtgcgtccgtcaccgctttttttgactcggaaagggaactccctgaccccttgcgcttcccaggtgaggcaatgcctcgccctgcttcggctcatgtacggtgcgcgcacccactggcctgcgcccactgtctggcactccctagtgagatgcacccggtacctcagatggaaatgcagaaatcacccgtcttctgcgtcgctcacgctgggagctgtagactggagctgttcctattcgtccatcttccagaaagccaaattctttattttctacagaaaaagtggtagaaattatcatatcattttatacatgatcaagctgagatacagagattaaaaatttagaacaattagtgtaatatagaaatacatttgtaatataataaaaattagtagcagatgtgaaattcaaatccatgaaatctgactccagaggttgcattcttattcactaaaatagggcatcatattttactgtgtaaatatatgacaggtatatttattatcttgtcagtagatatttgggtggcttatacatatttttcctattacaaacaataactctatgaacagtcttataacaattctcatccaaacaaataaaatgttctgtagagaaaaaagagtcatgaagtatgtatgcttttcaatgtggatataccaatttatatttctacaaacaacaaattaaatttttctttccctatattcttatcaacctactgtgttgtcactgtttatttatttttgccaaattgttgaaggaataataataacttattttggttaaatttgtgttatcagaaactaagagactgaacatattttttattggctaattatgtgtaagcttttgtaaaatttttatttgtgtctttagatttttttatattttattacagtgatttttttaatgacattaaatattccttttttttttttttttctgagacagagtctcgctctgtcgcccaggctggagtgcagtggcgcgatctcggctcactgcaagctccacctcccggggtcacgccattctcctgcctcagcctccccagtagaaaaattactttttaaattgactacaattatatgcatttttatagtttatctgttacattatgtttatgtgtgtcatattttatgtgacatatgttaaatatcttgcaaaaaataatctaacacaaaaaaaccttcagtttttccttttcatttttaaaatttatgatgatttaattaactaatatttccaatatttgtcattaataaaatctgagctaagatgtcctttcccaccctaaagtcgtatttaaagttttaatcctcctagaattgagttttatttatggtctgaagagacaattaaatttattttttctccccatgtggataaccattttttaaaatttacctttggataattactgcttgctctcacatatattaagtttctataaaaatatagataactttcttggctccctaacctgtctatttatctatttaggcaccagcttaaatcccttttgctgaagttttatgtgatagagaaacaaccttgcctaattctccttcactttgtttttctttttggctaaacacctgcagaagtgatacagataagtctagagagctaagtatctgagcaagaaaggcctggcagcagcaagtaaaggacacagataggaagaccatatcttagactgtgtcaatgggctcagaaaccagagctggctcaaaatggtaagggtgacaaggtttgatccaaacagtaatagaacatgcttatcacgatgagatgatactaggcctattaggaaagagaacccttaagtatctcaaacctctttagagtctaataatgttttttgttacatatttattcttaatcatgatattgcttaacttttaaaatatatgccccttaaggaagttctgaaatcaaggctcttttcttcataactcttgagcatttaatatggtttagtttttaggtttaaattttgctatttattgggttttatgattataaaaaactgagaatttactatcaaataaataagtttaattatatttaactatgcttttaactttcaaatatttttttctgtaaattgaactggtaaccactattatttgatcaaaagactccatggggtcctctcctgacttatgtcttaaatgaataaatatttatgtcctaatttatacccttgaatattaccatctttcaaactttcatcagcctgatgagcctttccaactagtccagcttgcttagacacttagtacaataccttcatgtcaaattgtgggcaaagttagggaagatgtactgtcttggtttttacacattaaccagctgaagctcataattattagattatttcccccatagcttgcagtatttgggtttataaccaagtgcttatctaatataatgcacaataatagactctagtaagctaaataatgagaagccttgggaaatggtataaacttttggattcatgttggaagcaaatatcaaatttgctgtagtatttcaattttgcctagaagtaaaagtttcaaatatgaaatagaatgttagctaatattgtactttaatatgaatacaaagaattgcaaaagaatgggtgatataaatgaaatgtatagtttttataaaatactgtgtttataaattaagtgttaataaattttgcatgaagtagtaagagtctagagttccgtaaagtgaactgttcttgtatccttcaaccatttataaaagtgaattgtttccaatttaccaggaaaatattcttattctaagaactcaagctgcaaaagaacaaatagcatattttggtaaattttctcttttttttgtagtaaatcttttcttttttaaattatactttaagttctggtatacatgtgcagaatgtgcaggtttgttacataggtatacacgttccatggtggtttgctgcacccatcaacccatcatctacattaggtatttctcctaaggctatccctcccctatcaccccacccctcaacaggccctggtgtgtaatgttcccctccctgtgtccacatgttctcattgttcaactcccacttataagtgagaacatgcagtgtttggttttctgtttcagtgctagtttgctgaaaatcatggtttccagcttcatccatgtctctgctctttagtttaattagatcccatttgtcaattttggcttttgttgccattgcttttggtgttttagtcatgaagtctttgaccatgcctatgtcttaaatggtattgcctaggttttcttcgagggtttttatggttttaggtcttacatttaagtctttatctatcttgagttaatttttgtttaggtgtaaggaatgggtccagtttcatttttctgcatatggctagccagttttcccaacaccatttatgaaatagggaatcctttccccattgcttgtttttgtcaggtttgtcaaagatcagatggttgtagatgtgtgacattatttctgaggcctctgttctgttccattggtctatatatctcttttggtaccagtaccatgctgttttggttactgtagccttgtagtatagtttgaagtcaggtagtgtgatgcctccagctttgttctttttgcttaggattgtctttgctgtaagggatcttttttggttccacatgaaatttaaagtagttttttctaattctgtgaagaaagtcaatggtagcttgatggggatagcattgaatctataaattataattttactctatggaaacatacaatttcatcattttaagtccttttatttaggcatatatcattaaaatcatacgaaataaattgttttagtatgacttataaaggcaagatttccttggaatattgtctgattgagttgtgaaataactgaggtgatgctggataaataaattaaaaataagtaaaatatttgtctgaattatttttgtttttattattttggcatgaattttctagagtgatgaatataattaatatgattaatttttcatttgtaaaactttaccttagatatgaacattttaaatacacacagtagcttcctcttaggaaaaataccttgttaccatgcataaattaaccaagatccatattattcttccattatcacacaaaataatttagtcttcttcactaactaacatctactcagaactctagtaatcacttacaaattgggagctttaaggttaaactatgatgcaattcccttttgtgcatgtttctggatgacaacgataatgctgttgcttatgatgataattataattttttaaatgtcagcatttattcagtaataaagtagtaggcctatttcagataacctgtttacctgatctgatttaatttttataataatcaaactaaagatctatctgaatcctgtatctgagagatatgagtaccttaaatgataaaatgtaatgagagtgtatgtgttttcacatttgctgcagtacttattatcttcttagagaacaaattttttcactttattgagcaactacttacaaccaaattagtttgacgtatattattatcataatgtataagcaaaaaggcaaggctcagtggagtaaattactagttgtttagttacacaagcaagtaattacccagacaggtttcaaattcatttctgactttctttgaactcactatatatactgcattctggaatcaaaagggttcaaaaaatattgttgcaaaaatttgagacttcataagtaaaaataagtgacttgagaaaccaaatgaagacctgtatctcatattaaaaaaatgtggtggggcatggtggctcaggcctgtaatcccagcactttggaagccaaggcaggtgtctcacttgggctcaggagttcgaaaacagcctgggcaacatggtgagactccatctctataaaaagtacaaaaattagccatgcatggtggtgcacgcctgcggtctggcggctgaggtgggaggatcacttaagcctgggcaacaaggagtgagccaagatgtcgccactgcactccagcatgggtgacagagtcagaccctatccatcacccccaaaaaatcattttgatattatggtcttaattttttgatactgtgatctcattttcattttcaataaagaatcttccattgacttattcacacaatatttactagaaatgtattttgagaaaggcagtatttgaaactgtgcataaggtgcttactcttgtcaaatattgctaaaatatcttgtaaaataaaacaatactggtgattttgttaaatagtgttctgcctatatgtttttatatgttaatgtaaaaactgcaaattctcattttgaaaatacaatatacatctgccttgaagcgaatgatgctggtccctgatcaaactggagcttacagtttagttgggaagatagccattaataaataaagcttgaatataagcattataacacaaagtaacaaatcctgtaaagtagccaaagagtacagcatcagggaattccatgtagaaaagtgccacctaagatgtgctctgaatgataagtagaaggagtcagtcatggtagaagtgtaataagaacatgcctagcacaaaggaagcctataaggcagaaaagagcctggtgcctttggtgaaataaaagaatacaaaagaggataaagggaagttagttctgaagagactcacatgagtatgagactttcatggtcttacaggctttattattaaattgaaattttattctatatacaagggaaagccattgaagttttttaaggaaggaagtgattgagtcatattaaaataaagcttagaaattttataggatgataaatgaagacatgatttaggtagctgtttcaatattccaagcttgagacactggtgttttgaacaaaaatagtggcagtgaaaatggaaaaatgtaaatagaatacagtcgtattttgaatatagaatcacaggaattgagcgtgtagggagaaatattttaaagatgtgatttcagatttgggcattatgaatttcagatgtctgtgagacacccacatggaatatcaaaaaagtaattgtctgggataatccaaaaaagtagccttgcctgaagagaaaactttgggactctgtaagtgtagaaatgatttttaaatccctaacaatagatggcatcaccaaaaccaaatttgtgaaaaatgaggagtgggacacagccctgagtaaacttttgataaagctgagcagaaaccagtaaagagaattggggaaaatttttctgaaatataagaagaaaattagaaaaatgggttgtgtcattatgaaataaaatatctaaagttaatgagggaaagttaactaaaagaagaacatgaagaatagatgtaaagtaaggataaataactgcagcgaagaagtagtgatatccaagaaacaaaaaggacccaaaaatgttattagattgaagaatatttgtctcagtgtcaaggaggatattgtatctattattctagttacttgtgcctccctgccttgatatatatagaaaggttatggctattacagaaagcagcttgctgctactggagatgatgaaagcttacaaggacagagcacacctacactgctaccttgtgagaggtgaagccagctggacttcccgggtggagtggggacttggagaacttttctgtctagctaaaggaatgtaaatgcaccaatcagtgctctgtctagttaaaggattgtaaatggaccaatcagtgctctgtaaaatggaccaatcagcaggacatgggcaggaccaaatgagggaataaaagctggccacctggttgccactctccccttccacgctgtggaagctttgttctttcacttttcacagtaaatcttgctgctgctcactctttgggtcctcactatctttatgagctgtaacactcactgcaaaggtctgcagcttcactcctgaagtcagcgagaccatgaatccactgggactaacaaacaattctggactaagagctgtaactctcactgcaaagttctgcaggttcattcctggagtcagcaagaccatgaacccactccggaagaaactccggacacatctgaacatctgaaggaacaaactccggacacaccatctttaagaactgtaacactcaccgcaaggatccgtgacttcattcttgaagtcagcgagaacaagaacccactggaaggaaccaattctggacacaactggactgcacatcctagggagagcaaaagatacagacctggaaatacttaatttccttttgtttccaggatgcattaggtaacatatcatgttgtgatagaactacctgctttgatcctatgaaagcatttatcaaagcatattgtaataatctactattgccttagtcttctccattgtaatgtgcacaatttaaggaaaggtatgtctaaaaatctgtatatccaatatttgactcgttgtggtacatagtagcacacaaaaaatttgtgaaatgaaggatgcatgagagtggagctggggataatatagtttgtttattttagaccgatcgagcaggtccagaggcaataagtgaaaattcaaagaacatgctttttgtcatatataagacagatatttcaagtattctagaatagtctaaaaagaaggatctatttccatgaaggcacttgagtggacagctgaatgacaacttgttggagggattgtagagaagaattaagtaaaattgtaaccactattaattgatcaaaagcctttgttatcatttatgttgatttatatcctaacataatgtaatattatttctatctttaagaaaacattcttaatattgtatgatatagctcctcatcttcaaagaattaatacagcttaataatattagttttataaacagcactaagaacgttgaaaatgaagagaaaatatgtatgggttagtcaatgtcttataaggtgctatttaaaattgtagttaagaaattatacattattactaaagataactagctacaaaatgttgcgctctttctttctcttctctctctctctttctctgtctctctagaaacagacagaatggcaaatgcaaatagtgaagcaaatgaattaaatacaaatatttttacaaatactgtatttgtggtatgtcaatatgttgtcagaaaaggaatttatcatagataatttttattgaaatgtaaccttaagtttctagagccaagggaagagcaaaaaagtggtgaagataataaaaaaagagtcaattaattaatgattcattcatagtgactgtaattcagaaaacatgacaaaagactatgacatttataagaataatgttatttttaaaaatatgggtacaatagcttatttctaaattgaaaatgttattactttttcagtattttatttttcaaatatccatatttcatcctatttataaatgcgaaaacaataaaatgttactagtggacatttgtatctatttagcatttttgatgggtcaaaatatttacatatattttaaacatatttgttggctgtcaagtatatatttgactctttaaacatatatttattggctgtcaagtatatatttgactctttaaacatatatttattggctgtcaagtatatatttgtcatggtatttactcagcttgagtgtcatacagcatcatctattgacatatgaaataattcagttttcagttgttattactgattgacactaaatttctttgttgaaaaattcaatactttgatatctattctacacttcatgatctttaatttatccatttgagaatgaatttttacctagagaatgttttacgcttattttatatagatggatcttattctttaataaataagataaaaacatatagagtctcatgtgtatatgccagatgattgattccaatggcctgtagatatgaaaataattattttaaaatgaaatatgagcaaagaagtattttaagatgtagacttcctcagaagagaaccagaaatatgggttcatgtaagaaataacaaatggcaatgtatggagtactctagataccttcttaattagagataaatgtgttgtacaaataatgagactggcatgtgggaaaaatatgttttctccttgtttgctttaccttttaattgggttatgaaattgtttaataatacaagcaagacatttctaatactgaactcttgagaccagacccagattgcactttgcatattcaatgaacatgatgaagatttcagtttttcaaagtagaaatcaggttagtcaaatactgaaataaagtgaatcatctctcaaatttatgctgagctactgtgaggattaaaagagataaactttgaaaattgcttgacagtggatctgacacatagtaggggcttaaaaagaaagatattactataaatataacttaatcatttaataaaatgtataatattttaatatacggataatatctttcaaaaaaataaataatccaaggttttctcaccttaatatagagtaatttttgagtgggcctttgaaatgcctagcacacatgtttttctccatttcctttacccaaacactcatattcccataatccatccccacaccctcaagtcaaactcatctcatttctctccatttcttagaactatgtgcactctgttttattactggaaatttcttttcattctttctcagtttatttcattttcaatcttttgtcttgatcaaatatggctctcccccaattatgccacagtcaatgctgtcttttctttatatttcttattctatattctatataaagccaccttaatctctgatttgcctacttttttctaacatcttcagtcaaatttaattcattgactgtgataccttattttattgtgctttgcaggtattacactctttcacaaattgaagttttggggcaatctcacatttaccaagtctatcagcaatcatttttccaacagcatgtgctcacttcatgtctccatgttatattttggtaaatctagcaatatgtcaaacttttccattattattgtatttgttatggtggatccatgatcatgatctttgatattactgctgtaatagtttggacatcatgaatatgtccatttaaatataagacagcaaacctaatacataaatgttttgtgtgttctgactcttccaccatccagttctttccccatccctctccttctcctgaggcctattccctgagacacaacaatatttaaattaggctaaataataaccctacagtgtgctgtaagcgttcaagttaaaggaagtgttacacttctctcactttcaatgaaaagctaaaaatgattaagcatagtgagaatgacatgtcaaaagccaaaacaggctaaaagctagacctcttgtgtcaaatagtaagccatgttgtcaatgtaaagaaaaagtccttgaaggaaattaaaagtgctattccagtgaacacacaaatggtaagggagcaaaatagacttattgctgatatggaaaaagttttagtggtcaaaccagccactacattcccttaaaccaatgtgaaattcagatcaaggtcctaaatctcttcaattctctgaaggctggaagaggtaaggaagctactgaagaaaagttagaagctagcagtggttagttcatgagatttttaaaaagccaaatctataagataacagcacaaaatgaagcaggaagtgttaatgtagagttgtaaccagttttctggaagatatagctaaaataattaatgaagataattacaataaacaacagattttcaatgtagatgaaatggcctaacattggaagaagatgctatctaggacttacatagctaaagaggagaagccaatgcttgggttcaaagcttccaaggaaaggctgactttcttgttaggggctaatgcagctggtgactttacattgaagtcagtgattatttgccattcaaaaatgctagggcccctaagaattatgctaaatctactctgcctgtgttctataaatggaacaaagcctggacgacaacacatctgtttgtagcatgatacactgagtagtttaagcctactgttgagaactcttgctcagaaaaaaagattcctttcaaaatattactgttcagtgacaatgcacctagtcacccaagagctctgatggagctgtgcaaagagatcaatgtcattttcattcctccaacacaacattcattctgcagcctatggatcaagaagtaatttcaactttcaagtcttattatttaagaaatacattctgtaaggctattgtcaccacagatcatgattcctttggtggatctggacaaagtacattgaaaaccatctggaagggattcaccattctagatgccaataagatcattcatgactcattggaggaggtcaaaatcccaattttaaccagagtttggaaaaaattaattccaatcctaatggataactttgacgggctcaataagtcagtgtagaaagtaaatgaaaatgtagtagaaataataagagaactataattagaagtggagcctgaagatgtgactgaattgctgcaatctcatgacaaaaattgaatagatgaggaattgcttcttatgaataagcaagggaagtgttttattgagctgaaatctattcctagtgaagatgaataacattgaaatgataaaagatttagaatattacataaagttagttagttaataaaagcagtggcaaggcttgagaactgtgactccagttttgaaggaagttctactgtgagtaaaatgctatcaaacagcactgcatgctacagagaaatctttcatgaaaggaagtgtcaattgacgtggccaacttcttgtcctattttaagaaattgccatagccaccccaacctttagcaaccacctccttgatcagtcagcagctgttagcatcaaggataaaccctcgaccagcaaaaagaacatgacttgctgaaggttcagatgattgttatcatttttaatgtatttttaattaaggtatatattatttttaaagttataatgcaattgcacttaatagactacaatatagtgtaaacataacctttataggcactgggaaataaaaaaaatttgtgtgaatcactttattgcaatatctactttattgcagtagtctggaactgaaccctcaatatcttcaaaatatgcctgtattcagtttatgaacaggtatttattaagtgccttctatgtgccaggtaccattctaggaccttacaatgtatcagtagacataatagacagaaatacagtactggagtaccttccatttagtggtggtgtggaatatagactatgaacaataaacatgaaaaataattcacttataaataatgctaaaattaataagtgctataaaaaggagaataaaggggataggagtggataaaggggagtgtagattcaatttgaaataatatggtcaggataggactcattgattaaagtgtagtggggaaaagataaagcattagcaccatgaatatttttgggaaaagtagttcgtgtgaaagaaagagacaaatctattgcatccaaaatgaaatgactaggaagtagagcagttggagaagtcagatatatgacattggccagacactgcacatgaagtccacattacatgttgctttcacatggagttaaggagagtcgctggaggattttgagcaaagcagcatcaaggtctgaattacattttggaagaatgattctgttcgctatgttgagaatagaaaacattggttggcaggggtagggtggcaaggaagaaaaagaacataaatttctgtttcatttattttcactttatgcccatgtaatttgtgtcataatatagtcaatctgcaattcatgttttatactttttaggtgatttaaggcttaagttatatatatttttatgccataaactgctgccagtattggcagctccaacatctatctcgataatcttttaaatagctaaacattaaggatccttaactggttttgctccattgatatatcaatacatcacattgtactttggccatatcctaattactgacaaaacaaagcatatcccgcctctgggttgatgaatttggtccagagactctttttcttaaaatttcttgtctttcaaaattaatacagttgttaggttaatgtatcagactgacattgacctacattcagtaatttctctaagattgttaactttccctagcattaagaaattatgacttagcataaatgccagattcatccccaacaaatacattcttagtaccatatttgtcaatttattaatgttttcctgcttggaatcctttcccttctgtacaacctatcaattcatcaaagcctattacatgttttatcttctttatgaggatttctttaacccttccagtcaacatacatatattttcttcttctgccaagaaaattacttaatcaacctatatttaataagtagcaactaagtttctggaactgtaccaaatctgggggaggagtctgatttgaatcactaatgaatggattattagacactaagagctcagaaggaaagaggatataataaaataacatgtagctcaggtacctgacctatcctgaggagctggcaactaacctaagatgaattggagttatttagacaaatgagggtggagatgaacagggcatccttatttggtcttaaccatcagtccatcatacatcaggctttttaatttttttatttttgtctcatttcatgtaatcctgctctcaattctaatttttacagttgtcaaaataaattttataatttaaaaaatactaaaatataccttgaaaaccactagtattttaaatacataatttttgtaatgttttgattttgatttttttataatttcaacttttatatacaggggttacaggtgtaggtttgttacatgcatatattgcatgatgctgaggcatggagtatgaatgatcctgtcacccagatagggagcataatacccaacaagtagtttttcagcccttggctccctcctgctctccacccttattagtccccagcgtctattgttaccatctttttgtccatgtctttatcagcagcatgaaaacagattaataacccatgttgctgcaaatgatagattttcatttttttaatagtttactactattctattgtgtatacataccacattttcttgatccattcttctgttgatgggtacttaggttgacttcatgtctttgctactgtgaaaactgctgcaataaacatgagagtatagatataccttcagtatcctcatttcttttattttgaatataaatactcagcagtaggattgctgaagcatatggtagttttattcctagcatttaaggaacctccgtactgttttccataatggctgtactaattcatattcccaaaaacagtgtatgagacttcctttttctctgcatccttgtcagcattaaattaataaaattaaaataggtataaaatgctttgcatcatcttttaaaaacgatttttataaagaaattctaagaatttaacattctgtctcttcaatatttgtgaacttgtaaaaagtatgtatacaagtggccaaaaactagaatgaagaatggaaaataaagcatgatttttaaaagtgatcagttcaatagtgattttttctatagtgtttctttttataatacatgggtagcaagatttaagaataataagaaaatgtcttagtttacatatttatacaatattgattaatcaaggtatgagtatgcacatttgaatatatagaatggactagatccaacatatgcctctccctgtccatacatcatatttagaattttaactctcatatatagcataagtccaaatcccatctttctaaattttatttctttgcttctgccataaaggatgctttcatccgaagattatctattgcatttcaactactcataacctactaatcagctttggtggcatttttttcatgtcatatgcagattatacaaatgttttacatattatcaaaaagtccattctttttgacacttcagccaggtgtggaaaaatttctaacactgttttccttctaacagattaaaattactgttattttgagagtttggtataattttagaatcagcaatgctaggtttttttcatacactatttatgaagaatagtatgaaatcaccataccagctgcaatatattgttaaactctccaaagaacactttctattattttgtctctctgtgtcattgtctttctttcctcctgtgtttttgtatcagacaacacttgttttctgaagggaaaatgatgatcatatctgttgtaattctgaaggttcttcaaatgcaaaaggatttataactcttatattatctatgattctgtatgaattggaaataaaatactattagattaaaattgaaaaataattttaaaagcatcctttcgttgtttagttatatttctttggtataaaactacacgttcatttaagtctttaatgtatcttgagttataataatttttgtatagggtgaaaaatggagatcctggacttcaatcttctgcatatagctcttagttatcccagcaccatatattgactagggagatttttccctattgtttgttattgtcaatattgttgcagatcagctggttgcaggtgtatggctttacttctgggttctctatcctgttctattggtctatgtgtttattttgtaccagtaccatactgctttgaatactgtagcctggggtagtgtgatgcctccaggtttgttctttgcttaggattgctttggcccttttgattccatgtgaattatagaatagttttctttaattctgtgaaaaatgacattggtaatttgataggaatagcattaaatctataaattgctttgggcagtctggccattttaacaatactgattcttcctggccttgagcatgaaacgtttttctatttgtttgtgtcatctctaatttctttcaacagtgttttgtaatcctcattttagagatctttcatctccttggtaagctatagtcctagatattttatttttgtggctgttgcaaatggcattgcattcttgattgggctttcaacttgaatattgttggtgtatggaaatgctactgacttttgtgcattggcattatatcctgaaactttactgaagtcatttatcaattttagaagccttctggcagagcctctggggctttttaggtatagaatcatattgcctgcaaagaaaaatagtttgacttgttctctttttatctggatgctttttttttttctttctcttgcctgattgctttggctaggacttccagtactatgttgaatagaaaggctgtgagtggacatgcttatcgtgttacagttctcaagggggaatggttccagcttttgttcatttagaatgatgttggccgtggatttgtcatatagagctcttattattttgcggtatggtcctttgatgtctaacttgtagaggatttttaacatgaagggatgttgcatttttttgaaaaggcttttctccatctattgaaataatcaccaggatatgacattctggatatcagccttagcaaagagtttatgactatgtccccaaaatcaattgcaatgaaaacaaaagttgacaagttgaatctaattagactacagaggttctgcacaggaaaataagctattgacaaagtaaacagacaacctacagaatgggagataatattcccaaactatgcatcagatgaagttctaatatttagaatctataaaacacttaagctattgcataaagaataaataaccttattaaaaatgggcaaattacatgaacagatacttcttaaaagaagacatacatgtgcccaataaatatatgaaaaaatgctatcatcacaaatcattagacaaatgcaaattcaaaccacaaggagataccatctcacaacagtcagtatggctattactaaaaaagtcaaagaaaatactgcaggaaaaagataggtataaaaaaatttaaaaaaaattaacaaaggtcaaagtacaatagatgctggcaaggttgcatagaaaaggtgacacttatacactgctagtgggatgtaaaccaattcagccactgtagaaagcaacttaaaacacaactaccatttgatccagcaatttaactacttggtatttaccccaaagcacaagaaatattctaccaaaaagacacatgcactcatatgttcattgcagcactattcacaatagcaaagacatggaaccaatcaagatgcccatcagtggtggactggataaagaaaatgtgatacataaaccatggaatactatgcagccacagaaaagaacaaaatgatgtcctttgcagcaacatgaatgctagaggccattatcctaagcaaactaatgcagaaatggaaaaccaagtatcacatattattacttacaagtgggaggtaaacactgaatacacatggacaaaaagtggaaacaataaatactggggactgctttagtggggagagagctagagtggtgtactgtgctcatgacctgggtgatggtatcatttatacaccaagcctcagtggcacacaatttgcccatttaacaaacatgcacattatattagtctgttctcacactgctaataaagacatacccaagactgagtaatttataaaggaaagaggtttaactgattcacagttcagcatggctggggaggcctcaggaaacctacaatcatggtggaaggggaagcaaacacatctttcttcacatggtggcagcaaggagaagtgcagagcaaatcgggggaaagccccatataaaatcgtcagatctcatgataagtcactcactatcatgagaacaacatagaggtaaccacccccataattcaatgaccttcacctggttcctcccacaacacatggggattatgggaactacaacgcaagatgagatttcggtggtgacacagccaaactatatcacacatgtacccctagaacctaaaataaaagtagatgaagaaaaaacaattccctccattttctaataaaatttctcagaaaccacccaatctttataaaatttaacttgaacatatctaaactcttactcacctgtagtattccttctctaattattacatgatttgaaattaaaccctttactttcatctacctttctttaaaatatgcaagttactttatacactgcctttttagtacatcaaaatgttttgttgttattggtgcaaaacttcaacacaagataatactgcataccattttctatcagatttgttggttaaaattattgtaatcaagatatcacaatatgtaaattacccactatttaatggtataagtatataactgttaattatttatattggattattggatttatattggataacatacagaaattattatatttctgtatgttagaaatccaaccaggaatatacaacatttcagcaacaatattaagaataataaggctgggtgcagtggctcacgcttgtaatcccagcacttcgagaggctgaggcgggtggatcatgaggttaggagttcgagatcagcctggccaacatagtgaaaccctgtctctaccaaaaataaaaaaaaaattagccaggtgtggtggtgagcacctgtaatcctagctacttgggaggctgaggcaagagaattgcctgagcccagtaggtggaggttgtggtgagtcgagattgcgccattgcactccagcccaggagacagtgtgagactctgtctcaaaataataataataataataataataataataagaagaagaagaagaagaagaagaagaagaagaaaactcttctaattgattcatcaaaaactggctttacaaaatgagaatacaaaattgtaactattttcaaaaacaccttatctgtcaaaacatgttttgattttctagagtgtatacaattattatttcaattgtagttgcaatgtatttggattctctagaagcctaatgtaatatttgtggtttttcagaataatcattagtgctttcaaaaccattaaatgtcaacccagatgatatacactgtggaatctgtattgggaaatctaaaaggaaggactggacaggataaggtttgtaatgtctcccatttctaaagcttcctctagggcattttggcccatagcttcttatggctccagccatttcttaatgcactggtggccaagctgcctaacgtgattttgctaccataatcacagccacttggatcaaaggagacgccagtctcaaggaatgataatccgtatgttgaatggagaactttataaaatgtattaatgtatttaaaaactgtaaaaagagtagattttaaatggtctccccacaaacattaagtaggtgaggtgagagtttaattagattattaattagattaattagcttgatttaatcattttgcattgtgtgtgtgtgtatatatataaacatcatattgtactgcataaatatatacaattattatttttcagttaaaaaatttaaaaaaagccttaataatgactgttttagctgacagggaagagataactaaattaaaactgtaatattctttcagttgagaacttgaaatccttaagttatacaaagccagtgtttactagtagctgtctaagctgaaagaaacaggaaaaaaagagtatcaaaggcaatatggagaaaaacaacaaaattgatgatactaatgcctctaccattgctactactaataacagtgagtagaaataactggtgaataacaacagacatgtagagggagcaggtaattactgaaatgaagaagtagttcttactgctgatttcttatcaggaccatatcatcataaggtatcctggttcctagagcaaacttagaccctgaatgacttcttggtctctatcattctaatttacaagggccatgactatattgcagttctgaattctatttgggtggtccggattttcacaggactggttataacaagattcacttttttcttatttccttgtatcttttcaaccaactccctttttctaatataaataaattgatgtctaaaaagccataatacataattcagttaatctaagagggagaattaacatgattttaagtatttcttttttggcctttaaaatatataaatatagatatctggtttattcatgatcattgttaagtagtatttatttgtttggacagacctatattttgttatccatttttgtgttaataatctaatccttcaccttatatttcttttaaaataatcctgctatgaacaagaatactttagtatatgcctcagagtgattatgaggaagattattttaagaatataagcactgaagtacggaaatgctgaatcatgggttttgtacattcttaacttagatgttgctttccaaagtggttgcattaaggtacattcctcctccatatccagcagtacataaaacttcccttcctctgtatccttctaattttcacactttcaattgtttattgatataagagatgtgaaatactatgtggatttaatttccatccttgattattagagaagttgagagtctattacccgtctatgtttcttcatttgtgagttggctttttcattcagtaggcttattttttcgtcagagtacttttcccaataaaggattgcttcaatttagtttttaaatttgagggtaatgtgttgggccatactgttagtaaaaagttgaactttatacctatgtatattcaagtctacatttagaaaatttttaggaagctgtctttatctcccattcagagtctagtctgagacaggcaagttttcaccatctctgtttattggaaggtggacttctcttagttcaccttagtaaaccctgagggtcctagcttgtgtaaggcatccaagttccaaccacccaacttgtgtgcttggggacttatctcctttccctgacatgtccttattgttaaaacaataaccttatcgctttaacaggtcacagaatttggcaaatgcctgaatgctgttttaactttagtaccagcttactactgtgatgtgctgtgtggctgctcatgtaagaaatacaaccccccgaaaaagaaggaaaagggaaaagaagggaaagggaaaagaagaaaaagaaaaaacaaattgggggccctggttatgtaggtgaagcctgacaaaaacaaacaaacaaacaaaaagatagtaaaacacctacaaaaagaactctgccaaaatgaagactttgctgtttggcattaccacccatgctgtctttcttaatgtcttccaaaaattttgcctagtctactgagaaaaccttcttaattttgactgggatgcaaaaactggcttatgtgtattctgcacatgtgttgacgatgaattccctacaattgtaagtgaaaatctgtaattaagtctctgttgttgctatctgatttcatcccacgtttcctatctggcattttaaaaacacaggcctctaggattccatgtggaatgctgtatcgtccctgactgcagcccctgtgtaagcttccatgtcctctgcttttctttaacagttaccattgccctaatctcttcaagttttcagaaattttttgaaagaccttttataccaatgcttgctcaaccttcttattctcctcatttttttttctatcaattaaatggaggttttagggaaagaatgtaggtatatccatgtgctatgatcagcatcttaaataaaagtttctgttaactagctgtgtacaagttgttggcttttttatttttattttttcaaaaacatggtattgctctgttgcccaggctgtagtgcaatggcacaatcttagttcactgcagcctccaactcccaggtccaagcgatcttgccacttcaaccttcctcccaagtagctggaactacaggcacccatcaccacacccagataaatttttattttttattttttagagatggggttgccctatattgcccagggtggtcttgaactcctggcctcaaataatcctcctgcttgggcctcccaaagtgctaagattacaggcatgagtcaccacacccagtttgttcacaagtcttaatatgttcttagagttagaaggcaatgtcaataaatcagtgatccaggtgtataatcagtcaattagaaagttaatttctcttctagatggatatctactttttacatttatgtaggaatgcagacctggaataatcagattttaatttttagaaatataactgccatcagaattttacatcagatctcccaccttattagtgttgtcatattattcgactttacttttgttgtcgttgtgcaaggtgaacaaaatatttctgcagaaagtctccagagtgcatgatactagttcatgatctctgttttagataagtgtttcatataattattaaaaaatcttcagaattcattattgttctccacatttatagacaaactgaggggcttcaataaggttaatgagttttccagatgcaccagagagggacttgaaacatcttttaggtccaaattatctcactaaatggaaatgttgtcctatatattctttgaaaatgctgtgtatgtttctaaaacatatgttgatttgggggagtttaaagattatctccagatcgtcaaataacttgaacgcagagccagtgctaactgctttcagtgttaacctcctcatttttcagggtcttgaaatttgatttcagttctaccaactctactcaaaaaaaggctaagagtaatattttagggagcattttatttttatatgcagcatatgaaaattattctcattaaacatttcatgaacatgctaataatgaatgcgctgtttgccaagtgaaattgtgttagtgtatgtgtcacctattcctacacgtggggttttaatgtgttatgctcaacaaatcaagaacaatttgaaatgcttaattgcaaatattctttattattttaaagagatatggattgttagcaaaatttttgctgctaattttctacgatattaaatactttgtttaatgattgtgtaaatgtaaaaccatgtttctattttttataaaaccaatttgaattctggatgaataaatagtgcattataactcatttcttttatatttcaatcagttcaaataattatttgaccaaaagttagaaattagtttattcaattaatatcaaatatttctatatatgtttgtttgtattgtgtatacatacatacagttatgcacatatatataattagaaatatatcaatttttcttacaaaaaaatgttatagaaaatcaatctatgaaagctagatcaactgtctctaggattactgcccaagtgtcccaactaatctttctagtccaatattacttttcttccacttatattcctgttccatacagcagagttttaaaaaacataactcatatcttggcactcctctacttgccaccttccaatagctttccatcaaactaagcatgaaagtacaaagcctgcactggcctgcctggccctacataaatctttcttttaccttcttttccaactcatcttttagtaatttccctttcctcatgacattcccaccaccgtgacaataatgccatcatccaaaaacctaccttagagtttcagcatttgctgttctctctaacttaaatttttgccacaaggcctggttaccttctcaaacaaagcaccctgttttatttttaccctaatacattacaggttttaaaaaaatatatgctgactcttcatctctatttttttatttttatgaaattatagcatactaaagaaaggcacacaaatcatagtgcagagctcaatttacaaagtgaatacatccatctaaccaccacctagatcaagataagtggacattaccagcactccagaaatgccgctcattctctctcccagtctgttcctcctaaaaacagccactgcctcacttttatctccatagattatattttcctattttaacttcagatcaatgaaagctgtagtttagtgcctgacatttaaaatttatgagttaaaaatataatatgaaatctacctgcacaaattttttagtgtacagtatagaattgttgacaatatgcacactgtggtacagcagatctctagagcttttttgttttgcatgattgaaggtctattccaattgcaattccttatttcctctcctctacctcttggcaatcagcattctactttctgcatctaaggcttaaactattttagatattttataaactaggaatcatgcagtatttgtccttttgtgactggcctatttcacagaacaaattatcctcagggttcattcacattgccacatgtgccaggacttccttcatgtttaagactgaatcatattccattgtgtatgtattccacattttaaaaaatccatttatatgtgggatgtacatttaggctatttctacctcttgctcattgtgaataaggctgcaatgaacataggaatgtaaaatatcaattcaagatcctgatttccattatttttaataaatgcataagagtggaattgctggaccatatggtcattctatttttaatatttttgtgaaacctccatgctgtcttccatggttgctgcaccattttagatgcccatcacagtatacaaggatccaaatttctccacattcttatcaacacattgttcatttgggtggggagggcagttgtgtttttttgtttcttataatgagcatcctaacaggcgcaaggtgatagctcattttggttttgatttgcatttccccgattatttgtgatattgagcttcttttcaaatacctgtggaccatttgtatgtcttctttggagaaatgtcttttcaagtcctttgcccttttattaattggggtatttttttcaattgttgtttttgagttgcaggaattccttataatttttgaattctgatgtcttgacagatatatgatttgcaaatattttctcctcttccatggcttgccctttcacactgttgattgtacctttgctgtgcagttgtgtctttgttttgttttgttttgttttatggttgatgtagtctcacttgtctatttttgcttttgtggcctaggctttggggtcatatccaaaaaacttatgcaagaccaatattgaggagattttcccctttgttttcttcttgtattttacagtttcaggccttttatttttaatttttttggacaaatgggatcacatcaagttgaaaagcttctgaacagcaaaggatacaatcaagaaagtgaagagacaacccacagaatgggataaaatatttgcaaagtacccatctgacaagggattaataaccagaatatataaggagttcaaaacaactccatagaaaaaaataatacaataaaaaatgggcaaaagatttgaatagacctttctcaaaagatgacatacaaatggcaaagaggcatatgaaatggtgctcagtatcatttaatcatcggagaaatgcaaatcaaaactacaatgagatattttctaacaccagctaaaatggcttatatccaaaagacaaacaataacaaatgctggtgaggatgtggaggaaagggaaccatcagatactgctggtgggaatataaatcaatttcaggtcttaattcaagtctttaatttattttcagtttatttttgtctgtggtataaggatcctagttcacatttttccttgtagatatccagttttttttaacatcatttgttaaagaaagcatggttttctccttatgtattcctggtaccttagttgaagatcagttagccatacatgcatgagcttatttctgggctctattctgtgcattgacctatatgttgctttttatgccagtaccatattgttttgtaatgtcatttgaagataggaagtgtgaggcctccaggtttgttctttttgttcaaggctactttacctattgtgtcttttgtggttccacacaaattttagaatttttttctacttctgtggaaaatgccattgaacttttcatagcgattgcattaaatctgaagatcactttgagcagcacgaacattttaacaatattgattcttttgattcatgaacttaggatagcttttgattaacttctgacttttttagtttctttcatcaatattttgcagttttagggtacaagccttttacctccttggttaaatttattcctaagtattttataatttttgatgctattataaatggaattgttgtcttaatttatttttcagatagagtgttgttagtgtatagaaatgcacctgattttttatgttaatttttaaatatacaactttactgagttcatttattagttctaacagttttttgatggagtctttagagttttctatatatatgatcattacatctgtagagacaatttaaatattccatttcaacctgggagtcttttatttccatttctgcataattgctctgaccaagacttccagtaatatgttgaataaaagtgctgagaatggacatccttatcttgctcctgagcttagaagaaaagctttcaacttttcatcattgaatttggtgttagctgtgtgcttgacatatatggccttgttatgttgtgatacatttcttctatacttaatttttaaaaatggtttttgttatgaaaagatgttgaattttgtcaaatgcttttccagcttctattgagatgatcatatgatttttatcattcattctgttaatatggtaaatcacatttatttattttttggggtatgttcaaacaccctttcatttagggataaatcacacttggtcataaaataggatccttttaatatgctactgctactgaatttgtcttatttatatatatccatcagagatattggcctactgtgttttttgttatagtcttagtcattgtttggcattagggtaatgctggcctcaatgagtttggaagtgtttcctactcatcaatttttttaaagattttgagaagactaggcattaattcttcattaaatacttggtagaattttccagtgaacccatctagtcctggatttttctttgttggaaagtttattattaccttcaaaggtaaagattcaatcattttactcgttattggtatttttggactttctatttcttcatgattcagtcttgctaggtttttatatttctaggaatataaccattttagttcagaattatcttttatgatccaatttattgctgggtcacaagttgtaatgtcccccttttcatatgtgattttatccatttgaatcttttctctttttttttcttcatatagataaatgtctgttagttttgttgatcttttcaaaaaacctacctttagcttggttgattctttaaaattgtaatttctatttcactgcttttaattctaatcttcattattctcatccttctgctagctttggacatagtttgtcttctccttctttgtttgaggtgcaaatttctatcatacgagatctttcttcttttttaagtaggcatttatcactatgagcttacctcaataacgactttgttgcatcccataggtttgggtaggttgtgtttccattttctttctctcaagattatcttcgaatttcccttttgatatcttttttaattattttattttattttcatttttgtgggtactcagtaggtgtgtatatttatggtgtgttagcccattttcctgctgctgataaggacattcctgagactgggaaaaaaaaaaagaggtttagttggatctgcagttccacatggctggggaagcctcagaatcatggtgggaggtgaaaggtacttcttacaagtaccctgataaacccatcagatctcatgagacttattaactatcacaagaatagcacaggaaagactggccccccattattcaattacctccccctggtttcctctcacaacacctgggaattctgggagatacaattcaagcaaagatttgggtggggacacagccaaaccatatcattgtgtggctgccccgtccaaatctcatgtcctcccatttcaaaatcaattatgccttcttagcagactcccaaagccttaactcatttcagcattaactcaaaagtccccagtcggaagtctcatctgagacaaggcaagtcccttctgcctatgagcctgtaaaatcaaaagcaagctagttacttcctagatacaatgaaagtataggtattgggtaagtacagccattctaaatgggagaaattggccaaaacaaaggggttacagggtccatgcaagtctgaaatcccgtggagcagtaacattttaaagctccaaaatgatctcctttgactcgaagtctcacatccaggtcacactgatgcaagaggtgggttcccatggtcttgggcacctccacccctgtggctttgcagggtacagcctccctcctggctgctttcagggtatggcattgagtgtctgtggcttttccaggttcacagtggaatctgtcagtggatctaccattctggtgtctggaggacagtggccctcttatcacaggttcattagactgtgccccaataaggactctgtgggaggtccgatcccacatttctcttctacattggcttcgtagaggttttccatgagggcctgtccctgtgaaaagttttgcctggttatccaggtgtttccatacatcttctgaaatctaggcagaggttgctgaacctcaattctcgacttctgtgcacccaaggctcaacaccacatggaagctgctgaggtttggggcttccaccctctgaagccactacctgagctgtacattggctcctttcagccacagctggagtggctagaatacagggcaccaagtccctaggctgcacacagtgcagggacctgggtcctggcccgttaaaccactttttcctcctgggtctctgagcctgtgatgggaggtgctgcccttgaaggtctctgacatggcctggaggcatttactccatggtcttggggatgaatattaggctccttgctactcatgcaaagttctgcacccagcttgaacttctccccagaaaataggtttttcttttctatcacatagtcaggctgcaaatcttccaaacttttataccccaaattatctctctcaagttcaaagtttcacaaatctctagagcagaggcaaaatgcttccagtctctttgctaaaacataaccagagttactttgttccagctcccaacaagttccttatctccatctgaaccacctcagcctggaccttattgtccatatcgctatcagcattttgggcaaagccattcaacaagtctccaggaagttccaaaatttcccacattttcctgtcttcctctgagtcctccaaactgttccaatctctgcctgttacccagttccaaagtcacttccacatttttggttatcttttcagcagcaccccactcctgttaccaatttactgtattagtccatttttggacgaatacagtaacaggactaatacagtaacagcagactaactgctgataaagacatacccaagactgggggaaaaaaaagatgtttaaatggacttacagttgcacgtgactggggaagcctcagaatcatggtgggaggtgaaagacacttcttacatggtggcagcaagagaaaatgaggaagaagcaaaaggagaaatacctgataaacccatcttagtaaccatcacaagacttattaaccatcacgagaatagcaaggaaaagaccagcccccatgatttaattacctctccctggttccctcccataacacatgggaattctgggagatacaattcaaattgagatttgggtgggggtacagccaaaccatatcctatgaggtacaagatgttttgatacaggtatgcaatgtgaaataagtacaccatggagaaaatggaatatccattccctcaagcattcatcctgagttacaaacaatccagttatacaacttacaattcaaaatttacaattaagttattattgactatagctcccctgttgcactatcaaataataggtcttattcattttttccaactatattttcaacccattaatcattcacacatctgccacagcccccactacctttcccagcctctaataatcatttttttgctctatgtttatataagttcaattgatttcttctttgattattgggatgcactcaggatggtggcagaagtattaaagggaaatattagggaaagttataggaaatagtcacaaaccttttggaaagctgaaaggttacatagcttgtaataattgaacaggctgaaggcagctggttcttaacttagagcattaggtcatagggtaaatactagggacaacagaggcttccccagttaagtctgtttaccctacctccattaactaacctttgagccagatggtcctctcggtggggaggtcgactagagatattgccccctaatggtatttactttagactggggtatctgagctttaatcattcatagaactgctctcttaaccatgttaattatcctcaagtgtgtttactcaaagcttctgttgttaattctgttctaaataaatgcctggagtgtgagctgctcagggctggctggagtgacaaatctttcttggtgtgcaggtagtcggacactcagctggattggcaaagcagaatatttgtgtgtcagtgtacgttttattcatccatcatttgggtcagggtctgcgagaagacccccgcagctaaggccctcttgtgaggagcaatacctccattggtgccccatgtgaggagccataccacaatttttgacccattgattgttcaagaatatgttgtttaattttcacataattctgaatcttctagttttccttctgctattgatttctagtttcattccattgttataaggaaagatagtttgtatgattatgatcttcttaaatttcttcagacttgttttgtggtcatacatgtgatctatcctggtgtattagttaggggtctctatcggggcagaactaatagactagaagtatatataaaggggaatttattaggagaattgactcacaatatcacaaggtgaagttccataagaggccatctgcaagctgaggagcaaggaagccagcccgagtcccaaaacctcaaaagtagggaagccaacaatgcagactttggtctgtggtagaaggcccagtagcccctggcgaatcactggtgtaagtctaagagtacaaaagtggaagaacttagagtctgatatttgagggcaggaagcatccagcttgggagaaagatggagactggaaaactcagaaaatcaagtccttccaacttctacctgctctattctaaacatagtggcagctgattagatggtgttcacccagattgagggtgggtctgcctctcccagtccactgattcaaatgttaatctcctttggcaacaccctcacagacacacccaggaacaatactttatattcttcaatacagtaaagttgacaataattagcatcacacccgcagaatgtgtagtatattgctgttaggtgaaatattctgagtatttctgttaggtattaggagtatagtatagtatagtatagtatagtatagtatagtatagtatcctctgtttccttattgaccttttgcctagatgttctaaccattaacaaaagtggtattttgaaattgacaactattactgcattgctatttctccattcagttctatcaatgtttgctttatatatttgggtatacataatgttgggtgcatatgtagttattatatcttcctgataaattatcataatataatatccttgtttcttatggcaatttttgacttaaactatattatgtctgatataagtatggctgatcttcttatttggttgccatctgcatggaatatcatttttcataattttagcctgttttcttaaattatggtgaatctctcatagacaacatatagttggatcttttttaaaatccattagtcattcagctactctatcatggttgggggtttaatcatttacatttaaaataattattgctagggaaaggcttactattaccattttggtgttttctgtctgtcgtgtagattcttgtctctttttttctgtcttgtcttcctttgtgtttattgatttttcttttagtagcatacaatgactcctttctcattttctttaatgtattatctaaagattattttatggttacaatggggcttacataagatgtaacaatatgttttaagctgataacaacttaatttcaatttcatacaaaatctactcttttatctctccttcccacactttgtattattgatgtcacaaattacatcttctatattaacattcattaaaatatttttcattataattatgtttctacttttgtcttttaactcctatatcacaattcaaagtggcttatgcaccaccactgcaatgttatcttattctttatttgtctatatgttttccttttccagcaagcttcatacttttatatgtatttgtatttctgcctggtgtccttttgtttcaacttaaaagactttctttagcatttttatataggtggtccagtggtgataaattccctcaggtttggtttatctgggaaagtgtttatctctccgtttttgaaaagcagctttattgcataattgtattcttaattgtcaattttttcatttagcactgtgagtacatctttttcactccctctggcctgcaaagtttctgctgagaaattctctgatggtcttatgagggctcccttttacatgatgagtcatatttctcttgctgctttcagcaagagaaattctctttttctgcataatttgattataatatattttcatggaaactactttaggttcatactagttggagtccatggggctgcttacatttgatatatgcttctttttccagatttagttttcagccattgcttcttcaaataagctttttgtacttttctctctcctctgtctaggactcttataatacatatattggcccacttgatggtattccatagatctcttaactctggactctttttcatttctttttgtttttgctcctatgactgggaatttcaaatgatctgtcttcacgtttacatattccttattctgcttgaccaagtctgctactgaaacactagtacgttttttactttagttattgtgttcttcagctccaaattttcatgattttttttaagttttctacctcatattcttgatattctcattttgtttgtgcattgtttttctgaactgattgagcatctttattatgatcagtttgaattctttgtcaggtaattttttgccagatgaaacagaatcatcttcctcaagcacccatcccatttccatttctttggtgtcagtttctgtagattcatttcttttctttcattgggccatgttttcttttttctttgtgtgtcttgtaaataagtatttgaatacatgcatttgagaaaaaatgccacctctacaaaatctttatgagctaattctgtaaaaggaaggaacttcaccaatcagcctgtctagaggttctaggggcctctcaaactttttcttgggatgcatcttctctgggattttgcatgcaatttcccaattagatttaccaatctgattttttgttttgttttgttccatgagtttcttgtctcttgttcctttggtgtctatatatagtaagacatgttctctggcattgcctcaagctgctgaattcccttttgtcctctgtgatctctaggtatttaaggtatacctgttttgtcagtcctctgagttaggtgagatagaatatcatcactcactcacccctgcccacaaaaatccagaacattggacacgctttccagtcttctctttccctcccaagggaaaagatatatgctgggtgctacatcccaatagtgatgagctacacccatttgtttgcagtattacaaattttctggcacttacataagatattgagctctctttcattctggtaggcccacaggcattcaaagtatgctagttccctgacagcactctgagtcatgacagatagaaatcaatcctttgagcagcaccacaaaaaatacagaacgttagttgtatgttcccatcttctcttttcctcccaagggagaaattgtgagctgggcttttcttcccaataataagctatgtgagtgtgggtaaggggttaatgcagttgaaatgaaatgcttttcttatccaaattaatacagttattttgggctttgagcatgtttggtgtgctgcttgtttcttattgatttctgaagttctcacaaaggcatttagactatatagtgttgtcgagtcattgtttctgtggggcaataaggtctcggtcttcttatttcaccgtctttctgatatcctccctgtgcctggctccatttgttaagcatttgtgttttgagatttattcatttattgcatatagcagaaattcttttctacatcactgaattatatgccattgcgcagtttatagatacttgtgccattgataggtacttgggttctttccagtttttggatcttataagtaatgatgatatgaacatttttctgcatgtcttttaatatacttgtatatttatttttgttgggtgtttacctgggaattaaattgctgaatcactgggtggacatatgtttaattttagtaaagaataccaagagtttcccaaagtagtcaaaaaatgtatattaattattacccacattatgtaagttttcttacatacaagccagcatttcattttgttattgttttagtttttcaaaatattttaatatattttcattatttaaaattgatatgcagaggtatgtcattagaactataaagtcatttctctatgacttgatgaccagtgttggtaagcaacttttcatatgcttgttggccatttgattatctttgtttctaaaagaaaatctttaaatctcttggccatttttcttttaagtttctgtttcttctttttaatttattggcattcttcatacattctagatataaatccttggcactttgtttcactgtagatattgaatcatctatatctaacatcataataaaataatttaatgctgggctttaggttctaatggtaaattggatgaacagtagaatcaaacaaagagaagcaagaattcagaaagttcaaagaaaaattagggtgttcttttgtaacagaatatacttcaaaataggtgatagtttcaaatgatgtaaataaattattggctgggtgcagtggctcacacctgtaatcttagcactttgggaagctgaggcaggaggatcacctgaggtcaggagttcgagaccaacctggccagcatggtgaaacccagtctctaccaaaagtataaaaactagccaggcatggtggcacacgcctgtaatctcagctacttgggaggatgaggcaggagaattgcttgaacctgggagtcagaggtaacagtgagccgcgatcatgccactgaactctagactgggcaacagagggagattccatctaaaaaaaaaagttatttctttatataatatgtcttaatttttataaaattaattaaatttggggctaatatttaattggtttttactaaagtttggcttagatcttatttctgtttattaatatcacattctgccctttgagacatgcaaactcagcactttttctgtcttcatgtttcttacttactatactaattataccagtgtaacatgacaataaccaaaagcttttcttatcaattttattaatgtaatcctacactagttatctttgaggctgtttcttttatcagtttaaattcatatcttatgaaagataacacagaattataaactgtgagcatgcaactctgcttttcatgttcaatctctgaaggggttacatggatgatcctgcctttgttgtgctaaataatttcttagaatcaatctttgcatatttcattcatgcaaacatactgagaaaacttctatttaacctcagtttctctggactttgtagaatccaaagtactaaatgatcatttaggagatatctaaataaaatctagataaaattttatttattttatatttatctagataaataaaatttatctagagagagaaatctagataaaatctattaaacgcataggaagtactttaaataatgtttttgctataggagttctttgtaacttcaagatgtacttattaattacaaattaagtagaactaatttggaaaaatggaaataatttatcaggaaaactatgaattttttccagaattttttttctcagagaaggaacatgctaatactatgtttatgaaattattgatgatgttgtagggctgattttcatttatcaagaagtatgatttgtataacatgagactgactattaacataatgggaatataaaggtcaagaagtagctcctttcataactctaaattttcataggcaaaatatgggtatggaagaatgaatgaatgattccttatgccctctagttaatctatatacattatattatgaaacacaactcacagggctgcatctaaatcgtatattggtgcacagaattggagtttggaaattataatatagtaaatttaaaatgtattactttctaatcattatattagaaacaaatataactaggtcactaccacgtttacattgctagattctccaaatatagaaatagaataaaaacgctgctccagatgtatattgtaaatatatcactcctcttataacagtagtaatatctaagatttcactatgtaacagtgatattgcctcacctcttgattatagtttgggctataacttgttcactctttcaataaatgatacattatgaactttgtcgtaggtatagaaaattgttttttcattgcttacaatgtagtatagtttccagaattcaagaacaaatttggaattagcactcttatctatgttgtagtgctcttttaaataaaacaccgttcttccttatgccattaaaaaattaaataaattattcatttactttggctggtgatataaagttttggcaattaattttgatttcttcaatattgaattaccactagctaaacaaaatcattaaatgccataatactcattttgattggttcaatttagcttttaagtttgatggttttaactttggttatatttctttagctttggactgtttatagactttatcttgattaggtagcatatgtgaaattcttaggcttcattctgtggtcactgtgttaggtataaagcaataaaaagtggtgccagagagcatgacacagtttatataaattttagtattgcgttgttttcccttggtgaaatagtgagatatattcttgtggggtagatacatgcacaaatgactgctgtaaataaatgtctagttaactattattgtatattcatatagtgtaccagatcctttacaaggtttactaatttaatccacataataactttttaaacaactactactattctttccattttacagatgaaaaaattgatgtgttgagatattaaataacatgcctcagatcacacacctaataaatattggaaccaatatttaaacttggtttctatgactcagagccaaatttttaaatcacaaaactaataactttatcttttggataacactaaagaaggaatttatttatgaatattaacttccaagacaaataactaatttgagaataactattcacattaaaaaaaatttgcttagcagaaaaatctctttatattactgaatattagtgtttaatatatttacttaatatatacatagaatatatatgtttagtatatataataaatacatatactatatatttattaattgtaaacacacagagacacagttagcatgactacatacctggaagtcagagaaatttggtagactgttagcaactggcagacagactattctgaaataaaaatatataaaatgtatacatgattttaagaaattgtatttaacaattttacattggataatatgagattaggtttaaaaaatacttaaatggaggaagaaagtgagatttcattcttgatgaaaactaggattagcaggtgatgaatcctgccaggaatgggtgctttccttcaaagcaacaggtttccttctggccaaggaggtgtctagaaatgtcttcctggagctatggcctggtgtgggggcctaatgactctggccagtggcctattctgctgtggctgagctggtattcaaaatgcaagactaagtcctccctactcttctctctcctttcctcaagtgggaggaagggcttattttttttgccataagctgtgcagtcttggcttagggctaaggtgatgccagcactaccttagctgccctagctagtatcccggtcacatgcccactaagtcctctggctctgggcccagttcagccttaggacatgcctaggagttgcagactttgtggcctggactgccttttgactatattttaggccccagagcaccttagccaatggtggcgaggcatgcgggaactcaaattctgactgctgagattggtgattcctctctatctaggttttgtttaaatgctcactccataggtggatgtcagctgattttggtctgctttttctttctactataacagggcagcagtgagtttaatgcctcacaattgctgcattttttctctccccagagcacaggaatgctctctgtatcatgtggctactgcctggggattgtagaagagtggtgtcagcagctcaagactctatttttttttcacctcttcagtgcctcttttatgaatacaaagttaactccaggtaccatgaatgctcatctgatttttggtttttatgaaggtttttttgtgtgtgcgtatgtagatatttgttaaattggtgttcttgctggggggacaattggtgtagccctctactctgttatcttgcatttccctctctatctggaatcatagtttattttcaaagttttcttgattctttattagtcattctgtatatatgaaactctgataatccatgagccaaataaagggaagcatgttaatgcttatattcaagtcattatctcattcaaaattccataatgttgcccatgtaattcaatagttttcagcctgcatagatcgagaggaaaatattgacattaaaaatcatttcaggaaaaaaaccataataatagacattgcttttaacaaaatacatgtcattctactaaaaattctcaaatatatggggacttttaaaactggataaagagaagctagaaagaatgtataaattttcttctataacattcttaattatgaaaaaaattatgatttcccagttagcttaggaataaggaaaggatgactgctctcaagacttctactcaacattgtacttgtacttctaagcagttcaataagcaaggaaaataaataaaaaaacatcaatttttgtgaagaaaaattatattatttgtagatagtgtgatcatttatatattctatgcactttaccaaaaactattaacagtactaaatacatttttagcaatatttcaaggtacaaaattagcacaccagaatcaaatttttaaaacaaataattgaaaattaaaaattgaaattaaatcaacgtttctaaaaggagcatgatttatgtttgtgtgatagatcattcaccaataccccctgcttttttgagaaagggtgtcactctaacacccaggcttgaatgctggagtatagtggtacaattacagctcattgcaacctctgcttcctgggctgaagcaatcctcccacctcagtttcctgagtagctgggactacaggcatgtgctaccacgtctggctaattatttttatattttgtgtagagatgccctttttgcccaggctggtctcaaactcctggacgcaagcgatccacccacatccacctcccaaagtgccaggattacaggtgtgcaccactcctcccagccctctccaatcctttactttgagtctatgagcgtcattatgagtgagatgcatctcttaaagacagcagatggaagggtcttctttgttatccaacttgcaatcctgtaccttttacatgggtcattaggaccatttgcattcaaggttaatatgaatatgtgaggttttgatcatatcgtaaatttgttagcggttgttttgtagtttttaccgtgtagttgatttaaagggtctgtgggctacgtgtttaggtgctatttttgtgatagcaggtattgttctttcattttcatttttaaaactcctataagatcccttgtcaggctggtctagtggtaataaattctcttagtgattgcttatctgaaaaatattttatttctcctttgcttataaatcttaatttggtgaaacatgaaattcttgtttggagtttattttctttgataatgccaaaaatagccccccagtttcttcaggcttgtgaggattctgctgaaaagttcaaggttagcttaaagaggttccctctgtaagtgatctaatgtttttctccagctgcctttaagattttttaatatttaccttagaccagcagtccccaacctttttggcatcagggacagggtttatgaaagacagttttctcacaaactggggagtaggggatggttttgagatgaaactgttccacctcagatcatcagacattagttagattctcataaggaatgcccaatctagatcccttgcatgaaccatttatattagggttcatgctcctatgataatctatctgatctgaaagcaggtggaactcaggtagtaatgctcacctcctgctgttcagcctgattcctaacaggccacaatccagtactggttcacagcatagggattggggtcccctgccttagactgtctgctgccctagtaatgttcattttgtgtagtatcttgtagagtttctctggatttttttgtatctggatgtctatctctctagcaagattaggaaaaaaaatttttgacttattttctcaaatatgttttccaggttgtttgctttttctgcttccctctcacaaatgccaataaattataggttttggtgctttacataatctcatatttcctggaaaatatgtttttaaattcctttttcttcattcttccctgactgggttggttcgggaggcttatcttcaagctctgaaattgtttcttcagattggtctaatttattgataaaggtttcagttgtatttgaaattccttaagtgagtttttcagttctagtagctctgattgatttttttaaaaaatatacttatctattctctcatttcctagattactttagaagtttctttgtgttgactttcaatcttgtcttggatcttgttgagcttccttgcaatgtatgttttgcattctttatctgtcatttcagagtttccactgtggtttgggaccattgctggagagctagggtgatcttttggtgatgtcaccacattcaaacatttcatggtgacagaattcttatcctggttccttctcatctggagagggctgtgttgggtagggtctttttggctttgtttctatagtcctgtgcacttccctcagtagatttttatatagggctgtgcagtttgacctatatgtcaataggtggtgtttgcaggtaagagccagctgtcactcaaggagatgggtatggaccttatctttgttttctgtgaggtgctttctgttgtttcaggtgaagggctggacaagtgggatgcctggtgtcctgcttgctgtcctgcatgggtggggagagacagctggacagtgctagagcccctagattgtccataaataccccagtggtgagctcaggaaccagccctgatgaaggttcctgggaagagctcctagcgaagcatgctggggtctcttcagaggcagtgaggggagtgtacttgctccttgtcctagatacacaagaatgtgatgcatttccctatcatatgtctcttccagggcttgtgactcctagttccacctccagaccacaatgtggttgaatgtctcttccagggcttgggactcctagttccatctccagaccacaaagtggttgagagccatgggaatgcctactttgcaactctccaggggagtgttttcaggatgcaagcttgatactcagcccaatgcagatagctttaaaactcacctgttctccaatgtggcagtattcttgcttcttgtaaagggggaggggtctctacctttggacccatgtgagtaggtgttggttgtggtggtgttggctggttgactcagtccaacataagtccttgggggaagtgttgaggtgtcaggagaatcggaatgggagtaagtagttcctcagttcttggcacctagatggactactggacagtgtgtatgagtcctgaaggggctggaccagggtcaggctagcccaaagttaaggtgctggcagtgatgggagaggtaagctggtctccgggtcacaggccaaactttcaggcaggggcaggcagaacacttaggtggtgggaggccaagggaatatcacaggactgtgggggtttgatttttttaagggatctgggctacaagtgaaattatcaggtgagggcaggtcagctgtgctgtgagcctttcactggggagggcaggatccctcagctggggcaatggagaccagtgcctactaaacattgagtacacatggacataaagatgagaacaatagacaccggggactgcaagaggggagagggtgggaggaggatgggggtttaaaatctacctatcaggtactatgctcactacttgggtgacaggatcatttttaccccaaactcagtgacacacaatttacccatataacaaacctgcatatgtacttcctaaacttcaaagttgaaaaagtaaaataaacaggcatgaaaacattagaaacatgtagcagtaaacgtaaaagttgtgaaagacatagtcactaaaatgtataaatcgttgcttaataaattaaagatttaaatacttggagatatagcattcatgaattaaaaaactcaatatagttaaaaggacaattctctcaatattgatttattgattcagtgtaattccaataaaaatttctgtggtctttgtaaagatactgacaaacagacttattgcaaagcaatagatagcaacaaagtgggtactatgctaaagacggacaaataaatcagtggaacacaatagtgagttgtgaaatagatccatgcatgggcagtcaatttatttttgataaagtacaaaggcaactttttgaagaaaaaatagccagtaaatggtgctggaagaattggaaatcacatgcaataaacaaataaacttgaatgcatatacatcttaaaatatacaaaaattaactcaaatggattatagatttatgtgtgaaatctaaaacataaactttctagaataatacatagcggaatatctttatgaccttgagtttgataatttttttagataccaaaattatgatccatgaattttttaaaaatggacatataaccttatcaatattaagatattctgctatttgaaagacactaagaaaataaaaacaagtctaagtaattcactagtcaacccataaatcattaaacaagtgcaaaatatttgaacagacacttcacgaaagaagatgcatgaattgcaaataagcacataagagatactcaacaccattagtcatctaaaagcagggtgagatatcactatacacatagttaaattggtaaaattaaaaagacctccacacaagactgtcccacgggtggtttaaatgtaaaaccataatttttatagtttgtctgttttctaaaactttaaatataggttccagtaatcctaatctgaagtatttatgccaagtagtgaaagcatatgtctatacaaagactttttcatgcatattcatagaagccttatttgtaatagccccacactaccaacacagtcaaaatatccatgagtaggtgaatggataggcaaatggtgacacatctatactatggagtgctgttcaatgttaaaaccaaatggttcattattgatacattcaaccgcatagatgaatcacataaataattatggtgagtgaaagtagccagacaagaaagagtgtgtactttatgattccatgtatataaaattttagaatattcaaaccaatcaatagtgggagagagcaggccaatggctgtctggcaatggttatattttggggaagggagggaggatgggattacaaaagagcactttagaatgtgaaagatatgctccttatcttgactgtagtgatgggtcaaggcatacataaatatcaaaacttagcaaactgtaaattaaataatagcagtgatttgtgcatcaagtatacctcaaattttactttagctttatttaatataatccataaatggtatgctgcttataggacttgtatggcatagttttttaaaatatagtatctatatttaattattataggatacagaaatgaataggtacaagtaaaacataagccattaattatctctgttgaacagcataatgaaagagtaggaaaaattaggtaacttgattggcatgatttatagcaattaagaaatagcatgccatttgcagaaaatgtgtatcaagtactaaaatatatatttctatgtgatgctaaacaaatgaagtgtttagtgtattttaactatgcatgttgtttgaggtcaccaactaatatcatcagtagactattagaaaccaatatttcatacaactatgtgatatctgagtatgtattaaataagcctagaaaagtgggctggtatctgggtatctggtagacacttcatgaatatttgttgaatcaatatggactgaaacctttaaaaataatttcaaaatgtattattagttcttaaaatgtgatacttttatcccaattagaattaacattttgcataggctaactattcaaaagctgcatcttgagttatctatagtagattatttcttccttgccaaataatatgatttattgttctctcatccagagctgtctaattttcccttgagtctgaatagagtttggtgatgatatcttgactacctccctgggtaccctatttgattgcctcatagacctcatgactaagaatttcttcatcttatctagcttaagcattctttcttcatgtttcaggccattacttcttgtcttacaatctttaactatcttcggtaattcatcccctcaggaatttaagctacccataaatataaaaagaaaaggacatatctcagtgtctgacagtttgtgaaaattgagacaactatattctagagatagcagtaagtactctagggcatgcagagagagctgtggggaaggaaatatttcctggtttgctaagtgaggcaaggtcactgaacttgtatgtgaatggctccctgaaactattgttcatttaccaaacagataacgttttaatctgtgatcttggctcttatttcatctattttcctctttgaattgtgtccatatgtgttgctgcttttctttaaatgatgataacaaaacaaggaaaagacagtgagaagtgtcaaaaagaatttcttgtcaaaatattatttttttgtgactatttctctatcattcccattttttatttttcaaagaattgttttgtgttgccttatgttgttttgtttgtggatcttagtaaattcaagaggccatactatttcaaacaaatgacccactggaaaatattttagcttgggaaattgtgtgattctctccagagtttctgtgaatgtcaggcatttttgaggcgtttccaaatatgaaagtttaagaatatattgtgttaactgaaatcaacgtatttctcagtataaaatacttgtccctggaaatctgaactttgtaacatttgtaacatttgtaactttgtaacatttgtaatctgaactgttgtaacattcttgtttatcaagtttcattcacttctaagcccctgccacatggtacaaatcaatgcaaatctattgtgttagaaactctgtccaagttcaatcagttccccagcttgtaagacccactttcaaaccatccaacccaggtctgaaatctctataaatactattatctaaaatgatgaatcagcattgcttaacatcatgttattaagcaattgcaaactaaacagcagtgagataccactatgcatcttttaaaatggcaaaaattaaaaaataaattaaaactgtaaatatggaatgttgatgaggatgagaaaccacagagaattctttcacggctgttgagaatgccaaatggttaagacacattggaagacagtttagcagttttttacaaagctaggaatagtcttactataaaatccaggtattttgctcctaggtatttatccaaatgagttaaaaatttattaccacacaaaagctgacatgaatatttaagacatctttatttataatattgcctaaaactgaatcaataaagacttccttcaaaggttagtggagaaacaaatggtggtacttccataaaatgaaatattactcagtaataaaaagtgagcttaaagccatgaaaagatggaggaaccataaatgaaaatttctaagtgaaagaagccagtctgaaaaggctacatacagtatgattctaactatataaaattctggaaaatgtaacactattgtatagagaaagtaaaaaaagaccaatgtttgcccaggcagcagatgttggccttactaggtgaaaaacagggatttttagggcaagcagcaaaactattttgtttgatattgtaacagttaatacctgacattatgcatttctcaaaacccacagagctttacaacacgaagggtgaaaccataaaattttgttaataataatcagtcaatatttgttcattaattatagcaaacgtaccacactaataccagattaataataggggaaactgtgtaggggagaggttcatatcagaactacctgtactatctgctcaatttttttctgcaaattctaaaattattctaaaaataaagttgattaattaaaaaagtacaagtggtcgcatagaatgacaaaattgaagtaactcaatttctgttctttgcctttacaatgatcatttattttaaatgtcctacttgaaagaaaacacatacatacagatctaggtctgggaatgggagtggaggaggagtacttaacttaattatctaatatcttccatgtagaatacaatgttttattaagagataagtactaatgctgtgctactttgaaatatatatgcatacctaaatatgtattacatacatttaatattaatattattaacatctctaatataaattatatagaaatacaatacaatattaaatatataatatacatatctgtacaagtatacaagtacatatatatgcatacatcaactcagcagtaagtacagcaattattttaattagaacttcgatcacagatgcttttgttttttgaaaatgagtattttatcactgaaattatttggaattggtggtggtaattttaaaacagtaacttttagtagggtatttattggttttaaatgactgtcccttcattttggtatacagccattttggttgaatctataatagtctcaaatttttctgacactgaaaaaataataataacaaatgaaggaattaatcaattttagcatttttaaagaatatattaagacagtcggaggaactctggcctagctttccagttttattaactgattggctagtagttaggactaattgatagatttagcagtataaacttcatcactagaggcagctctcagggaatacatgactgtgtaaacagagtacttgattaagttgtagagccccagggaacagcctggactctggttatgtaaatataacagatggctaagcaaatgccgtgctgtactaagagtaggtttattgtagttatctaggtttatatagaagatttaagagggagacgatccaacttttccaagccaaaccaggtattgactatatcatactgtcatggaaattatttgagaatgggttggaagtttttcaagtcaacatcctctagagaacagtacactgtttaactgcttatgattgttttgttatatttttaaaagcaattttccttgaagaaaattgtgagataatggcccagatcctgtcatttgataagggttatgccactttgtagaagacagaattggtgagtaattctcattgcaaaaacagcttatgaatgaatactttttgaagttcacatactatatatgctcttatttaatcttatttaatcttcatctcaatgtttaaattaggtgcaggtacttctcacttaaactgaagaaactaagttgaggatagaaaagaaagaacttatataaggggaaaaaaccttgaggcaatactgtacaataaatatacattggtttgaaatcactagcacacttatacaccaataacagtcaagccaagagtcaaatcaggaatgcagtctcattcacaattgccacacacgaaaataaaatacctaggaatacagctaaccagggaggttaacgaagtctacaaatagaactacaaaacactgctcaaagaaatcagagaggacacaaacaaatggaaaaacatttcatactcatggataggaaaactcaatatcatcaaaatggccatacttcccagagcaatttatagatttaatgctattcctattaaactagtaatgtgattcttcacagaactaggagaaaactattttaaaattcatatggaacccaaaaagagcccaaatagccaaggcaatcctaagcaaaaagaacaaagctttaggcatcacactatctgacttctaactatactacagggctacactaaccaaaagagcatggtgctggagcaaaaacatgcacataagccaatggatcagaatagacaactcagaaataagactacatatgtacaactatcagatttttgacaaagctgacaaaaacaagcaatgggagtaagactccatattcaataaacgatgctggcataactggctagccacattcagaagattgaaactggactccttccttacaccatatacagaaattaactcaagatggattaaagacttaaatgtaaaacccaaaactatcaaaaccctggaagataacctaggcaataccattctggacataggcacaggaaaaaatgtcataaaaaagatgccaaaagcaattacaaagaaagtgaaaatagacaagtgtgatctaattaaattaagattttctgcaaaggaaactatcaacagagtaaacagacaactgacggaatgaaataaaaatcttgcaaactatgcatctgataaagatctaatatttagaatctgtaaggaatgtaaacaatttaattttctgagatagagtcttgctctgttgcccaggctggagtgcagtggtatgatcttggctcactgcaagctccgtctcctgggttcaagcaattctcatgcctcagcctcccaagtagctaagattacaggtgcgtgtcaccacgcctggctaatttttgtatttttagtagagatggggtttgatcatgttggccaggctggtcttgaactcctgatctcaagtgatccacccttctcggtctcccaaagtgctgggattacagacatgagccaccgcgcccaggggaacttaaacaaattgacaagttaaaaaaaaaaaccaaaacaaaacattaaaacgtgggcaaaggacatgaacagatacttttcaaaagaagacatacatgcagtcaacaatcgtgtaaaaaagctcaacatcactggtcattagagaaatacaaatcaaaacagagtaccacatgttctcccttataagtgggagctggaaggtgagaacagatgagggaaatcagtgtgccccaggacagagggtgggaagagggagaggatcaggaaaaataaccaatgggtgtcaggcttaatgcctgggtgaagaaattgtctgtacaacaaaccccatgaaacaagtttacctatataacaaacctgcacatgtacccctcaacttaaaataaaagttaaattaaagaaaagatatattggaggagtcatgataaagaccagagcttggtgcccaggtgaatgtccttacagagtctaaataccatccaatagacagaatagaagtcttaaaaattcagaattgtcctactgcagcttatagttgccaatcactacttatgtaggtaatgtttaattagaatcagtattatcctgggaaaataaactatatgtcttagtatcattcactctaaggtacaattgagcacttactatgggcagaaaatggtttctggccacttgaatcacgtagtctaatgcagtattctgcaaatttacctgatgacaaagtataccaagtgcccttgttaaaaatagagattgctaaattttctcctggagagtataattcagattgttggaaaagacacaggaaatcacatttttaataagcacctcatgtgacagttttcaggcatgtgtgaaaatcttggtctaccagatttctaaataacatataatgaggacccaaagcataattactttagctagagtaattgtgtcttcaaaaattattggaaagaaagcaaattaaaaggacaccattgtttcttgttaagattttctgtcattttgctatctataaatgattctattgttgacttttaaataatcaatttaagattttgaaaactgtagcattctcctaatctacaaataaattcctgctgaaactattgccatctgctgcttacatttaagaacatagccaaaggcccagaatattacccaagactatgcctaaaagggtattggacctagggcctcctcataaaaagtttctactactgccaagtcacaccatttatcttcttggatacatatgcaggggagagtgggatagttctgctttacaatgatggtagtggtagtaaaattggggtggcagacagatgtatatgtgcaaataagtatgggtatatactcacacatgtatgtgtgtgtatatatatatatatatttgggacaatttgtttttaattgtagctgcatggtcatccaaaatataattttttattaagaaattgataagtaatcattattattattatcattattattattattatgccacacaggaaacttgagtttgctgatgtttttctccttttacaaaagaaagggttgggggaaccatattgctaactttaactgttgtctagttgccagatatatctctaacagtcattcaatgtcttatatggaggaaatgacctaaggcaatatatcacttacaattttatactgcattagcagcaactaatatagctgtctaaaaataattattttaacagatgagagatattgcctcatacatagtcttataacctagactcatagaaattaggactctgattgtctactgtgaggtttaacactatatttgaagtatgtttagtttctccagtaaaagtattctaagcaaggtctttatttaatatactattccaaaatatgttctaacacttctatttaatagaaaatcagcaaatgtattatttttaggtaaaataatgcatcagtaaaataagtcaatgtcaaaaattttgctttattattatgcaaagtaacagagtacaaagaaaacaagttttctactcataacaaagaagatacacaggtaaaatttaccaaacagaaatccaacaatctaaataaaacaaaatttaaactcaaaattttgttcttaaaaagagttagaactaaattcataaactataatttccttaggtttcaatagagtactgttaagactcaataaatcttttaaaagacaaggaatctattttttaccagactttcttagccgttggctttgtcagcaacagtgtttgcagccattaaaacagtgaatcgccaagagaataagtttagaagaagagtaaatcattatgtaataccatatatatagttgagataactggggagaagttgaaggcaaacataaaaacaggtaaaaagaagaaaaagactaatatataggatcagtgatcaggaaacatttttgaacacctgaatcacactgactggctctatctttttcttccctcttcttccaaaagtacaagaaaaataatgatttgagtttccaacggatctttctatagtttggaaagtatgttgccttgattacaatgtgaaattacaattaagaatatttggcttgctgaaaacctattgtgggtttctggaggaggcatcatttttttcgcctacttttctatgttgctaaataggtttttactgcagggatcattgcagaaagcctggaaacaccagaatctctaacatgctgaaagcattgtgttgatcatgtaagaatctggaaaaataattttttcttggtttgcagttattttttacagtgtaggcttaaatccatttgagctggctaaatatactggaaaatgaataactctttgatgttgtggttaaaatttttggaagaaaatgcctaaacagaacctataaaaattcagaaaaatggaaatttcaaactggctatttattcatattaaattaactaaaagcagcagcattttgaaataaatattcgtatcttttccaagtaactaaaagaaagctgaccatgtatacagttctggtccctaatcccatctttaagggtcatcaaaaatgttgtcacaaatatctgaatgctattctctagactatttttattttggactttaagtttgtagaattagatcacatagttcttcattaattacacaatgtcatcggaatccatgtgtagcaatcactgcaggcaccccacttatatccctcaacacctaccattgtagtttttgtaaatggcttgcctctgaaagcatcagttactctctgcatgatggtattctctagctacaggagcatgtaactaagacagttggtactggatgtaaggcttcaggaagtagatgggatggaattctagaattgtatcaatcatcagccatattcaacaaggatagttttcctgaggattactggggtgataacaacccttgggagctgcagcttcttaattactaagacttactaagacttccatttgtgttcgatttggataggatgctgatggaagggaatgcactgtattactcaagtagctctagctgttgaaaaaaatatggaggcaattatatttagaaggattgagtataaactggctattgttagctgctatagtagaagaaaaatgtaggctcagatgagtcaaatatcaattcaggggacagcataaaagccagaagttctttatgaaaggatttaaaaagaatttgtagtagaagggtagactctactgaaactcaggctgaagatttgattgtaatagtagcagacttacaaaagaaactacaatcacggccccagatttacaagcccaggtcctgtgggaaataatagtatcctgagaccagaatggatattagagtgcaaacacttgacaatattgagcgtccaggtccctctataaggaatctggtctaggaaaataggtcttacttttgcaagaaaatagcacatgcttgatctcctcaatgtctgccagctcccccacttcctgcttcaagacaaatagctaagttcagttatcaacatggtcttgctaagagaagaaataaattactcacaaaaagatctgcagattctgactaatatgtacccacaggatagcacatatggcaatggttattgaggggactggaacaaagatgcagaatacattactgcatagggaaaagtttagtgatatagaggtactgttgtgactgagtgtacatttacagcaaggattcctggagctgtcctaatacactggaagattgatctacaaaaactggaaacagtaatttacaggaaattgagacactgtaactgtctaggtagcatattgagaaacaggtcaaataattcctaggatagggaatgctcaaatagatcagttaagtaagaccaaagaatgtatcagctgattatgatctttgggggaatctaagagacacacctttcactaaattaataagaaatgttctaatgtggggttctagcatctctgagacattcaggattgactgtcttttagagagcaatgttgatattaagaggtatcactatcatattgagttctgtaccgtcactcacagataataggattctgaaataacagaggccatgtggtaacatttaaccatcacaagtaaggttcatgtaataactgtgtgggcagcaatgatgtaatagcaagaaggtgatcttgatcctcagggatttgaggcaatggctaacacaccatgctgttcctagggataacatatatgaattatcaatgaaagtattgtattacttggcttatatagctaaaaataatcaaaagcatttgagcagaagactggtggcagtcagaaaatcactgtccctaagagagttttcaggcctgagcatggcctcagatccagagccctataatagaagaggaggtaaaagccatggcgagtatataaaacagctggtccctaaactaccagattaggaaaaggagaatactcagatcatttaaaagacattggatatgtatgggttgcatgctgacactgaaaccaggagacacaagacaccatcatgacctcaggtaagaggtgaggtgataaatggagttctggcaaaagtccatcttaccctggatccaatgggtccgtggaaacactccgcagtcatttcccagtttcttgagtgaataattataatggaaataattaatagctggcattatcaagtcagttcccaaacctgtgtatttatagacattgtgataggaaagaacaatcagaggtgtgtgaaaatgcctgcccatgcaacccccagccaagattgtaaataacatgcaatatagcatcctgggtagaatggcagaaattagtaccactttcaagactccaataatacaaagttagttatcttcatcatatccccatttaattaatcagactaagaaaaaatcagatgtttctgtacacctattctataaatttaaacaagtggtaaccttaattgccactataaagctggacatggtttctttatttgaataatcaatgtagcacctagttcttgatatgaatctacttagtacatgctttttattttcaattgatattagaaagagaaccaaatgctgtttgaatattcctaagaagaacaagagtatacagcaatagctatgttaataaatctattagcctatgaagtaaaagtggtctcctttactatcattactgtgtaacatttgggaaagttgtgttttccatctgtaaaacttaggttttttaatgattcaaattcctggtttccagtgatgggagcagtacttcttccaggtaacataaaaagggttctaaacctaaaaccgtaactcagggctggtcaatttgagctcttcataaggtagattggtaagaaaagaaaagatttactgtactggcatgattaactgactatggtgaaaggatagagtggttgctacatgatggaaacagggaagagtctgatgtaaactcaggaaattaattggggcccgcccctctttatgcttccatccctggtgatgggaatacaaatgggtaattatagtaatcaaccagagaggggcacagtatccagagggctcagacacctcaaggatggattatttcattagatgatgaacgtaaactagcacaaatgctgtccaaagatgagtggactccagaatgcatgatagagaacagagaatatagctatggattataaactcagaaacaagcgcaatagtgatgaatccagcttgtcctattcactggactccaaaatgcatgatagagaacagagtgtttatctatcaattataacctcagaaacaagtgcaacagtgatgaatccagctgtccaaattcaaaatttggaaattttgactaatcacaaccttgaaaaatcagggagaaatgaaggaatttaatgtgtagcacatgtgtatttgagagatgcaagaagtgaaccatagcagatgttactgctatctgactcatatctctccaatattcaatgctcactgttccttggaagctgattgtttctcacatcaaggccttataactctttacctgagggatttctctagacacatgaggaagatttgctacatgtggtgcagctcaaattttgaagtaaatgatatcaaatgcaatcctctgccaatattggctatacacacatttggacagtttggaacaattttgggatgtgttatactccatgaaatagacagtaggactaacatacagctttccatagaggtaatctattcatgaatataccagttttagctaatttttcttccctatcctactgtcccattcccatgctggtgcttcttgggattacctcctaaataacaatgtcttttcaaatcttacactcgaggtctattttggggagaactcaacttaagaatccatttgtaccctattttatttttattctatcaatataattaacatccgtaagcacaccacccagaaactccagcctggtaaaatcttagaataacctctgaaaggtacagctaatgtgacactttggaaatgatgctctacttgaaaaaaaaaacagtgataataactgaaaataacttcttctaccaacgcaaacttttacttctccatgtcagatataatccgaatttggaattaccatttatttaatttaaaaaatgttttaccttatatttaatgcctacctttatattcaaagtattttaaaaggtaccacatagatggactcttcctggtgtcaatactattgttttgagtatttttgtttgtgtttcctagcatacaaatgaaagaattttattgaatatatgcctgggaatcaatgtcagttaagagtgaatttgattgttgagccttataagtaagtatttctccaaagtaatgttatcaatttatatttgcaaataggaatttataggagatattgtttatccacatttttgagaaaacttaatgctgtcatactccttaattgtggccaatcaatggtgttaaagatggtttcttaaccatggtattaatttgtattttcttgattttttaataagtaagagtatctgttaatacattaatatgtcatgtgtatctgttctataaaagtggaagacaatatatattatttaccaattttcccattgtgttatcatttctttgtatatttgcatgagttatttatatattattaataccaattatttgtagattatttcaaacatattttcccagtttgtagattcattttcatttactacaatttatattttgaagaagagctattgttatttactagctttaacattattattaaattttattttaataaactcaagtagaaaatattaggtttttaaaaaaaaattcctacgatgccccagtaaacagaacagtgttgtttattaggcattttactaatttgtttcacgtttaaacatagatattttagtccttcatctatttatatttaaatcttatgtgtaatataatgtggcattccaattttattttcttccatctctacaaatattttcacctttattttaaatagtttgttttataccaagtcatgtcacctgcaccacacattttagttcaacatacgtgaaggtctttatctggtcaatgcattctattgctctggtcattttttatatatccatatcagtactatactattattattattattattacaaaatacatattgatatttggcaaaaatctctaaccttattcttattcaaaaggatagttattgctatactcttttatataagattcataattagcttgcaaatttccacagaaaatattttggcatacttatttaaattgaaggcatttctaaataaatgaagaataagagaagaaaacaaagtgagatttaaaacacttagaactaaaagagtatgaaaccatgatacatcaactcttgtgggatgcaactaaagcagatatatttagaaaagagaagctgagatattaataaaatcagtggctaatatgagatgttagttgaagaaaatgttgtagaaagagaagataataaaaatgtaattgcaaatcaataaaacatataaataagataaataaagccaaaagcttttgtttctaaaatgttaaaaaactgaaaatttacttgaaatattggtcaaaaatgaaagtaaaaatggagaaaagtattatgattaagagttatatgagacaagttaaaaacacaaaataataaaacttgatgacaagaaaactagcaaaccttttttgcttatatttctaaattatttactagaatgtaagttaaagaaacaaagatctcaaacaattatagataggagtggataataaatctttttttctgttccccaaatttaaatgttgacaaatgctttatgagcattgatagagttgatcataagacttttcttatatatgtatcgatataataaactttggaataacttttctaaaattgaaccatctttgcattcccagagtaaactcatgttggaaatggtgtatgtttcaattcattgtttaattattttgcaaatgttttatttaagatctttgcatcaacattaataaagctatgcttgactgtagtgttttttttttcttgaattctttcaagcttgccatcagtggaatattccccagtgtccgttactggctacacctgtttgcagcatagcctgaactgccctgctggagcactttcgcccacaactctcccactgccccaccagaatgctgttgccagtggccactgccagagttctttcactggcagcccccaccatcctgccagagcacttttgcggacaggcccctgccagagcactttggcccgcagccttccaaagaccctgttggagtgtattcacctgccccatggagcactcttgccagtgtctcctgatggagcactatttccagcagacagaaagcacctcagcccttgtccttcagcacagccagtgctcaatcttgaggggtcagagaacaaagctgtgggcccactactaagccctagtgttagagtacacagcccaggagtaccgagctgagcctcagccccctgtaagcatccagaaatgaagccaattaagtaaacataaattatactccagtcaaatcctcaagggcaataaagaacataaaatctaaaagccccatccaaaggacagcaacttccaaaaaattgaggaggagggacttaaaactatactataaggctacaagtaaccaaaacaccatggtcttggtacacacacaccaatgtaacaggatggagaacacagacataatgctgcatacctacaaccacttgatttttgacaaagttaacagaaaacaagcaatagaaataaggactccatatttaaaatatgatactgtgacaactggatggccatatgcagaagaatgaaactagacccctatatttcactgtatatcaaaattaactcaagatgggttaaagatttaatgtaaaacttcaaactaaaaaatgccagaagaaaatctaccatatgcccttcttgacagcggccttggtgaagaatttctggctaaatttccaaaagcaaaatgctataaaaacaaaaatcgacaagtgaaacctaactaaagagcttctgcacagccagataaactatcaacagaataaacagatgacctacaaagtgggagtacatatttgcacactatgcttctgagagaggttttatatccagagtctacaaggaacttaaacaaagcaacaagcgaaaaccaaataacctcattaaaaaataggaaaagaatatgaacagacacttctcaaaagaaacatgtaagtagccaacaaacataaaaaagatccgtattactaagcatcagagaaatgaaaatctaaactacacagagataccatttcacaccattcagaatagctactattaaaaagtcaaaaaataatagatgctggtgaggctgcagagaaaagggaatgcttatacgctgttggtgggtatgtaagttagtttagacattgtggaaagtagtttggagacttctcaaagaacttttaaaacagctaccatttgacacagcaattctattattgggtatatattcaaaggaaaaaaaaattctcccaaaaagacatgcagtcctatgttcatcatagtgctactcacaatagcaaaaacatggaatcaacctaggcctccatcaactgtggactggataaagaaaatagggtacatatataccatggaatcctattcagtcataaaaataaagaaatcatgtcctttgcagcaacatggatggagatggaggccattttcctaagagatttaatgcaggagcataaaaccaaacactgaatgttcttacttttaagttgaagctaaatgcccagtacatatggacataaagaagaaaacagtagacacaggtgactactagagtcagagggtagtggggcatgggatgatcccataacccaggtagtgagcacattatccctggacagtttgttatccccaaacctagcatcacataatatgcccatgtaacaaacctgcgcatgtacaccctgaatctaaaataagcttgaaattgcaaaaaaaaaaaaaaaaagtcactgcccccattaccccatttaccgctgagaatcggctgctgtttctaatatgatttttttttttctgaaatagccgtgtagctagctaaagctttttattgatgagatattattaatctttcttgttttattagtattctgaatctagaaataagaaaaaatgtcatcagaaaaaggggcactgagataaaagcctagtattcactacatgtttttacccatttttccaaagttttatttgtagatgtccattgaggtagggagagtgggaactttttgaatttatggttattacatagattgtaaaaattactatctgactgtaagacaatcttgtatcacctcccaaagtatcatgggcttttgggaaactgcgctctaccacttactgtaactttgggtaaattatgtagtgcatcttcattttattgttctcacttaaaatagggatactactaatacaactcaaatatagtaattaagattaagtaagaaaatacttgctagatgcttaatatagatcttgccatatactatgcactcagaaaatgttaattatatatgtaaacatataacatatgtaatatatgatatataaatgttaattagtaatctcatcactattatcatttgtctttttataatgcataggtcataaacctggatccttggctttgacttagctgttgtcagctgacatgggctttcccagtaaatttctaagaggtgttctctgaaagtatttctccaatttagcagagcctcataaaatgaaggtcacttgtatagaaattatttattttacagctaacaaaatggatggtactttctggaattcatactaccgtctttgtaggcatgggatccccatagtaaacaaataaactacccacacatgtacatatacaagctaagaaaagtggacctcccatcccttataattgttctcttttattttcactttagataaatggagatcagattgaaagaaggtacttgaggacaatgagagaaaatctggattattgtatgatgtgcttcactttcagtctgcaaatttgtatagttattatcataaaaacacatgctttaaggaaggcaaatgctagattagaaatatcttagatgacatattatattttgtgtatcattttccaacctacaaattgttataattttcttttataactaccttatctactaggtaatctcttctaagaaaacaatggcagtaaaagtattactatatcctacgtatcttctacttgaagtgtactagtgatcagattctagtccacaatattttagctctccagaagtatgacagtcacaatcatgaattttagtacaggttataaagagatacgatgtaaacttctcactcaaaaattgtttcttagcaatatatatctttggtgcaagcacttaaataacactttcccatgccagttgtaaccttctcttgggggttcagggtcaagtactgaaatctgtggtgataaaagcttaattcctattactctgtgaaaggctactgtcatcaattacattttaaacttgctgttaaccctaaataaactgaattgtgcatccagaaagaaatatggttcaatgtcaaatttatttgtttaaccaactcaaactcacaagaacatttttagctttggctatataaaatccagataaggaaaaacactatcaataataggttatagaattacatcacttacatcaaataggaccataaaaatttatatatattatattcaggagtgaagcaattcagactgactacactttagtgctctgaaagtgtgacatatttttcttataactaaaggtaggattcctttttcattctgtcttttgttttgatttggtttggtgttttgtatgatcccatttctaatacaaatttctacatcatcaagggtctcaggattccacagacaacatatgctgttgaaagcactgacaatttagaagccctctccacaccccttgaactcactccaaagactagaagcctagataataaatcactaggagaaaagcagtattttgcagttttggagttgattataaccaagtatttgaacatttttaatacaatttatgtaaattagggccaagttttagagacagttattgacagaagttagttacgacaaattcaattactttctttctggtacttttaacttactcttgttctgatatcatcattactcaaaagccactgtttcttaactccatgattaggacttaaatcaacatgtttccatgatgtcttactgtgttttcttcgttcatcaatattactcacatctatcttacaaaatggaaagaaaagaaaatgccattagaaatggttcatacatataaatagatgctcaaaaaactcaccatatttattttatgaatgttaatattttatagcataaattactaataggctaaaaatttaacatgaattttacaccaccccacctctcactaatcttggggaaacagaggctattcattagatacgtgttctagctgactttcaaaatatttcaatctgtagagaacttttaaagagaagtacatttttctcactaatcaatttgttaatatgaatatctcgatttttggtattaagccagctttttgaaaatgcttttaactaatctatcaagactacactagtacctaaatttgaaatttattatttattgctcaacagctttcatctatttggaaatcagcccacaggaacactccttaaaagaagaaggataatgagtaagtagagacttttttgaatttgtaatttctggcatatcatttgaaagattgattctataaaggctccatgatgccaagatataatattcaaagttagtgaagcacagctgagtatcataacctggaattagctcttaatctgtgtgtcaagttctttgtttttgttttgttacatagcaaatatgcatactgttaaactgatacctgtccactagagtaatgagataactagtatactacttgtggctcaaggtgaaaaatttggtttagtatcaagatggaactcaaaaggagatcttatgatggcaaatactcatgaatatgccgagcaaaagttttattcaaatgctaacaggaagcttagagtagacaaaaaggagaaagtgactaatatagatgcttttataaataacattataatattaacattagatctttgcattattttcatttttcactttttttttaaacggagtctcgctctgtcatccaggcaggagtgtagcggcatgatcttggctcactgcaacctccacctcccggattcaagagagtctcctgcctcagcctcccaagtagctagggctacaggcacacaccactatgcctggctatttttttttttttttttttagtagagttggggtttcaccatgttggtcaggctcatcttgaactcctgacttcaaatgatctgcccacctcagcctcccaaagtgctgggcaatgcattattttcaatagtcctcttttatttagtgttgtgttaaaccaattatcaaaatttggtaattagaggtataacaaaaacatgcaaaaaattgaaaaccattatcctaaagctacaaatgagaaaaaaaatttcccacttgtgtttattgacttccctaaccattaaaataatcataaatatatatttctaagtgtaatctgggcattacacaggagtaataatttagcatactaactatataaggcagtttggaggttgtatagttttacttatttatatgctacaaaatgaaacaaaatatatttcaaaaatatgtgtcctggttgttctggttatttgtatctttactaaaaaccaaactttgaggccgggtgccgtggctcacgcctgtaatccaagcactttgggaggctcaagcgggcagatcatgagatcaagttcatcctggctaacacggtgaaacctcatctctactaaaaatacaaaaaaattatctgggcgtggtggtgggcgcctatagaccagtcactcaggaggctgaggcaggagaatggtgtgaaccagaaggtagagcttgtagtgagcggagatggcgccactgcactccagcctgggcgacagagtgagactccgtctcaaaaacaaacaaacaaaaaaacaaactttgaaacaatatatatttgaattagtatgtgatattgcttattagttgtatctctgtaacttttctccccatcgcctaaaattcactccataccagttataatcaaattgattttaataaaaaaaattattctctcattgaatatatctttctctatacaaaagaatatgatgtcacaagctggtgagtcagggaaaaattgatgattatagattcttattaggatataaaattgcaataacgggaaaaaatgcaaatcactttctgtcatttcctaatattatagattatttcttaagttttataaaatgtaaatgtcttgaaaaataaagttcagtcagccagaaaacttacacatcgctttctaaagtagatcctgaggccaaggtcttaagcctgctctcaggggcacagacaggcgtatatccccaggtctctatgagcagaactgctctcaaaccactcctgacacatggttggtgatggttgtgttaactaatatcattgtggttatcattaccacgatgtggatccacaatgatattagctaattaatatatatatatatgtgtgtgtgtgtgtgtttacatatatgtgtgtctatatgtgtgtgtgtgtatatatatatgtatatgttgtgcacctctttttattatactttaagttttagggtatatgtgcacaatgtgcaggtttgttacatatgtatatgtgtgccatgttggtgtgctgcacccattaactcgtcatttaacattacgtatatctcctaatgctatccctcccccctcccaccaccccaaaacaggccccggtgtgtgatgttccccttcctgtgtccatgtgttctcattgttcaattcccacctatgagtgagaacatgcagtgtttggttttttgtccttgcaatagtttgctgagaatgatgattttcagcttcatccatgtcattacaaaggacatgaactcatcattttttatggctgcatagtaatccacggtgtatatgtgccacattttcttaatccagtctatcattgttggacatttgggttggttccaagtctttgctattgtgaatagtgctgcaataaacacacgtgtgcatgtgtctttatagcagcatgatttataaacctttgggtatatacccagtaatgggatggctgggtcaaatggtatttctagttctagatccctgaggaatcaccatactgacttccacaatggttgaactagtttacagtccaaccaacagtgtcaaagtgttcctgtttctccacatcctcttcagcatctgttgtttcctgactttttaatgacccccattctaactggtgtgagatggtatctcattgtggttttgatttgcatttctctgatggccagtgatggtgagcattttttcatgtgccttttggctgcataaatgtcttcttttgagaagtgtctgttcatatcctttgcccactttttgatgaggttgttttgttcttgtaaatttgtttgagttcattgtagattctagatattagccctttgtcagatgagtagattgcaaaaattttctcccattctgtaggttgcctgttcactctgatggtagtttcttttgctgtgcagaagctctttagtttaattagatcccatttgtcaattttggctttgttgccattgcttttggtgttttagatatgaagtccttgcccatgcctatgtcctgaatggtaatgcctaggttttcttctagggtttttatggttttaggtctaacattcaagtctttaatccatcttgaagtaatttttgtatgaggtgtaaggaagggatccagtttcagctttccacgtatggctagccagttttcccagcaccatttattaaatagggaatcctttccccatttcttgtttttgtcaggtttgtcaaagatcagatggttgtagatatgtggcattttttctgaggcctctgttctgttccattggtctatatctctgttttggtaccagtaccatgctgttttggttactgtagccttctagtatagtttgaagtcaggtagtgtgatgcctccagcttgttcttttggtttaggattgacttggtaatgcgggctcttttttatgaactttaaagtagttttttccaattctatgaagaaagtcattggtagcttgatggagatggcattgaatctataaattacctcaggcagtatggccattttcacaatattgattcttcctacccatgagcatggaatattcttccatttgtttgtatcctcttttatttcattgagcagtgttttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgtttatcagcttaaggagattttgggcagagatgatggggttttctagatatacaatcatgtcatctgcaaacagggacaatttgacttcctcttttcctaactgaataccctttatttccttgtcctacctgattgtcctggccaggacttccaatgctatgttgaataggagtagtgagagagggcatccctgtcttgtgccagttttcaaagggaatgcttccagttttcgtccattcagtatgttattggctgtgggtttgtcatagatagctcttattattttgagataagtcccatcaacacctaatttattgagagtttttagcatgaacagttgttgaattttgacaaaggccttttctgcctctattgagataatcatgtggtttttgtcattggttctgtttatatgctggattgcatttattgatttgcatatgttgaaccagccttgcatcccagggatgaagcccacttgatcatggtggataagctttttgatgtgctgctggattcagtttgccagtattttattgaggatttttgcatcaatgttcatcagggatattggtctaaaattccctttttttgttatgtctctgccagactttggtatcaggatgatgctggcctcataaaatgagttagggaggattccctctttttctattgattggaatagtttcagaagcaatggtaccagctcctccttgtacctctggtagaattcggctgtgaatccatctggtcctggactttttttggttggtaagctattaattattgcctcaatttcagagccgttattggtctattcagagattcaacttcctcctgatttagtcttgggagggtgtatgtgtcgaggaatttatccatttcttctagattttcaagtttatttgcgtagaggtgtttatagtattctctgatggtagtttgtatttctgtgggattggtggtgatatcccctttctcattttttattgcgtctgtttgattcttctctcttttcttctttattagtcttgctagcagtctatcaattttgttgatctttcaaaaaaccagctcctggattcactgattttttgaagggtttttgtgtctctatttccttcagtcctgctctgatcttagttatttcttgccttctgctagcttttgaatgtgttcactcttacttctctagttcttttaattgtgatattagggtgtcaattttagatctttcctgctttctcttgtgggcatttagtgctataaatttccctctacacacggctttgaatgcgtcccagagattctggtatgttgtgtctttgttctcattggtttcaaagaacatctttatttctgccttcattttgttatgtacccagtagtcattcaggagcaggttgttcagtttccatatagttgagtggttttgagtgagtttcttaatcctgagttccagtttgattgcactgtggtctgagagacagtttggtataatttctgttcttttacatttgctgaggagtgctttacttccaactatgtggtcaattttggaataggtgtggtgtggtgctgaaaagaatgtatattctgttgatttggggcggagggttctgtagatgtctattaggtctacttggtgcagagctgagttcaattcctggatatccttgttgactttctgtctcgttgatctgtctaatgttgacagtggggtgttaaagtctcccattattattgtgtaggagtctaagtctctttgtaggtctccaaggacttgctttgtgaatctgggtgctcctgtattgggtgcatatatatttaggatagttagctcttcttgttgaaatgatccctttaccattatgtaatggccttctttgtctcttttgatctttgttggtttaaagtctgttttatcagagactaggattgtaacccctgcctttttttgttttccatttgcttggtagatcttcctccatccctttattctgagcctatgtgtgtctctgcatgtgagatgggtttcctgaatacagcacactgatgggtcttgattatttatccaatttgccagtctgtgtcttttaattggagaacttagcccatttacatttaaggttaatatggttatatgtgaatttgatcctgtcattatgatgttagctggttattttgcatgttagttgatgcagttccttcctatccttgaaggtctttacaatttggcatgtttttgcagtggctggtactggttgttcctttccatgtttagtgcttccttcaggagctcttttagggtaggcctggtggtgacaaaatctctcagcatttgcttgtctgtaaaagattttatttctcttttacttatgaagcttagtttggctggatatgaaattctgggttgaaaaggcttttctttgagaatgttgaatattggcccccactctcttctggcttgtagagtttctgccgagagatcagctgttaatctgatgggcttccctttgtgggtaacccgacctttctctctggctgcccttaacattttttccttcatttcaactttggtgaatctgacaattatgtgtcttggagttgctcttctcgaggagtatctttgtggtgttctctgtatttcctgaatttgaatgttggcctgccttgctagattggggaagttctcctggataacatcctgcagagtgttttccaacttggttccattctccctgtcactttcaggtacaccaatcagaggtagatttggtcttttcacatagtcccatatttcttggaggttttgtttctttttattcttttgtctctaaacttctcgcttcagttcattcatttgatcttccatcattgatatcctttcttccagttgattgaatcggctactgaggcttgtgcattcatcatgtagttctcgtgccatggttttcagctccatcaggtcctttaaggacttctctgcgttggttatcctagttagccatttgtctaatcttttttcaaggtttttaacttgtttgccatgggtttgaacttcctcctttagctcggagtagtttgattgtctgaagccttcttctctcaactcgtcaaagtcattctctgtccagctttgtttcattgctggtgaggagctgcattcctttggagcaggagaggcactctgatttttagaattgacagtttttctgctctgtttttttccccatctttgtggttttatctacctttggtctttgatgatggtgatgtacagatggggttttggtgtggatgtcctttctgtttgttagttttccttctaacagtcaggaccctcagctgcaggtctgttggagtttgctggaggtccactccagaccctgtttgcctgggtatcagcagcggaggctgcagaacagcagatattggtgaacggcaaatgttgctgcctgatcattcctctggaagttttgtctcagaggagtacccggctgtgtgaggtgtcattctgcccctactggggggtgcctcccagttaggctactcaggggtcagggacccacttgaggaggcagtctgtcagttctcagatctcaagctgtatgctggtagaaccactactctcttcaaagctgtcagacagagacatttaagtctgcagaggtttctgctgccttttgtttggctatgccctgcccccagaggtggagtctgcagaggcaggcaggcctccttgagctttggtgggctccacccagtttgagcttcccagccactttgtttacctactcaagccttggcaatggcgggtgccctgccctcaacctggctgctgccttgcagtttgatctcagactgctgtgctagcaatgagcgaggctccttgggcgtaggaccctctgagccaggcatgggatttaatctcctggtgtgccgtttgctaagagctttggaaaagcgcagtattagggtgggagtgacccgattttgccatctgttacccctttccttggctaggaaagggaattccatgaccccttgcgcttcccaggtgaggcattgcctcgccctgcttcagctcatgctcggtgcacgcacccactgtcctgcacccactgtccgacaatccccagtgagatgaacctgttacctcagttggaaatggagaaattagtcatcttctgcgttgctcacgctgggagctgtagcctggagctgttcctattcggccatcttggctccaccccctatgttgtgcaccttgaacaaagtccatctttgtcaattaaatacttaaaaatttgaaaatagagaaaaagagccctgtctccatatttggtctacatatttccttattacaaatagtgcaacatatatccacaagagatttggtactctatgaattctgttgatgataatttttattataacaggaattatcatggttattgataccattttatatgcatatttcctcttagaaattcaaaactgattaaaaattttggaatggtttaaagttgcttgattgcttgctaaccactgaaaatcacaaattattattttttaaattgtgtttatttatttatttatttgagatagagtctcactctgtagcccaggctggagtgcagtggtataatcacaactcactgcaacttccacttccctagttcaagtgattctcatgccttagtctcccaagtagctgggattacaaatgtgcgccactacgcttggctaattttttttattttcaatagagatggggtttcaccatgttggccaagctggtttcaaactcctgacctcaggtgatccacctgcctcagcctcccaaaattctaggattacaggcataagctgccatgcccagcccacaaattattttgaacagaacatacacagaaagcagtgcaaaattctaagtttggacttaggtagagtatatcttttagtactattttttctaatacaaatatcttaagatatatgtcatcaatgcattaggatggattttaccttttttaaaattcaaacttattttctattttgttgtctattaatggaatttttgtggtaagaaactgtatcttagaagtgacataataattaatatttgcatatagctctaagtgtttcagaagacatttatatttgtctgttgatagtttcataaatcttaaaaatctgggtttaattttatctaattatttagaggagaaaactgaaataatagaaaagtaaagtaaaacagaggaagactggtaaaattaggggttgtggcctgcccgggagtgcactgctcagatcttccttctgtgaggagacttgctgtgaggactgtagtgagccgacagcctccacctcctctgccttctggatttgctgcagtgctcatgccaaggccatgctgtccttccctggatggctttcagctactgactgagcatggtgggcttcctagagctaagccttccctgcccatcttgagactcttgtgataggtcatctagatcctgggactgcctattgttctggctgagacattctcagagctgcgctgcagtctgaggcacttcttattcaatgttcctgccttctctgctttaacaaatgtcagaccattattgcagtgtggggctctctctatctagttctgttctaacctacacaggaatattcccgaataaatgtcttgcagtcttgtgctggtgtctgctacatgcaggacctgagatgatgcagtggcttaattacattcatagatattagagataggtttccactggtggaattagaggcaattgagaaatgttgtctggctaaaatattaaatgcttttcctattgtataaatagagtataagagtttttgctgcaaagaaagataaagaagcttgttgcagaccaaccaaattacagggaacagctagaaaagataggcaaaatttgaattaaaaatttgaagattttaatcatcaaggacttttaggcaagcagcagagataaaacaagaacaaagagttaaacccaatattctgactattttccattagaggcatttcagttttttaaccagagggacaataaactaaaggtttggttcactacaaaatttcatcagtacaatagtcttctgtagatgtacaaaaatgggtactctcataatgttctgtggcatatatttgggaaaaattacttgaatttatttttcctttccaatttgtattttaagtccaggaggtacacatgcaggtttgttacatgggtaaattgcatgttgtagggatttgatgtacagataattttgtgttctctgaaacattattttgtgttctctggttctgtacaccagaaattttacttagtgatatgtaataaaaacaaatatttcaaatggttgcttctaaatttatatatttgaatatatagctttaataatgcaaatttagctataatattatcaactaattatggaatgggacttaattatactaaacacttctgttgttattcaatttggaaacagaatcttctggaatcttctgaaaatctgattctagtttggataaaaatgtcgtaccttgccacataggtatattatgtggataggttttattcattctttactaaagcaatgggtgaaaaatctctagaatgcctatacattattttcctactaaaacaattgtattataatattatttgataatggatggttgcttaagaatgcaccaatccaattgcagtggaacagaaggtatgtggtgttttccagttttaaaatgtcataaaatattcattatgtatttcttgcaattatccagtcagtattaatatttccattacacaaatgatgcataaagaattcaaataacttgaataaattgaaaagtctgaatcattaaacaaaaaggagtgattgtgttatttatttggtctatgatgtaccattctcagatttactgtttattgaaaatagtagtggtgttgggctggggcaaaacttttcctaatataaaaagtatttatgacattattaattaattgtctaaaagtcatctggatacatgctccatttcattctgaaactattttttaatgtttgcaggattttcagaaatcatagcttagttctagctacatatcatgtctcatcagctggctgtcatttcctagcctgttggcattgatattttggattggtttgtacttcaaatcacttaggcacttaatagcttataaatgtttacactgagaccaaaatgtagatgaagacaatttttgaaggaaaacatcagtttgtatgctagccctggacaatacccagtaacactggcttcatttttcattattagtttcactctctgtctagtaaaatcacgatctcattcagcttcactttttataacagtctagtgacttgaaaaaaaaaaactttgatatcatacatctttgtgggagaaatcaaaattaattaaggcataaaatttcttatagattgctacaatttagtcacttcctgctgtatctatgccctcacagagttcccctccatactgattctgagcatagaatccatgtctcttgctttggtaattggaaagtagtaaatgtgaaaaaagcagaggcttaaaaagtgcttatgcattgagattcgtcccttcttgatgccactgaaatattcttccccagggtagctgtcacctgatgaaagacaatgatcatatcactcccatcactccaaataatatgtacctccaattgccagacgtaagacgtaagaatgaggccatcctagataaaccagctgcagattacgtggcagctgactgcagatgcataggtacactccgttgagatcagcagagcatggcttacatcagcagaactgtgtatcaacacagagaaacatggaaaatagtaaatgatgtttgttttaagaaactggattttaaagtgttttattaatgcagctaaagataactgatgaattcagtttgtgtggtcagccataaaaatgtttcactcattgggtctattttcaaaggtccaaagcaaatatttactagcaaatattttgaatagtggagtccagggaacatttttttggtaagaaaatataatggaactccatttatagttttttgctcagaattatggaagtggggaggaaattttgaaatgatatattcaatggtcaatgtaataaaataaatgcatacactaatgatgcttcatattcaaatcaaaagtgtttatatgcacttctgcattccttcacccaataaaatgtcttaattttgctgaaatttgtaagtaatttaaaaatctttcttctacttctatgacaatttcatttcataatgaacacttctgaaaatagaatttgatagaggaagaaataatttcatttttattagtcagataacatgtaattgttagtacatttcccatccatcagagttttcactacttcttcctgagtctgagagaaggggaattatctattcacagaaaaatttgaatgtggtttattgacaggaattcacttcacttttaaaattacttatgtgataaatttgtcattttttttctaaaggcaaagaaagaaataagaacatatttagtgatgagcacacaattaaatgtggcaatctgattgaatatttgtaggcttaaattgtattttacaaaaaaggggttatagaagatatcaaatagcttatgaatatatgcctttattggtagacagtaacaatattcttatttattaattgctaaattttactaactttaaaaaaaagagtactggtagaactgaaaaagtctaacacagtgaggtaggtagtggatataagctataatataagtaggttccttgtacaagtacacatcctgagaatatgtttcaagtatataacataaaattatcaagccattttttctaaggactgaaataattaaaggttttcactaaaacttttataatgttttcattttcaaatgtttgtcactttctagccaagcaggcaataaatttaggaactaatgcccaaattgaaaaaaaaaaaagtgataaactgataatctgtgaattacttaaaaggtgaaactaaaatattggagtaatttgaccaccagcaaattatcatctctattattctccattttccaaattttgtgaaactcatttacatacttattcaacagaaaaattctatagacaaaattgcacattttccaggctattcttttatatatatttgagattcaattatcaaaacacaatcaccctatatagtcactaaaatggctataggggaaagatatattaatgaatttagaaaccaggtctttcaaaatcatacataatctacaaaataattatgcttgcctttgtgtagcaaataatttattttcaacatataaattttccactgataatataaatacatataaccaaactatattatgtatatgggaaaaaattattatttagaaacttcttataacccaagttatcaactattttacctgtcttaaaaattcatgtggctcattttctgatttgtcctctcaccacatattttctatttattataccatctagcataataatgcaataatttcagttaaagtttatgtcctctctttgactgtgaccttcttgagggtcagacctgtttcttgtttattgttttattcctaatatctgacacagaaacttaaaatcaattgatgttttaaaaatggttctcagagaataagcattttcctgtcagtttttaagaattaaaaaaaaaaaatgctccatttccaccttaaatccgtaactcatttcccagaggccaaaggttcccatttccacatgagataattcatttagattaaatttccctgtttaaggtagaaggtggcaatctagctgaaaggatcagatagaggttaaaaaatgaagtaaatggaaattaaaaaatggaaaggtagtccaaattataaaattgagctatagcaccaggatattgtcttatagaaacagaaaactttttttttaatattttgggttttatggacctattgattgcatggcatacatagtaagataagcaggttttcttgtcatttttactgtaacattgttaactaaaacaaaaaatagttcatagaagaaattaatatttttagataaatgatacaatgcaagtaaaatggagtcatgacttaaataactgcagtattactacatctattctaaaatattttcaacacgtagttctcaaaatgttgatattatccatgtaaattatcatgaataattagtgaatattcatgaaacattcattgacataagtttataagtattgattaaaattcaccaattagtgtgcttatggacaatttaacaaatgtgaaaacataaaaggccatattttatgtacatatgtgttgatgtgctctatttgaaaaaatttgtatgagctttaatgctttatctatccaaaataaattcattcctactacgttatgcccataaatcttagtgaataatttggatggaatttatttatgccaaataatatgcaacttaatgaaagaaaatgacatttaggtcatttgcattctgtagaattactcagttaactaaggccatgtattgaaagaggtcttgacggcattggatatctgtttactaaaaagtaaaaagaaccaagaaacattttgtaacctaggtttattttgctttttagactttgctttatttgtgtatttaatgattgcccttacccgctgattacttccccaattgtatgcattactcttccaatcattttctgatttcttgtcatatgctccaaagagcatttagaaccttgctatatttcttactctagtttcacacactagaataaataaaaaccacataagaaatcaccccttttatctttgttcctagtttacatttgataacatatatttaatatccttttggaaatttataagcaggttcatctaatttattattaaataaaacaggtaagcaaatttagtccaattcaatgaataattacggaggatctacactgggtaaactgtatcagattttgagcgtacaaaatgtctctgattttttagagctcctttgataatggggaaaagagatggtatttcttgggaaatatgaagttgaaaacttaaattttagatgatgtgtcgtgtctcaataaattttaggacagtgcttcttcctttagaatagattgagcaaaaatatttcttactgacccgtctttttacatgagtaaagaaggagagaaacactgtactatgatgttgactccagtcaaaatgtcctgaaccatcagtgctgggctgcttaggttagagacaaaagccactatcttttatgaattttgacatgtgcactataatggacacattctatactcatgtcctttcagcaggaaacaattgtttttctgacaaaatatttcaaaaagattcattgtttactttccagagaagactgaagcttgaccttgggctatcagttcccagacagttctgctacaaggctcacaaaataaatgtctctgcaataaccaagttccaaaatctaatggatatctcctgcttttcaagtttccttttaaaaatgaattcaacaacattgaaagcataaggaagcaaaaccaagtgcttattttgtaaagtatctttgctcattataaaaacccaaacagaaaattcacatctcattataaagggacaagtagaacgatgtaacaagaccagtagcattaatgaaattgcatggcatggacatattttttcttctactcaaacttacagttaggaattaattcaccaattacttaacctagttcagagaatccatgcatataattttgtggaaattcaatgtagaacaatttatagaataaaatctcttgtttaaatttttcaactggatgttcaattatatttgtaaatgttctttgcatcagaaatcaatactttaattttatattgattttactttacaaaatcaaccatgtattcttactttaaaaaaaatgatgagtgatatcaagagaaaacacaaaaatggtcaatattcttagttattattctaacatctatttaggcttccatatatttgtttgttaattcaatactgagattattgaaaatttattttttaaaaaacaaaagtgggctgggtgcagtggctcacacctgtaatcccagcactttgggaggctgaggcggaaaaatcgcttgatcccaggagtttgagaccaacctgggcaacataggaagacccccaactctacaaaattaagaaaaaaatgaccacatgcctgtggttacagctacttgaggagctgaggcgagagtatcctttgagctcaggaggttgaggcggcaatgagaggtgatggcgtcattgacctccagcctgggtgacacagagagaccctgtatcaaaaaatagaatagaataaattaaaataaaaataaattaaaaggagatttataaactctgtcatttgccaaatgtatatctaggatgaagtttaaaaagttttccatagaaaaattcatagcataggagaaagttaaggatatgagtaacaatcccagcctatgagaagaagaaagcctttgaagtactgtgtacttgatctgagggagatagctcaagaagagagaaaatagaataaaggcaggagatgagattaggatagtctggattcctcatagttgggacaaacttcaggaaacaggagttgtagagttatcctgttgtatatgaggaatcctgctttctagggcataagaaaagaagttgtgtatgcatagtgccctgtccaacatagtgtttgggaagtgtatttgcaacgtatgttggaggaggcagagaggcttaccttataggaataattggtctggaagagacctggacaagtggaaagacatgctaaaaattctagaggataagtcagagctcttgaacattagcaacaggtgcaattatgatcctaaaaggacaactaaatccatggatatcacacacaatgatcaggccagtggagccataccagttacactccagcaaagaggaacagggacttgaggacagatcacagatctataaacattttcttgggcttcccatacctctttctcatccctcaccaccccacaaaccgggatgagaaactttttatcctagacacagtcataaaggagggaggagaagtcaaactttaaggcagagaagaaaagccctgatatctagggcctttccttaattagtatttacatgattttatatttttgtaatttttatttatttatttatatttcaatagttttgggtgtacaggtggtttttggttacatagataagttctttagtggtgatttctgagatttttggtgcacctgtcacatgagcagtgtacactgtgcccaatatgtaatcttttatccttcatcaccctcccactcttccccagcaagtccccaaagtccattgtacaattattatgccgttggaagcaattaaaattaacttacaagtttaacttacctgttttcctccctgctttgctccatgcaaatacaaatccaaagccaggacaaagtgaggactccagaagtgaactacctaagttactgaatgtaaagttattcactttctacacatctaaatttagtgtgcaaatttcaaacctgtgacaagttttaaagtaaaataaatgaatgctcactatttaaaaatataaacaatttattattattgttttaggaaagaaaagttatagttaacacacaaacactggatatcttctttttgcccctgcagatcagctgtctgttcttctcctccctgctatgtgtccaatatgctgatggtcataaatgcacttttattcttctggctttcactggcttcagaaaatgtggagtaccagcaggacccaggaatcctgcagttctgggatctgtccctatagggtagttgtgggcttgctgtgtctctcaggtgacagtgacagctctgtccaggtccctccatgcagtgctgacttcttcccagaaacagccaatgctaccaatgtcttatgtgtccttctaaagtattttaagtttgcataaatatctgtgtatatggggatttttataataacagttctatattttttcaaaattacatttaatagaatatactttaaaatttatttaccttgtattctatttctgaatagaatacaaaactctgttttgtatatcatacttatttacttatttacttagttaatatatcttataaattattccctgttagttcatgtagagttgcctcagtattttatgctggctgcaatttaacataatatgtaacatggttaggctgtgtcctcacctaaatctcatcttgaattgtagctcccataattcccatgtgttgtgagatggacctggggagagataattgcatcgtgggggtgatttcccccatactattctagtggtagtgaataagtctcacaagatctggtggttttataaggggaaacacctttcacttggctctcattctctctcttgcctgctgccatgtaagatgtgcttttcaccttccaccattacagtgaggcctcccagccatgtggaactgtgagtccatttaacctctttttctttataaattacccactctcagttatgtctttattagcagcgtgagagcaaaccagtactgtatgaatgttctataattctttgaaatatttttcaacacaaattttttcaatggacttgatatggtttggctgtgtccccacccaaatctcatactgaattgtagctcccataatcaccacatatcattggagggacatggtgagagataattgaatcatgggggccagtttttcccatgctgttctcatgacagtgaagaagtctcacaagatctgaaatttgcacaagtaacagggagccaaatgttaattgctaagacaatggggaaaatgtctccaggacatgttagaggtcttcatggcagcctctctcatcacaagccaggaagcctaagaggaaaaaatagttttataaagggctgttctcctgcaaatgctctcttgcctgcctccatgtaagatgtgcctttgctcctccttcacctttcaccatgattgtgaggcctccctagccatgtgaacctgtgagcaaactctcttgctttataaattacccagtcacaggtatttactcatagcagtacgaaaactgactaatgcagtaaattggtactggtagaatggggtactgctattaagataataaacatgtgcaagcaactttagaactgggtaacaggcagaggttggaacactttggagggctcagaagaagacaggaagatgtgggaaagtttggagctttctagagacttgttgaatggttttgaccaaaaagtccagactgaggctgtctcagatggagatgaagaacttactgggaattggaacaaaggtgatacctgctatgctttagcaaagagactggcagcattttgttcctgccctagaaatccatggaactttgaacttgagacagatggtttatggtatctggcagaagaaatttctaagcagcaaaagattcaagatgtgacttgggtgctcttaaaaacattgttttattcattcacagagatatggtttggatttggaactaacgtttaaacagaaggcagggcataaaagttaggaaaattggcagctttacaatgcaacagaaaagaaaaacccattttctgaggagaagttcaagctagctgcagaaatttgcataagtaatgacatgccaaatgttaattgccaagacaataaggacaatgtctccagggcatgacagaggtcttcacagcagcccgtcccatcacaaaccaggaaacctaggaggaaaaaattgattttgtgggccaggcccaggaccttgctgcattgtgcagtcataggactaggtgccctgcgtcacaaccatggctaaaaggggtcaacctacagctcaggctgttgcttcagagggtggtagccccaagccttgatggctttcatgtggtgttgggcctttggatacacagaagtcaagaattagaggcagagcttgcagtgagccaagattgcaccactgcacctgggcgacagagcgagactccatctcaaaaaaaaaaaaaaaaaaaaaaaaagaattaaggttaaggaacctctgtctagatttgagaggatgtatggaaacacttggctgtccagatagcggtgtgctgcagggggcggagccctcatggagaacttctgctagggcagtgcagcagggaaatgtgaagtgggagaccccacactcagtttccacaggggcactgcctagtggagccatgagaagagggccatggtcctccagactctagaatggtagaaccaccagcagcttgcacagtacacctggaaaagctgcaggcactcaatgccagcctataaaagcagccaggaggggggatgtaccttgcaaagccacaggggtggagctgacgaagaccatgggagcccccctcttccatcagtgtgtcctggatgtgagacatggagtcaaagaagatcattttggagctttaagattttactgcccagctagattttagacttgcataggcctgtagctccttcattttggccaatttttaccatttggaacaggtgtatttacctgacgcctgtaaccccattgtgtataggaagtaactaacttgcttttgattttacaggttcataggcagaagagacttaccttgtctctgaagagagtttggactatggacttttgagctaatgctgaaaagagttaatactctgaggaactgttgggaaggtatgattggttttgaaatgtgaaaacatgagatttgagaggggccaggtgtggaacaatgtggtttgcctgtgtccccacccaaatctcattctgaattgtaactcccataatccccaagtgtcatgggagggacccagtgaaaggtgattgaatcatgggggcgtttttcccatgctgttctcgtgatagtgaataagtctcatgaaatctgatggttttataatgggcagtttccctgcacatgctctcttgcctgccgccatataagatgtgcctttgctcttccttcaccttccagcatgattgtgaggcctcccgagccatgtggaactgtgaggcctcccgagccgtgtggaactgtgaggcctcccgagccgtgtggaactgtgaggcctcccgagccatgtggaactgtgagtccattaaatctttttttctttataaatcacccagtctcaggtatttgttcatagcagtgtgaaaatggactgatacaggacttttagttttttctaacatttttctgttataataatcttattaatatttttgccttatattattcctcatgtctaaccatgtacagggaatattattattaattgaatttttgataagtaggatcaaatttccttcatagagattgtaacactttatgctctacccaacaatatatgagaccatgtttcttaactcccttctcttctacaaagttactacattcttgattttcctaacttataaaattgtttttttctaaataaggtcgatgacttttcacacttttaacaacaatttgtatttgtttctctatgttctttctatgtatatccatgcccaattcttgaaatgtgttggtcttttaatcatttgaaagtgctctttatataacgtggagattaatgttttactgtaaaaataggtagcatattttaaaactcagcttgtcatttatatttggacttctccattattttaccattcagaatgatttttaaatatgctattgaatttattattttcttttagactacagagttttgtgtcatcattatcaaaagcactggtgaagagtcagccttgaaaagacctaggaaatgtatcactgtttgtataatgggtttaattgtgtgtccttacaaatagaattttcaatgtatgtcataagaaaagtctgtgacacattaatctacagcaggtttatagatggcaaatgataaaataagaattcttattccatagtagagatggagtaaaattcttcatttccagcaaagtacaagaagttgccaatacagtgctccaaaaaccacatttagagtaacaaggctgaagagtatgtccttaggagtacaaatgctaggacctgaggtagccacaactttatttcattagaaaaagacaaatagaattccaaataaatgtaccaattcacattaccaagaaatgcagaaatgttcaaattacttacctattgttaactgctttgttgtttcatgttgtaagtgtgtgaaatggcataatttgatgttttaatatgtatttatcatgattattaatgagtgtgaataaatacatttgttttctctttttctcagtctttcaagttttccttttttaaataaatttaacttttattttagatccagtggtacacgtgcaggtttgttacatgcatatattgtgtgatgctgaagtttgaggtatgagagatcccatcactgaggtggtgagcatagtacccaacaggtaggttttcagcctttttcccctttcccctctagtagtccccagtgtctattgttcctgtctttatgtccatatatacccagtgtttagctcccacttataaatgagaacatgtggtatttggttttccatgcctacattaatttgcttggatgaaaacttccagctgaatccatgttgttgcaaaaggatattctatctttttttgtggcagcatagtattccatgatatatatgtaccacattttttttatttaacccactgtcagtgggaacctacattgactacatgtctttgctatggttaataatgctgcaatgaacatacaagtgtatgtgtctattttatagaataatttattcttcttttcttatataaccagtaatggattgctgggcctaatgatatttcaatttttacttttgagaaatctccagttggtttccacagggggtgaactaatttatgtttccactaacagttacatccccttttctccacagcctcccagcagctgttatatttttcttttaaataatagccagaaatcatatgatcacttcagtaggcacagagaaacatttctataaaatccaacatcctttcatgataaaaaccatcaaccaactagtcattgaagaaagatgctaaaaataataagagctgctaagacaaaaccacagcctacatcatactgaacaggtaaaagctggaggcactccccttaagaatagaaacaagacaaggatgcctacttgcaatactccttttgaacatggtactggaagtcctagccacagcaatcagtcaagagaagaaacaaaaggcattcaaatagaaaaagaagtcaaattatctctgttcactgacagtatgattctatatgtagaagactccccaaagaaaggttcctataaatgataaacaacttcagtaaagtttcaggatacaaaatcaatgtataaaaatctttatcattgctatacaccaataacatccaagctgaaagccaaatcaagaacacaatcccacctacaatagacacaaaaaaaacataaaatacctaggaacacagcttaatgaggaggtgaaagttttctacaaggagaactacaaaacattgctgaaagaaataaaagatgacattaacaaatggaaaaacattccatactcatggatagaaagaatcaatattgtcattaataaaatggccatactgcccaaagcactttataaatttaatgctattcctatcaaactcccaacatttttccacaaaactagaaaaaactattctaagattaatgtggaaccaaaaaagagcctgtatagccaaagcaaatctaagcaaaaaagaacaaagctggaggcattgtaacacccaacttcaaactatactactattctacaaggctacagtaaccaaaatagcatggtactggtacaaaaactgactcataaaatagatatgattctattatttctgttctcctccagaataactcagtacttcatttcttcacaactctctgtggttttatttagtcttttttcatcccgaagacataattattgttgctgttatacatatttgaagtttgtttagatttatccatgtatttttaactttgttgagttttctttttctcttcttagagtgactttatatctgcctaaattattcttcaaacatttcatttagtgagggtttatatagagcaaacgtgtaatttttattttctgaccttgtttttatttcttcctccctcactccttacagacactaatctgttcttcatttaatgattgtgtcatttcaagaatgttatataaatgaaatcatgcagtatgtaacattttgacactggctttcttttttaatgcaggagcataattttcttgtgagccagccagattgtcacatgtataaataatttgctcctttttatggctgaatattaatagtattctatggtatggacataccatcatttgtttaatatttcaccattttaagaacatccagtattgtttctgtttctaactaatatgaatagtttagaagagtcaaaaagagaaacagtctattgtatgtaccaatatttttatatttaaagaggttttcagaaaaattaaatagctgtaaaaaaggattcttatataccccctcaccaccatccgaaacacaattttccatattattaacatcttgcattagtgtgactgatttattacaactgatgaaccaatattgatacatttttaattaactaaagtccacagttcacattagggtttactctttctgttgtacattctataggtgctagcaaaagtataatgacatatgttcaccaatacagtatgatacagaatagttacactaccctacaaatctcctgtgctgcaacctattatttctctcctcctccttcccagcaaacattggtcattttactgtctccatactcgactttttcaaaatgtcaaattgtgggagtcatataatatgtggcattttcggactaacatttttcacttagcaatgtgcatttattcttccttcatgtctttttattacccgataggtcatttctatttatcactgaatatcattcaatttgatgtatgtaccaaaatttatttattaatttgcctacagaaaaacacgttggttgcttccaagtttgggcaattatgaataaagctgctgtaaatattcatgtgcaggtttttgtgaggacatgttttcaattcatttgtgtaaataccaaggagtgaagtctctgaatcagatggtaagactatgtttagctttggaagaaactgccaaactgtttcccaaagtggttgtacaattttgcattcccaccagcaataaataagagtttctgtctttccacatttacaccaacatttgatattaccagtgtttggattttagctattctaaaaggtgtgtagtagatttactcatatttttcttactgtgatttttcatacttcatgttattcctagtatccttttcttaccacctccttactgtttagaggacttcctttggctcttcatttaggatagctctattggtggaaaacttccttcattttccttcacctgagaaagccttgattttgccttccttgttaaaagctattttcattagaaataagattatgggtaaatagcacttttcttttagcacttaaaaaaatgtgtgctacttttttctggtctctgtagtcctgatgtgaaacccactatgattcaaattgttttcccctatagataaagtatcatctctcttacagacttcaacaatttttctttgtctttagttttcagaaatttgagtatgatgtgtcttggtatggatttatttggtatattctctttggagtttgctcaagcattgaatcttcaggttctttttttttttttttttttttttgccaaatttgaaattttcagtcactcttcctgcaagtactttttctattccattctctctctcctttccttctgggacatgacgacatgaatattaagctgtttgttgtagccccatgggttcttttaaaattcagtctattttctctctgttgttaaaactgtatgattttaatagttctatcttccagttcattgattctgttctcttagtttatattttatttctttgctgaaactttatatttctttgtgagaccattttttaatttgtttgaagtatttttgtaattgctccttgaatcacttctatgatggctgcttaaaaatctttgttagataatcctaatgtctctgtcatgtagtgctggcatctattgactgttgtctgtctttcaatttgagatcttcctgtttcttgctatgatgcatttcctttttattaaaacctgaagatttggggcattatattttaagactctggaccttatttaaattttatcttttagccagcttcttctgaaactgctctggcctgagatgaggaggcactggctcattacttcccatggtggatagacacctacattctttacttagctttgttgacaactgaagggggaggttcttcattactcccaggtaggggtgagagtcctggctccccactaggcctccaatgatatgtccctttatgggagggataagagtgcttcattactgctcctctgatggtctctactgacaccatgagaagagcgggtgatggccttatttatagtggctgctggtaaaagatctgactctttcttaggcctcttctgacagtaccccaacaagaaggaggagggaaaaggatacctcattactgttggatggaggtggaagtccaggatccaatgaggtcttcacttttggcacagctcaggccttattacctcctggaggagatgaaagtcctggctccttgcttgtcctctaatatcaccccagcaaagttggaaacaccttgttacagctaggcaagattggaattctagactcctcatccagcatttgctggcatgggtgtaggtgtggccacaatttatgttgtggtattggctgccgtagagtaggtattttctaaaactttgctgtctttctagccgtctcctttctttttattcatctctacatcacaaacaactgaggggaacaaaatcatgcttttaattctttgatcaccaataactacctctcagacaaatggattaattgaataaatgttatgggtatcaagtaatttttcaatcttcctgtggattgccagaatcatgagacaaagaaaatatttttgtagttttataaggaagaaatcttatcttcaatgtcatccataatatcataatgttttcaggtgaatctttgtgatataaatgtataatcactctctgtaaaaaacaacatgtcttccagatttgtgatattttctgtctggcctattttaacagtagacatgaataataattattaggcaaagatctatgtttttgtatcttggtgaaaataaacacacaaaatgttttaaaatgttatttactttctgtaataaaaaagagtttttaatatgtttctccaagagtgataaaatgaaagatttgcaatttttagctttcttctggacccataaaatttgcacctatataagtttcactcaatatatgctttaaatattttgcctaaaagtaatgtgtgaactttgggttttgtctggaaatcttgacaattgagagaacataaacagaaaaagaaaagaaattttctatagtatgcattgtcaccacttcaagtatgtacaccttaaatagaaccttaaaatatactgttagcatctatttttattacttcaaagaaaatctcaataggatacttttaagattttaacataatgtacctgcttaagctgatagcaacatgaatctagaaactaatcaaattatttttaatgggaagataatgctctggccttaatttttaaaagtaaggtaattctaatcatacattttgaacatgtacaagcataattatcttctgttactatcatgtggactagccaatttaaaactacaaattatattgaaaagataagtggaatgaataagaaaacctcgtttaatacatgctgtgctttttttttttaccttgaacaagtccttttaatctccttctgaaaactgaaagatttctttgttcagtcaataaatttctctgatcacacgttttttgaactctaacttctaactttctatgaagaagtaaagcacactctgatattagccataacaaatatgttctaaatcaatctaaacaatattaatttgtgcaagcatttatttacattaatttacttctcactgtctagaacacatgctcagcatgcaaagatattaatgaaattggaccctagaagagaagcagggtcgaaaaattaaaaaagtagatattaaaataaaataaaatgtttactgtattttatttcattttattatctgattatttttattattttaatttttttccttgggccatattattttattggcaggtcagtgaagagccagaggtaagggtccttcaattcctattccccaacccagggactccccctgaaggagagcagaaacccaggagcctgccactcagaggaccttggagttgggcaggttgttgtagcaatattcctggccttctagctggttgcaatacagagagatctcctactccagctgtgaggtgaagtccataaccccctggtactccttgttctgcctctcgctgtcaacgcacatattacccagctgggcttcataaatattttatttcaagaaagaaattaatgatatttgagaatttgaaattgagaatgatatttgaaaattatgattaaacatatttaaggaagtgcaaatggaggtgcaaggtaattaagtcatatctcaaacagtctcttcatgtggtgacattagttactgaccacattatcagaacataacacatttacggtaatagcagtgcaccatttatgatgaaacctaaactgtagctgatagtgccaaacaatattagaaatcagaatgatttttttaatgcagctttatctggtgtaaaaaagatacttgtttgttcaacaaaattgccacaaccaaggtttgttttcttttttcttctgtttttttttttgttgttgttgttgttaaggtgtcttactttggtaattatcttaagtacgttgcaatatactacctttgaaaatatttttaattaattgtctaaaaaccttgctggaataaatatattaataactcaagtcataagaaattaatatattcagtgcctctgtaatacctgctataccttaataagtgctccttagcaatttattgaaaattaattaagtcttgccaaaggaacacaaaaaagtcaactagaagactaattgaaattattataacctttctgtgtaaatatacagcacatatgattggataagaagaacatcttgtaaatttgattatcagattaattattcttaacatttatatatgaaatatcaaataagatatcactggtagttattatgcattaaaatagttttgtaagtacttaaaataatattttcttaatataattttcagttaatattgtttagacattcaaaatcctattaacattatgttgaatcaggtagaattttttccagtggccaatcttttctccattttctgaaaacttatgtctcttatagccctgcacttaccagatgttctttctctcctttgtcctattcaaaatgtatacaactgcaccatattctcatcattttctgaaaggtaaatattgcagttagagcaaataatttagttaatgcattgggtctaaattaatgcctcagtgaattttaaacatatcttatttagacagcctagatgggttaatgctaaaattgttgattggtaatgctggcaggcctatgggagagatattttgaatgaggatgtccaaaaatgcaacacagtaagtctaaaaactagcccttatttaatctacctctatatgaaaagcatatgctaaatgctttgggagaataagaattgtatttaatctttatgcaccctactataactatttaacctactaaaactattattaaatatgaatagatgcagaagaatttatagataattaatagatacagacattcagcctcagaatagttaagtaagttacccaggttcatgtggttattaagtgatagacttgggatttgaacccatgtagtcaaagcacaaagatcaagtgcttgacaatgattcctaattcctcaggtaaaagtagattgaaagacacctactctgcctaagtataagagcagacccatgtcataatagatgtaggactattaatagataaatagctgttattaatagctagctgattaatagttagtagattaatagctgttaagaagtgaattaatgatcaagctaagactacctgtggataacatttcaaattttgtctttgtagactcttcctttctttccaaaatttgtctacactaagttaaggaacagctgtaaacttacaccaaagatggtcaacaggaaggcttaggaatagaaattcttcacaagttggtaaaaaaatatattttgaaaacagtagacaaacatacaatgaaatcagcttggtcacttgtgcttacatttgccaatttaatcacagcctgaatgttattttgacaccatgtaaatttgtcattgaagaatgcatatattgtataacatttgccttcttcaaaggaatgtctgtatacctttaatacttcaaatgccaagagttcacctttcatgttttctcataaaactttcacattgaatgtttagcatgatttttcttgccatttttatattcaactagaagagaatatttggaaacttaaaaaatatttatgtgcatatgatactaaattgtatatagatttatttctatttatatatctatataatattaagaatttctatgtgccttgcattttattagatacaagaaaaatgatatactcagagaagacacaaaattaatgtgaaatatgtgtaatggctgataaataaatcctgtttttggtattagtcagggttaagctataggaaacggtattccattctagctagcttaagaaagagggaatttgtttaaggatattaaaagatattaatagaatgtttttatatcctattatggatctattgatatgaattattgttgaacattaaaaaggctcaataaatcagtaggggtagagggggactgaagactgaagaagggatactaggttaagtttcaggaacaactatccaaaccataccaagtatgctaagaaactttcctttaacatcataaacttgtaggttctagaactacactaacactgtcacaatcaatgaaactgacaaaataaaaacccaccatagttcggaaatcacacgcctatagacaatcaggacactatcatgataaaaatcaattacagcttctgttcttgtctctggaaccacactgtacctactagaagctgcaccagcaaaaccagtgtttgtatcctgtttctacactcatggagccagttattgaactatggaacagctgttgatttcatttcaccaaaagcaagtgccttaatgcccacatttgccaggtgaatagcaaaagaagctgccatatggcctccatctcacttatgtcttccaatattttgtgtgcacatatgatcagccaaacctaaatcatatgtggaaacctgaatctggatgagtttggaaaatgcaatttctatgtatccaatctctttattacaggaaggtaaactaagggagagtagaatagatatcacattgattagacaaaacgtgtatttatgatgttaaataatgtattatatggaataatgtctttgtcatttaggcgctaatgtattttaaatctgtagtctaacatattctgcttttccaggtgtccagcctttgtctctctatcagaaattttttagcagcaaagaaagaaaatatcatattaaaagtaatgtaaataatgtggataagcattacctaacagaaaaaaagatgcccagagcaatagcagtttcaatgttggtaaagtaattcaaatacgttatcaaaaaccagagatctttcttaatctaagagtgttgactttgattctcagatttgaccctcataacttgaaaatccaagacttgtgttgacatagggttgttgcaaagggagaaagttgaaggcatccattatggttaataatgagtgtaaacttgatgggattgaaggatacaaagtattgatcctgggtgtgtctatgagggtgttgctaaaggaaattgacatttaagtcagtgggctggcaaagacagacttactcttaatctggatggggcacaatctaatcagctgccagcagggctagaatataagcaggcagaaaaacatgaaaagagagactggcctagcctctcagcttatctttctcctgtgccagatgcttcctgttcttgaacatcagactgtgagttcttcagttttggaactcaaactgactctccttgctcctcagcctgcagaccgactattgtgggacctcgtgattgtgtgagttaatacttaataactctcatatacatatatatatacacacacacatgcacacacatatacatgtgcacatatatacacacacaaatatatatattctcatatatatcaatattttatatatatattttatttatatatatatattccgttagtgttgtccctaatagagaactccaactaatacagattttggtaccaggagtggttcttgaggaacagaatattaaggatgaagttctttagttggttttggggtttctggagttggctgcttaatatgattagacccaaaaatgctaagggccctacttctaatagtatggagagcactgatagttcttggtgtgaattgtttagagagttatgcaagataaatgcatttgacactcctgaatcatcacttgtgagaggtgaggagtttagtctgtctatccacaatagctttgatcatatgtggagaaacaaggaatataatgaagctggttggttgctcccaagttcagtagagaaagtgataaaagaaaattatgaactcaggaattctatctgccggcttcagaagcagatactcagcctcaaatctgttaagattgccccgattgtcttttattttattttattattattatactttaagttttagggtacatgtgcacaatgtgcaggttagttacatatgtatacatgtgccatgctgctgtgctgcacccattaactcatcatttagcattaggtgtatctcttaatgctatccctcccccctccccccaccccacaacagtccccagagtgtgatattccccttcctgtgtccatgtgttctcattgttcaattcccacctatgagtgagaatatgcggtgtttggttttttgtccttgtgatagtttactgagaatgatgatttccaatttcatccatgtccctacaaaggacatgaactcatcatttttcatggctgcatagtattccatggtgtatatgtgccacattttcttaatccagtctatcattgttggacatttgggttggttccaagtctttgctattgtgaatagtgccgcaataaatatacgtgtgcatgtgtctttatagcagcatgatttatagtcctttgggtatatacccggtaatgggatggctgggtcaaatggtatttctagttctagatccctgaggaatcgccagggagcattttttcatgtgttttttggctgcataaatgtcttcttttgagaagtgtctgttcatgtccttcacccaaagtctccttaagctgataggcaacttcagcaaagtctcaggatacaaaatcaatgtacaaaaatcacaagcattcttatacatcaacaaaagacaaacagagagccaaatcatgagtgaactcccattcacaattgcttcaaagagaacaaaatacctaggaatccaacttacaagggatgtgaaggacctcttcaaggagaactacaaaccactgctcaatgaaataaaagaggatacaaacaaatggaagaacattccatgctcatgggtaggaagaattaatatcgtgaaaatggccatactgcccgaggtaatttatagattcaatgccatctccatccataaggccaaccagaagcaatttgtcttcaactggaaagtccagcattatacattttctatcctacctcaggggtatatcaactctccagctttgtgtcataatcttattcagagacaacttgatctcttttcacttctgcaagatatcacattggtccattacactgatgacattatgctgattggatccagtgagtaagaagtagaaaacacactggacttattggtgaaacatttgcatgccagaggatgggatataaatccaactaaaattcagagaccttctacctcagtaaaatttctagtggtccagtggtgtggggcctgtcaagatattccttctaaggtaaaagataagttgcttcatttggcccctcctacaaccaagaaagaggcacaatgcctagtgggcctatttggattttggaggcaacacattagtcatttgggggtgttactctggcccatttatccagtgacccgaaagcctgccagttttgagtggggtccagaacagcagaaggctctgcaataggtccaggctgctgtgcaagctgctctgccacttgggccatatgatcggcagattcaatggtgcttgagatataagtggcagatagggatgctgtttggagcgtttggcagtctcccataagtgaatcacagtggacgcctctaggatttttgagcgaggccctgccatcttctgtagataactattctccctttgagagacagctctttttctgttactgggctttggtggaaactgaaagtttgactatgtgtcataaagtcaccatgtgacctgaactgcctatcatgaactgggtgctttctgactcatctagccataaagtgggtcatgcgcagcagcattccatcatcaaatggaagtggtatatacatgatcaggctcaagcaggtcctgaaggcataagcaagttacatgaggaagtggctcaagtgcccatggcctccactctgccttctcccccagcctgcaccatggcctaatggggaatttcttatgatcagttgacagataaagagaagacaagatataccttagaaggaatatcttgacaggccccacaccactggaccactagaaattttactgaggtagaaggtctctgaattttagttggatttatatcccatcctctggcatgcaaatgtttcaccaataagtccagtgtgttttctacttcttactcactggatccaatcagcataatgtcatcagtgtaatggaccaatgtgatatcttgcagaagtgaaaagagatcaagttgtctccgaataagattatgacacaaagctggagagttgatatacccctgaggtaggatagaaaatgtacaatgctggactttccagttgaagacaaattgcttctggttggccttatggatggagatagcattgaatctataaattacctcgggcagtatggccattttcacgatatggcctggatcacagatggttctgcatgatatgcaggcaccacctgaaagtggacagctgcagcactacagcccctttctagtacatccctgaaggacactagtgaaggaaaatcttcccagttgtcagaacttcaagcagtgcaccaggttgtaaactttgcatggaaagagaaatggccagatgtgtgattatatactaattaatgagccgtagtcaatagtttagctggatgaccaggaacttggaagaagcgtgattagaaaattggtgacaaagaaatttgggaaagaggtatgtggacggacttctctgagtggtcaaaaactgtgaagatatttgtatcccatgtgagtgctcaccaacaggttatgtgagcagaggaggatttcaataatcaagtggataggatgacacgttctgtggacaccactcagcctctttccccagccacccttgtcattgtccaatgggtccatgaacgaagtggccatgattgcaggggtggaggttactcatgggctcagcaacatggacttccactcaccaaggctgacctagctatgaccactaatgagtgcccaatttgccagcagcagagcccaacactgagccctcagtatggtaccattccttgagttgatcagccaactacctggcagcaggttgattatattagatttctttaatcatggaaagggcagaggtttgtactcactggaatagacactattcctatgggtttgcccattctgcacacagtgcttctgccaagactaccatccacagactcacggaatgccttatccacatattggtactccatacagaatggcctctgaccaaggcacacactttacgctaaagaagtgtggcagtgggctcttgctcatggaattcactagtcttaccatgttccccatcatcctgaagcaactggattgatagaatggtgggagggccttttcaagtcacaattacaatgccaactaggtgacaatactttccagggctgggccaatgttctccagaaggctgtgcatgctctcaatcagcatccaatatatggcactgtttctcccatagccaggattcatgggtcctggaatcaaggggtagaagtggaagtggcaccactcaccatcaccccagtgatccactagcaaaatttgtgcttcctattcccatgacattatgttctgctggcctagaggtcttagttccagagggagaaacactgccaccaggagacataacaagattccattaaactggaagataagatggccacttggacactttgggctcctcattcctttaagtcaacaggctaagaaggaattacagtgttggctgtggtgattgacttggactatcaagttgaaatcggtctataactccacaacagaggtaagtgtattagtctgttttcacacaggtgataaagacataccagagactgagaagaaaaagaggtttaattggacttacaattccacatggctgagaaggcctcagaatcatggcagaaggtgaaaagcgcttcttacacatcggtggcaagagaaaatgaggaagaagcacaagcggaaacccctgataaacccatcgtttctcgtgagacttgttcactatcatgagactagcacgggaaagactggtccccatgattcaattacctctccctagatccctcccataacatgtggaaattcgggacgtgcaattcaagttgagatttaaatggggatgcagacaaacaagatcagtaagaaagagtattcatggaatacaggagatccattagggcatctcttagtattaccatgccctgtgattaaggttaatgggaaactacaacagccaaatccaggcaggactacaaatgacctagacccttcaggaatgaaggtttgcatcactccactaggaaaaaacaaaaaacaaacaaaagacaaaaaaaaacaaccatggcctgctgaggtgcttgctgaaggcaaagggaatatggaatgggtaatagaagaggtagtcattaataccagctacaaccacctgaccactgcagaaacaaggattgtaattgtcatgagtagttcctccttcttttgttaaatacatgtttctgcatgtatacacttgttctaagaaaatatcttcattttatttgctttcccctttatcatgtgacataagatttattgacttcacatcagcatttaagtattattaactttatgtaatagtatttgtgttggagattggtgcatttccgattgtatgaaggatagttgtgttatggtaggcataattatgaccttattattgtctttgttttaagattatgtatgatctcaggagatgtgtatgagtttgagttgacaaggagtagacttatgatccttaatactgtgtgtcaacttgattggattgaagtttgcagagtattgatcctggtgtgtctgtgagagtgttgctaaaggagattaacatttgagtcagtgcactgggaaagacagacccacccttaatctgggtgtgcacaatctaatcagttgccagagcagctagaatgtaagctagaatataagaaggcagaaaatgtgaaaagagagattggcctagcctcccagcctacatatttctcccatgctggatgcttccttccctcgaacatcagaccccaagttcttcagttttggaaacccgactgactctccttgctccttagcctgcagatagcgtgttgtgggaccttttgatcatgtgagttaatacttaataaactccctctctctctctctctctctatatatatatatatgtgtgtgtgtgtgtgtgtgtgtgtgtgtgtgtagtttattaagtacatatatacacttaatacatatattatattaatacaacacatattttatatattatatattaatataatatataatattttatatgttatcttatcttatattgatatattatatattatattactatatatgtattataatattatatataatacatgatattaatatattaatatataatattaatgtatatgttgatataatataatgtataacacataatatataaatatattgttatatataatatacaatatattattatatagtatatataatatattaatataatatattacatataatatatagtttattaaatgtgtgtgtgtgtgtgtatatatatatatatataaaatcccattaattttgtccctctacagaaccctgactaatacagcaatttctcctccatgattctttatagagtgaggggtgtcttcctgttaatcccatagcagctccaattgctagaacccagtgaaatttcgggatacttctatagaaacacttgtaaagctactgtgttttgtcaggaaagaatattttaccagcaagtaagaagggcttaggagttccatgaaggtaactctaaatctaccaagcaggtcagaattgcttgtcttccttccacagcaccctgcccctttccttagtgtctgtttccatgaatggtaccctcatctatttggtctcctaagccatttcttcctttgctctactatccaaattcagtttttcaccaaatcctgtctatttctactcttattacatttcaattctatttctttcctaatatttacaatgccttagcagtctgtttatgtctcatcactgcactactacaaaagcttcctacttaattctcacactagggtcttaatcatttttaattccataataatatcacaaaatgtaaattttgttattttattctcctccttaaagttgttactggttcctcaaaacttttaggatgaattattaacatatagactaatattttagcacatagttctttttctgactactgctccctccaaggcttcatatcatgttgtttctccaaatgcaattaatacactagccatatcaaatgtatttcacctctatggttctgaacacgttaatcaccctttataaaacatctcttcctcactctctttcttctccaatgcttgtcttttaagactcagctcaatactcctccaaaaatcatttcttgacccagaaatataaattaggcacccagttctcccatgcatccttggcatgcattagtcatagaatttgtcatattctcttataatttttatctatatattttttcaatgtcattgagtaaccttcttgagaaaaagaatgttttttatatatatacttttttattaatgtagaattgatgaattaattcagctcattgccatgagagagtttctagatcacagttaagaaaaggagaatcaggtagagtccagcagagtccatgagttgaggagagttatgagattccaggtaaaacaaagtgactacaattcagaagacagaaagctggtgaggagagaaccgcaaacgctgaagattggcagaggctctccattgaatattttgctgaatgcgatcagcatgtgaatttgagaaaactaaacaaagctgaggattggaggaacactcaaagaaagcagtgcctgatactcacacaagattggaaaatctcataattggacagattatataaaaatatcttatctctgtagtggagaataattagccctaaattgaacactgttcctatcccacttaaaatatcttagagaccatactagaaagatcaaactatttttaagtagcttaactgcattccaaaacaacgctcaagaatatttattggaatacaaacatattctacatctaagaaggtgaaatacagaatgtctagcgcctgctagaccgacatgcaaaatgcaggaaaatgtaatacataatgaggagaaaataacttcaaaatcaacccagaagtgaaaacaaaattcatgaataccacaaatggtgacttaatgagtaatatacaagattttttctaaagaatgcaggaaaatgtaatacataaagaggagaaaataaatcaataaaaatgaacccagtagtgaaaacaaaattcatgagaaccacaaattgtgacttaatgagtaatatataagattttgtctagttaatcttttacaaagtttattaactgtttaaatgaaaataatagaaatgcagtcagaggcttataatttacataaaagaaaaacatattacaataacagcacaaaagttgggaggagagcaatggaaatatgcatttttcatgttcttatataggcaaagtagtgtacgttcactagtagatagtgataacttaaagatatatactataaacttaaatatatactataaatctataagcaaccacttgaataataaaaggtagagttacagtaataagaaaacagcaaataaaataaaataatcataaaaaatcaattaatccaaaggcaggcagaaaaacaggagaaagttaaagaaaaagaacagatgagtcaaatgtacgtcaatagctggatgataaatttaaactaaaccatatcaagaatcatgtaaactataaatggtctaaatattctcgattaaaaggccgagatatattatataacaaagcaatactcaatatatagtctacaagaaatgtacttcaaatataaggaaacaaacaatctgaaagtaaattgattgaaaaagaaaaaatatgctaatactaaggaaaagagggctgcagtggctatattaatataaaaattaaatttcagagtaaagggtagcattagggataaaggaagtcatttcatattgataaagtgataaaattctacctgataacagcaggaaacactttataaacattcactgaacatttaccaaatctaccatattctgcatcataaactcatcaacagcatataaggatgataaatgaatatgcatccaaataacagagcctcagaatatattatattaaacaaaaactgttctaactgcaattaaaaatagataagtctaaagcttatctattttataatcagatatcaatgcaccatatcaacattcgataagggaagtcgacagaaaatcagtaagtatatggatgatgtcatctacactgccaataagcctgatgtaattgacaattgtggaatattccactaaacaagagcgggatacaagtactcactaaacatttatcaatatccctcatattttccatcataaaagaagtctcaataaattcaaaagattcaagtcatacaaattatgttttctgatcactggtagaataaattagaaatcaatagcaggaaaaattcttgaaaatctttaaatgtttagaaactaaataatataaatagagtcatagaatgaattttaaaaaacagaatgcattcttgaagaaatgtaaataaattcataatctatctgaaattgtagattactactaaaagagttattgggagaaatatatactaataaaggcctataaagtaagaaagcttaaattaaagacctagcatctaggagaaaatgaaaaattttaaatcaagcaagtagaagaaaataaataataaaggtttaagcaaatattaatgaaatagaaaaaaatagagaaaaatctatgaaactaaaaacttgttctttgagcagatcaataacaactgacaaatatcagatcagactgaaatgggtaaaaaagaagataatatacttactaatatcagaaataatagaaataatataattgctgcttctatatagattaaaaagataataagaaaatgaaccattttaggctaataaattccataacttggatgaaaagaacaaactctttgaaagacaggaaaccaaaaaaagaaataaattaatagtctaaattagtgcaatcaaattatagttaaaagcctctcaacaaagaaaactcttggccaggatgtcttcatttgtgaattttatgacatatttaagaaataaataatattattctacacaaagttttctggaaaactgaagaattagaaatatttcccaactcatttcatgaagccatcattatacacatataaacatagaatgatattgcaagtaaaactgcatatcagtatctctcatgaaggtagatataaagattctgaataaaattttggcagttataatctaacatatataaaggagataatcgtcacgagcatgtggggattattccatgaggcagagtttaacaattaaaaatcaatcaatataattcactgcaataacaaaggacagatattaatatgagcatttgtccaaatctagattttactgatttctaataaaatttccgtaaactagaaatataggggaacttcctaaattcccttacgaaaaaaatctctaccactaactccacatataatggtgaaagaatatctacaaaaacatccctacagctaactccatatataatggtgaaagtctgaatattttctgctaatataaatagcaagtcagggatatccgccctcactacttctatttagctttatgttggagatcgtagacagtgaaataagaaaataagatattttaagagcatatagattagaaagagaggagtaaaattttctcttatttgtgggctagataattgattgtgcaggaaatttgatagaaactacaagatatccactagaactaatgagtttagtaacattacaagatacaaaagtacagaaatcaattgtatttttaaataataacaaagaacaattgaaaattcagtaaaaacatagtgttttcagtagcaccaatatcatgaaacactcaaggataaatgttataatagttgttatagacatgggtatgaaaatgaaaaaacattgctgaaagatatttttaaaagatctaaataaatgacgatacatagcatgttcatatgtcagaagataaaatatttttaagatatcaagtgtgaccagatccatcacctcaaaataatgctatttatataaaattccagaaaatgcaaaggaatgtattgtgatagaaaataaatcagttgttcccttgggctaggtgggggaagagggaggggaagggttgaaggaagaattatgaaaagacatgaggaaactttgggatgatttctgtgcccattattctgactgtggtgatggatcaatgaacataaatatatatataatttagcaaaatgtagagtttaaaatgcaaggtttattttatgtctatgaaagcacacacacacttttaattctgttttctttgaaaacatgttcagttgatagacactattaatttcatgttcacctaaactttaaggctacgtagatgtaatgagaaattaagtaatttttctaatttttatgacaaaatctacttaaaaatcatttattttaaactaagatgggatccttcgaaataaaactacttaaaatatctctcaaaaaaacctgtatatttttagtcctctctgaccttgaatccactcaacagatcatcgaacaactgtctaaattcaaaagccaaaattcttattttggttactctcatgtcatatatcctcactcagtaactaatgtaaaagtaaagcagccctgatggcttctgtggacctcctgagcctctcccaaggatttaggtcctcagggaattagcaatatttcttatgggattcagttttataacaaatgtttaaaaatatacatatttacattgtatggatgataggactcaatgattcctcttattctgttttcctggctcttctttttttctggtagttggcattatgggaatcgctcagacataggccctttcttccactcttccaacgtcattcttgctgctgtgagaaatgcatcctctaatatgacttcattaacttctctctcattaactgacaaatctggaatcctcaatattcaattcatgatgatactctctgaagtcatctccatttcactggcccattctagggtccattatttgaaggctgcccccagtctcattttctattcaaacttaattttctgaattatcctactttttatacttcattctttgcagtatactccgctactgtatttattaatctcactgttcactccattattaaatcttcctctgatttcagaacattgcatgtttttctgtttcccatagtatgactttgactcaatatcctcatgaacagctttgaggactatctctcctagtttatttggtagactcttttacaaatatattaccccaaagggcagttcttaaatatacacatcttggccttattgatccatccatagattctgcttaccttctgctttccttaacactgaaaatctagaaacttgaagtcaccgttgcctttccttctgctctatattaaaccacaacctaaaatctgtccatctttccttctcaatatctctggatttagtccttaagcaaactcttcttacctaacacctgttgctattagcaacactttttgtcttcaaagtgatctcatacaatctctattccaaaaactgaaaacaaaacaaaaagctgccaattaaacaccacaactgtcatggtaagcccctgctgaaaatcatacatattattctctaactttgattacaaaaaatatcaattttttagtataattatcaggttccttcacgatctagtgccacattacttgtataattttattctacttctaatgccagttacctcattccagtaagtttagatcttcactatattcttcctatcatgcattatcaacacacatacagacatacatctttattttgcctgcatatctttctctctgcctgagtcatatgcatcctttgatgcctagcatcatattcaagctcctatttcaagtgtttctgggtataaatctattatctgatattgcctggtcatagaagttgttcaatcaacgatgaattgttcctggagaaaataactttccctctttcaattatttgtatgttttctttataacatgtgtcatgttaatatttattgttctcttttcaacttgtatttatataatatttagcactttattattacagtattaaaataatacataaatctgtgttagttaattgatttatctatatttcatgtctatatttccatgcacataatttaaaaacatgagtattgtaacttttaaaacctttattcataagtactttatcttatatacatatatatatattttttcccctgtggaaagaaaagggctaatttcagccagtaattcaccctttgctacaagggagacatttgaatagtcttgactagatctgcttataaacatgcaaatatgatttgctagcaggggatgtggaggtttcttcttagaatgacataacttgtctgtctagatcacttattataaataaacctacacgtttatgttgcttggctggctggaaaatagggagtaaaatgtattcttctacatgtgtaactaatgaattatataaaaaggagttctcaaaacaaaatagctttctttataaacaatgtttctgcatacatagtttagaacttatctatctgaatccaaaaacaatctataatatgggagaaatgatgtgttttgaaaactatgtttgatggattgacacttcacctgaaattgttacaactgtacttgattctgtcttgtgtcctcgaagtcattagtaaagtttgacgttgtataacatatataattttcaaaaatcagcgtggcaactcaaccctttgtatttacacacaacctcactgtgcctagcatagttttggtatacagaataaattcagagacatttcattattgatagcttataatctgatataaaagtagagcattgacttttgttctcaatattccctgcaatatatatttatatatgtacagatgtgtaacacctatattataaaagtatataatataacaaagcaggcatgatggcacatgcctgtaatcccagcatgttgggaggctgaggcaggtggattgcttgaggtcaggagttcaatactagcctggctaacatggcgaaacctcgtctgtactaaaaatgcaaaaattagcccttcatggtggtacaagcttgtagtcccagctactggagaggctgaggcacgagaatcactagaacctgggaggaagaagttgcagtgagccaatattgtgccactgcactccagcctggatgacagagcgagattctgtctcaaaaaaaataaaataaagtatgtaatataacataaaacattttatagtattctgcacgtaatcgatggcacagttttcaaactgggtgatgttttataccctgatatgtcatatgtgagataaacatatttactatggttaaaattttataaataccaaaatgtctaaccttagcattatttctaaaataagtaatttatatttagtacacactagtcgaagctcactgtttttctgtggtacttgttttagtgtgtgagaagtttttgctctccctttttctcatactttttaatagaaagttccaaaacctgggattctaggaattttatgtcattttggttcaatactattccggattctaatataatggtctgaagtttgatgctgtttgaagaagctggggttcatcttgtgtgatgctttgaaaatgagaagaaagccctttcttatatttgaaagtgtcctggcaatgagcaaagggtaaagaaaatcactgcagaatgctgtttgctcaattcaaaagccagtctgctttatgggccatttttattctttgactggcttccctggagagattcaaataaagaggtttgaaatataccaggttgaaaggctgaatatgtcaagagtatggatcactgaagcaagatcttcatcttgcagcttaattttctggctggagcactttacaaatgaacgaagacattcacggttactgccgatgcctcagactccaggaacatcaatgagtctctaaggggctcaaaatatttcaccacattgaacatcaatggggaagcctctttttagcagaacagatgttacaaactttaccaaaattatgaattcctcctatcaatagtatacttttttttttttacatctacagcatgcgctaaggcaagcaagttgtaaatgcattttcttgaacattttatgcgacagagaaaccagcagttttagagcacaaaatacactttaaaattggcaatattgagctgtgtatcctttgaatacttctatattttttaatgttattcattttcctgtgacctcttgagcagaaagcacaagagctgaactctgtggagcttagcatttgaattgattcagtaagtataaactatagttatttgtagagatccaaagtactttttattcagaatttattgatgagtaataaatgcactttccaactccaccagcatgactctggaatggagtagataattagaagttcaatgtaggaaatttaaaagtcttagattcacaggagaatttaatctctcctacaccaaaaacattattgctctggaaaagatgtagggcattgggagtttgacagaagggtgggttcgaaggacagttcccccaacccacatactagaatgatgtcctatttacaaagaaatcaccaggctttgtaatgtaatttaccaggctttgcctgacaaggcccctttgaattgtaaaaattggtttaaataaatccataaaaataaatataaccccaaagacagagaccttagaatggatgatgaaccaccaaagatgagaaactgtacacagatataattttgatagaagtatcacaaaataatttatgagagtcaaagagtaagtcatctaaagaaatgaacacgaccacacagcaagctctttgtgagctcagatatgaaaatgacatgggaaaatgtaggaaaagagacccaaagcaaaagatgaatctttaaacattaaacaacgtctaataatgatggcaggaagactaaaggtaaaacatgcggtgacaacagcaagacaggaaatggttagaagaaaaagcataagaaaggatgagtctgctcatgtgaggtcaatgtcaaatgttgacgaggacaaaataagaaagtagaagccattcatatttttctactttatgaatgatcatttcatttatatatttagatatatatttacatattttattttttattgtacacacactatatactagacaagatacagagttctatctgggaaggaaaatgttcacccaactgaaaaaatagaacaaacataaataaaataactacattttaactttaatgactaaaaagcacataacaacttttcaagattatcatttttttacattattattaacttttttttttttttttttttactctaagttctgggatacatgtgcagaacatgcaggtttgttacgtaggtatacacatgccatcgtggtttgctgcacccatcaacctgtcatctacattaggtatttctcctaatgatatttacagctaatatttatttagcatatccaagatctcaaatgttacctttaatcttcattccaaattataatccaaagttgacaaatgagaaaagctgagctaaattaaatttctaaagggacttaaattaaatttctagaatttacattttctttaaagcaagaatctaacaactccttttttattttcgggggctcctccgatctgctgcttttttatttttatttatttatttatttttttgaggctttcctgtcactatggaaatatcaaggcccttttggcagctggaatgcagacagatccagcacaaccaagtcacttttcccacatggagattctgcagagtcttcagcagagacgcaaatttgcagatttgggtaataaagatcatagccttaaacaagacttccctgatgtctaccttctgccctgtacttttcacttttgtatcacaccattttttaaatcactttaatgaaaagtatttgaacattttttttgtgtgtttactacatacaactctataatggaatctctatgacaagaagagctttgtttgtctttttctatgctgtttacccagtaccaagaataatgcctattatctagtggcactccatatatatttagtgaatatatttatgaattatgagagaaaaggccatattaagaactccttatttgtataaaaatagtaaattaaaagcaacaccacaatcatggagaaatgtaagattactgtcaccataaaattattgaaagatgcagaaatgctcattctagctgcaaaatatattttctctacagtggttgatgaaatttttttaaaaaataagttggatgttacagaaataatttttggcttcttatagggccgcagtggagaatgggataccagaggaccaggtgacctaagctgtctcacttgaataaggtatatctgatatatctagccaaaaggttgggcttgcccaaaaaactttcatcatcatatatggacaggagtagtttcgagcagatactaaaggtacaaataaagtaagattcaacttcattcacactccctatctatctatatcctgccacactgtagcccctcttcaggacataaatatgacctcacactccctatctatctatctatatcctgcctcactgtagcccctcttcaggccataaatatgaccagcccaaataagaggaaataatttaagcttggcttcccaatggctctgcataatatgctgtcaccagctataaatgaaatgcagcatgacatttcttttaggactttctcttgaagaaagagagtcaatctcctgcatggccattttgtccacttaaggatgtatggctttgttcacttataaggatggatgtcttaacatagagatatattatggtttatgcttgatgtctaaggttttgagatgatggtgtaagtggtcagggacttagaagactgaaattagacatttggtgacaaagaaattttagaaagaagtttgaaactggattccatgaatgatccttgctcctggccatcatacctatgctagcaacaccatcctgggaacactaaatgcctgatacaccacatattctccaacacaaaaaaatataattatctagaaaaaataagtaaagcagaaaactgatgccttaaggaatttggggtctcataatatactgtgtatcatccagagagctagtattatagactactgaaatgacttattcattggttaaaaatacattttagattgcatagaaatatttctgttcatagttacttgagtgtgattatcaatagtatactctttcactcataaaacatagttatttggatggcacattatatctagcaaacctatgtttagatgaacctaggagacaacattttatattactctgtagagtggtacgttttactggaagtctactgtgaactcttgcaggcaagaaaggcctatataatggcttattctttactattaagatgcggcttgttttactagagaaagatgatcaacaatgtactgctaacaaataaacaggacatgtaataagcaacatcaaaatgagagaaaggaaagagacagagaaaatgagagatatttattatgagaaattggcttatgcaattatggagagtgagaagtcccacagtctgccatctgcaagctggaaactcagaaaagcaactggtgcaattcagtctgagaccaaaggtgtgagaatcaggggagctgatgtaaatccaagtccaagggcaagagaagaggagatatgtttcagctcaagcatgcaggcaagtatgcatttttcctctgactattttactcaagccctcaaaaattagatgatgtcctctcataattgggaagtaaatagactttattgagtccaccagttcaaatactaatctcatccagaaacactctcacagacacacccagaaatgtctatttgagcaccccatggctaggcaaatggacatataaaattaaccaacatagtgaataaatgttagtcctccagaaaggtggaaattgactttttatctgaaatgtattaattctcactttctatacagggaaaaaattctattgagccttcttttcccagtacaaaagataattaaaatggggttatatactacattggcacttatggagcaggcatctgatctaatttggcaatagttgctccaactcaatattatgaatcttgaacaagttttgcaatcatgtaagaacaaattgatgttaacttacaattgtgaggtgcaccctaccagtagtatacatcaacagaatattaagtggtagcaacaatagaaaatcatcattctaacaggatattcctggtggcctaaacttggctgccactcctgctcccattccaccttcccatgaattctttgaactactaaatattccttcaataaatcaattttcttcttaaaatagccagaatctaccaggcgccgtggcttacacctgtaatcccagcactaggtcgaggagggcggatcacttgagatcaggagttcgtggccagcctggccaacatggtgaaaccctgtctctactaaaaaatacaaaatttagcagggcatggtggcaggcaccagtaatcccagctactcaggaggctgaggcaggagaatcacttgatcctgggaggcagaggttgcaatgagctgagatcgcgccattgcactccagcctgggccacaagagagaaaactctatcaaaaaacaaacaaacaaacaaacaaaaaaacagaatcagttactttttgtttagtcaagaactctgatagatatatctgcatttgaaaaattgtaaaaatgtatacacaaaacttttctaagcaaaatgttcacatagtgtttaaatagtcttacatgcaacaagacctaacagttttggctgatctaagaattaatacaaagtagaaatgtaatgtatcttacagaaagtagagtagaagtacaatatgtgctaataaaaggcaatgctcagaaaaaaatgtaaaagctattcagattagcataaattacttcaaataagggctttgtatttttagatgtactgtgtgtagttgtaagacaaaaaaccaggatcagagattagaagttacagttctgaagatttcagctaaataccataccgaatatttaataagcttttcaaaaattgaattatctcacttgggagactatagtgaaatcagactttgtcctagatcttattcccatatgtaacacttattgcctatgtgattttcagcaaataacttctttaagatacagccctttcatttatgtaataaaaaactataagaccagaaccagtcttaccattgtattggtttcctcatttatgacttaaataaatctttgacatatgctcactctatttatttgtgtaggaatttttaactttttaaaaatgatcccttgacagtaagatgtccaagcagactcaccttctggagccagttcaactgcgtggccccagaaagtacacttcatgggctgtttgggtccaggcatgtatattcttggttctgagagtaaattgcaaggagcaaaataattttacttcagctgtctctctgattctctggggtatttttcttccaattctgggtttttatttgtatttcttttttggggccacgtttagctttgagcctggactgaacatggtttccccgttggtagcagcagtgtttgggaatcagatttttattttctgatcatttcattttgttgtttctgttgagtaaaagcagggctttattctttgtcagataagaaatgactgaagatttggtttgttaattgtgttgtggtctgcctctctgtgaagcagatcacctccaaagatggtcatcaataattttcctacttccttcttcaagaagtggagtcttactatttcctttttttgaatctgagctggtctcgtgacttgctttaaacaatagtaggtgacagattaactgtacactaattccaggccaagtccacgtgacaactttcacttttgctgtattagagctataatacaacatttaagaagtcaaattatgctgctcctgagggagatgccaagccacatttgttccagccatcttggcttaggcaccagacatgcaagcagaggcttcttgcactttcaagcctcagacaagttcttggctaaatgagtgaccccagataacaaagagtgatgatataaagggtaatagggcaatcattagtgacattaacatcataatatgtgtatggacaatttgttattatcaatatattatttcctgctggttttctcataatgttttttcaaattatattcttaatgatattcattaatttatttccatttgtattggaacagctgaattaaattcagtgcatgtatacaatacaaaacttgacataatgcctctcttggattttacaaaaagtctttttacatttttaatgagaacttaatttttgttcttttaagaagagaggaaaatttttactatatatctttgtttttaacattaaaattgatgtattttgatgacttcacacatggaaaaattaggcctaaaacaattgtattaatttacaaatgtttcatttgaaatctttagtatctttttttaatattaatttagcccttaattcaaggaagatattagaggtatcaaatatatctaatcaacacagtttctacataataaggtcatcaactctgcatgactctggtactaatagtagatgtttttatgcctgtcagtttctaataaaccctgcctttctcctgagctgtgatgagcatacttaacagtacagttaagaaaggtgcttgtttcccattgattgtggatttctttcctttccaaataatatatcacaatttctttataatatttaattttcattacagttcatgtgatatatatatataattctctctttaatcagagctcaatcatgagcccttgtttagatcatagaaacagacaagacatttttctatgtgggatacaatggcatttccacagagaggcatcagtcttctgatctgtttatttgattgctttagcccttaaccagaaaacatctggcaaagtaaaccattgttgcagcactaaatctggaagtttttgtttttaagtttcttttcattctgtgaaaaattactttctctggaaagaaaagaaaaagctattactattagaaaagcatgactacacattgtgaatttttaaaatattgatcacaaatttcaacatgaatgtagatgcctacactattagaatgcttttacttggtttcagttttctagtttttgttaaaatatctccaccatccccactttaattttaggttattccaactagacattgagaaaggctgaaattctcatttgactacattttactcactttgaaaacaaacagataattgactaatgttctgctgaaacagcaaaggcatattcatatacctaaattaatagtgtttggcatatttatcttttgacatacatagtacaaatatatggccttatatatagttatctttatcctgtatctttacacatacacagacacacacacacatatatacatatatatgcatagttgtatgtatagacacacacagatataatctcggtattcctttatatatatataattactaaatataatttagaaggcattgaattgtactgtaaaaccatgccctagatttcattatttaacattatttcatcattaatttaacaaccatttcttaaaatatatttatttgtgtctcacatgcttacatacatacatatgctagatatatgtgtatgtgtgtacataagcatgttacatacaaacaagttgcttagaatcacatttatagccaaagaatgatttctctgtgttttggtaacacattccctaatgtctctattattagctccattgggaccaatttaaaactatccacccatgttctcatggattgaataaggctatatatcattgtttaaatgtactactcaaaaaattggaatccacggggaaaacatagaaacactaggtaaacaaaaatcatcttcccaaccaatactcttttcacaaagttttagaaacaatttcttccttctaatttatttatgatgtttaaggtattaagaaagaggagtcggaaatttaatttttattttttacattttttctcttgggaaaatactcaatattcacaccatgagatatgttctactatagcaaacccaggaaaaaggaaagggagattttatttactaagcaggttctatcttatgcaagttactgtgttaatgtctttatatacatataacccttggctcataacaatactgtgaatctagctatactcctattttattgaagtagttgaaattccaatgttatttgaaacgctttctatctggctcccagaattgcaatatcttcatgaacagaacttgctcattcctgcttatttacatcatttcacaatcatgccttttacaacttatatgcatacgttcctttacatattttacccattatttaattactatttcatatatgcaaaaatgtacttctctcagaactttatgcagctgccaactttgatacagatacattactccaattttattctcttttcctttaaattttactcctgtcacttactactttgtggagttatcatatgtattcttttcattttatgctttcattgtgtgtactccacagtggattgtaaacaaccttacaacagggaccatgtataattcactgatgtgtatcaagtgtctaaaactatgcttgtaacaaagtaagaattaatgaaatatttgtgattgacaggataaataaaagagtgtgtaaatgagtcctaggaactgtgataaatgaaattacattgtctttaactctgtaatggtgtcttgctaccagctggtaggcagaaattttcaggagctcaaattgcataaacccagaaagttttaaattaaaggtcaccatctggaattatatgcacacatacttagttccaaaacactggtttaggggaattattactttccagactcattcactaattctcaaaattgtttatttaccaaaaagtagaagttgtcactggagaattgtaaaaggccaatagttccatcttaattgaagactgtgtcaaactaaaatgatgctctgagtataaaaaacaaaattatgcattaatgtaatgtgtaacacactaatttttaaaaatcataataaagaaaaaacctatctaattgtgttgttaaatgcttatgatgagcataaaaataagcaaaattaaattattttatgaaataaataaaaacacggaaggcataatcacctaataatgcgtgatgtgcaacaaaattcgttgttatgtaatttaactatattgtgtatattttatattgatgtagttctacaccattcttaaagtaccataacatctattgacacagttaattctcacatgaacattttgaattagatatagaagatattttcttgtcccatttgtaataaaaaatcagttttaaaagtacaaagttatttctctaattcattctttgacaaacgttaattgaaaaattaaccaagttccaggcagtgagtaaaacagaaatattttctcttgccatagcatgttttggctataatagatgcatattagacaataaatacacaaagctgtattaaacaatatgacaaaaataatagcaaaaggttcatataattgggggaaacatctcaactgacagttcagggaaggctttcttgaggaagtaatatttgaacttaaacataaagaatcagtagagattacctgggaaggaaagactgaaataattatttactcattcctgaaaaggaattaatagatacaaatagcctaacatagaagggagctggcactaaaatctacatcttttaatttataatccaattttgttatactataataaagagagtggttgcaattcacttattctgagaaaataaacaaactaattaacaaagtagatgatattctaaactaagatacctgtctggctactatagcaaaggacaaatagcactggcagaaagcagagtattgcagaggtcatgccatggggcaattacatgccactgatagtgaaaccactgagcctattacttcatctattgactcagcaggttatacaaacagcattttctaagtgtgccataatgtgaaaaacagttgaatcaatggattaaacaagatagagttttatttctttcttaaataacaatctaagcacaatctgaccagaactattattgcagcaccactgcgtcaggggtccaggaccaattcatgttttgacactgaaatctctacagtgctaccccacaggaatggtccaagatgctacatgaccatatctgttctctaaattgtttgaaggctcatgtctttccaataaaagcatagtaaaataattgaacacatcacttctggcaatatcccattggccagtagataacaaatgaccatgtttaatttcaaaagagtctataaaatatagtctttcctttaggtgtgcttgttcccagctaaaattaaagggtttatattgttaatggccccttcatttgacaagaattgttgagtgacttctaggtgtcagcacttttctaaatacagatacattggagagatacataagtaaaccgaattaagatttctacacttatatttacattctaataggagaggcaggcaataagtaataaatactaaaataagtatattaaggtgtcttttcgttcataaatattatgaaaatatagaaaaaggaaagggtattgtagtagtaagctggtaaatatttcaaaactagctctgtaaaagaattccttacttgtagtgttttccaatttccatgcaggaaatacttccaatacgatcaattttaagctaccaatgtgatgtcaacaaacttgtgaaatttctaaaatatttgcaatcaactatcatgagcctaaacaacttggctccagcgtatcactggaatatatggaaggcatgatttggaattgtaatgtggtgatcgggagaatacataacacaataacatctgagctttgtggatatatgagagatgagtgtccagggatggaaacagccattgctaagaaatgaggatctggcatttttgaggaatagtaaacaagccaacagggctggtgccaagtaaataaagaggaatcatgttggaaatgaagtgaaagaggaaactgaggccagatcatgtacagtttgtttatgcttggaagagttttgacttttaatgttattgaaatggatagccagccactgaggagatttgagcaaagaatggcattctcttatcttacaaatatttaaaatgattcatttttaatatatttaacatatttaactatatttcatggttgattcaatatttaatggttgattcattgaaaatagactatagagatcatgtagaaggagggaggtaagttaaaaggttattgaaataattcaggccaaagataaattggtctaggctagcggaagaggatcagggtatatgaaagaaaatcaggactccatatattttgaaggaagaggcaataggatgtcacaaatgattcaagttttttatctgaccaactgcaaggatggacatagctctttgtggtttgacacataaaaactaaaaaacaaaaatcaaactcatagaaacagagggtagaatgatggctagcaggggccaggtttgggggaagccaggatgaagaaatgttggagtgtacaaagttctacagcatggtgaatataattaataataatgtactgtatactggaaaaatgctgacaaattttaaatgtactcatcacagaaaatgtcaaggatgtgaggtgactgatatgttaattaatttgatttaattattctataatgtgtgcatatatcaaaacatcacattgtataacatgagtatataaaattttgtcaatttaaaacattttattgcaaaaaaaattattttctctccacttacttttcatccaacataccatggtaaaatagaaatgtaactacaggaacagctcccttatggggtagggaataatggaaaacatatggcaggttactcatctaaatcagttatcatatctttggaggaattgcagacatctttggacaacaaaagaacattcctgggttagctcatatcacaacctctggttctgttcattgtaaagcaaatagaatcatctgtccatcatccttattgcccccaactttgcctgctggagcttccttcattggttattgttctctatctgcaaatctgaattggccagtaaagtgcatgcccaccctgagactttatatcattccaaaacctatccagtgagtacagtctctaggccatgggagtgattttaagtgtcaaacaagcaatggcctttacaggttaggcatacaattttatggtgaatataatcttctggaaacatagtggactttgtatccgtttctattcagtgcaatgaatgaaacacagacatggatatattctaaatgtaagtattaatcatgaaaagttttatcttacactgcattctatccattccttgctacacactccttcatggaggttaccttgaggctatctgaaataaaagcttaggtgcgatggtaatagccataatcccaattttgtggctgaactgcttcccatggcctgccaaagagttcttcatggtagttatttaaatgcatgaggccacagtctctcctgtttccaaaggtgcctcttcagtcacctcttatcaccactttagtttggtatacaaaaaccattggatttttcatcattgtcaaggctcaaattaccagaatttgggtaaaatagattgcagactgaggccaaaacaatctccttttacaaagctgtattctctggtatctcttctttgaaactctaggttttctatgatgttgtctctgctgtcttgccgcaaatgttaacaagaaatcaacacttccagtattttaattttttcctattggttccccttaaattacaggctcctttggcctgtattctaacttctgagattcccattattacagaaagtctattggacaaatctggtaacaaatggtttgcttttacataatcagggtagctgaccttctagtctacaacatctgtgtccttgagacacagaaacaccatgctgatgattccttttgagacttcgtaacagcaactctacttctggatcaaatgttgtttaagtttgtttataatttcaagtgatataacaatatcaagctaaaagtggctttaaaaagttatatgtttttatttcttacaaaatagtacaagtgaaaatactccagagatagggaccctgtcttctaacttcttgttctgtcatccctaggatattgcaattgtttatatacatccatgaagattcctgagcaaaatgtttcaatgttgaaagtagaggttatatccattttatttaggaatgcaatctgaaagttgcacttgcatttcattggcctgaactcaagcatctgagtatttaagacaatcaaatgtgactgaaaagtagtctctatttttgatagataattccgtctctaattttaaggttatattactaaaataataatgttaaaaacataatcaatattgggtcatatctcaaaatctatgctcaggtttcacatatttttcctagaggctaggtaattgtacatgtattttaaatataatgcatgtaaaacctaagcccttaaaataatgttttcacttcaagtttaagagtttaatccaaagtgtgaaattgtttacattctaaaacccatttcacaactttatactatgtaacaattattgtattatattctaaccctgattttcttcatctggtaatgaaagtcatatttttactcgcattggtttatgagaagactaaataaaataaaaatcgaataatattgagtatgaatacttattatgtgccagactttaagtgatttctatgcagtagtcatttagtcttccaaacaattctatattttagacacagctgtttttcttattttccaaacagataaagcaagtcacaaatcccgtcttcacttaaggttgcagagatagtggctaaagtggctaaacttctataaattctgactccagaactcccactttcatttaatgcactatgtaaacaatttcgcacatttcctaaatataatatgtgccctgtatggtatgctgaataatctctccctcctcaccaacatgtccgtatcctaacttctagaacctgtgaatatgttaggttacatggcaagagcgaataaaggttgtagttgggattgagattgctaatcagatgatctaacataagaagttatcctttaacattgaggggtgggcacggtaatctcaaatgtcttttaaatgtcaaagagtgaggcagaagagtcacattcaagagtgatgcaatataagacttgaccagtccatttgcctttgaagatggaaggaagctgtgagccaaggaatgcagggagcctctaggagctggaaaaagattggaaacaaaaagcatgggggctttttgagagcccccagaaagaagtgtgatcctaccaacaaatttgtggtaactggttaaagcagccaggggaactaaaatagcatctaaattcacacataaaattaagttacacattttactttttatgctgttttgttttggacagaatgaatcacaaaatatttcattttatatatgcatctgtgacattttaaatagaaagtaatcttggactattaaaattgtgcagaattaacacatgaaagaaatatatgatatccttccaagggcgattttgccttatctttgtgtttttattggtctgttgtaggttgatacattttttttttaacatctggcaaatacttttgctttttgtggagggatggtatacatttttaaattttatttttcattgaggtaaaatatacatatgaaattgaccatctttataattttcagtttatatttcagtggtgataaatacatttatatttttttcttccctatatctccctctccccactactcttcccagtctctggtaatcatcatgctgctctctatctttatgaatccactttaagctgccacatatgagtgagaatatgtggtatttgacttcttgtgcttggtttatttcacttaacatatggcctccagttccatctatgttgctgcaaatgacaagattttattcttttatgtgactgaataatattccattgtgtatgtataccacatcttctctatccattcatctgttgatgcttatgttgttttcatatcttggctattctgaatagcacaggagtgcagttctatcttcaacgaactgattttattttttgatgtatacccagtagcagaattgctggatcatatgatagttctagttttaggtttttgaggagccttcacactgttctccaaagtggctgtactaatttacattcccaccaacagtgtatgaggattctcctttctccacattcttgccagcatctattattgcctgtgtctttcattaatggcattttgactgggtttagatggtatctcactgtggttttgatttgcatttccatgatgattaatgatgttgaacattttaatatacactttatccttttgtatgtcttcttttgagaaatatctgttcagatgttttgttcattttttaattagtttattttattttttgctattaagctgtttgtgcttcttacatattctgattattaatatcttgtcagatgggtagtttgcaaatattttctcccattctattctttgtcttttcactttgttgatggtttcttctgctgtgaagaagctttttagcttggtgcggtcacatttgtccatttttgcttggttgcctgtgtttttgagttcttatatacacaaaaaaaatatttaccaagaccaatgtcctggagcgtttccacaatattttcttctagtagtttcatattttcaggtgttcaatttagttttaaatttgctttgcttttgttttcatgtgtggtgagaaataggggatctagttttattcttctgcatatgattatccagttttcccagcaccatttattgaaaagactgctcattccccattgtatgttcttggtgcctttgttgaagatgagcgtggctataaattcttggatttttatttgggttctatattctgttccattggtctgtgtgtctgtttttataccagtactacgctgttttgtttatggagctttgtagtcaactttgaagtcagataatatgatgcctccagctttgttctttttttgtttaggattgctttggttatttggggtcttttgtggttttatataaagttagtactttttacttttatgaagaatgtcattctttggtgttttgagagggattgcactgaatccttaaattaccttgggtaggattgtcattttaacaatattaatacttccaatatatgagcagggaatatcttttcttttttgtgtgtcctctttaatttgtttcatcagagtttcatagttttccttgcatatatcttccacttatttggttagattgatttcttagtactttatattcttgtagctattgtaaatgtaattgctttcttgattttatttacagatttttcactgttggcatacaaaaatgctacagattttttaatgctgattttgtatactgcaactttactgaatttgtttatcatttctaacagttttttagtataatctttaggattttctaaatataagatcatatcatctgtgaacaaggctaatttgacttctccatttcctgtattcttatttgcatgctctttatattgtcttcaggtatgctccttctatacgcatttggatgagagtttttatcataaagttatgtttaatttttaacatatgcttttttgtcattgattgaaataatcattcttcttgattctgcttaatgtgatagatcacattttttatttgcatatgtttaaccatccttgcatcctgggatgaattcgacttgttcatggtgaatggtctttttaatgtaatattgaattcagtttgctagtatttttttaaaaaatttttttgcatttatatcaagagtgacattggctggtagtattttgctgttgttgctgtgtccttatctaggtttgatatcacggtaatgctgaccttgtggaatgaatttgaaagtattctctctcttcaatttttttgaaaagcttaagcgtgattagtattacttctttaaatatttggtagaattcaacagtgaatctattcagtcctgagctttcctttgattggagactttgttttattacagcttcaatctcattacttcttattgatttgttgaggttttctatttcttcatggttcaatcttggtacattgtgtgtccaggaatgcatccatttcttctagattttccaatttgttggcatataattgttcaatatagtctctaatgaatgaatctttttatgtctgaggtctcagttgttaggtctccttttttgtttctaattttatttattggggtcatctttgtctcttagtgtagctcaaggtttatcaattttgtttttattttcaaataaacaacttactatttccctgatcttctgtattattgtgatctcaatttcatttatttctgttttgaactgtatttttttcccgtaactaattttggtttagtatgttcttgcttttctagttcttcaaaatacattgttaggttttttatttgaagtcttgctacttttttggtataggatttattgttataaactttcctcttagtagtgcttttgctgtatcacatagaattttggcacgttttgtcttcactttcagtctgtgtctccaagaaatttgcttcacctatattgacacacatagactaaaagtgagggggtagaaaaagtattccatgcaaatgaaaaaaaaaagagtaggagtacctatacttacataagataatatggaatacaaatctaagattgccaaaagagacaaagaagataagtttagagtgataaaagggtcaattcagcaaggggatatagcaattataaatatttatgcacctaacaccagagcttccaagtatataaagcaaacattaataagtctaaagagaaagagaaactgcaatacaatagtagtagacaactataacatcccaccatcagtgatggacagatagatcattcgtagagaaattcaacaaagaagcagcagagttaagttgccgatactcttttaaaacttttaggatgtttttcatatgttgtttcattcttatacccatctataatcactttaattatacttatgttcatttttcccttgtgaagaattttcaaaagtttgtttttcctatttcattagtcagttcgaagaaataatttttgaatttattgatcatgtctacttttcttggcttcattgtaaattactttgagctttcatctttattaatttcttactcccactgccctagtttatgaagctgttatactaacttctccaataaaatgttgaggtcatatatgaccaatatttccagctttgacataaacttatttaaggctattgaattttgggtctttgttttggttgtctctacaggtgtattgaaaagagtgctttcatttttagataaacttagtacaattttagacacagaaaatgtctgaagatggtatagagtcccatatagatcaacctaatttcagccattaaaatctgtagtatacttgttacaattaataaaaattattgataaattattattaaaatttatactttattcattttttctttgtttacttcatgtttttgttgttgttttaggatcccatccaggataccacattatattattagtcatgttttcttaggcttcttttgactatggcagtttctccgacttctcttggttttgatgagcttgacaattttaaggagtattggtccaatattttgtagaaggtccctcactggaagttttctgatgtctttatcatgaatagctattttcatcatagcatatcaagcgtgtatactatcagcatggtttattattgttaatgcaaactttggtcacctggctgatgtagtgtttaagtttttccatggtaaaattactgttttgtttctttttttcatacttagccctttggaagtaagtcacggtgcacagtctacactcaaggagtggagaattgtctacaagattcatgtgggcagaataagcaacataaagtatttagaattattctgtatgagagatttgtttattcttccccatttatttattcatttatttttaccaatatgaactcatggatatttattttatactttggattataatccaatattaaattttgttgttcaagttttgccaactggaagttctttcagttgccttgtgtccctttggcacagcaccataattgtcttttctttggggggatatcttcattaatttctgtgactacaggcagatcgttataattcctatctgagtactagaatcagctcattctccaaggagccttggtttcatttattggagaataagaaacaaagatctgagtgctatgtgtactcattgatactgggatattattgcttctagaccctctcagttgacagaggaaggaaacatatgtgtgtatactgtcatgtatatacacatatttataaatacttctgtatacaataatctatagccctatttagctaaacatgagctcataatgatgtccaactccaatacattaccacacgaatcattttaccttcttcttttgcttatctgataccttcccaacagtgagaaatctagcttccattatcagttatcccatttacaaaattatgcgattctagaatgtatatatagcaatatccaaacttttaacctgtattctcttggggataactttactaacaagattaaatgcatatgtagtttattttggttttcctttttttatgattgacataataatttatacatatatatgtggtacaacatatttcaatatatgtctatatacattgtttaatgattaaatcaagataattagcatatctatcatcctaaacttgtatgatttatttttgatgagaacattcaaaagcctctctcctagctgttttgaaatatgcaatacattattgttaattatagtcatcatagtgaggcaggaggatggggagagattgatcaatgggtacaaagctctcactgcctggcttctcaagggcacttgctcggatctcagagcagggatggtgctgaacctgggcgctgtcacagccctgctgggtgtgcactcttggggcactactgacatgccagccccctaccgcctgggtcccctctggaatttgagcactgaggagcttgagtggggaagctgaggggcaggtggagggtggctttgtgatggcctgaaggtaccccttggtgccagcagtgtgggcatgatgaacggctgtaggaggtaggcaggcttctgggtggaagtgggtgtgtccccagtgacgccccacttcaggccagggcaggcctgaaacctgggggctgtgctgctagtcctgcagactagagagggaactcgttgtgctttttcctggccccactccatggctgcccatggaacaattagcacacgcttcctgctctgaagaccacaacagccccaggtgcatcccgagcagagcagaggatggtacaacccactgcagagaggagctaccctctccagggcctcctctctactgagagctgaacactcgacagaacgacctgcctacacagtggagctacccactgtgggtccgctctgagctgttctaacactcaataaagctcctctttgtcttgttcaccctccacttgtctgcttacctcattcctcctggatgcaagacaagagcttggacaaaggtgccaccagccacagaggtttgtggccagaaaatcgatgccccaaagatcctgcaacacttacttgctgtctgtatattttctttggtgaggtgtgtgttcagatttttgcctatttttgtaatgtggttctttcttactgttgtgttataacattttttgcattttttagagaaaagtctttaatcagatatgttttctgcaaatatttcctctctgtggctttttgttttcttagtggtgtgttttgcacagtgacctatgaaattttaatgaaatctacttaccaaattatttttcatggattgtgctttcagtattacatctgaaaactcgtaccaaacccccaaattacatagatttttctcttacattttattctagaggtttccatagttttgtatttttctttcaggtctatgggtccaatttgaatggattattgtgaatgttgtaagtcctgtgatatattttttatttatttttccctttttatataggcatccaattattctagcattatctgttgtaatatatattctttcttttttaatcacttttgctttttatcaaaaatcctttgactatgtttgtgtgtttctgtttctatgctctctattctgtaccatcggtttatgtctattatttcaccaatatcatgccgtcttgattatctttagtaagtaattttggtaacattatagaaagccttaaaatcatgtacagtaggtcctcaaactattttcttctgcagtattgttttgactattttagaacatttgtctttccatataaaatttagtcagtttgttaatatctaaaaaaatagcttgttgtgatttttactgaaatggcattgaatctatcaggttaggggaacttttcatcttaaaaacattccatcttccaaaacatgagcatagattattatatttataatttttatttattttcccctaattttgtagttttctgcattctgtacatattttgttagatttatatggaggcattttaatgctattgtaattacttattaattttaaattccaattgttcattgcaactacataacaaagtagttgacttttgtatattaactatatcccatgaccttgccatgctcacttaatagttccatttccagaaagtgttttagtatgtttattggtcggttttgtttcatttttgattctttaagattttattcatggagaatcataccatctacaaataaggacaggttcattttttcctctgcaatctgtcatttttatattctcatcatattgtatcagttagggtttctagtataatactgaacaggagcagtgaggaagaagaacattgtctttcccagactaagaagcaaagtatccagtttctaaccattaaatgtggtttctagtttctcaccattaaataggatgatattgctgtaagtttttttatgttctttaaaatctgaggacattcctttctactcctatttttctgagttttttgtcattaattgctgttggattttgacaaatgcttttccaatataagttgttatgatcacaagattcttcatctttatccacttatatcataaattacatcaattgatttctgaatgtttaaccatccttacatatctggaataaataccctttaggacataatttatatttgctatgtattgttggatttaatttgctaatattttgtgagggatttttgcatctatcttcctgagagattttgctgtgtattttttgtcttgtaatgtttttatctgctttgaatgtgaggataatactggccttagagaatgagtttctactttattggattggttgtggataatttgtatcatttaatccttgaatatttggcggaattcaccagtggcaacatctgtgtcttcgtccatttgggctgctataacaaagtatcatatactggatagcttataaacaacaaaaatttatttctcatagttctcatagaggtggggagtccaagatcaaggaggtttcggattctgtgtctgatgagggcctgcctcctggttggtagatggctgtcttttttacatgacctaatcacttctcaatggccttacgtcctaatgtcatcaccttgggatgaggatttcaatatatgaatttggaaggtggtgaggagacaaaaatattcagaccatagcaatgtgggaaggtgctttccttttggaagtttattaattattggatcaattattttaacagatactgtcctattcatattttctatttctccttctataaagtttggcaattgtgtctttcaataaattggttcatgtcatctaagttatcaaatctgtggatgtacagttgtttatactattcctttataattcttttaatgtctatgggataagtagtgataaagttatttcatgttttacattgctaaattgtgtcctttttttttcttgcttagcttggctagaggcttcgtaattttaatgatctttctgaaaaactagtttttgggttacttgattttccctattgtatcactgttttctaatttattgactttcattttaattttcattctttcttttcttctgcttgtcctaggtttaaatttttcttctttctttagtttcctaaggtgtaaacttaagttatttattttagcttcttatcacatatacacatatatacatacacacacacacacacacacacacacacacacacattgatatggtttggatctatgtccccaccaaatttcacgttgcattgtaatcccatgttggaggtagggtctagtgggaggtgactggctcatggaggtgttctcatgattgggttagtaccatccccttggtgctgcttttgtgatagtgaatgagtgagttatcctgagacttggttgtttataagtgtgtagcacccccacccccttcctcctgctccagcaatgtaagacacctgctcttgctttgcctttggccatgattaaaatctccctcagccttcccagaagcagatgctgccatacttcctgtacagcctgcagaaccatgagtcaactcaatctctttatttataaattaccagtctcaggtatttttttatagcagtgtgagtatggactaatacagacatatgctaaatgtttccttttttattgcactgtttttgctatattcctacaatttttgctaagttgtatttccattttcatttagtccaaaatatttttaaattcctcctgacacttcttcttgacacatgcaccacttagaattatagtgtttaatctgcatatttagaaattttttcagatatctttacgttgctcatttttaatttaattccgtggtgggctgagaacatactttgcatgttttctaatttttttaagtttactaaggtgtattttgtagcccacgtagctgtctatcttggtgaatgtcccatatatgtatgaggaaaatgtagattctgtagtcattggatagggagtatcctgtcaattaaatcctgttgattgatattggaattgctattaaagttaactatatcctcattgatattcagcatgtttgatctatcaatacctgaaacagagataccagaagtttccaacttggatagtaggtttgtacccttttcctgtctattctatcagtttttgcctcacatgttttgacactgttgttaactgcaaacaagtttaagattgttatgtctttggagagaattgacacctttatcattttgtaatgccagattttatcactgataatcttccttactctaaagtctgttttatctgaaattaatatagctacttcagcttgctttgattagtgttaacatgataaatatttatttatccttttacttttaagctatttaggttttatactgaactttttttatgtatacaatatatgatttggtcttggattttttttaaatctgctttgacgatttccatcttttaccttaagtatttaagtgcttcacatttaaagggttattaatataattggattattatctaccatgtatgtaattgctttttattcattgcattttcttggtttctcttctcctccttcccccccccgcccttttattctctgtgtttcttttcctttctttctttttttttttttaacagaatctctctgtgtcacccaggctagagggcagtggtttaatcttggcacactgccgccttgaaccccccgggctcaggtgatcctcccacctcagctgtagtaggcatatgctaacatgcctggctaatttttgtattttttatagagacagagattcatcatgttgcccaggctggtctgggactcctgaaagttccacctgccagggatttccaaagtgctgggattaaaaacatgaaccaccgcactcagccttctctggttttaattgaacattttgtatgtttaattttatctctattttgtataccattacttctttgaagcaattttttagtgttggccctggagtttgcaatacaaaattttaaataatctatgcataacttaaagtaacactggtctgatccatgtataatgataactttataacatagtattcccagttcctctattttgtatttttttctgctatttccagaaaatttaattttatctttcttgaatttcttgaaattatattgctaggtttataaagatttatcattaataggtttttagtggatatttctctatataacataccatttttgtaccatttaatgtacttgcattgtactatatttagtaaagggaaatttttataagggaaatttatagcatttcaatatcagaaatatatgctttagtagcattatcgtgttgttttgtgttttctatttatttttattgtcttgtctttctcttctcattgtctttattgagtttattctgttttttgtttgttttcattctagggctttggaatctaaatctgtttctttcatttaatagataatattaaatatgtaagagctgtatttagcttctgcctttctattacaataagaaggatatagtgtctacagtgtctttacccagaacaagacaggacttatagcaatacagaatattttgttgaatatgaatatgagaatatgaattctcagttttcatcacttttatttgacacattgcatctttttggacgagtttcttaattacattaagcttcacagacacctcattaatattttaggactgattatacgctttactgattcttttctcatattgattatgtgtgtgtgtgtgtgtgatgtatatcttattctttttatctcaagtgatccttttaggatatggcttatgttcttgaatgctaaccatcctcaatctttgtctcaaatagtctttattttgcctttgcactttaatgatcattttgctaaacctagaattctaggagcaaaagaatattttctcaaaacttttggggtattcttgacgcagtgtttgaggacaatataatactttttcctgttgttggtagtctttttgtttttctctgaaacttctaaaaaaatttatctgggtattataatacttcatcagatgtttctgagtatagatgttgtatatttattcttcttgaacaactctttcatcctaaaaacatgaacatgacctttttcctattattgctttgatcatttcttcctttttttttcaatctctattatttcctttttttttttttttttttttttttttgagacagagtcttgctctgtcacccaggctggagtgcagtggcgcgatctcagctcactgcaagctgtgcctcctggattcacaccattctcctgcctcagcctcctgagtagctaggactacaggcgcccaccaccatgcccggctaattttttgtattttttggtagagatgggttttcaccgtgttagccaggatggtcttgatctcctgacctcatgatccacccgcctcagcctcccaaggtgctgggatcacaggcatgagccaccgcacccgacctgttatttgcttttagaagttctagtacagaaattttgtaacttcaccttctactcacaaaatatctaacttttctttataacttagctttcttgtgtttactacatgatagagaatatatttgaccttttagttcagtaatttatcctttttttaaatttagttttattttagattgaggggaacacttgcaggttcattacatgcatatattgagtaaaggtggactttgtgcttctcgtgtatccaccacccatatagtgtctattgtgcccagtaggtaatttttctttaataacagtaaagttttgcttatttgttgtattattattattgcagtagttttatttataattgcagagaacttttggtgtcttcctcaattttcagtgtcagagtagcaaattaactggggcatagtccaaacttctgagatccttggagggaaatatcacagtggccttggaatatgtcttttgagaagattagcatgagcactgaactataacaaaagcaagccatgacaggtcatgtgctggtacatgagccaggcattgatattttagtttctcgatcctgggactgttcaagaaactaattaatcctttagtttcttgacacatacaatgctatgtgtgtatcagttaaatagaagctttgactaacagttaatataaattctattaactaaagccttaatttgggggttaacatgtggagagggagtataattagaagtagagcaaaaagaaaatgggccaggtgcggtggcttatgcctgtaatcccagcacattgggaggccaagacggatggattgcttgaggtcaggagttcgaggccagcctgaccaacatggtgaaaccccatctctattaaaaatacaaaaattagctgggcatggtggcatgcacctgtaatcccacctgtaatcctcagcacaggaggccgaggcaggagaatcacttgaacccagaaggcagaggttgcagtgagctgagattgtgccactgcactccagcctgggtgacagagcaaggctttgtctcgaaaaaaaaaaaagggataaacaggctttgttagtggtgaagtctaagcaagggataaacaggctttgttagtggtgaagtctaactagttctctcttttgggtcagctttcatgacttatttgaccaatagaatgggcagaagtcccttctgagacatccgcacctaaatcctaagaagtattgctgcttccctctggtcctctggaaagtacacgctgtctattctaagaacttcgtactgtgataaagccataatgagtggttttaagatggagaaacggagattcctgaacagcttttactgttctaaacaaaccagatcaggtataagacatgtgagtacaaaagcctttatacaaacccagtcttgacaactatccaactacaagtacacacaaaactcagggtgggaacttgatttagttgcttctttcttggttaagttatttatttttttaaagcatggcctaaaacaatttcataaaataaggcatagcattatgcttcccatgacaaatagtcaatattcttcctcagaactgtataaggttttgtttattgaatgtctgttatccagtttactgatgaaaaatctgatgctgggcagtttctcaggccttcatgagtgacctcattcaataaatttttggaagcttttagggtcatctttgtatttttgatattgtaaatttttaccatctgtagccttgcatgttttattttttggattgtatatctgatgattcttttgtcctaaatttttgtgtatttttcctgttaaatgatcttgtattacatttttgtaatattttcctcatcattattctgtttccttttaatgcttaatcttttagatttattttctcagtctcaccttatcttagttttcatatctttgatatcattccactttttcagtttcccctcaaatgtctgccaatccttaactcttcattcacattttaaattatatgaacaaaattctggtctggagtctgtgagtacataggataagagttttgttaactggtgtgcctcacaactgtggtggttggaatgagtgatcggtatgttggaagacatataatgtgaaaatatggagctatttgctttaggggtcaaggagtatacaaactttttttccaaggtcgttaatccaatttctttagatacgttttttagcctggtgtttagaagcttagccctcagacacactactcatagagatgtgacaataaggttggaataatcagttctcatacagattttcaataaatccattggttacttgctgccctctcttagtcttggagcttctgagaccctgacctctctgaggttcttcaggaaaaattgcaactcctttagtcacagttccttccatgcataccccagttgttgcctcctctaacttggtgtagtcagggaagttgcacatctgactgcagaaccggagcatgactggaggatccttgatctgctgactgtctcctaaatattcgacacaatctccctcttgttgatggttcccatgctcccctttgttctatgtttagcctccttctttgtttctttttctactcttttaatgaggacttgaaatacagaagatataaatgtatgtaataattcttccgtgtttgacttaaagtatcttataatatttttcttttaccttcatttattatttttcttatgctttgcctttatcttgatccaaatttctgcgctgtatcatttttctttttgaataatttttttaaaaagtatgtcatgcagggcaagtttacatcagttttttttttttttaaatacttcataatatcactgtatacagaactctaggttggtgggttttacttctttccacagctaaaatatcccactctactctctccttgctttcatggtttctgaggactggcatatgtaattctttttttttttttttttttttcagttggagtctcgctctgatgccaggctggagcacagtggcatatccagctcactgcaacctccacctcccaggttcaagcaattctcctgcctcagcttcccgagtagctgggactacaggcataccccaccacgcccagctaatttttgtatttttagtagagacgggtttcagggtttcaccatgttggccaggatggtctcgatctcttgaccttgtgatccgcccaccttggcctcccaaagtgctggaattacaggcatgagccactgtgctcagccaggcatacataattcttatatttttttcctctgtaggtaagatctcccacagtgtctggcatccttcaagatttttgtcttagatttgctttcctgaaatttggatatgatatgtttcggagtatattttgggaagtatttattctgctctttcttgaggtacctggatttattattaaaattatcagtcaacattacttcaattatttcttctgttcctttctttctttaattctctttacagtactcctataacacctatgttacacctgttgcaactgacccacagttgttggatgcactttactgtattgtattgctttgttgcattattctttaaattagctttgcatattgtgaagtttctattgccatatcataggtttactgattctttccttggccatgtccagtctcctgttgagtgaatcacatcaaatgcaatcttttttgtttcagtgttttcgattctagcatttgattttgatactttcttacaatttccatctttctacttacattacctgccaggtctgacccacagacactggccgaacaacggatgaacaaatgcactctgacaccaatatccagtgaaagagcaggctaggagaccaggctgcccacagacaccaaggagggtgctgttaagagtcagcagccgcaaccccagcaagctggcgctgcaggcatttattcagtatagctttaatgacaaaggctttgagtcaccacacttgtggataattaacatggtcaccctccccggagggagcagtcctacaaatgatcaaaggtcagtcttaggaccacatgagtaaacaagctctttagataaactcccttacattcctttgtacctattctaagctattatctcaaggtaagaggattgggctgccttcggccataaccctatctgaggcttttgcaaaagcttccagccttccaagaaagtttgtttctattttacaatttctcccaccatcctgactgaactcctacaattacccatcttttctttgatgctgttcactttttccacgagagcccttggcatattcattataattattttcaattcctgatttgataataccaaattctctgtcatatctgagtctgcttgtgatgcttattttgtatctcaggttgtgttttttgccttttaatataccttgtaattttttgttaaaaaccagctatgatatatcgaaataaggaactaaggtaaattggttttttaatgtggggttttatgtttagctgattggtagctcggctgtttattgtatgttctagctgtggtgtcagaagctaaaatttttctctagtatctttgtatttttctcctctgctgtctttgggttttcctagaatctggttaatatggtctgagtttcagttatttttaagctacagtcccttgttaatacaaaagaaccctactaatgtgttggtaaggtgtgggggaagtggaagcattatgtaatcctatgattagttctcagtcttttagtgagtctgtatccctgtgctgtggactttcacaagtacttagcttttattccccttaggtgagaccaaaacggtaagggaaattgcagttgtgtattttcctacccctacttggattaggctctagtaaagcccaaataagttgccctttggttacatactttcatttgaggagaaaaatttgctaaggaaaacagagtactctggatgtacttcaaatagttacgttttcccttcatcaggagcatgagagaatttttcatgtatcttcacccagagaatctggcagagttcccagactcatgaacatgtagggcttccctaaagctgagctcccgggagttttaatttcaagctggtccatgctcagtcttctgtcatttaccttttaaataattcagtcaattaccttttaagtgttcctacctctccagcagtggtttctgtttcctgtgaggtgtgattctttgtgttgacccgtctttccaattttcagttagtagtttgccttgcaaacttaattctgtgatggatctaatatgagttcttgattttcagtttgttcaaaaaaaattttttttatgttatgtagatagaaaagacaactttaaagttctttacatgtgggtccagaaactgcaaatgtccagtagtttctctgtctctctctctctcttttgcatctcaacttcattcaaattgcatacatacacacataaaacaactactaaaacataaatggacagtatgacatgcaaatttcagaatagtttatgtgtatgggaagaaaacaattagaatgtaggaagctttgcttataattgtaatgcctcattctattaaaatgacaaaaagatctgaaacaaacaaggcaaaacattaacttttgttagatcttagtggtataaacccaaatgcttgtttagtctatctacttttttagtattttcaaaatattttcagtaaaaatatttcaaaatctaaccactgagatgaaactaacagttatagttgtaactaagtatgtctgtagtacaaataatgttgcaaaaaaatgctgaagtttggaaaattgatttttaaaagaaaagcccttataaagaattgataacttaaaaattaattctaagaagacaaagacaaaaataagtgaatacataaaatttatgttctaatttaatttttttatggagagatgctaattatgcatgtttcttaggcaagttagctaaatcaatcctgaaattatgatggtctattcattcatttctgaagacatgcaacttctgctaggaatgactttctcttcttttgtatggttagcagaggaggaagcaagaaaaaaaaaaaagaagaaaaaagaaaaccttaagtctattgtcatagttatctcaataaccaacaagacgcagtttctagtcaaaatacataaagtggacaaatatatttttaaaaagtcctaacatatgctgtctacaagtgagtaaatttggctttagggacacccatagactggaagtgaaggtatgataaaacatattccatgcaaacgaaaacccaaagaaaacaagggcagccatacctatatcagaaaaaaatagactttaaatcaaaaactacaataagagacaaagaacgtcattatatagtgataaagaggttgattcattaagaggatataacaagtacatatctatctatctatatatgcacccaacatctgaacacctaaatatgtaaagcgaatattaacaaatctgaagggaagaatagattacaatacaataatagtaggggactttggtaccccatttctaataacgactagaatatccagacagaatatcagtaaggaaatgttggacttgaactgtacttcagacgaaatgtgactggcagacatacacagaatatgttatttaagagcaacagaatatgcattcttctcaagtgcacaggaaacattatccagggtaaatcatatgtaagaccgcaaaacaactcctagctcttaaaatatttaagaagattaaaattgtatcaatcgtcttttccaaagagaatgacaaggaatcaataataggaaaactagaagattcaaaactatgaaaattcagcaacaccctcctgaacaatctatgggtccatgaagaaatcaaaagggaaatttaaaaaactatcttgagacaaacagaaatagaaagacagcactactaaaacttatgggatactgcaaaaactgccctaggagggaagcttataatgataaatgcctacattaagaaaaaagaaagattttaaataagcaatctaactttacatcttaaggaaataaaaaagaagaacaaactaagtaaaaaattagtagaagggaaaaaagatcagagcagaaataaatgaaatggagtttagaaaaacaatagaaaagaaaaataaactaagcatttttttgaaatcataaacaaaattaataaacttcagctagactaagagagaaaactcatgtaaaatcacagatgaaataagagacttataactgatactacagaaatagagaagatcataagaggctattatgaataattatactcaaaaaaattcaatattctagaagaaatggctaattctggaatcatataacctaccaagactgaatcatgaaaaaacagaaaatccaaaaagaccaataattagtaaagagattgaatcagtaatgaaaaattcccccaccaaaaaaaaaaaaaaaaaaaaggccattaccaggtgacttcccaagtgaattctaccaaatatttttcttaaaaattaatatcaattcttctcaaactcttccaacaaattaaagaggcaggaacatttccaaagtcattttatgaggtccatattaccatgataccaaagtaagacaagggcactataatgcctctctaaagtggaaactctagttcaattctttttatcctcatttctcatgtagaaatttaacaaaactgtggaagtaaagtatttgcaaatattgaagaatctatagtatggcatagttttttgagaaatggactccctaaagttctttagagacaagttcttgtcttgtttttatttaatattttcagtcatggtacaattatggaataaagaatactcttatttttgttttgaattttcaagtgagtggaatgttttttcaatagctcgtaaatatgaattaaaattaaattgtgagttcaatatgagttgaatttattaaatttcaaaggtttcttgtagagtggttcatttagatgagtaaatagagagagtggtatactgacaatatcacaattgcgtttgctgtcaggacaacctaacccagattctcagtccatgacacagcatgcaaatgtcatgctaacactcagatacgaacacatagccaatcctatatcaatgctatcctattcctggatagcatcgtgccataaggaaccagtttgcaggactcatcattgaagtttggcatttcagaagagaaagattaatgccttcctttttttatataaaacaacagccttatagatttccatctaaaaataatttcttcatcaaatatattctaaaaaaaattttgcttactgcttatagctccctcttgagtattcaaatatatactaacatattaacagctctgagaagtcatattgcaaaaccaactctttaactttacttaaccagcattgcccaaatctgtttgaccacagagcattttcatggtgtgtttcagttattaactctatggtatactatttgggaaatattgtctctcaattgtttaagtcatttatgcaagtgtatggaatagtatgattttcattataagcctacatttagaacaatgtttttgtattgtaacatcttaatttgaataaaggaaccagtacaattaagttgtgtgatttttaatggtataactattctgaatacaaaatcttaatttgccgtttgagtattatgttttactaagatatacctatatgaaattgatcaaaattccccatacagtaattatagaaattttgcattgcacagctgttgggagaaatttaatcctccccaaataaagatgaggtaagcttgttttttcttaaacatatgacaaagaaaggtccagattcaacaatagatacaacaaataatttggcaacacaaactatatgccaaatgtgatattagtaggttcttccatacctccaattataagaaattattacaacacaaacatagctgacaacattgtttccagaagtaagtcatggcacataactgaatctgacttcccaatttattagtgtgttccagaaagaaaagtgtgcattgctttcatttcattttaacaatgtcatctgagataccatatatatatatctatggtgtttttcccacctctttctaggaaaagccaatactttatattatgtccatgtattagtcagagttcgctagagggagtggactaatagcatagatgtatatgtgaaaggaaattgttaaggagtattgactcacacgatcacaagttgaagtcccacagtagtccatctgtaaaatgaggagcaaggaagccagtccgagtcccaaaaccacaaaagtagagaagccgagagtgcagccttcagtctgtggccaaagacccgagagctcatggcaaacaactgatgtaggtccaagagtccaaaagccgaagaacttgcagtccaatgtttgagggcaggaagcatccagcatgagacaaagatgaagcctggaaaactcagccaatctagtctttccatgttcctctgcctgcttttatccttgctaccctggcagctgattagatagtgcccacccagtccactaactcaaatgttaatctcctttggcaacaccctcacagatacacccagcgacaatactttgcatccttcaatccaatcgagttgacactcaccattaatcattacagtgccctttcttagcttatataggacactagtaggaagacctcaatatgtacaaataattacattgaaagatttatataccagcatccataagccaggaatcatttttaaaaacaagttaaaaaaaaataagggatgcatgagttgttttgtttaaatggtcttgataaatatttccccatagaacatagcgcctcctagaactgcatccccatagaacaaagaacaggcatacacattatggtcatatcctcaaagcagataaaaaataaaaacatatcttactttctgtaactgtcaccaagatactcctcaacattttatgacaaattaatgaattgggtcccatcaactttttcagattcttttctatcaaaattatattaaggataccaagagaacagctaatgatgacaaaatatatctaagcaatatggtataatttatatttaaactaattgctcatctagataatttaattaagcaaatttccataataaatttgatgtgatcattttgcatttttttaaaaaagaaaaacaatagcctcctgttgtaacagcaaaaatgcggagaaatatttatctttgtttatctgttagagtaatcaagtgtgaatttcttgagggttttgacatttgcaaaattgtaaaaatttcactaaaacaaggtccatctttttcttcttcataagaaaactatttgcatggttaacatttggaagatgtttggaagaccttatgcattgataaagaaggtgacaagcatgttagaccaagaaacagttttaggtctagggagaagtaaaacacacaggacaatttgttttacacgctctgactgatatagcacatatccatcagagggaggagaaaatgaaaccaaataatacttgttaattttagaatgattttattcctgctactcttaaataatggagaatttctattgcttttcaaatccttgttttagtttgcaacagaaaaaatcaagaataatgtttttattataagtgtgtgaataaaaaatataactaatattttggatattgcatttaaagtatttttaaaattgtcttaatattggaatatttacaaattaggactaattctttatacatgaaaagcattaggttgaaaataagtgagatctatttagaacgaatgtatacatttgttgtatactactaaattgaaactagtttttatttactgttcaaatccttagtacctctctaatggttcaagtggggatacaaatatctcaattatttgaaagttaaattaagttggaaaggctctcttcttatcttactttcccttggtgattctctttctctctagctcttttacactcaagattgagtctattgagtataagaagaaaacctataaggctaatcctcaaaagcaataacaaaaactacttcagttgagtgtgttagcagattggataaatattggtttgcctggatgacataccgcataatctccttctctaagtgactgacatagcagtctcttccttcttatgctatagaaccatggaagcatcttgccaaataaaatagatagcatggagattctgaaactatgttacagctattcttgtaaatttcatagagccaaactttgagcctatttacttctaactttgtcttaacaacaagtaacaagagagtaagtcacatttacatgtcacatcactgtgagagataataagattattcattgaatgtttactaaatatctactctgtgttttaaacacttgggacagaacattgaaaagataaagtttctacccttaataattttacattttgaattagaaggaaaggggcagtgataagtgataaacattataaagaaaaataaagctaagtagtggcatgatggagagaattaattttttttttttttgagacaaagtcttactctgtcacccaggctggagtgcagtggcacaatctcggctcactgcaagctttgcctcctggcttcaagcgattctcctgcctcagcctcccgagtagctgggactacaggtgcgcgccaccacacctagctaattttttgtatttgtagtagagacgggtttcaccgtgttaaccaggatggtctcgatctcctaacctcgtgatccgcccgcctcggcctcccaaagtgctgggattaccagcatgagccactgtgcccggccgagaattaatattttaagtagggtagtaagggaataactggcatagaccccagagaatgtgtgatatgttctaaaagcagcacggcctgtagagttgaagctcagtgagcaaatgagaaggagaaaggaagtaagaaatgatgcatgagttagaaccaggcatctgctatttatcttcctctagtagatcatggcaattattttagaatttatttggatttcatacggtttttagcagacaagtgttaaaccatactcatgttttaaaagttgcattctatcttctacatagcaaatagaatgaaaggaatttaagaattagagtggcactctcaattaggaaattattccagtggtccatggagtccagaagcagtaggagagataataagaaatgaccagattcttggttaagttgtaaaagtggctacagcagtactatgctaataaattagggtataagattaaaggacatatcagagactactctggagttttttgacttaagcaattggaaggataaaattggcatcaactggccgggcgcagtggctcacgcctgtaatcccagcactttgggaggccgaggtgggcgaatcatgaggtcaagagatggagaccatcctggccaacatggtaaaaccccgtctctactaaaaatacaaaattgcaaaacttagctgggcgtggtggctggcacccatagtcccagctactcggaggctgaggcaggagaatcgcttgaacccaggaggcagaagttggcagtgagccaagatggcgccactgcactccagagcctggcaatagagcgagactctgtctcaaaaaaaaaaaaaaaaaaaaaaaaaaaaaaagattgccatcgattgacttaatttacttcaggaaggcagtggaagagtaggttttggggggatgtcctagagttcagtttttaatgtctatcagtcattcaagtagatacgtagagtgggcagttaaatttataaatctgaagttgatgaaaaaggtctgagacatagagtgacatttaaaacttcttaattgtatttaaacctataatcatcaattaaagaagggagtatagcactgggtcttcagcactctaacatctggacatgaggaaaaatcagaaaaggacactcaaaataaactatccataatgtacacagtgaaccaatggaagagtttccccttggaaatttaaatgcaaaaagtgtttcaagatagagcaaagaactgatgtgataaaggttgctgacataacatgagatatgagcaataatgatcaatattgcaaaatagggaaactgacagtaacagttttcctggaattatagggataaaaatctggtggaataacttcaaaagaaaagggaagagagaaactgaagatagagagtgtactctttcagctacaattagactgacatacaaacataataggaataagaataaattcactgtctttccaatttttaattagctgttaagtagggcaattttacttgttttctcattaagctcttacccattatattttagcattttatattgtcaacgagtagctctgctatgagtaattttgatatttatctcttacttttgttttgcagtttgcataaaatacctcgccacctgattatatgtctgtaaattatttttcctactatatttcacttttacacctttataattagtctcaagatgttcagtaaaatctgctgcctactctctttcatgtggatgccttgtcaagtcaggatttcctactggtatttttaaacatttgtcttctcctatccctttattctttttctcgtcttcagatctgttactgatcctccttatctcccttctttaggaagtgttacagctccctatattcctttactagagagagagagagagatgcaagggagaatattctgcataatcccaaagtgtcggaggatattaattaatttcactatacatttgtgttattctttgattatggtaggttttttccccagttatcttcatttgattgtaccttaagattccaaattcttctttgcatcctttttttaaaaaaacctaatgtctggcaattacattaactgaattccaactgatttctgtttcatcactttaaccaagaatttaaaatatttacaaacttaaccaagattagcaaaacagcttcatagtagcttcttctgcccctttccactttaaatttcctctcttatctactatcttatgtatcaaatgaaaattcctaactgtgttaaaggtagcactctgaaatattttcttaaaattattccaacagtgacattctatgaaataaaataaaactcttttaccttacactattttattatcatagtttaattattctgatatacattaaaattgtactaaaggattatggtgaaaagtagaagtcttttgcttatcaaaagaatcacctttagtccccaagttattcttatgctatttacctccatatttcagatgaatatatttatattattttttcatgtattaactttagacattatcaatgtcttgacaatgaagttgagaccttaatattttcgctgcagaaggatatcctttgcctctatcctcactcagtacgagttatattaaaaacttgattcattgttaattttattaatatgattatttaatatttacacctgagaaaacttgttatgcaaattttttatggaattaccttgtttttctatatattgtttattttgtgttgagtattccagtacctctgtcttctactaaatattatgtcattatgctttgatcacattcattccattttttttcccagaaattccacttcagaagctctctttattcccactataattactctcaatttctgccacctcgatgttctgatatctttcttcatttctttcctgaggtagattccacttcttaaattttatattttcttgttatttggtttactctcttgttttgctaaatcacctgagaaagtttgcatgtgaaatacatattttggaaaacatagtgtccgaaaaatttttttacactcaatttgattggtagcttgttttagtatagaaaaggtgcagatttagaattaagggatgacttaaaggctttatgctactattttctatattataatgttgctatcagtgccattttaactcgacatttctatatgattattcaattcacttttatattttgatgttctgaaattttataacattgtttcttgctgatcctttcttattaatttttctggagacaaagagaactttaaatctgcagacatatgctcttaaattctgcttttattctagcgtgaacccgggaggcggagcttgcagtgagcagagatcgtgccactgcactccagccagggtgacagagtgagactccgtttcaaaaaaataaaaaaattaaaaattaaaattaaaaaacattctacttttattctagcagtatttacactcaactgccgcataatgacatgttgatcaatggaccacatgtagaagggtggtcccataggattatgatactgaattttattgaatcttttctacatttagatatatttatatacacaagtacttaatattgtgttacagtgtcctacagtgttcagtgcagtaacatgctgtacaggtttgtcgcctaggagcaataggctataccatatataatagcttaggtgtatagtagactgtacatccacatttgtgtaaataaactctatgatgttcttacaatgacgaaatcatctaacgacctagtcatcagaacataccctgtctttaagtgatgcaaggctgtatttgataattttccttctctgttttctctacttcatttctagtatagctagtaagagatattggttcctgttctgatactctgattttcttaacatttaccttctattttccataacatttaattttgtcatgcttcagtgagactttataaactttattattaaaatgttctactgattttctttgctattacatgtccaattcccaagaacgttttctaagtagaccgatctaactttatgcttgcatgacattaaaaacatttaaaataaagtacagcatacataaagaaaagcatacaagttaagagtccacagttcaataaatattcaaaatttgaacacatttgtgtagtcaccaaacaaatatttaaaaggagcatcattagcacttgcagaacccctgccctttgcatctagtagccaaccacccacacactcctgcctcaatggaaaccattatcctggcttctaaaaacactgaatgattttaactccttttacagtttatatatgttgaaatatatttatgtacccttttgtgtttgtttaattttactcagtagtatttgtgtgaggctataattcatttgttcttattgctgttatttgttaacctgaatatactacatttatttatccatcctaatactaataagcatttggtttctttccaatttttagctattataaataatgcttcaaataacagtgttgtacatgtccttttacgaatgtatgttcaaaaatattttaaatatatatccaacagtggagtccctgggttataggataaaccataatagatacttccaaaacattttccaaaggaattattctaattttcactcccaccaggaataaatacataaaggttccagtttctctatattttttgtcattacttagtgttgtaattagtttatttttagctgtgttggtgggtggattctcattatttaatttattgtctgaaaaactttaccaaataatattgatattccttatttgaaaggtgaatttttttttctgcctggacttcatttattgagggtgtgttgaatcttttctctttttgctttcaatttgttttatcagtaattatttttaaggttaattttctgggtgtagacattaggaagacaacgttctgactactgcattatttccgttaagtaacctgctgtcttattgctgctgctttaaagaaatatgcctattctttttaaacagattttagcaatttatctttgtctttgatttaaataatttcatcatggtgcatggggttttgtttgcattttacctacttgaggttcatgctgtttaataaatttgtggcacaaaattatggtattcatcagttttgtaaaattatcaataataatattctcaacagttgattgattttaatgtttactgaggtgttattaatattcaatgaatttatatttaacatgtgaaattaaaacatacatatatatagtaattgatcaccatcatcaagatgtttattattccccaaaatttcctaatgctcaattctaaccttttactcctacccttctccccaatctatcccagataaaccattaatctgcttttcattatgttagatgtgtttgcattttataaaattttataaattggaatcatagggtgtgtattttttgtttgacttttcagtataattattttaatatttatagatgttttcactttttcctttttcattgctgagaagtattcgttgtatggatatatcacaatttgtttatttaacaactgatggccatttgagttgatttcagatttagttactgcaaaaaaaaattgctaagaacatctgtatacatatgctttgtaccggcatatgattttattcctctcggataaataccctggagtgtaatggctggatcatgtagaagttatttattcaactttttaagaaactgcaagtttttcagagtggttgtaccatttaacattctcatcatcagtgcatcagagtgacagttcatattcttcagttgaaagatgtatagttgtatcaaattgtggttttaactggcgttttcttaatgactaaaggcttgcatatcattttatctgattatttcctatttatatatcttcttttgtgtaatgtctgtcaaatatattcctggaattgtggtgtgtgtttcttatcactgagttctgagagctctttatatattctggataaaaaaattataagatttaaaaacatatattattactatgtgacatgtcttttcattgacttaaaatgcccttaaaaaccagattttttgtgaaatttaacataacatttttctctatatagacatatagactgtttttttggtgtcaagtgataaaatttgtgctgtgaagattacatattggagatatagttttctactcttacatttatacaattcctagggttctaatacacaatttctatattgagaaaatttacttcctcaaattattctttttattctacattccataaagtatatggtgctttaagcatgagagactaaatgtataatctaacttatagtatatttaaaaagaagagacatgctttccatgatacttcatttctattccactccatgtcatataaagatatattgttttgttaccacattataagcagtataaaccaagagaataaagaaagcatcagtgttcaatgcataaaattagagataacattcttttgcaaaactttggtttcatacatagaaaggcatgtactcaaaaaatatatgttactgttgccaggtgtggtagcttatgcctgtaatcccagcactttggaaggctgaagtgggaggatcacttgagctcaggagatctagaccaaactgagcaacctaggaaggacctgtgtctacaaaacgtaaaaataaaaaattagccaggtgtagtggtacatgcctgtagccccagcacgaggtaggaaaaccaattgagcccaggaggttgaggttgcagtaagccatgatagcaccactgcactccagcttgggcaacagagtgagaccctatctaaaaaatttgtttaaatatgtatatatatatatgtacatacatatatttatgacatacatatagttagtatcctgtgttatgatataataagtatctcagtatagatcttagatacacaaacacacatatatatgtatgtatacatgtatatatgtgtgtatatgtacattaaacacacacaatattgaaagctgcagttctaaagaaagattctatagcagtaaaatgttgcttacaataaaagcaatatttcacattatttcataaaaaaaccacaaaatattggttcccacagaacgatagttactgtaaaattctgttgcctgtttattgattatgattccattttatatttatgatactcagttttcaaatttttggtggttctagaactaagaaaccttaaatgtttgaggggatggataccccattcttcatgatgtgcttatttcacattgcatgcctgaatcaaaacatctcatgcacctcataaatatatgtatacccactgatatggtttggctgtgtccccacccaaatctcacatagaattgtaataataatccccacatgtcaagggcagggccaggtggagataactgaatcatgggtggcagtttcccccatatggttctcatggtagggaataagtctcatgagatctgatggttttataaatgtgagttctcctgcacaagctctcttgcctgctgccatgtaagacatgcctttgcttctcctttgccttctgccatgattgtgagttctccctagccatgtggaactgtgaatccattaaacttctttcctttataaataacccaatcttgatatgtcttaattataagcgtgagaacagactaatacacctactatgtacccacaaaattaaaaattaaagttaaattttgaaaaagaactaaaaaaccatgtgctttcaaatgcattttctagttttacacattattacaaataaaatctgtttttggctttaaaattaccatattttaatctttattatttttcataaacatctcatattcttaaggccatttttaatcatacctcaagttcaagatactactttcaattctacgccaacagagtatcctattcttaaggatatgtcatagaaatgagtctaaaggtattaaaaaaattggaagctgtacttatcccttccacattattgtccaggaatacatgtattttcctatattttctcttttaaccatatgactaatgactccttaggttcagctgctaaacatgataatattagtaaaaataagagtgattatatccacagcctgtgccctcatgatgttcacgggtttaggaaagacaaaaatagtatacaaaatttgggtgtggggtaaaaatgataaactgtgtatcaaactatcttataggataaataaaataggaatcaggaaagggagagagaaggcagagaatctgaaaaggaaatacagaacaaagcaactagtctcattatgaaagaaagatcatatttttaaatcataaaagaaggattagaagtacaaagaaagaagtagacacgttatagaatgcctagtacataattagcctcataaaaatacaatatgaatctaggtccagaacagataatgcttaagtgactaggtgaaaatagcctttctggtcttgtaaaatgcctgaataatttcctgacatcacgtttaatgcactaacgatattttctccttagctcctttgtttgaaattaccagatagaatcattgttactgagaattccttaatatttatcaattattgttatttttgtcattgtatgtgtttttcttctatcatagcaaccttttaaagttcatgtccttttttttttttttttttttttgagacggagtctggctttgtcgcccaggctggagtgtgtggtgcgatcttggctcaatgcaagctccacctcccgggttcacgccattctcctgcctcagcctcccaagtagctgggactacaggcgcccacccccacgcccggctaatttttttgtatttttagtagagacggggtttcactgtattagccaggatggtctcgatctcctgacctcgtgatctgccagcctcggcctcccaaagtgctgggattacaggcgcaagccaccgcgccggcctcatatcctttttttgttattcaattttctatttcactagtcagaattaagaatgtgcttctaacacgtaatgcacaaagcaaaagactaagatctaaatagggcagccttaaattcagtgaaaaatataaaaaatatataagcatcactatattcataaaaagctaatacatgccacactcattcactctctgctactataaatggctgctttgacaaccgtatattgttttgatgttttacgcagtgaatattattggactctgaacaagtcctttgcagtttaaagcctataaattggttgtatgttacagagaaataaactttaaaatgtctcctgtgtgtacctgttcattggtccaataacttgccttatggtcatgcccacattcaataatcatcattatggaaataacaatgcttgtctgttccaaccagtagtatcaacagatgctaagagtactagaaatcacacaggctttcatgcgtgcttttttttagactgactgcttttgactagggaatatatttatgagggtattttcattcttttccccacctgttttaatcttcaaataactcaaactcctgttccataatgttagtgcttcaatatggtctcctttatgtcctcttcttttatctactgctcagaagaacttaccaaaaacttcagaagaggtatcaaagagtcataaaagctctgaaacaccctgggatgacaccatccaattactatatagttgaaaaacatttttgaaaaaaaaaattttgccaaatggagtttaaaagtattggctaaacacatttcaaagtattaattgtatccatagttattcagatatatgtggttatatacaaaaaatgttttggaaaacagaagtactaaatggctataaactttgaagaaaatattatgtgtcaagtttttttctctgtaaagattagtttgcattttatagcatttatatcaatggaatcatacacatgtattttttagaggaagggctgccttttgtcattcagcatacttatttttagattatgcatccatttgatcaatagtttatttgttttatttctgattagaaatcaattgcatgaatatattaaaatttatgtatccatttgcctgtttatggacagcgcattttcttgctttgcgttattacaaataaagctgctgtgaatataatgcacatgccttgtatgaacatatgctgtcatgtctcatgagcaaatatctagtattggaatggctgaatagtacgatagttgtaggtttaacttaaaaaaaaaaaaaaagcattgtcagtgtattttccaaagtggtcataccaacttaccttttcataaacagtgtatgagatttctaaatgttccacaatctgaccaacacttgacacagtcagtcttttaaaattctagccattctaataggtctgtagtggtttataagtgtgatttaaatttgtatttttattataactaataacgctgagcatcattcttgagattcttgggtaaagtgtttgaatagtttgtccattttttaaatttaggttctttgttttcttattacattttgagaattttttatatgtcatacatttgtcccagtctatggcttgtattttcatccctttaacaagccctttcaaaaatcagaagttttaaatttcaataaagttaaatttaaccatttttctctttggattatacttttggcatcatatcactaaatttttgcccaatacaaggtcacaattatttttttctagatgttttacagttttagattttgcatttgatcaataatacattttagttcatttttgtatttgttgcaaagtagaaaaatttatttggtgggaaggagttggatacccagctcctccagtcccttttttttttttttttttttttttaaagacagggtctggctttgttacccagcctggagtgcaggggcacaatcttggctcactgcaacctccgcctcttgggctcaggtgatcctcccacctcagcctctgaatagctgggacaacagctatgtaccaccacacctggctcattttttattatttttttgtagagatggggtttcactatgttggccaggccggtctcaaactcctggacttaagtgatctgcccaccttgccctccaaaagggctgggattacaggcctgctccaatactatttgttgaaagtctatcctttccccatgaatctgtctttgcacttttttcaaaaatcaattttctatacatgtataagtctatttctaaacactgtattctgttccattgatatttttgtctatagtttggccagtgtcacagttttatgataaagttaagcattataataaatgcctttttttaaagagacagggtctcaggctctcactctgtcacccaggctggagtgcagtggtgcaattttggctcactgaagcctcaaccttccaagcttcccacctcagcttctccagtagctagtaccaaaggcatatgccaccatggctaatttttgtattttttgtggagacggggtttttttgtgttgcctaggctatacttgaactccttagctcaggcgatccacccacctcagcctcccaaagttctgggattaccaaagtcatgagccaccatgccaggcctataataagtgttgaaatcaggtagttttagccacccatattaggttttctttttcaaaattgtttgggatttttgtttgtttgcttttttcttctttttttgcatatccacataaattttagaattgtacagatgttccttaacttacaatgggattatgtcctgataaaccatttgtaagttgaaaatatgtcaaaaatctatttaatacgtctaatctattgaacatcatagcttagcctagcttacattaaatgtgctcagaacacttacataaaaattaattgtggtaatgatttgtgaacatactaaaaccaacgaattgtacttaaatcaacaagcaaaaaataactccatttaaaaatgagcaaatgacatgaacaggcatttctcaaaagaaaacatacaagtgaccaacaaaaatacaaaaaaatgctcatcactaatcatcagagaaatgaaaatcaaacccacaataagataccatctcacatcagtcagagtgtgttttgttaaacagtcaaaaataacagatgtttgtgaggctgtgaagaaaaggaaacacttatacactgtcaatgagaatgtgaattagttcagcaactgtggagagcattttgaaaatttcccaaggaactaagagttgaactactattcaatccaggagtccccttactaagcatatacccaaaggaaaataacttattctaccaaaaaagacacgtgcccatatgttcatcacagcactatttacaatagcaaagacatggaatcaaccaaggtgcccatcaccagtggactggattgagaaaatgtggcacatatacatcatggaatactacacagccataaaaaagaataaaatcatgtcctttgcagcaacatggaggtacctggaggctatttccttaagcaaagtaatgtggaaacaggaaaccaaatatctcatgtcctcacttacaagtaggaccaaaattttgggtatacatggacataaagatagaataagagatgtgagggagagaatgggacaagcactgaaaaactacatgcagggtactatgcttactaccaaagtgttggattcatttatactccaagattcaccatgccacaatatagttttgtaacaaggctgcacatgtacccactgatactaaaataaaagctgaaaagaaaacaaaaataaataaatggtagtattatgtagtctgtaaattatacctcaacaaagctatttgaaatatatatatgtacatattttttaaaatgaggaccatagaataaaataaatcttataatgtagaaaatgtatggtactacatagatacttggtaatcagtaggcttcctagaggaaatgacaagtaaataagaatgtgaatactggttttgaaatagttaggtgaggcttcagcacagatatatttttataaagaaggtaaggtaaacaaaaaaagaagaattccagttagaaaaaaatagcaggttctaagactcaggagtaatcaaatttgtggcagatgaaggaaactgaagacacccaaatgtagaatgtttgctggcagttggaaggtagaaaaaagaagagtagccaatgaggctggagaatatcatggagaccattataaaccagaataagatgttgagaattcttcttaaggttacctagatatgattaaagactcgattaagggttcactttatcaaatatacctggtcacaagtaggctagttttaaaatggagcttatatatagcaaacaaagaagaaaactatataagaaaattacatctttattatctatgactgattttggtcttgacctatcaaaatgggaaaatattaatttcttacatctacactattatttaaagtacatgatggttaattttaactgccaacttgattgaacaatgagatgcccaggtatttaataaaacattatttctgggtgtatttgtgaggatatttctggatgagaatagcatttaaatcagtagactgagtaaagcagattgccctccccaatgtggggtcatcatcaaatccctggatggactgagtttaacaaatcactagtttccctgggtccctagctttcagatactcaattacgggacatctcagtttccataattgcatgagctaatttcttataacaaacttattcattttggttctgtcattccggagaacactaattaatacaggttttgtaacagagagtgattctagaggaacagattttaaggatgatttttctggattagttctgggatttctgaaattgagttaataatctaattgtacttatagatgctaataattctatttctaatagtaaagagagcaccaattttccatggtggaacctggcaatggagatacacaaaacatctctattggatctcttaatcaaccacttataagaagcaaggagctgggtgactatgtgtcttatgctttagaaatttttgaaaaactaatgaatataatgaggttatcaggggcccctaatgtcactggacaaagtgatgacaaaaaaggatgaattcagggattcaccttcccagtgcaagtacttcataaatgacctaaaagtttctatctgtgccctgaaagagacatatatctcttttagcaacagggatgagactgctgaaaattcaacacagactcttatccttccactggctgaatttcaatacagcctcacagggtatcctatcctcacagggtatctactgttaaaacgagggcattgattggaaaggaataggatgtagtaaattgaaatggggatgtgtggaaaagccctgatagaactgaggacattgaacccctaaattctgatgagtcttctttacctaatgaggacaaactgttgcacctgaaccttacttttgaagtaacctccccacccacagtataagatgcctctccattttcagtggtattagcctctctacacttgtctgaggagtttaaccctgcattaccggagaaagctataatggccttccccaaggcttttgttatgccaggccgtgctgattcttctcagggcccacaccacaagcccttttttcttctaaacatataaccagactcaagttccaccaggcccctaaaagtgaggcccaagctgtgacagatgaggaggtgcactatactcaaaaagagctttttgagttttctaacttatagagacaaaaatctagggaacatgtgtgagaacagacaataaagatgttggatgatgatggaaagaacataaagccaagacaaatttattgataaaggttcactaagcagatattctgcatttaatgttacagctcagggacttaggaagagctccgtttggtttgttggctggttgaaacatggaccaaaatgtggcctaaagtgagcaaattagaaatgccagaccttccttgatttgtgtatagagaaagggattcagaggcttagggaaattagaatgttagagtgcatttgtcatttaagacctactcattaatcctgagagggtccataaaacataagtatactgtaaaaaataaatttgtgagggaaaccgtggcattcctgaagagctgtgtaatcacacttctctgcaagccaaatcttacagtgagaactgcagccacagaattgggaagcctaaatgcaatgagagtaattggttaccatggtgacagcagccaattggtgctactagactgccaaaagcaaggtgggcgtggttactgtaaggaacagcagaatcaaagcagcaatcagaataatctatcctgtgcagatctgtggcactgactagttaaccatggtgttgttagaagtgaaatagggagcctactaaattcttattggatccatatcagcagaaaagttctaggttaagtgaacaaaatttaacctgaatcataaaagcaaatagtaatggacccttaatcaattcccagatttgaaccagtttatagacccagacttactgaatgaaagagatgctggatctccttgaagaagaactccatggtacactatcaaaaatgtatagtgttcatcttaatctttacacaaaggatctatggctttttaccatgtaactgttctttggggaaaataagataatcagaactttcagggacttctggacactggctctgaagtgacgttgatttcaggagacccaaaatgtcactatgattcatgtgtcagaaaaagggcttatggagatcaggtgatcaatggcattttagccgaggtctgtgtgctagtaagcccagtgggtccctcaacccatcctatgattatttccccagctccagaatgcaaaatcgggataaatattctcagccactggcagattctccataatgcttctattatgtgtggaatgtgaactattgtgatgagaaaggccaaatggaagccactagaattgcctatacctagaaaagtagtaagtcaaaagtaatacagacagccctgatttacaatggtttgacttatgatttttcaactttatgatgggtttatcaagatgtaatcccataataaattgagaaacatatgtactgcattattggagtaattgcaaagactagtgtcaccatcaagaatttgaaggatgcagggtgatgactcctaacacatctccattcaacttgcctatttggtctgtggagaagacagacagatcttgaaaaatgacagtggattgctgtaaacttaacaaagtggtgactccaattgcagctgctgctccagtagcttcattgcttgaacagattaacacattccctgctacttggtgcatagctattgatctgacaaatattttttactcgatcactttttctgcattcctgtccataaggtccgacataaacagtttacttctcagctgacaaaactaacaatacactttcattctcctacctcagggatatatcaactctccagccctatgtcataatttaatttggaggtattttgattgctttttccttctccacaggatatcactttggtctattacattgatgaaattgagctgattgaatctagggatcaagaggtaacaaatactctaaacttactggtaagtttttgaagtcagaaggtgggaaagagacctgacaaatgtttaaggacctactactgtagtaaaatgtctagggatccagggatatggggcatgtcaaattagcccttctaaggtgaaggataagctaatgcacctggaccttcctccaaccaaaaacgaggcactatgcttagtaagccgccttggattttggaagcaacatatcccttattagggtatgtcactccatgaatttggtgactgggtaaatgagtatgttgtgccatttatcaagtgacctgaaaggcagctagtattgtatggtgtccagaacaagggaaagatctacagcaggtccaggctatttgaaaacagctctgccacttggaccgtatgatccagtggatctaatggtatttgaagtagcaaatagggttgcatttagaggcctttggcaggacttataggtgaatcatattgatgactcttcatattatgaagcaaacccctctcatcttcaaaagataactgttctctttttgagaaatagttcttgaccagctgttggagcttattagagactgaatgctgaatcaaaggccaccaagttaccatgtgacctgaaattctcactttgaccttggtgttaactgacacacaagaacctgtaggtaaggaagactatgtctgaaatacaggatatctcttgtggtgtctatatgtatatatagatatagatatagatatagtttttatatccttttgggaagaagcctgactaatagaaaacctgaaaaatttccatggtggattactttctagttcacagaaagacatctaaccaactcaaagctccagggagttttttcaattagtctgaacatctaaaacataaaggggagagtgacattggaatttgaaaaaatattaattttattttgctgtatagtgttcctgatgtttctcaggaaaattaaagataaataagtctacctttaattttgtttgaatttggtaatactattttttaatattaattgacaatcaattgattggcaaccaataaaaggtagctatcattgagtatgatacaaatgtagcatgataatattttgaggtgttgatttggtttttactttttcccattcttttggaggctttatatatttatttgtttatgtatttatttaaatagtcatagcaaaaggcaataaatcatttttatttcaaaactaaaacttttgagattcaaaagcctaaatcttgaacaattttgaaattaaaatatttgctacaagtggcttagaaaactaaatgaatggtcagaattaatttttatggggtcttctgatgcctaacttctacaactgtccttgaaactagataaagctaatcttgaaaagtgaaagagaaagactctttcactctgctttagtttagataaaggaagagtttagatgctgatgactcataggagagacctttttctcatttggacaaatcctggagtgaggataggaattacagatagattttagtttgagaaattcaaaagtagatgaaaacctgaaccacctttttcagttagggctcacaaagcattaagagtcagagtttgccccttcctaggctagtgtgagaacataagaaatttctgcataagccctataggcagtcagatctgaggcaacttggtagaatccctggtttctgccatcatgaatcggcagcctaaaaaagttttcctctgcagccaaaacgagcataaatgtggcactttagtctggcaggtgtggaagggtcttgtggcaagatgaagcaatgtgtccaactgaatcaattatgtttgtggatccaccatcaatgagctgagtaaacgaagacttcatgatagaaaccacagtaaacatgtagcatcacctttgttagatatatctcgcctcccaagcaccttaattaaggcctcggtcttggccttaattaagtccccaagagaaacaacttcatgaattgaggtgaagaataacttgctaaaatttaatttttgccgcctggtagaacaaagtttcaaaatgaagtttaatcataaaaaatcaaattccttattcaagagagctatcatctgagaatttgcgcccttactctgataaaaagcaccactgtttactgaatgcttaccaggtgacaagcactacactggttactttacaaagattagctcagctttattaacagtaaggcatattctaaaaatgttcccctttaagcaagtgtttttaattacagacccagttaactctgataataaatgttcatacaccctcttatagttgcttaacaccatacaacttagattaacattgggctaattgttcttatacctggcagttgtagatccagcaatataaggtatctgttcacaccatgataacttaatattcatgttctctaccctttaaagctgtttcccattagctagacttttatgatttcccagcacagttggcaacaattttatttctatcaagcaaaagacaataatatgttagaggtattcactataaaatttttttaaaaaactgttaaagggtttatcatgtcttgggctgtctcagccttcaaaaaaattaattggccccacaggcttagatggatttaaaatttttgaagagaaaagatgttaaaatgatcacttctttccctaaggcatccctgaaaatgctggtcagaatggaaaatgtgtgcttgaggctgggcccagtaacaatgtacaggaaccatgccatattcatctgtgacctttacagtatagttctagaaaatgaattcagcctccagtctggccaaaaggtataaataagctttacagttttgaccttagctaaatggggagcaaccagataagcaagcatcaaagaaaatttgcttttattttagaaacatttccttcacgcttgcaaaatctaaaggtaggctgagggagggtagggatgaggcagcccaaagacaaactgggtaggtcaaggatttcttttctcaccataaacttgtaaaactgctaaggaaaaatcatacactgaaaaacaggaaaaaaattgtttccgtgcatcttatcatttgtgtacatttttctgcctctcaagtgtgtgtgcttgtgtgtgtgtgtgtgtgtgtgttagtgtgcgtatgaatgtttaaataactgcatttagattaagattacaaataagaaatgttaaatctctcagatataagaataatcttaaggtatttttcttgaccctgaaaagtaaaaaagcatgaaatagttttgccaagaggaacagatgtttctgttgtatatttcttactccctgggcatgtttgagaattctaaatataaacgttcaaacagacagggtgcaaacacgcaggaagtttgggggagtgtgatgattcatttagacgattcaatctgattcacaactttgcacatgaatcaaaaatcaggaaaattgaaaaaaggatggtttagtcatactaacatgtgtatggcatacatcttaaaaagaaagcaaattcagaatgctagccaatttcaagagtaacttaaaccacataagcaataaataggcaaaagtttcaaagacttacacatactaacttaatttttcatgatcatttcaatcccctataagggtttcatctgaacccattacagatttaaggggttcacatatatatatatattatatatatataatatataatatatattatatatatatataatatatattatatattattatatattatatatatatataatatatattatatattattatatattatatataatatatataatatatatataatatatatatatattatatattatatattatatatataatatatatatattatattatatattatatatatacacacacacatatacatataaattttactcatatatagtataattttctatattacaaaacaaaaatctcacaaagtggtagggggatttagaataagtagtctgactaacacactacttagcacacagtcatctaatattcaagacggagtaataatctgagctttctggtgaggatgctgtaagaatcaaactaagctctgaatctctgaggagtagtgactataactgtcatcctcataaaagttgatattgatctccctgatacatagaataaacagtctccattacagtggtaatatagtttatcacaaaataatatgtttttgaaaagtacaaataagacaaaaatgcgttaaggtcaactcctttaaaaccaaaggtctttttttgtggcaaacaagtatgccaaatttgataattatatatttaacaacattctacaacaaaacagatagatactttggggtatattttgtgactctttttgtggtatattcctcatagactagtatactttatatcatactatatggaaccttaaggccctaataactaatttgtttactggttagattaaacctagaaaagtttttaagttaaaaaaaaaaacttttggttttaagtattttttagcctttgtagtagatgttattgatgcctacatacataaccatgttccagacactgttaagctattggttgaaaatggctatctactgtcttccctggagaattgcacttggctgaaaaggagccacttttgcaagagagttgatgctcttcctgagctgtcttccactgtcaatgactgactcaagaacacaaaatgtcaccatggtttcttcttagaggaggggattatcagatattaaaagtaagccatctcacagttgatccagcacatccatgaatcttcctagtgatcatgttcctggtttctgaatataaaatcaaatgaatatatttagcagttaccagaatccttactttggtttcctaacctatagaaccatagtgaaaaagacaaagtagaattccctgaaatgtctccatttttttagaagcaatactacatcttgtgggaaagagtaaatattagtgtcagcctcaaagacttaaagaatgggatgctttacttgggaaacttcccattcagttcaccagtctgtctcctacaggttggagatggaatatagtggatgacagtagaattaccaaaaatgtaaccaagaaatagaattgtaattgctgttccagatgtgttatcttccagttttgttgtcatatctaaaatagattaaccaaacctctgggatgcacagtaattggtttggccaatgcttatttttacccaataggcttgagaaaggagaaactgaagcaagtcatattcacaagggattaacaaggctatgaatgtactgttttagcctaagaccatgatcattcttctgctcctgatctgtcatctggactttctacagaatatcacattagcccagaatgtcatgttaattggacccaaatggcaaaatatttgtatatgctctggattaattaaacccatattttcactggtgagtgagacctatattcagtaaagttttggaggcttgtcacataaggaaactttttaatattattattttttttatttttaagttctgggatacatgtgcagaatgtgcaggtttgttacacagatatacatgtgccatggtggtttgctgcacctgtcaacctgtcatctaggttttaagccccacatgcattaggtatttgtcctaatgctctccctccccttgacccccaccctctgtgttgttcccctctctgtgtcctggtagggaactttttaggggatctattgtacaagaatatgccagggaatcctattcaatgaaaaggataacatcttttacctcttaccatctaccactcaaaaaaaacaaaaaaaacaaaagcactatgcttcatagttttcttcagatattgaattacatattccacactttggaatactgttccaacatatatatagtagataactgtatttttgtttgtttgttttttatgttgtcatagactcattggtctatgagtctgtttttatgccagtaccatgttgttttggttactataacattgtagtataatttgaagtcaggtaatgtgatgtctccatatatgttacatatatattacaattacaatatagtagatccttataatatactattagataattgtaatctactagtttgagtgggctgcaaaggagggggaataaaaggtgttctatatcaaggccaagctgtgaacaagcagcattgacactagggcaacagaatatggcagaacacataccctagaggtgtgtttggcagagacaaaaatgccacagtgacatgtagactttcgggaaaatccgaatatgaaaactgcaagtcagagaacagacccatctgattcttgagaaagaatttactttctgcagcaaagaactatagcctgtttgagaagcagcctctgaggggggaaggctagaataattcacgctgtaatgcattagagtatgacacataagaatgagctaaactttagtgtagctagacatacatttagaaatatttgtagatatttggaaatatttgtatatatgtatatatttatgaatattttatacaaatatttatagatatggatatatataaatttatctacaaatacatatatgtgtgtgtgtatatatatatacacacacacacacacaatcttactgctgggtagatatccaaacaaaaggaaattggtatattgaagagatatctgcactcccacgtttattgcagcactgttcacaatagccgagatatgaaatcaacctatgtgtccattaacgaatgaatggataagtgctacatatgcacaatgtacatatacacatacatatacgtgtgtgtgtatatatacatacatgtatatatgtatatatatacatgtgtgtatatatacacacacacgtatatgtgtgtgtgtgtgtatatatatatatatacatatatatatatatatatatatatcctagttagtatatacacatatgttctctcattttgtcagacaagagagcctacaagcaatgactccccagtagtaattggcatacctagggcacagatcttggcttctaataccagtctccaatgaaagtagctagagctccttggagaaatgattgattttaggactatggcaagaaatatacaatatgatattagagcatcctgtgtccatactcaaaacaaaacaaaacccacaatgattgggatatgccaaagggacacaggggctgaatgaaaaaactaccaatggacaaagctgaaataattttagcaataaaataaaataattataaccccaaatataaaatacatatacaaaagtatatacagatataaataaattagggaaaagagacaaattgaccatacagaaaagctcaatctaagtagatactccaccctcaaagagatgtaatatgtttctctactccttaagtgtggaatgcacatagtgctttgcttccaaagagtaaaaagtgaaaagaagagttacaagtaagtttaaagtggaaaaatctgacaaaccctacctcagccaagtgatcaggattaacatcagcaatggtaaatcatattgataatatatatctctgacacaatgtgatgaaaacagcattttacttctctggttttccttcaaacaatacttaagttctatctaatcataataaaaatattgaacaaatcccaattgagagagatttaataaaatatctaaccagcactcctcaaactgtcaaggccatcaaaaacaaagaatatctgagaaactgtcacagtcaatatgagcctagagagacataacaactaaatataatgtagatcctggaacagaaaaaaaaaaaaaagagtgtttgataaaaactaaagaaatccagataaattatgaactttaggtaataataatgcatcaatgttggtgcattaattgtaataaatctatcataccaatgtaagatgttaacaggagaagctgaatccagggtatctgagaatctcctgtgctatttttgcaatttttctgtaaatctaaaacatttctaaaataaaaagaagttttttttttgcttttttaaaaagcagtttctgatatgctactgatcctgaattgagattgaacatcagactattgcacatcaaataaatgtgtagacagacatgcccattaagatgtaagtattgttgttcccaaagaagactaaggccaggtgttctcgcagcaaaacaccctaaaatggaagcagcacattttcaaatgacccaaacaaacctagagggaatgtgaaagttggccgagcaggtagccaaaacccccatctcacctacacttttcctcatatgggtttcgtatgacctgtctataaggtaagtgccaactgggtttgggaatgcaagcaaataagcacatggcactgtaaaggacacatataccctatatatttttaattttttatatttgattattattcctacataacagttgtacatatttatggggggatgtgatattttgatacaagcatacaatgtataatgatcaaatcagggtaatttggatatccatcacctcaagcatttatcatttctttgtaataggaacattccaactgtacacttttacttattttgaaatatacaatatatttatattgtatacaatatacataccttactgtgctaccaatgactaaatcttatttcttctatctacctgtattttgtacccattaaccactcccccgttttccccccacccctactgctatccaccacagtccctggtaacctttattctaatctctatctccatgagtgtagttttatttttatttttggtagattttaacatatgagtgagaacgtgatatttgtctttctgtgcctagcttgttttatttactataacgacttccagtccgtccatgttgttgcaaatgacaagctttcattctcttttatggctaaataatattctattgtgtatatgtagcacttatccattcattcgttaatggatacataggttgatttcatatctcggctattgtgaacagtgctgcaataaacatgggagtgcagatatctcttcaatatactaatttccttttgtttggatatctacccagcagtaagattgctggggcatatgatagttctattttcagtttcttgaggaacctctgtactgttctccatagtggctgtactaatttacattcctgcaaacagtgtgcaaagctttccttttctctgcatacttgccggtatctattattgcttttttttttttaataaaagccattttttaactggtagagatgataacttcttgtggttttgattcccatttctgtaatgattagtgatgttgagcagtttttcatatacattttggccatttgtatttctcctttcaagaaatgtctatttagatcttttgcccatttgttgattagattatttcctttttctattgagttttatgagttgcttatatattctggttaataatccctgacaggtttttagttcgcagatattttctcccattctgtgggttatctctttagtttatcgattgcttcctttgctgtacaggagttttttaaattgataggatcccatttgtgcatttctggtttggttgcttgtgcttttaggaacttaataaatctttgcccagacaaatgttttcaggtgtttttctgttctcttctagtagttccatagttttacatctttgatttaagtattttatctatttttatttgagtttgtatatgtttaaagataggggtctagatttattcttctgcatatgaatatccaattttcccagcaccatttatgaagaatctccttttcccaatgtatgttcttggtacctttgtaaaaaatgaattggctgtgaaaatgtggatatttttgttgttgttttctatgttgtcatagactcattggtctatgagtctgtttttatgccagtaccatgttgtttcggttactataacattgtctccagctttgttcctcttgctcagggatgctggggctattctggctcatttgtgcttccatatgaattttaagattattggccagatgtggtggcttatgcttgtaatcccagcactttgggaggacaaggcgggaggatcacctgaggtcagaagtttgagatcagcctggccaacatggtgaaacctagtctctactaaaaatacaaaaattattttttcaatttttttgaataatgtttttgatattttaatgggaatcacattgaatctgtagattatcttgggtactatggacattttagcagtatttattccttcaatccataaatatgaaatagatttccatttatttattgtcctcttcaatttcttttatcaatgttttatagttatcatcatagagatcttatactttttggttgagtttatctctagatattttattttatttgtaactactctaaatggtattattttattggtttctttttcagattttttgctattggcatatggaaatgctactgatttgggtatgttggttttgtatcctgcaattttagtgagttttactgtcaattctatagtttttttgtgtagtatttagatttttctaagtataagatcatatcatctgcaaaaaaaaaaaaaaaaaaaaaaaaaagataattgacttctccctttcctatattcctatttggatatcctttatttctttcacttgcccgattgctctggctaggatatccagtactatgttaaagaaaagcggtgaaagtgggcttccaggccttgttccaggctttagaggaaaggattgcagttttccctgttcagtatgacactatctgtgagtttgttgcatatgacttttatcatgttgaagtatgttccttctatacccactgtattgagagtttttattatgaagcaatgttgaattttattagatgttttttggcatctattgaaatgatcatatggtttttgtctttcattctattgatatgatgtatcaaattcattgatttgtgtatggtgaaccatccttgcctccctgggatgaagaccacttagtcatgatgaattatctttttaatgtattgtttgagttgctagtattttgttgaagatgtttacatttatgttcatcaaaaatattggcctgtagaatttttttatgttgtgcctttgtctggttatgctatcagggtaatactgtcttcatagaatatatttggaagtgtttactcctacttgattttttttaatcgtttcagtaggattattattagttcttttttagttgcattgcagaattcatctacaccaggtcctgagattttccttgatgggagacttttattactgttctatcttgccacttgttattggtctattcaggttttggatttcttcctgctttaatcactgtaggttttatgtgtctaggaatttagccatttcttctagattttccaatttattggatcataatagtctttaataattttttgaatttctgtggtatgagtgttgtctcccttttttgtaattgattttatttatttgggccttctctttttttttcagtttgcctggttaaagatttgtctattttatcttttcaaaaaaaatcaccttttcattttgttgatattttatatgcttctttagtccactttctcttatttctgcagagttctttattatttcttctactaattttgggtttggtttgctcttattgttctaattctctaagatgcattgttaggttatttaaaaattttacttttttgatgaaagtgttcattagtatgaacttcttgttttcctttcctgtatcccataggtttgtttccattttatttgtttcaagaattttttaaattttcttcttaatgtcttcatttacttaatggtcattcagaagcatattgtttaattttcatgtgtttgtgtaatttttaaagtttatctcattactgattccattgtggtcagaaaatatacttgatatgattttaatttctttgaatttgcaagaaagcaaagtcatttatttcatttttaaatagataaacagtaaaattcactcttcttggtgtacagttctatgagctttgacaactgtacacacacagtcttataaacttgttctattactccccaaattcccttgcgcttttccttgtcaacttctcttgacctccagccctggcaactaatctgctctaggtcactatagttttgccttttccagaatgttatatcaataaaacacacagaacacaatcttttgcatctgacctttttcataaggtattgagattcattcacattgttgcctgtatcaataatttgttccttattattgctaaatggtatttctttgtatgaatgagccagtttttaatccatctatccactgaaggatattttggttgtttagcatttgggggttttaataaagttgctataaatatccatgtagaattatttaagactgattttaccagcctgggcaatataatgagtctctgtctcaaaaaaaaaaaaaaaaaaaagggaaagaaagaaagggaaagaaaaagaaaaaatattagccaggcatggtggtgggcacctgtagtcccagctagttgagaggcttatggtgggagaatgacttgagccctgtaggttgaggctgtaatgagccatgatcacccactgcactccagcctgggcgacacagcaagaccttgtctcaaagaaaaaagactggttttgtggcctaccataggttttatccttgagaacattctatgtgctgaggagaagaatgcatattctgcagctgttgggtgacatgttctataaatatctattaggtgcatttgttctacagtgcagattaagtctgattgtttcttagccgatttttttatctagatgatctatttaatgctaaaagtggagtgttgaagtctctgactattatttttggaggtctctctttagctctaaaaatattcactttatacatctgggtgctccagtgttgggtgcatatacatttataattattatatctttttgttgaattgatcctttgatcattatataagatcatctttgtctctgtttattgtttttgtcttgaaatatattttgttggatataagtatagccactcctattcttttctggttttcctttgcctgggttatctttttcaatgcctacattttcagtcaacatgtgtctttataggtgaagtgattttcttgtaaacaacatatacttggatttttaaaaattcattcaaccatttaatgtctcttgataggagaattttgttaacttacatttaatgttattattgatatataatgatttactactgccattttgttaattgttttctgattggttggtttgtttttccttccttccttccttccttccttccttccttccttccttccttccttccttccttcctccctccctccctccctcccttccttcattgctgtcttcctctgtgtgtaagttattttccctggtattattatttaatttcttgcttttattttttgtgtatttcttataggtttttgctttgtggttatcatgggttcggaaccaacattttataaccaattattttaaactgatgacaactcaaatcacaaagataaaaaaaaacaagcagaaagaatattaaaaaactacacttctgctttttgactttttgttttctctatttttatctttttatatagtctatctctttacaaattgttgtagttgacagatttgtcttagcctttctactaaagatatgagtggtttacacacaatttcagtgttaaagagtattctttgtctgtgtagttacttttaccagtaagttatttaccttcagatgatctcttactgttcactaccatttgcttctttcatgttaaagaactctctagcatttcctgtaagacaaaactgatgttactaaaattcctttggttttctttttttgcgggaaagtctttatttctccttcatgttcgaatgagaatttcgctgaatacacttttctacgttgaaagttagttccttcagcactttgaagatgtcatcctatccccttgtggcctgtaaagtttccactaagcagtatgccacagacatatcagagctcttatatgttatatgcttctttttgaatactttcctcattcctgacctttgagagtttgattgttatatgtcttgaggcagtaatacttgggttgaatttgcttggttttcttttacctcctggtaccttcttgtaggcctccagcattctttctcattcttttttctttgttttcctctgactgtatacttttacacagatcatcttctagttcactattttttccttctgcttgatcaattatacggctgagaggctctgatacagttttcagtttgtcaactaaatttttcagctccagaattttggcttgatcttttaaatttcaaatgtctattgaatttctctgacagaattctgaactccttttctgtgctcttttgaagttcactgagcttcctcaagacagctattttgaactctttgtctgagaggtcacatatctctaccactccagaattggtcactggtaccttatttagtctatttggtgaggtcatgttttcttgaatattcttgatgcttgtagttgttcgttaatgtctgggcattgaaagctaggtattcattctaatcttcacagttgggatttgttgtatctgtctttcttgagtgggctttccaagaattaaaaagggtattgagtgttgtgacctaaccctgtggtcactgagtcctttcagcacaatgtggctccataagcccaggaatgctgtgactcttaagactcctagatatacagccttggtggacttggagacaataagggagaattccctcagttaccaggcaaaagtgtcttattttcttctctttctttcccccaatcaggaggagttcctctttgcattgggggaggggtgacatgggaactctcatggccaccacagctagaactacactggatctgaaagaccaacagcctttcaggcaaggatagtactggggtttacctgcagcccataggcactactgtctgcctagtgctgatgtttactcaaggtcaaagcactttagtcagaagttggtgaattcttccaggactaagtctgtctcatcaggagatcagatttccttctggcccagggtaggtttagaaatgtcatttagaagcaaaagtctggaattagaggcttcagaaatctgcttggtgctttgttttactgtggctgagttggtacccaagttgcaagacaaagtcctttgtactcatccctctcctttccccaagtgaaaagagtctttccccaagctgcactgcctggagttggggtaggggtgacataggcactctcatggccagctgcagagctgttgttgcactgggttgcactctaagtcctctgcaaccaagttcagtgcagcaccagggcttgcccaaggactatagtccctgcggcctgtctctcactcaaatttatttagggttctctggccatttcagtctgttgatactgaagcaaaccaagactcatgttccttccactgaggcaaagtatttccctctggcttagggctgtctaaattttccctccatgggtgccagcagaattctgccttgtgttgtatttgactgtgagagggcagaactgaattccaatgtaaagtctcaaatgcacttcactgtccctcctccaagcatgcaaactgtcctcttgctgcactgcctgggtttgtaggagtggtgtagacaatgcaaggctgtcttccccacctcctttaaagtgactttcctggctattattttaaaaccagttactgtgaccactcatctgatttttttggttcttatgaagatgttttcttgcatgaatagttgttcaatctggtgattctgcaggaacactattgctgaagtgttccatttggcctcctttctcctctctcctcagtccatatacactttaaatcaatgcctattttatggtgctctgtcattaatgagtaaaggacaggaattgaaaaatgtagaggtaaaaacagagatgatacttgatattgctgtgtcctcacccaaatctcatcttgaattatagctcccataaaccccacatgttgtgggagggaaccagtgggagataattgaataatggggtgggttttcccatgccgacctcatgatagtgattaattctcataaaatctgatggttttaaagggcagttcccctgcacacactctcttgcctgacaccatgtaagatgtgtctttgcttctccttcaacttcctccatgattgtgaggcctccctagccatgtggaactgagtccataaaacctcattttctttataaattatccagtctcaggcatttcttcatggcagtatgaaaatggacaaatacagtactccttactgtcattcctagtaacacacttaggaaatatgtgtttattgtctcaacaacttcaggttttgagtgtttagatgtcttcgtttcctaaaagaagaatgcttccacaagaagacacagttagtgtcccactaaacttaaaattacagctacaaactagataatttgggctctgtgtgacagttgaccagccggtagagaaaaagattaccttgttggcaagtataattgatcttgatcattatgaagaaatagggctcttatgctacataatggggacaaggaggaatgttccttgtcaatttggcatttcaattgtatactaggtgttttgtattttttcccacccccagttttaaatgaaaatgggtgagtacagaaagcacatatttctacagtggtgtaagatcacagatcctttacagatgagagtttgaaccacacaccaggcaaaccatctaaacatacagaagcattagccaagttggaggagagatttttgaaaagaaaatgaaggagggagataagtgtcagttacaatcccccataacacaagtttacctatgtatcaatcctatacgtgtatgtacctctgaaattaaaatacaagtttaaaaaatcatttttaaggatttaaaaaaagtgtcaattatagccatggtaccaactatagttggttgacctttaacttttcaagccaaaaagactatctttatacatcaaatagtgctaccctctggagcaaagggcaagcatgcttactatccattatacaatatatgtgttccctaagctcagtgattctctcctgaaaagcatgacttctttagtaattaccttcatgacacttaggagaagcaggggcaaatgttgagaacatggctactgctatcattatgagtaataaaacatcctttttctgtaacccaggagtcttgtgttttctatctgtttcaatgaaactgtgagctaatttgttagattgcaagttgagtaaaatctcggatctttcatggttattgacaatccaaaatttgtttctttagaactttaatatacttaacaaacccaggctaaaataattttaaaaagacccaaaaacacaaattataaatatcagtatgtaaatggcagattcaacatacattgaaaaaaagaaattaggtgccaaaacttaaatgaaaatgaacccattcttgagaagggtgacttatacaagcttacttgagaagaagtaatatattcagaaaataaagaaattgagtacatcattttaaaagtcccagaaggcttcacctgtaattacttcaaatgtttaagaataaataatactcgagggaggagccaagatggccgaataggaacagctccggtctacagctcccagcgtgagcgacacagaagacgggtgattactgcatttccatctgaggtaccaggttcatctcactagggagtgccagacagtgggcgcaggccagtgtgtgtgcgcaccgtgcgcgagccgaagcagggcgaggcattgcctcacctgggaagtgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcagagggtcctacgcccacggaatctcgctgattgctagcacagcagtctgagatcaaactgcaaggtggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagcacacagctggagatctgagaacgggcagactgcctcctcaagtgggtccctgacccctgacccccgagcagcctaactgggaggcaccccccagcaggggcaccctgacacctcacatggcagggtattccaacagacctgcagctgagggtcctgtctgttagaaggaaaactaacaaccagaaaggacatctacactgaaaacccatctgtacatcaccatcatcaaagaccaaaagtagataaacccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgactgggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgataagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcatcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactagaaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggacgatctaccaagccaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcactgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaaaaatctcactcaaagccgctcaactacatggaaactgaacaacctgctcctgaatgactactgggtacataacgaaatgaaggcagaaataaagatgttctttgaaaccaacgagaacaaagacaccacataccagaatctccgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaacaactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaaatttagaccaatatccttgatgaacattgatgcaaaaatcctcaataaaatactggcaaactgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaacggctaatatccagaatctacaatgatctcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccacaatgagatatcatctcacaccagttagaatggcaatcattaaaaagtcaggaaacaacaggtgctggagaggatgtggagaaataggaacactttgacactgttggtgggactgtaaactagttcaaccattgtggaagtcagtgtggcgcttcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaactggaaaccatcattctcagtaaactatcgcaagaacaaaaaaccaaacaccgcatattctccctcataggtgggaattgaacaatgagatcacatggacacaggaaggggaatatcacactctggggactgtggtggggtcgggggaggggggagggatagcattgggagatatacctaatgccagatgacacattagtgggtgcagcacaccagcatggcacatgtatacatatgtaactaacctgcacaatgtgcacatgtaccctaaaacttagagtataaaaaaaaaaaaaaaaaaaaaaaatgctaagagagtagattttaagtgttctcagaacaaaaatgataattctgtgaggtataatgcatatgttaattagcccaatttagccattccacaacatacatgtatttcaaaacatcatgttgcacttgataaatatatgcaattttgtcaattaaaaaatgatttaaaaaatgtgaaaaaaaaaaaagaataaataatactcatccaatacaaagtcttccagagaaaatgtaaataaatgctttctatttattttatggggactgcatcaccctcaaactaagatattataaaagcatcatcagataagaaaactacaagatgtcctagagcttctccccaaataagaccttgaaatgagaaattaggagtttgtggtttctgtggttggttatcccaacaggcacaagtgagggagatgaacaggtcagacggggaaggagggaagcagtccaactagctgaaaagatcatggtctattaaactttaccacagatctcagtggaacaaggcaactggcggtcactctggcagcactattaggataattttatatatatatatatatacgtgtatatatatatatatacgtatatatatatatatacgtgtatatatataatataggtgccaatttttcaagatgtcataaccaatattgtgctttattagcatttgtctggttattacaatgttttcccattcaagtcctgggcatgatttttaatacaatttttttctctagccataggagatgaaagtctctttcattttcccatagaattcttctggacttcacgatgaacatttagttggtatttagaattcgctcgtcattttcttctatcattgtattgatagcactgaacagaaaatatccaaatccacatttgtttcaataattagtgctatcatgtaactcatacagtggcataagccagtgtttcccacctgtatgccattccagttcatcagaggtgtaatgatggtccatgcaagggactattacaaataggtataccaccagttaataggttcttgttgcagccttgtctgagaccacatatacttcagaaccccatcctgagaatatgcgtcctagaacactagaagcaggttctgagcaaaaggatcatgggcaatagtttatttggaaaatgcaggatgcacaaaagggggaatgggaaactcagacggagaagcaaagacagccaataaggggtatattatcaaaccagctcacactctgggtaactgatgtttaattccatggggaagttcttagagtaaaaacatgtgcctcagttttatcccatctaggacataggctaatacttccagtacaatgatagatatgatggtagcaggcataccatgtctctttccgaacccagaagaaaatctttcaacatttcacaactatgtatgattattaggtttttatagatgtattttatcagtgtcagttttattctatttctaattggctaagagttttgttttgtttttaaatgaattctaatcaggaattattgtgaatgacatttacaaactgaatacaaaatttctaaagaaaatattatcaaaccaaatttagcagtatatttaaaacttatgataatcaaataatagtagtccagaaatttaaatttaaaaccacaatcactggtctgtaatataaaagaaaggaatataaaagtagacagttctgctatgtacatttcttattttctagtaactacacattcatatgtttataaatatatactgtatatatttactagtacatattttcaaaaacactatattctacactgtatattttagacactagacactattctttttttttttttgagacagaatttcactcttgttgcccaggttggagtgcaatggagcgatctcagctcaccgcagcctccgcctcccgggttcaagcgattctcctgactcagccgcccgagtagctgggattacaggcatgtgccgccacacttggctaattttgtatttttagtagagacagggtttctccatgttggtcaggctggtcttgaactcctgacctcaggagaaccacccacctcggcctcccaaagtgctggattacaggcgtgagctgccgtgcccggccgacactattctaaatgctttgcatatatatatatatgttcagttatctctcaaaagtagctatgaaccattagcatcaatttatctacaaataaggactataaggcccagagagtttattcatactagttaacaaattaacatgattttaaattcccaaaatttgactccaaggatttttttattatgactatactatactgctttaactgaaaaatgccagaaaaacttgctgtgatttgttacattaatagcctaaagaggatacttcaatatccagaaataatactttaatttaaaaatcaataatcaattctaaaaaacaattcatgcaagtctgctttctctaacctgaaaatgctctttcaaaaaaacccacattaaacatcgtacctaatcatgaaaggggaagagggaaagaggtgcctattataattacttctatttgactttttaccaggaatcctagcccatttactaagatgagaaaatggatatcagtatgtggatttcaaaggaagcatagtgattatttgaagacaggaaagttccaagaaaatatatagacaaattactgaaattatttaaaactccatgagctatctaggtgtcttagtctatctggattgctacaataagataccatgaactgggtagctgacaaacaacagaaatgtatctcttacagttctagatgttgggaagtccaagaccaagtaactagcagaatcagtatctggtgaaggcacactttctaattcatagattgttccttctcattgtgtcctcacatggtagaattgggatataatctcccttgggcctactttgtaagggcacaaatcccacttataagagctctgccttcatgatctaatcacctactgaagagtcccacctactaatactactactttgagggagaggattttaacatatgaaagttgggggaacataaatatttgatccatagcactaggtatacagacgacaatcaacattttaaaaatttgaccaaaataaaaaattagaaaataaataaaaataaaagtagaagtatctattcataatatgataaaaattataaggcacttgggaataaatctgatgagatatttaagaccattttgaaaaatcaaaaacattttgtaaaaatactatataaatgtctcatatgagaagactcaaaaaggatgcaggactttttggtaaatatgatggaattaaacagaattacagagtaataagcaaacatatgatttttacattatttgaaatagagctaaaagtattgaatttttgccatattcagtattggaaaccattatgcttagttaagaaaaaagtaaatttgctaacatgtggaaaagctcagcaaaatttaagaaagtgagaaaagaaattttaccatataagttatcaaaataaaatagattactgaggatgttccaagaccagcagaatagttgataattatttggcatgtagaacatgattattattctgtaaattggctgaatctatactgctagggtggtattaagactggtagaaaacattactcaatatgtcaactctaaatggaaatactgaatggcccttttactttacttctacttctgttttaccagctaacagaaatttctgttttctccaaggagatctttttaaataaaatctatgttatattggggaaaaatattttctgcccaggaatcaaatctgtctttttaattcacctcacaaaacccaaatactgtttcagtgtttaagcttgtacccatgcatcccttgaacttccgaggaagcttagaaaatccatcttttggactaatgtaaatttatgcataaataggctgggatttttcagagatgctcacactcaagagaaagcaaatatgaaacatgacctccattgtgttctggacctcgtggtgtaagatctgaagacagcaaacaaaaagaacatatgtaagagtatcacagtaaaatggaaccacttaaatatgctgatcctgagtcctctaatcctatggattcctacttgcaagctaaagagtctttagtctttaatccagaatgagtcaatattttaatttcttccagcaaaagtcatcttaactgatgtttgtagtttgactcaatgttatctttctagagatgaacaagttttatcgatcataattaaagtcaggaggaaaataatagaacatttcacattagacattaagaattatttatctaatatttaatgtggtgattaacaaattcactgtttccaaaaataaatcctgaaatggggtcaaattcctactgttctatgaattcttttctgatattttactcatcccagacataagtatattaagttgaaccacctgatattccatttttgaaaagcaaaatgatcaaatattaataattttatctgcttttttaatactggcagaatgatagaaactaggcaaagtaaagtgactacaatataatctctttcttcaaagagcttccaactgatatctggtagttagggaataaatagtattcaagtggctgatacttgctagagaaaaaatataaataaaacctgaaaactgaaaaggagaggattgtgggaaatgtgtaaatttgccattcattacctaaaaattatgaagtaattgttttgtcattaagaagagtgataatctatctttagaatattattcactaccttataattagaatcacataagttcagaaaagtaaatttttgtctttcttcgtaaataatgtaggactttttcttttaatttggtacttgaaaaagataaaacatggtgtcaaagagatatatagcagtacctcttggttaagaggcattgtaatagtttacttttatgtagaacatatagactgttttttccagatagaagttaagaagataatgtttagatgcagacattttataagcaggagcatctggaagttctgtaatgtggtagttacataaagaaaatatataactcacagtgctgagtatcagtttacatataagagttcagctacaacatttgttcacaacagagtacacattattcttttattgaggaaagtggaaattaaactgtgaagaaatgttctgaacaagttccagatctagaaaggaatttaaggtacaattcaaactaagaaacatgctgttcattttgttttcacaaaatgtgatatacattcattttgttccagaatgaaaaaaaaaaaaaaaaagaaaaaaaggagcctcctgttaaaatcacagccactgcaaattcacctttaaatttagcaagccagaaccatgtggcatatttgatttggatatctccgtctttaggtatttgtttacttaagaacttgagtactaagcatattgaggaaaacatcagccatgcagactgaaagtatatttgtagatgcagccctttagaaagagcaagaactccggaaagctgctcctccataaaagcaaaaggaatattgacaaaatcctacaaatcaactttttcttaactctggaaatcgatcaaagtcatggaacaatctaagtaaacattactcaagaaagaaataatgaatctcagtaagaagagtgaggtttgatgggttatatacaaaaggccctatgcccatcccttggtcccagctgcacagaagccttgaaaattaacagaatggctagtagaagctgtgaaatccagcagcctagtcaccactaggggtgaggaggaatgagtttggaactctctataaatctaaacatcagagaattgtcactatatacctgtttgtactattccccaaaagctcaattcttaggatttgtctttagtttacttaattcagatcttgttctgggcaaaaggcccttgccgtgggactttgtctgaaacaatccctgacagtttaaatctcacctgcctgagatgacaataactgggagtaagaagaagcgatacggtttggctgtgtccccacccaaatctcatcttgaattgtagctctcatgattctcacatgtcatgggaaggacccagtgagaggtaattgaattatgagtcgggtctttcccaagctgttctcttgatagtgaataagtctcatgaaatctgatggttttataaaggggagttcacctgcacaagctctcttgccagctgccatgtaagatgtccctttgctcttccttagtcttctaccaagattgtgaggcccccaggcatgtgtatctgtaagtccattaaacctctttcctttataaattacctagtctcaggtatatctttattagcagcatgagaacagactaatagagaggctaacaaaaaaacgtaaaagtaagggagttaatacaggcctttgaaagctctaacatattcctggaaatcaagaagaaaatactcacatgcaggactgtgtacatgccaaggaaagatgaaaaaaggtttaaactctcggctcaaacattgagaacctgacaagaaggaagtgaaagcaaaggcagatttttaaactacctgtcagggcattgaaagcaaaacccaatacaagcacagagcccttccactaaagctgagactgggtgacttattggttcaaggtacttaagaaaacctcttttcaaatattagctgacaatgaaactaacaaagcagagacttcagtgtctccacaagacaaagaatataaactttatagaattagtacagaaaaatcacaaagtaaaaaatagaaacaacaacaaaaacaatacaacagtcagcaatcacatgaaaccccagggaaggggaatatctgattttcacatgaaaccccagggaaggggatctgcacagttgccttatattatatacaatgtctactttttaagaaaacattataacatatccacaacaaaacaacaacaacaaaaaagtgactggctcatgcatgagggaaaaaggagtcaatagaagctctccctaagaaagctcagacattagacttagtagtcagagtttaatttcgttctataaatatgttcaaacagctaaaagaaaccatgcctaaagaatgaaagaacaaatgaatgaaacatatctcacaaaatagggaacagtaattaatagaaatgaattcttaaaagacaacataaaataattctataattaaaacttactatgactgaaatttcaaacattcactagagaggataaacagcagacttgaacttatttttttcttaaaaaaaagaatcattgaacttgaaggctggtccgttgaaattatccagtctgaggagcaggggaagaaaaagaataaagaaaaatgaacagaacatcagaatcctatgatataccatcaagcatattaacatgtacataattgaagtctcaagaggtgagtgagaaagggacagaaagaatatttttaaaaatatttttatttttaaaaatcttttcatatttaatgaagatatgaatctgttcatctgagaagtcaattaattccagaacaataaacctgagcgatccacacccagacacatcatagtgaaactgataaaagacaaagattttgaaatgaacaagagtttagcaactcatcacatatgaggaatactcaaaaagattaaaagttgattctttatcagacaaaggagaacaaatgtctgtgggacaatatattcaaagtagtagggggaaaaaacaatttcaacaaagaagtctgtagtcagaaaaactattcttttaattttaatgagacattaagactaactaaataaacaaaaaatagactttatcactaggaaacttgtcctataagaaacactaaagtgaattccttagcaaaagctatcaaagagcaattcaaatccacaggaagaaataaagaacactgttgtgcagataaatatgaaatactttataaatttatttttctttgtaataatttgtttctgaacaaataaattaaaactgtgttgatgggtttataatatataaagatgttcatttgtaagaaaacaggacaaagaagtggggaatggagctatattatgacaaagttttttatactatataaattgctggccttcatggaaaccacattgttttagctaagatgtcatctgtaatcctcagggaatcttccaagaaaataactttcagcacatggtaaagaaaacaaaagggaagtaaagtaacactatagaaaatatgtattttgcacaaaagaagcagtaaaaaaagaaataactgaacaaaaatatcaaatttaagttttatactttataactacttaaatttaacttaaacagattaaacactcaaaaaaaaaaaacctcacacggcagactggcagaagtgattagaaaacatgatccaactctatattgtcagtaagtgatgtactttagagtcaaagacatacatagattgaaagtaaaaggaaggaaataaatacataatacaaagatatgcagctgctatattattatcaaacaaaatagactttaaaacaaaaagtataactggagacaaagaagagcattttgtgataatgaaagtgttcaaccatcaaaaacatgtaacaactataaacatgtatgcacctaaaacaccgctctaaaatacatcaagcaaaggctgatgtaactgaagggaaaataacaagtcaacaataataactggagacttaatatcctattttaaataatagaacaactagacagaagatgaacacaaaaataaaagacaacatgaaaaaatcaagtaatcttagacaactagggaacaatctatacaacaaaagctgaacatacgttatcctgaagtgtgcatgaaacatttatcaggatagaccaaatcatatgttagaccataaaataagtgtcaataaattttaaaagatttagatgacccaaattacaatttccaaacacaatagaatcaaattagtagtctatactagaaagaaatttgggcattttataaataggtgaaaattaagcaatatattcttaaataaccagtaggtcaaaatatatgtagaaaaaggggccaggtgcggtggctcatgcctgtaatcccagcactttgggaggctgaggcgggtggatcacaaggtcaggagatcgagaccatcctggctaacacggtgaaaccccgtctctactaaaaatgtaaaaaacaattagccgggcgtggtggcaggtgcctgtagtcccagctattcaggaggctgaggcaggaggatggcatgaacccgggaggcagagcttccagtgagccgagatcacgccactgcactccagcctgggcgacagagcaagaagactccgtctcaaaagaaaaaaaagaaaaagcatttgacaaaatccaatatccttctaattttaaactatctaacaagtaggaacagaagggaatttcttaaatctgataaagagtagcaaaaaaaaatccgtagttaatattatacttaatggtgaaagactgaaagcttttacctaaaatcaggaccaatacaagaaggatgttattctcaccacttttatttaatactaaaataggggtcctagcctgagaactcaggcaaataaaagaaagtatttgcagatggcctaggcttacatataaagaattttaaagaatcaatttataaaactatagagctaataaatgagtctagcaaagttgctatatataagactagtcaacaaaaatcaatttatttttatagacaagcaatgaacaatctgaaaatgaaactaataaaactatttatgatagtaacaataagaataaaacaggaataaatattacaaaggaagtggaagatttatacacttaaaattataaaacatggcaaaagaaattcaagaaatactaaataaacatcaaaaatcccatatttgtagaaaggagtttattatattgagacaaaattcctcaaattaatctgcagatttagcataatcccaatcaaaataccagatatctttcttgcacaaactaagaagctgatctgggccaggtgcagtggttcacgcccataattccagcacttttggaggccaaggttggtggatcacttgatgtcaggaattcaagaccagcctggccaacatggtgaaactttgtctctactaaaaatacaaaaattagccagatgtggaggtgggtgcctataatcctagctactcaagagactgaggcaggagaatcacttgaacctaggcagcagaagttgcagtgagccaagatggcaccacagcactcctgcctgggcagcagagtcagaatctgtctcaaaaaacaaaaacaaaaaggtgatcttaaaattcatataaaaatgcaaatgacacagaacacccatgtgttagttcattttcacactgctgataaagatgtacccaaggctgggcaatttacaaaagaaagaggtttcatggactcacagctccacgtggctggggtagcctcacaatcatgggggaaggtgaaaggctagtctcatatggcggcagaaaagagaagagaacttatgcagggaaactcccctttataaagccatcatatcttgtgagacttattcactatcacaagaacagcatgggaaagatccacccccatgattcaattacgtcccaccaagtccccctcatgacatgtaggaattgtaggaactacaattcaagatgacatttgggttggggacccagccaaaccatatcaacccagaaccaatttggaaaaagaaaaacaaaatttgaaggctcacatttcttgatttcaaaacttactgtgaatctacattgatccagaaatgtggtactggcaaaatgacagacaagtagataaatggaatggaattgagtgtccagaaataaactcctctattattttcaattgattttagcattacgaagacaattcaatggggaacttaatagccatttcagcaaatcatgctgggacagctagacacatacctcacaccatgtactaaaattaactttaaatggataatagacctacatattagaactaaaaagatggaagtcttagaaaaaaataggaataaatgtttatgaacttgagctggcaatagtttcttagatcttacactaaaacacaattgagaaaagaaacagttaaaataaatttcattaaaataagaaaatacatttgtgattcaaagaacatcaagaaaatgaaaagacaactcagtgtgagagaaaatgtttgtaataatatgtaagtgtagcgaatgcagaatatgtaaagaactgttacagcacaaaaagaaaatgacaatccaattaaaaacaggcaaggatttgaatggacatttcttcaaatatacaaatgactaatatgtatatgaaaaattctcaacataattagtcattagggaaatgctaatcaaaaccacaatatgataccactttacacctatgagaatggctaaaataaaagagacagacaacaattgttgacaaggatgtggaaaaactggaacattcaaaaatttctggtgggaatacgaaaatgtaaagctacttttgaagacaatttgaaagttcctcaaaaagttaaacatagagtaaccatatgccttagcaattccattcctaagtaaaaactcaagaaagctgaaaacatatgtctgcacaaaaatgtctacacaaatgtccacagcactattgttcctaatagcttaaaagtggaagccattcaagtattcattaataaatgaatgtattaacaaaagtaatgcattcacacaatagaatattatttggccataaaaaggaacaatgtactaatacatgctacaacatggatgaacttcaaaaatattgtgttaagggaaagaaatcagtcacaaaatacggcctgttgtatgatctcatttatatggagtgttcagaatagtccaaaccatgtagacaggaagtagattcatgtttaccaggggctggggaaaagaagaaatagggtgtgagatttcttttttttttttttttgagggaatgaaaatgttcaaaaatcagatagtggtgatgattgtacaactctgtgaatattgtataaaccactgaattgtacacattaaaatggtgaattttatgtcatgtgtattatagcttaataaatcttttattacaaaagaaaatacattttggaataagaagtctataagaatatttttatattttaaaatattgattgcagtgagctgagattgtgccactgcactccagcctgggcaacagagtgaaactttgtctcaaaaacaaaaaaaaaatggaaatttgtggtgaagtgtagagttagtgttcactggaaaataaattgactctagacttcaagatagagatgcagaaaaatgtacatcaagatgtcttttagagtatctgaggatataattgaggaaagacaggtactgttttattcaagaaaatcataaaagtatctcccaaagttattcatctcggttctgctcccacactgttgctcccaggaatgttacctgttttctacctcctggctactgttatggccaagccagcaaccatgaagaaagtgaaaagaatgcaggaccacatgatgactgttgtgggtaacttcccccataaaaagttagaatttttattttataacagcatttatataatgaaaaatgtattactattatatatttaaacactttcactgacataaaagtttatttttttcttctgatttaaaaaaaatgaaaaagtttcttgggaccctaaaagtaggatgggcctaggcactgtgcccaacggataagtcagtcttaaagatgagatcagcactcatagttggaaacttagcacaagtctaggcttgcccagaattgcatgaagaaggcgtaagatggggggcatcagaggcatctactctagtcagtcacatgaataaatatttttacttaggcctaatattatatcttcttaatcttcttataacaccttccataaacacactttataaaatacttcaccactactctaaattgccagctctatttttataactaggatgatatgtaatgctatacggttacattataagacaaaatgatgcctgatattattttttgacaacacgttttatctactcatccttgaaaattgcatagaaagtaatttttttatccagtaacatgaatcaatgaaataaaagagggcactgtaataatactgatgtcaaaagataacacctatcttataggcttttttcttgttatattaagggagaagtacaacgtacacagtggtcatggtttgacccaagatataatcgaatctgtgaaatagcgaagtgctttgtaatagagttttactgtaattgctttgtcaggttatcagtcttgtagttcttccctaaatagaaaaagtttgtcctgttgcttgaaggtatagtgaattttggaagaatgagtatatgtcagctaaggtggcattgacccaaaaaaggcttgaacactgagcagaccaaggaataatacttctgattacagactagtgcagacagaataagaaataatcaggtgaatgtgttgatagggtggggatgagggttaaaaggacaaaaataaattcataaaaagttcatcctgtactggaagttttagactgaaggaaaatgagctaaaaatgctttggttaaattttccaccagttgctataaagtcattagaagcctctgtgagtaaaggaggtaactcccagaaagtatttatagatttagaaagagaataaggttaagtttccttggagacatagttctttcaagccagatctaacctgatctgaagtaactctaatattaagagaatttaactgaatattgtctgcttctttctcctaaatcaacaaaaatattagattgtgtcatgtatcttatgatgttaattatacaatgaatataatttacattattagcaagataagtaattaaaatgtaattcaatctaccttagaaataaaagatagttttttaaaacttgttgtcattcccatttaaactcattaaaatacccgtagaaaagatccttaattgctgctttactatagaaacatgaaaagaatcacaacttttaagaagaaactataaaattactcttataaaattatcattttgctctttatgccaaaatctttatttaactgtctttcacatttttgtaatgtgtttttaaattatctactattaggtctaaagccattgtagtaattttattaatttgataagtatcactgaaaattcaagtgtatacttatgtataagtacatatatgattagacttttgattccagacttcattccacatttagtttttcattcagaacctgtaagaatttgattcttgtagggcagtggctcttaaaatttagtatgagtaaagattacttcagggtttagcagtatagctcctaactggagattctttggtactagtggggatacactatgaatatgcattctaaaaatcaccccagtctcttaatccgggagaaggaagaacagtactattatattgttatacttatatatattatatatatatataatatatatattatatatataatatatatattatatatataatatatataatatatatattatatatataatatatatattatatatataatatatatattatatatataatatatatattatatatataaaatactgtattatatatactgttatatactgttatatataacatatatataacatatataaaacattatattatatactgttatatataacatatatataaaacattatattacatactatatatactatgtagtatatattatatactatagtatataatatatattatatactatagtatataatatatattatatactatagtatataatatatattatatataatatattatatactattatatactatagtatataatatattatataatatattatatatactgcatatatacagtattatatatactgtatatacagtatatacacagtgtatatactgtatatatatacagtattatatatacatatatagtgttttttatatatactgttatactattatacatatatatatgctgttacactattatatggtttagacaattaggtaatatctattaatactcagcaatgtattcaactctaatttgtctcctgtatctctggggctggagttctagaaatcacattcttcagactcacttcctagctgagttctaatttagagtctgccaaagagagacactgtcataagattttggagacagaagaggaccagaatttatttttgttccactaacagttggcaggcacattgacttcagctaaaagtaaggttatgctctcttccagatattctcctataaatgaattaattaggtgctgcaggtagctgaaattataagtgctgatttcctgtaagttatgaaacttgaaaatttcctgataccatcacacatcttctctgatatgtattctatccttcctccaagggtattaactcctttctgcctgaaatatattcttagcaagactttgagatacatagcatgtgaataaaatagaggttaaccatatgcctaaatcctggtgactcttatactctacctgcatgtatgcaagacctcatcctcatttcaagccccccactttatttattggcttctctgtgggaattaatatactgtattccaagagtacctatctacccagcttctgctgcttagaaccttcattctcaggcacagaaactattcttgtaactgtatcagttacactccaaagccagggcaggggtgagaggctatataactggctttctgagttagaacacagaggacatacatccttagttaaaatgttataaatgatggtgaaataaaattcagccagtactatagctacttttgtcacactatagataatacagaggcatctgagtcttataggaaaacatatatatcatttttgtgcagtcaatttgggaggccagtagtttataaaagaatagttctctaatattagtactagaaataagcactccaaatttgtgttagcagtaaaaatcatgccttgtgccctcctgttgaagactgttaggttggattcaggaatatgcatttcttataaacatcataaaatttctgatgaatatctttccagagagatactttcagagaaattaccttaaaccatttatggaataaactaatttttatttcaaaagtctaattttttcttaactaaagaaagagctttgggaagaacagattgatagaaaacatccatttttccctatagagaatcaaaatttaatctaatgagcagaaatatggaagattataacccaaataagttatcttaaaaaggttaaatttggctagatatggtggctcatgcctataatccaagcactttgggaggctgagttgggcagatcgcttgagcctaggagttcgggaccagcctgggcaacatggcaaaatcccatctctatagaaaatacaaaaattagctggccatggtggcatacacctgtggtcccagctactcagaggcctgaggctggaagatgatttgagcccaggaggtcaaggctgcaatgagcactgattataccactgtactccagcctgagtgacagagtgagaacttgtctcaaaaaaataaaaaagtaaaaaggttgtgtatcatgatgataatggcttccaatgaattacattccttatatccaaattcctttgcaatgtgatgtctctactcttctcatcaacagtggagtatatttcttcattgtcttcaatatgagcttcttctgtcagtctctttgaccaatagaatgctgccattttagaggtgaggaagcaaaagaggtaaagtagcttacccaaaattacacagccaataagtggtagggctatcattaaatattaggcagtcaaatttcaaaatttatgcacttaataagtatgttgtattgactttcataaattgaatcctcatacaaagcaaccaaggggaagaggccaaaatgactgactagaagcagctgcccactgggggctcccacagagaagaacaaaatggtgagtgaatcctacaccttccactgaggtatccaggttctctcattgggacagactaggcagctggtgagacccacagagagcaagaagaagcagggtggagtgacggcccacccaggaggtgcataaggcaagggaagctcctacccccagccaagggaggtggtgagtgattgtgccacctgcccagaaaaccatgctttctccatatatctttgcaaccctcagatcaggagatccccttgtgagcccacgccaccgaggccttgagtcccaagcacagagctgtgcagaagctcagtggccactcatgttgcagccagcagcaacaggctgaaaactacctaagactactaccaaatttactgggggagggggccaccatcactgcagctccagtctgccatttttccctgatagtgttggggagactgagtggtttggactgggaggaatttcccacagtgcagcacagcagctgtggtaggtcatggccaaaattcttctttaaatgagacccagattcattccctctcactgggtagggacatttctatgagaatttcagcaactccagccagggatttatggacagaactccaatctccctggaacaaggccctgggtgagaggtggccatggtctccagttcagcagacttagtccttcctgccctgctggctctaaagaggctgggcagtccagaaaagggggattttccccagcgcagtgcacccactccaccaaggagaagacagaatgctttgttaagtgggtccctgactgtatgattcctgactaggtgagactcccttaacaacaggggttgccagacaccttatacaagggcattcccatggccatcaggtcagtgcccctccgggacagagctcccagaggaaggagcaggcaaccatctttgatgttctgcagcatccaatggtgaaacctcaaggtgcatgagggacccaggggaataggagaatagggtctggagtggacccccagcaaaatgcagcagtcccacggaagaggggcctgactgctaaaagaaaatccaacagaaagcaacaacaacatcaacaaaagagacttcacaaaaacctcattcaaaggacagcagcctcaaagattgaaggtacataagctcatgaagatgaaaaaaagatcaatgcaaaaacattgaaaattcaaaaatctagagtgcctcttctcctccaaatgattgcaacacctctccagcaagggcacagaactgggctgaggctgagatgaatgaactgacagaagtaggcttcagaaggtaagcagtaataaactttgctgagttaaaggagtatgttctaacacaatgcaaagaagataagaacaataataaaacattacaggagctgttaatcacaataaccagtttagagaggaacataaatgacctgatagagctgaagaatacaagacgagaatttcacaatgtaatcacaagtatcaacagctgaatagatcaagtggaggaaataatttcagagctggaagactatcttactgaaataagacaggatgccaagattagagaaaaaagaatgaaaataaatgaacaaatcttctaagaactatgggattaaaaagaccagggaaaatggtctctttccaagatggaaaacatacttgggatattgtccaagagaacttccccaatctagcaagataggccaatattcaaatttaagaaatccagaggaccccagtaaaatatttcatgagaagatcaaccccaagatacataatcatcagattctccaaggtcaaaataaaggaaaaaaaatgttatgggtagccagagagagaaagagaggccaggtcgcctacaaagggaagcccatcagtctaacagtggactgcttagcagaaaccctacaaaccagaagagatagggggccaatagtcaacattctaaaagaaaagaatttccaccccagaatttcatatctggccaaactaagcttcataagcaaaggagaaataaaatctttttcagacaagcgaatgctgagggaattcattaccaccaggcctgccttgcaagagcctttatggaagcagtgaatatggaaagaaaaaaccattaccagccactaaaataacacgctaaagtacagagaccaatggcattatgaagcaactacattcacaagtctgcaaaataaccagctagcatcatgatgacaggatcaattcacacgtaacaatattaaccttaaatgtaagagactaaatgccctaatcaaaagacacagaatggcaagctggatagagtcaagacccattggtatgctgtattcaagagacccatcttatgtgcaaagacacacatggactcaaaataaagggatggaggaaaatctaccaagcaaatggaaagcagaaaaagggaggggttgcaatcctagcttctgacaaaacagacttgaaaccaacaaagatcaaaaaagacaaagaaggacattacttcatggaaaagggttcaattcaacaagaagaactaactatcctaaatataatgcaccaacacagaagcaccaagattcgtaaaacaagttattagagacctacaaacagacagattcccacacaataacagtgggagactttaacatcccactgtgaatattagacagatcattgagacagaaagttaacaaatatattcaagacttgaactcagctccggatcaagtgaaactgatagatatctacagaacgatctacccaaaaacaatagaatatacattcttctcagtgccacatggcacttactctaaaattgatcacacaattggaagtaaaacactcttcagcaaatgaaaaagaactgaagtcttaacaaacagtatctcagaccacagcacaatcaaattcaaactcaagattaagaaactcactcaaaaccacacaactacagggaaatttaacaacctcctgaatgactcctgggtaaataatgagattaaggcaagaatcaagaagttctttgaaactaatgagaccaaagagaaaacatccagaatctctaggatgcagctgaagtagtgttatgggggaaatttatagcactaaatgctcacattaaaaagctagaaagatctcaaattgacatcctaacatcccaactgaaagaaatgaagaaccaagagcaaacaaaccccaaagccagcagaagataagaaataaccaagatcagagtggaactgaaggagatagagacatgaaaaacccttcaaaaaatcaatgagtccaggagcttgtttttttttttttgaaaaaagattcatataatagataaactgctagctagactaatatagaagaaaagggagaagattcaaataaacacaaacagaaatgataaggtagctatcaccactgaccccagaaatacaaacaaccatcagagaatagtataaacacctatatgcaaataaactagaacatccagaagaaatggataaattccgaaacacatagaccctccctaaactgaacaaagaggaagctgaatccctgagtacactagtaatgagtactgaaattgaggcagtaataaatagcataccaacaaaaaaagccccagaccagaaggatttgcaggtgaattctaccagaggtacaaagagaagctggtacaatttcttctgaaactttttcaaacaactgaaaaagagggactcctccctaactcattttatgaggccagcatcatcttgataccaaaacctgacagggatacgacaacaatattaataaaaaaaacttcaggccaatatcactgatgaacattgaaagcaaccaaaactaggtgataaaagttttcagtaagaaaggttaaaggaaaaacaacatgccattttttcaggtctatttcaaaggtgttaaaatgttattaccaccgtctcagaagaagattttcaaggacttttgtcattggttttctgttattctctctactgttaagacattgtcaattgtataaatggaatcaaacactggtaatcaagttgatgaaaatgaagtatcagcataagacaaccaaatgtctaggacaggattagatgtcatctaaatatcgctgagaaacaactcaggggaaatttaataggtaaaatgtatcaaaagataacaaagataggataatgtaataatgacaaaatctgagagtcaatgaatagaatgaagcaggttatttttcagggaaagtgtgttaagtaggaagactaaaattaatgagagaaagatctacattcaaaggaattattaccagttatataattttatcccgggaattattcttaaagtgaatttttaaaaggcacattattataaaatcattactcaccatctttgtaactacaatagctatatgcatgatgatcctaagcaagatgctgaataagatctccttgttgcacaatccttgtgataaatagcacaaatataaatactgagaagaaaacaaatctctataatgtgctactatctctctgttattgaaaaattttccctagtatcatttactaaaatttgttggccagtaactgtacttcactgtatatagtctatgcaagggttaacaaaatacatgatatctggttgtttgtattggtttacaatttacaatgagaataaaaatcagactttcccatgttatcacaatggtttcaaatgattcacagtgtcactaaaatacattcagaagagatttctaaagatttgttacaactgacagagctggaccttctagatttctctttcctagcaacaatatatgagttgtaaatgcagcaagcatccttgagtattttagtctaagtactaagtttagaatgaaaacaaagaatactttccaatctatgttaggcattttaatctttctttctttctttctttctttctttctttctttctttctttctttctttctttcttttctttctttctttttctttctttccttccttccttccttccttccttccttctttccttccttccttcttttcttttttttctctctctctctttctttcttttattttttcttgagacgcaggcttgttctgtcacccaggctgaagtccagtggcacaatctcggctcactgcaagctctgcctcccaggttcacgccattctcctgcctcagccctcagactccaaagtagctgggactacaggcgcccgccaccatgcccagctaattttttgcatttttagtagagacagggttcttgcattatcagaaataaaacttgtaataaaagaggaaattaatcaaaacaaaaataggaagttctgatttcttattgactggcagtagtctgagcagctaagtctaaagaagacctcaagtcttcaagtacttttctctctcaggagtagtcttattccattgctggatggcaacactgattaatatgatgtgatttagatgaaaaaagaaaaaccaaaataaaattgataaaaaaaaaattaggtgctagagccaatttctgatgaacttgcttgttcatcaagttcagtcaccagtgaaaaatcaatgacatgaaaatggactactaagtcacactgtgatcatttcagaatgtctctaacaacatttggaatccctaatctgtccagaaaatctctctttttccctaccaacttagtgctacaatacagtattttaaagtgtctaaagacctacaaaagttttatggctcatgttcctacattcgacttggatggattctagactacctctcaaatgttccattattcctcctttctctcacacacacacacacacaaaattatacaaagccactctcaagtaatatttgacttcttgacattttcctgagtatataatgctgaaacatccccaaattcacaagcagaaaattattgcttctaaatttcaccagagattttaagccatattttgtgccatggatcactttggtagtctagtgaagcctttggacttcattttaatttaaataaagccaattatattgcaatatagttttgaaaatgtttttttaaaatatatgttagtgtttaagataataagttccagacgtatgcttaataatgacaatattgaagttttcatgagctttatttcaaaatatctataataaatgtttcttgtcatataaaatttattatttctattaggaacaaagttacatgtactacctgacactaatctggtattccacttgtattcataatggggactgctaatttttacctagtggtttacatttatatatataattttccctctcaaaatgcatgtatatgaaccccaaatcttaaccacagattcttgggcatccatggactccagtttaagaaccactgccctataagtgaaacataaattatcaccttaaagagatactctgcaaattctttttttggattgcttacagtgatctgagcattatctgatattactctgcaaattaatatccaaatactcccataagctacctcttctccataaatattaaaaccatattctatttatagtatctttgaaaaagtctgggaagggaggttatcactgttgggttcctgctttcactttgtttggaacctggcctaatatacattgttttatgtactcaaagtatgcttttaataggaatatgtgtttgttcatttttattccttctctcaaaagccacatatatagagtttgattggcattgtgttattagtaacaagagggagactagcagttcttatgacctacaacttacacctattatgtaaaagcattacaataattgacactggcaattttctccctttctgcatcctaaaagtgtctttgtagaaaaaaaaatacctaaaatatttaaatttgtgaagcagagatgctataaaatgtagttcactgcaggtagacaactgccaggaatataataatgatagaaatctgtgcatacgtaagtataccccaatatatatccctattattcatgtagcaatttctttttgcaaagtgataagtagaaaccaattaatggaaataccagtaagaagcagttaggtagggttatattagaggatgctggctagatcagaaacaaaatgtgggcagtcaagaaaggcatcaatgcctactctaaggaatttcttcagtcattcactagatgatcagtaatgatcacttgattattgaaaagaaaatggaaaatgcttttatgacattgctgcagtgagatgtccataattaaattgctctcagttttggccttttatgtacttcaagatccctcattgtgatggttaacactgagtgtcaacttgattggatagaaggatacaaagtatcaatcctgggtgtgtctgtgagggtgttgccaaaagagattaacatttgaatcagtgggttggtgaaggcagatccacccttaatatggtgggaacaatctaatcagttgctagcaaatataaagctggcagaaaaatgtgaaaaggagagattggcctaggcttccagcctacgtctttctcctgtgctggatgcttcctgtcctggaatattggactccaagttcttcagttttgggacatggactggctctccttgctcctcagctttcagacagcctattgtgggaccttgtgatcatgtaagttaatatttaataaactctcctatatatgtatatgtgtgtgtgtgtgtgtgtatatatatgtgtatatatgtatacatatatacatatatacacacatatacatacatgtatgtatacatatatatcatgtaagttaacacttaataaactcccatatatacatatatacatatataaaatacatatacattatatatataaatttatatatactttatatatatgtatatgtatacacatatacatatatatatatatatagataaagctgaggagcaaggagagccaatctgagtcccaaaagtgaagaacttggagtctgatatatatacacatatatgtgtatatatacacatatatgtgtatatatatcctattagttctttccctctagagaaccctgactaaaacacgcatagaggaacagaaaggcatgatctggaaaagcagttgctactcattcctcctttgcgccttttaccactttgttttggatgggagaagtaaatgaacaatatattttgctatggttgttttaaaatgtattcagctttaaattaaattaatacatgtcagtgttccctgaattaggtttataatctttttaaaaacccacagtaattgtataccccattcttccttcacttaccttagttatcaatctcatgaaagagtttacaattctaagttgtttcccctttgtatgctttttcatttatatctactatacatttgcggccattttctgatatttgaatatttaatacaacattctcacaattggaggataaagatttaagtctctcatacatattatctacccacacttcactttccttcttaatttcttctaatgtagaattcatcttgtaatgaattaccagaattggtattcaggataaatagtattgtaatttgtgacaactgaggatttactattcaattaacaaatttctatggctatataactttacatttttctggaacaattgaattttggggggagtggtgtgcctggttttccatttttttattcactgccaacagaaacgtaaaacttcttcccgtgttgagatgtgtgagtatgtgtttatatgtgtgcactgatttattgattacatttttttccctgagaaaatttcttccagattaatttttctgattcccctcttcaaatctagctagttgttctctaggtgggctgcttacctgtcctctttggatttttcttcatgttatctagagtattcccttcacttagaaggtgctttttatcttctgtttcatggattctatgttatcctgcttctggtttagtcattttgtggagcttatcctctagtagcttatggagaaatggtgaattcaggaaaattttaaagatacatcatgactgaaaacagcattattctttcccttatactcatagtttgcctgagtatagaattctgtattggaaatttggagccagaaattttgaagacatgacactagcatctaatgctgatgtttagaaataatgtcaatccttttagtaacctgtttttctttctcaataatttttaagaatctctttatcttcactcctctgaaattcaatgatgattcaacttcatatggctatatttttctgtaattatactgacaatttgatgagacctttaattctggaagtttgtgttttatattttctgtattagtgttcatgtctttttaaaattccttattcactcagttactttcaggggacttcctagacagactccaattttatataactttgtcttttgctctaccttttgagatgttactcaaaatatttcctatgatttttctgacaattttaatacatttctcatgtgttaaatttcaaagaaaattcttatttaaaattttctataatttcttaattttcaccaatttaattatgttataggtaattttttatttaatcttaccataaaacatactcatttaatacttagctatatacattttgcacataaacaacacaaaaacataattttttctcattaatacactttttttttatttcaatattttagattcagggagtacatgtgcagatttgttacatgggaatattgcacaatgatgaagtttgaagtatggatccagtcacccgggtagtgagtatagtacttatctgacaggtagttttttaaacagctcccctccctccactctctagtagtccacagtatctattacttccatatttatgtccatgtgtgctcaatgctttgctccacatataagtgagaacatgtggtatttggttttctgttcctgcattaatttgcttaggatgacctccagcattatccatgctgctgcaaaggacatgattttgttcttttttatggttgcatagtattccatggtgtaacaaattttcgttgatgggtacctgggttgattccatgtctttattattgtgaatagtgttgcaatgaacaaacaagtgcatgtgatgttttggtaggataatttatttccctttatgtatatcctcagtaatgggaatgctgggataaatagtagttctgttttaataactacctttgagaaattttcagactgctttccacagtggctggactaacttacatttctaccaatggtgtataagcattcctttttctctgcagctgccaccggaatctattatttctggttttatcgcaatagccattctgactagtataagatggtatctcattggtttttcatttgcatttctctgatgattagtgatgttgagcattttttcatgtttgttgatcacatgtatgttttcttttgagaagtgtctgttcatgttctttgcccagtatttaacggggttatttgttttttgcttgttgtttaagttgcctatagactctggatattaggcctttgtcagaagcatagtttgtgaatatcttctcccactctgtaggttgtctgttttctctgttgatagtttcttttgctgtgcagaagctgtttagtttaattagggcccacttgtctatttttggttttgctgcaattgcttttgaggacttagccaaaaattctctgtgaaggctgatattgagaatagtatctcttaggttgttttccagaatgtttatagtctgcagccttacatttaaacctttaatccattctgagttaatttttgtatatggtgaaaggtaagagtccacgttcaatcttctgcatatggctagccagttatcccaatatcatttgttgaaaagggggtcttttcccaattacttgtttttgttgtcctctgaaatccgcagagacacaatgaaaaaaggaaaacttcagaccaatatccctcatgaacacagatgcaaaaatcctcaaaatacactagcaaatcaaatccagcagcacgtcaaaaagttaatatacaatgatcaagtaggctttattcctgggatgccaggctgggtcaccaaattcaaagcagtaagtgtgattcaccacgtaaacagaatcaaaagcagaaacgatatgatcatctcaagatacacagagaaaagctttcgataaaatccaacatcccttcatgataaaaaccctcaacagagtaagaattgaaggaacataccataaaataataagacatatctatgaaaattccacagccagcatcatagtgaatgggcaagtgcttaaaccattccccttgagaagtggaacaagacaaggttgcccactctcactactattcaatgtggtactcgaagtcctagccggagcaatcaggcaagagaaataaatgaaaagcctccaaataaggaaaagaagtagtcaaactatctctctttgctgatgacatgattctattcctggaaaatcctagactctgccaaaaggctcctagaattgataaacaactctagtaaagtttcaggataggaaatcaatgtacaaaaatcagtggtattttttatacaccaataacgtccaggctgagagttaaattaggaacacaatcccagttataacagccacaaagaaaatgaaatgaggcagcgctcctttcacgggggcactagctgcagggggtctgttcctgcagagccctgattcagcgacagatgaataaagtacactgatacgcagatactctgcactgtcagtccagctgagggtccgagccgcttacaggctccaagctgagttctgtaaacagttgcgactcggccatgatcagctagtgagactcacatttattcagtaagactaattaacaaaagttgtgagtaaacaccactagagggtaaagattaaaggccaggttcccaggcctaaagcaaacaccatttgcgggtgataaacttctgccaatccccacccgctcccagtaggaggcagtaaagtacccgcggtaggacaaaggtcagtcttaagcccatataagtaaacaggttagtaagataaacttcccacattcctttgtacttgcaccctaatctttctggctcctgaaaagagaccctggctgccttccaccaagcaatctgaagctatgcaaactctcacggccttccaagagagtttttgactattactataactatatttaatatttttcccatcagcttgattgaaccctaacaatgaaatacctaggaatacagctaaccaagaagtaaaagatctgtacaagaaaaactaaaaaatactgctgaatataaccgtagatgacacaaacaaatggaaaaatattccatgctcatggattggaagaatcaatatcatttttctaattcttgttttgtggaagatttttataaaaggaagataatattcacaaatgtattttcataattaaaattaatattttgaattacatgagtatgaccataaatgatgggtctattacatttttaaaacttccattaactaaggtaggcatttttgagaactttacgagatgacattgcgttgctctcatgcctattgccagggtgattgcacaataactatattatctattgcgtgaacaaagcttcctcactggtctccctagcacctaatttgttgccatgtgatacattttacaggctgcagcagaactagtttaaacacacatgtcacatttctttttagagaattcagttatagttttgcattactctacagctaaaatctaaattcattaatgtgtatgaacaggctctggccattatccatatcttttgtccacctctcttctctcttcagtgtactctgactaaactgtactaaatttctgtcatctctattatctatttttcctcatattccatactgttttcactgtctagaacaacattttatccatgccagttttgggggtgttagctcattcattcttagagaaatccttcaaaaatggttactatctgatacttccactctcatttaaaaaaccacactttggtctaatcattctttttttgttttttgttttttgtttttttgtcttctactattctgaaaaacttaattttaatagtagttaggtgttctaagatgtcagcttgacaatagtgtgcaaggtatttagttaacttaaccttgaactgatactaacttcagttaattaattgatattcattagctatctagatcatttctaagtaaggaaatgttaaaacattgttactgatgcctcattgtgaaggtttacttctgggttaacttcttgagattagtttatattccttttttacttacttttggagaaaaacgttttgtttattatacccatagaaatagttcttgcatagtcatatatgctattacatacaattataaaaaatatattcaagttttcattttagtaattaatactgctcttcttttttcacatttgaggagtatatcttgttttccagaacaaataagacaatgtggcttagcaactcttataaatattttaacaacgttgaactttatctgaattttgtgttcctaggaagtagcagcatttaagaaaccaccactacttctgccattcgtttatgttccaagaaatgactaaccataaaagaccactttactcttgtatattacaagaaaagagctgtcacaatcttttctcatgacttccataaaccttgtaattatttacctgcctttgtaaaaatccccttcctttccttttccttacttaacattctctttcttagaataaatagcataaataaaattatctctttaattgtccagtgcattttgtctttcaaagctttgatgccaagactcaaagaaaattgaaactaccatggatccatatttattctacccaggtaatgaggtctgttggtaataaggtctcttggtgtaccttgtgcactgttcctgattagcaaccttctcacttttgaaagaaatacaatcatgtaatctcataggtttactttcaaagtattttattgtcattttggttaaataggcaaccaaataattttcccctataacctattatcttgtctttatcaactattcaaatctcttgaaatattttgatattttgctttccaaaaatagtattatgtcacaaaagacccaaacaaatgaaaaaacattccatattcgtgaataagaaaactcaaacttgttaaaatgtcagttcttgccaatttgatctatagattcaatataatcacaatcaaaatcccagcaagttgcttgtcaacatagtaaactaattctaaggtttacatagaaagtcaaaagaccagaatacctgacacaatattgaagaagaagaatcaagtcagaggacactacctgatttcaaatcttactatgaagctacagtaatccagacacatagattggcaaagtaacagacagatggatcaatgaaacagagtagaaaacccagaaatagaccctaacaaatatactcaactgatttttgacaaaggagaaaagaactaacaaatgaaaaaaagattgtcttttcaacaaatggtgctgaaacaaccaggtagctagttgcaaaacagtgaatctagacactgaccttacttaatataaattaactaaaaaattaacctaaatatagaagtaactaaaaatcaatctaaatataatgcaatatgaaatgcaaaatttctagaatgtaacataggataaactccatggtaacttaggtttggaaatgaatttttagatacaacaacaaaagcgtgatctatgaaaaaaattaaaatgttagacttaattaaaattaaaaacgtctgctctgtgaaagataatgttaagagaatggaaagacaaacaacagacttggagaaaatatttgcaaacacatatctaataaaagacttgtatccaaaatatacaaagaactcttaaaactcaacaattttttttaaaagtccaatgaaaaaataggcagatgatctgaacagccacctcaacaacaacaacaaatatatatatatggcaaataagaatataaaacaatgctcaacattataagtaattataatcgaaatgtaggaaaatccaaaacatggacggaattaaatattgaagagaatgtggattgacaggaaatgtcattactggtggaaatgcaaaatggtacagccactttggaagatagttttaattatttatttatttatttatttatttattttttgagatggagtctcgctctgtagcccaggctgcagtgcagtggcgcgatctcagcccactgcaagctccgcctcccaggttcaagccattctcctgcctcaccctcccgagtagctgggactacaggcgcccgccaccacacccggctaatttttttttttttttgtatttttactagagacgaggtttcactgtgttagccaggatggtctcgatctcctgacctcgtgatccacccacctcagcctcccaaaatgctgggattacaggcgtgagccactgtgcccagccggaaggtagtttttaaagttattacaaaactaagcatactctcatacttttatacttttaccatatgattcagctaccacactccttagtatttgcccaagtaagttgaaacttcatgtctacacaaaaatcttcatatgaatgtttatagcatcttgttttataattgccaaaaattggagaaaactaagatgtctttaaataggtgaatgaattatttaaaaaaaaaaccgtggaacatccatctgaatagtggaataacatctgaataatagaatgttattcagcaataaaagaaatgagctatcaagccaccaaaagacatgcaggaaccttaaatgcatattgctaggtgaaaaaaagccagtcttaaaaactatgtactgtatgattccaattgtgtgacattctagaaaaggcaaaactgtagagacattaaaaaaatcagctcttgccagggcattaagggtgaggaggaggaatgaataggtagaataggaggaatttttaaggcagtgaaactattttatatgatactgtaatggtggatacacgagcttatgcatttggcaaaacctgtagaatgcacaatacaaagaaagaacccttatataaactatggcactagtcaataataacatactagcatttgtctgtcacttgtaacaaatataccacacgaatgaagatgtcagtaatagggaaaactgacaggtagagaaaggaagtatacaagaacactgtaatttctgttcaacttttgtatcaccctaaatgactctaaaaggtatattaattaaaataaaaattataaatgataccttttgagcttaaaactgtatttttgatttcccagaaggcttctggaaaatcacaaatgatttctttcacttcgaaaagaaggggtggcagaaataattaggttcatttaatatgttactgttgatgcaatgtatatgaagaatggtcaaatcagaagagattcttagactttctagggttaaattgtattgctaaaatgttcttaatgtatggattacagaacatgtatgtgaagttcgtatgatttgtctttgtcctcacagtccatggcatgtttctatcattgttctttggctgctttgctgatattagacaatagtatagtattttcagtaataatttcagttatttgtaagacatcaacttgtttgtaaatctagttctttaatataaacagggcatctctcttaggccattggttttgaactggggattcatatcatttaactgtagagttttattaatatacagatattccagatttacataatttatttttattcttgatatattctgactatatgttttgatatctggagtattttctttgtaaataatatgtccctttcagctttgtaagttaaatgtactaactgtatctactatttttgcaaatagttttattatgcttataaatttttgtctaatataattttggattgacttttatcttattttgcatgccacaggaaataaacaaattttctttttcactcgtattattcttgtaatgaactctcatcagatatttcagttttttaaattactaatattaagttacccacagcctttttaagtctttgtcatctatgcatagtttttgttttattctaatgctaccctgaaagcacttgtgatcagccttaagccagtatgcttcatatttaacaacaacaacaacaacaacagaaactgtgttagagatccataggaaaggactatacaaggtacttttgggtacaggtttctgacagcagtatttaaacagcttttggatcacttctttgtatttccaaaactctaagtaagaggtggacaggttcacaatatgttcaccaaagatagatcacgaaaagaattaattatataagactgagtgtattgatgagagattattgtggattttgtttcaaattattctgattttttattgttctgttttttagacatacaaagcgtctcctaatcttttcttttaagctatgtataacttataacaatttagtaaactatggttttgcaaactaaaattatacatttgtaaatgatatgtttttcactctgcctgaccattcctgaattcaaaaaaatcttattgagtatcattatttttgtggaaatataagtcttttaatatattcaatagagcatgttttctttgttagcaggacataattggaaaatatgtacccaaagccttgtctgggctatcacatttgaggatgatgctcacatactcagatatgaccatataattttaaggaactaaggttggcttatcgagacaataatcacaaagccctcttgggaaaactaccttcatacatggcttacaggatttccaacattacagatgcgtaaagaaggccacttcctatcaagaccacaaaactcagaatgttttgggggctttaagaaaaaaaaagtaacactgaaatttaaaggttttcaggtgatgacccgtttgttagtttcctattgttgctataacaaaataccacaaacttgtagacaaaacaaaatattttattatcttaaagttttgtaattcagaagtttgaaatgggtatcactgggctaaattcaagatactagaatgtctacattcctttctgtagactgtaggaaataattcaatttctttcctcttccagcttttagaagccacccctattctttaattccttggcttgtgactacctttcttcattttcaaagccagcaagtacaagttgatttcatcacaactcataatttggattctctttttctgcttccttcttccctatttaagaacagtaaactttatataggtaccatctgtataatccaggataatctctctgttttatgatcagttgaatagcaaccaattcgatcttgaattgtaatttccccttctcatataaagttgtatattcataggttccagggattaggatgtggacatctttgtggagggcattggtctgacaccacaccagctcttggcttgacttctagttttaagagacttttaaaagtacaatattagattttctttttaatgaaaacttccagcaaatcaaaatttaaaaatccaatatggtaatttactactcttgcccctcctatgtaataatccagccaaatctaatggtactactatctaataataatactattttgtgatcaagaataatctttctttgaaattagtttttatcaaaaaaggggtcactctgaagagaaactttgtgaatcagttacaaacaatgtgtcatctatagcatatccttttggtttatcaaattctagccctattcattctgagctatctggagcccacattcatctttagctatttttcaccactatgtaatttgccaatagctgatgaatatgcaaattctgttttgcctgatggacatttaattgacttcctaaccttccatataaaatcagttttggtacctacttatagattagacagatattattaccttgtccaagttgtcaatccttgacaaaatttcaattctccaagttttctttaatatctgtcaatagccctccaaactaagttttccaatctttctccttcctcagtgtcaccaagaagtaaaacttgactttgcatatctttatcttgactctgattgtgttggggctggccattttaccaggatctgaagaagttctgcaagtggaaccttggctacttgatataaatcttgaaggactaaccactgcaagagaccatccatgggcccaaattcttcctgtacaaggtcctatctggatcattaaggaagtctagcaaaatatccatgtcatgatacaagaggtaaccagactatggtcagcatccaccaaggcatcaattttctagcttgagagttttgagaactcaattagtagtgctgcataacctcctggaatccactagactggttaatctcagggtccaaacctggattctttattttaatacaatattttatatcaatatttctctttttcattattttaggcttccctcttttaagattcctaaactccaggacaagaacagtcataacaagggttctcaactctgctgagccattcaacagatggttcaaccagttttacagaaaaaaaaaaaaaagaatcttccagtgactatttctgacatgcttctttgcctcactcagaaagttaatgatcaactcaagttatttagcaatgaagacatttgtcttgtacaaaaagagggattgacaatttcgaacattatcatgatctctataagactcaagtgacacacttgtttatttgcctccataaaacaccagacccctttctttctttgagacatttctcattaattaatgttctctctatgaccataaccttaataaaataatctccttaacagtctactgcacttagtctttcacaagttcaaccttttataataggcttctttatcaccaataaactaattacataatcatagaaataaatatgatagtgatgatgatgatattgaatacatactgcttattctgttcttagcatgttatatataacaacgatttaatcttcattacaaacctatgaagtagacaatgttaatatctccattgaaccagtgagaaaaatctgagaacaaagatattaggtaagtagatcaaggtcacagagcttgtaagttatagaaccaagtttcaaacacaggctgcctggttccaaggtctgtgctcttaacacttatgccaactgccttactgttaagcctctaaaaataacttttcttcatccagaagactcctccaatatggttctgtttttttaatccctgttgtgattacctttcttaaggtggtgcaatacaatcgccctaagtgttctgctctctgtggctgtgtataagagaacaaatgataaagtactttttcctccaaacaaaattcttcatacattatatatttttttaaaaaatttactttcatggtgtagttttattatcattgtatttatatttgaaaaatatatttgagtacaattttcataaacattgtctctagagctagactgccttggtttgaatacctgcttcaatgtttaccagctatgtatcactttgcacatattatttaatcactctaatccctggcttcatcctctgtaaactgggaataataaagagaaccaactccaagcatatatgtgctatctagtgagataacaaatggaaaacactacttggaacataaaaagcacttaatcactatcatttttttaactctacatttcactgtaatctctttaagttcagcagtgagtttatacttctctttatattccatttgtaagacaccaaattcaacccactatatgctcaatagttttttataaacataatttatgtccattagaccgacagcacagaggtaatttctttatgatttatacttaaacatagtatttctaccattgtttagtatggtcacataaccacataaaatattctgctgttgattacttacttaattacttgaaagacctcagtttttttctaaaaatttgatagctataatatgtacactattataaattaaatagatattcatatacttatatatattatatatatacatatcaggacaatcttactccaggtaactccttctctctgtatttcataggcttattaccagaaataaatttgataatgcaaatgaaaatatttgtaaagtactgcacaaaaatttaataaactatgatatttatatgattaatatctaaaaatggggaagagaataaggtcatatggaattgatctacatctggttatcttcaactagatgcctaatatcctaaagatttcaaaaaattggaatcattttctccccaatgaagcaatttatatctagcttaaagtataatgtaagtaatgaaaaaatagctcttctcaatcagttctgacctaaatccaagtcctataacaatctttcaaatgtatccattctttttcttattccttatttctaaaactcatgtttatcctgttatttcttgatttttaattttgagtctatatgtactgtggcagtgtttacttctctcttgtactttcccagttctgacatagtcaccctttcccatctcccagtgaatcttgtattagttcattttcacaccactaataagacatacctgagtctgggtagtttataaaggaaagaggtttaaatgattcacagttcagcatggctggggaggacccacaaccatggtgaaaggctaaggagcaacaaaggcatgtcttacatggtggcaggcaagagattgtgtgcagaggaactgccctttgtaaaaccatcagatctattgagacttactcactatcatgagaatagcatgggaaaaacccgcccctatgattcaattacctcccactgaatccctcctatgacacgtggtgattatgagagctacaattcaagatgagatttgggtgcagacacagccaaacaatatcattctgcccctggccccacccaaatctcatgtcctcacctttcaaaaccaatcattccttcccagcagttctccaaagtcttaactcatttcagcattaactcaaacgtccacagcccaaagtctcatctgagacaaagcaagtcccttctgcctaagaccctataaaattaaaagcaagttacttacttcctagatacaataggggtccaggtaaatacattccaaatgggagaaattggccaaaatgaaggggctccaggcccaacacaagtccaaaatttaatagagcagtaattaagccttaaattaccaaaataatatcctttgacactatgtctcaaatacaagttacgttaatgcaagacgtgggtccccaagccttgggcagctttgcccctgtagctttgcaggatacagtccccctcctggctgctttcacaggctggtgttgagtgtctgcggcttttttaggcacacagtgaaagctgtctatagatctaccattctggagtctggagaatgatggccctcttctcatggctccactaggcagagccccactggggattctgtgtgggggctcctacccacattttccttctgcactgccctagcagaacttctccacaaggacgctgcccctgtagcaaacttttgcctgaacatcagggcttttctacatatcctctgaaatctaggtgaaggttcccaaacctcaattcttgacttctgtgcaaccacaggctcaacaccacgtggaagctgccaagcttggggcttgcactctctgaagccatgacccaagctgtgccttggccccttttagccatgattggagtggctgagacacagagcaccaatttcctaggctgcacacagcagggggatcctgggcctggcccacaagaccacttttttctttctaggcctctggacctgtgatgggagggactgccacagaggtctctgacattccctggagacattttccccattgtcttggtgactaacatttggcttctcattattcatgcaaatttctgcagctggcttgatttctcctgaggaagcagggttttcttatctactccataatcagcctacatatttttcaaacttttatgctctgctttctcttgaatgctttgctgcttagaaatttattctgccagataccctacatcatctctctaaagttcaaaattccacagatctctaggataggggcaaaatgccgacagtctctttgcatagcaagagtgacctttactgcagttcccaacgacttcctcatctccatctgagaccaccatatcattatcaatattttggtcaaagctgtttaacaagtctctaggaagttccaaggtttcccacatcttgtcttctgagccctccaagtttctaggaagttacaaactttcccacattttcctgtcttcttgtgaggcctctgaactgttccaacttctgcctgttacccagtttcaaagttgcttccacatttttgggtatctttacaggagcaccccactacccagtaccaatttactgtattagtttattttcatgttgctaataaagccatacccatatgaacaccaacaactaagacaggtcttagtaaatttagaaagtttattttgccaaggttgaggacatgcacctcctgaggaccacatgtgcccaaggtggtgagagcacagcttggttttatacattgtagggagacatgagacatcaatcaatatatgtaaagtgaacaatggttcagtccagaaaggtgaggcaaatccaggtggggagggggcttccaggtcacaggtaggtgagagacaaatgtttgcattctttttaggttctgattagcctctccaaaggaggcaatcagatatgcatttatctaagtgaacagtgggattactttgaatagaatgggaggcatgtttgccctaagaaattgcaagattgaatttttcttttagcttagtgattttggggcctgtcaggcctctgagcccaggccaggccatcgcatcccctgtgacgtgcacgtatacatccagatggcctgaagtaactgaagatccacaaaagaagtaaaaacagccttaactgatgacattccatgactgtgatttgttcctgccccaccctaactgatcaatgtactttgtaatctcccccacccttaagaagggactttgtagtctcccccacccttaagaaggctctttgtaattctccccacccttgagaatgtactttgtgagatccacccctgcccaccagagaacaaccccctttgactgtaattttccattgccttcccaaatcctataaaatggccccaccccatctccctttgctgactgtcttttcggactcagcccacctgcacccaggtgaaataaacagctttattgctcacacaaagcctgtttggtggtctcttcacatggatgggtatgaaatttggtgccgtgactcggatcgggggacctcccttgggagatcaatcccccgtcctcctgctctttgctccgtgagaaagatccacctacgacctcaggtcctcagacggaccagaccaagaaacatctcaccaatttcaaatctggtaagcggcctctttttactctcttctccaacttccctcactatccctcaacctctttcttctttcaatcttggcgctacacttcaatctctcccttctcttaatttcaattcctttcattttctggtagagacaaaagagacacgttttatccgtggacacaaaactccggcgccagtcacggactgggaaggcagccttcccttggtgtttaatcaatgcagggacgcctctctgattatacacccacgtttcaagggtgtcagaccacgcaggggcgcctgccttggtccttcacccttattggcaagtcccgcttttctggggaaggggcaagtaccccaaccccttctctccttgtctgtaccccttctctgcttttctggggaaggggcaagtaccccaaccccttctctccttgtctgtaccccttctctgcttttctggggaaggggcaagtaccccaaccccttctctccttgtctctaccccttctctgctttcctggggcaggggcaagtgcccctcaaccccttctccttcatccttagcggcaagtcccactttcctggggcaggggcaagtacccctcaaccccttctccttcacccttagcagcaagtcctgcttttctagggggcaagaaccccgaaaccccttccctctgtgtctctacattctcttttctctgagtttgcttccttcactatgggcaaccttccaccctccattcctccttcttctcccttagcctgtgtgctcaagaacttaaaacctcttcaactcacacctgacctaaaacctaaatgccttattttcttctgcaacactgcttggccccaatacaaacttgacaatggctctaaatggccagaaaacggcactttcgatttctccatcctacaagacctaaataatttttgtcgaaaaatgggcaaatggtctgaggtgccttacgtccaggcatttttcacacttcattccctccctagcctctgttcccaatgtgattcctcccagatcctccttctttccctcctgcctgtcccctcagtcccaaccccaagcatcgctgagtcttcccagtcttccttttctacagacccatctgacctttcccctcctccccaagctgctcgtcaccagaccgagctaactcccgatacttcctcagcctccactcctccaccctataatccttctatcacctcccctcctcacacctggtccggcttacagtttagttccgcgactagctcttccccacctgcccaacaatttcctcttagagaggtggctggagctgaaggcatagtcagggtacatgtacctttttctctatcagacctctctcagatcagtcaacgtttaggctctttctcatcagaccccactaaatatatacaggaattccaatatctaactctgtcctacaacttaacctggagtaacttaaatgtcatcctgacttctaccctctccccagatgaacaggaaagagttttttctctagcccaatctcatgctgataaccaccggcttcatgagccagacctccaggaaggcattagagcagttccctgagaggatccccaatggaaccaccaggcaaatttcccagggacccactggaaatcagactgcccagctcgcccgggagccactcctagagcccctaaagctctagcccaaggctctctgactgactccttcccagatctgcttggcttagtgactgaagattgacgctgcccgatcgcctcggaagccccctggaccatcacagatgccgagctttgggtaactctcacagtggaggatccccagccatatgaagacaccctagctgtacgatcagttcttgttaagaatctgacccctcaaactctacaacctcgatgagccggatcctacttagtcatctatagtaccccgactgccgtccgcctgcaggatcctccccacttggttcaccgttccagaataaagctgtgtccatcggacagccagcctaatccctcctcttcctcctggaagtcgcaagtactctcccctacttcccttaaactcactcgtatttctgaagaacagtaataactcttatgagcctaatacatcccttcattctattaggtcttttcgtccttaccctacattttgcaacagggctttatgaagccacccccaccacttaggctgagccccaaaaaactagtcatccctactatcttctgtccggtcatactcctattctccattctcaactacttataaatgccctactcctgtttacactgctggtttacactgtttcttcaaaccatcacagctgatatctcttggtgctatccccaaactgccactcttaactccctcttagagtgggtagatgatctttgctggcaaggcaccctccaatacttccaccctgatgaagttctattctttactttttactcactcttattctcattcccattcttatgccaccctctacctctccccagctatctccaccacactatcaaccttacccattctctcctagccgcttctaatccctccttggcgaacaactgctggctttgcatgtctctttcttccagtgcctacacagctgtccccgccttacagacagactgggcaacacctcccgtctccctacacctctgaacttcctttaacagccctcacctttaccctcctgaagaactcatttacttcctagacaggtccagcaagacttccccagacatttcacatcagcaagctgccgccctccttcgcaattatttaaaaaacctttctccttatattaactctactccccccatatttggacctctcacaacaaaaactactattcctgtggctgctcctttatgtatctctcggcaaagacccactggaattcccctaggtaatttttcaccttctcgatgttcctttactcttcatctccgaagtccaactacacacatcactgaaataattggagccttccagctccatattacagacaagccctctatcaatactgacaaacttaaaaacattaacagtaattattgcctaggaagacacttgccctgtatttcgctccatccttggctaccttccccttgctcatcagactctcctcccaggccctcttcttgtttacttatacccagccccaaaaataacagtgaaaggttgctcatagatactcaacgttttctcatacaccatgaaaaatgaacctcaccctctatgcagttaccccatcagtccccattacaatctctgacagctgctgccttagctggatccctaggagtctgggtacaagacacccctttcagcactccttctcatctttttactttacatctccagttttgcctcacacaaggtctgttcttcctctgtggatcctctacctacatgtgtctacctgctaattggacaggcacatgcacactagtcttccttacccccaaaattcaatttgcaattgggaccaaagagctccctgttcccctcatgacagtgacacgacaaaaaagagttattccactaattcccttgctggtcggtttaggactttctgcctccactattgctctcggtactggaatagcaggcatttcaacctctgtcacgaccttccatagcctctctaatgacttctctgctagcatcacagacatatcacaaactttatcagtcctccaggcccaagttgactctttagctgcagttgtcctccaaaaccgccgaggccttgacttacttactgcttaaagaggaggactctgcatattcttaaatgaggagtgttgtttttacctaaatcaatctggcctggtgtatgacaacataaaaaaattcaaggatagagcccaaaaacttaccaaccaagcaagtaatttcactgaacccccttggtcactccctaattgggtgtcctgggtcctcccaattcttagtcctttaatacccatttttctcctccttttattcagaccttgtatcttctgtttagcttctcaattcatccaaaaccatatccaggccatcaccaatcattctatacgacaaatgtttcttctaacatccccacaatatcaccccttaccacaagacctcccttcaacttaatctctcccactctaggttcccacgccgtcccaatcctgcttgaagcagccctgagaaacatcgcccattctctctccataccaacccccaaaaattttcgccgctccaacgcttcaatgctattttgttttatttgtcttattaatataagaaggcaggaatgtcaggcctctgagcccaggccaggccatcgcatcctgtgacttgcacgtatacatccagatggcctgaagtaactgaagatccacaaaagaagtaaaaacagccttaactgatgacattccacgactgtgatttgttcctgccccaccctaactgatcaatgtactttgtaatctcccccacccttaagaagggactttgtagtctcccccacccttaagaaggttctttgtaattctccccacccttgagaatgtacttcgtgagatccacccctgcccaccagagaacaaccccctttgactgtaattttccattaccttcccaaatcctataaaatggccccacccctatctcccttcgctgactgtcttttcggactcagcccacctgcacccaggtgaaataaacagctttgttgctcacacaaagcctgtttggtggtctcttcacacggatgcgtatgaaagggcccaagatgttttcctttcacatttcaccctttattttttaaaatcttctggagaaagaattttagaagaaaatgagtatttggacccaggtttcatctgatctcttatggttaggatggtttattcctagacaggtaagtcccaagttattaggaaggctcatttttagaaggttgtgaagtctcatgccttatgaagagaaaataggaggaagaaaggagaaaaaacaacaagaaacaaaagaaaaatcctagaaaagtgatataggccacattactttgaagttcacatatcaatatgcaggtatgaaagtggcttgtgtgtgtaaatagtttgctgttatatccttctgaagtttaagttgtctagcttcagttcacagggatttacaaaagtacagcttaattttcaattatgtaaaatcagaaaaaatggggggaaggaaaagaaagaagaaaaaacattttttatactttgtaaattatatatataattttagagacctgtagccaggataaattagaattcagcccaaactgtagaaagtaataaaaattggaaaacattaggcaagaataaagtctgacaacaggtatactatagtttttgaaacaatttttctctctccatttttccatttttactgaagacaaatcatggtaggactgatttgctttattatactttgccagattatttatataaagttccgcaagataataatttttcacataggcttttaaaattggccttgatggaactttgttctgtagaagaactctcagataagacttttttaaagcccagcccagccatggatttgtgccatcaaatacctatgagttggaaggatttcctctcctcttgaggttccaagataaacctggggctcctggacctgtcagaaagtgacaatctttacctaccacgggtcagaaactctgtataggaattgtgtaaactatgtggccagttttcccaaatgatttattggctccataagtgaagtttgattcctaaaggaaagcacaccaatccagtaaaagccttagtaaaataaccagtttctccaactgtgtcctgttacaaatgaaaacagattcttattgcacttatgcaaataactgtattgctgtaagttaagaatactcacaaatagtttccaaattctgaaaaaaatcagataaagagaaataaatatgctccaaattttgttcataggagtatactaaat[450 bp omitted]catatcaataacatatttatacaaatatagctcaaagaaaaccaaacaccattttatatttgacagtgcttcctatatcatttttatgtcaaataagccaaattgtgtcatttttggggctttagagaacctaatatctcaaaggattaattaggtcagaaaaagacataattcataatttgatttttgaaagtttgtcaaatatcaaaggtttaaaagactcgatatcacaaaataggatcaccagtcattgtaaaatatgtcattcatttaaccaaagtgataactcaaggatttcaaaaacaagtgagaaccttcattctttgagatagaagactaattttcccaacaatatgccctaataaaaacagcataaagtcaattaaatttgtttttcaaaatattataaacaatctataagattttaatattgatcataaaatataacttccataagcctttttttataaactttatacctttattaaggagttgattaatgcttcaagaaaaacttattattctgacacagggatgcatatgttggtcttgcatcagtgtcactttgacactaatgattaatttataaagaaactaaacttactttatctttcaaaattggcccttacaatctcatgcacccaccacttccacgatagtctctggaccttgaggagttcaatagctttaatttattgccctgtgtctcaggaatgcagtttattttgattggcatcttctatggagcctgaagatgaggctttaattaatgtcagtgtttaagatttaccagggctttgtatcctttttagacccaggagtcaaagccctgtaactaaatgccacaaagactttaaaagcaaatacagagagatacacggatgtaataacatttattttaaaaaaataaataaatctcagttttttcctaagcaaaccaaaattaataatggcataagaattatttcataaaatgtaaaatcggttaggccagttaccaaaaggcaaaagaaaaagactttctgcagtgcaccaaatattaaattggaagaaaacatttcctttagactttaagaaaacaagcttttaaaaggggagagaaagtcaaaaaaaggcaagatgcaatgaaagttgaactttggctaacagaaattgaaatatctcataatttattaagaataaatcaaccccttaagaaaatgtcattgttctaaccaataatttagtgtataagtgtgttttctttacatcaagcccaatctctggaaagagcattgtaatttcctttaattataaacaacttgatcatttagaagtttttttttaaataaataaatccccttcttgtgatttacacagatccttcatgacatatttgaatttgtagtgtgtcctgaacatcattttttcttaaacaaccagttattttattttaggactaaatttaccatacaagattccttctcttatgaaattatttctcttcaagttttcttaccacacacacacacacaaactgtttatttttataaccttctttacatctctcttatttcctggttcctttaccttgctttatacataacctttaaataagttttcaattagacaaaatttgttcaccttttttaaaaaggacattttcttttttgagatggagtttcgctcctgttgcccaggctggagtgcactagcacgatctcagctcactgcaacctccacctcccgggttcaagtgattcttctgcctcagcctcccaagtagttgggattacaggcgcacaccaccaaacccagctaatttttatatttttagtagagacagggtttcaccacattggccaggctggtgttgaactccttacctcaggtgatccacccgccttggcctcccaaagtgctgggattacagacatgagccactgcacccaggtgaaaaggacactttttttttaagcaagaatgttttcctacaatatatttttattggaaaatatccaaatgatgaaatatctattatttaatataaatttatattctaaattgtgacttttgtctacaagtatttatccaattacatttacctaattattttattttaattgcttacctagattatttatgaaaactgaaataggcatcatttaaagttatggaaccaccattaatctagtaaattaattagagctctttatatatttttaacagtgaaacatggtgtacacaacacataaatacatagatatattaggtatgccaatagcagtacatcttatagattcctaagacctccttttttttttttttcctctcttagacttgcagactcttgataacctgcttccttactgcagcagttgtcagctaaatagccctaaatctgcatattagaggaaacaactcaggtgaaaatcagatagaaaaatttacattataaggtacgaagagaaagtctggtgagctagagggaaattaaaacagatataattgccaattgaacataaaattgtagaagtctattataaaggcctttaaatatatatatacacacacatacacatacacacatacagacacacaaagattctatagcttttagttcagtactttagccatgagataaatacaaattcacaagtttggaaaaaaataaaacctgttagatccaaacagtggttttttatcttaatagaaaagtaacagcagatttaaagtaggtggaaaagaaaatagaggaaaaggggacctaggaacattacagtttgcaggtcaaccttagggttctctttccttaacgtaaatgtgcaaaaagaccacatgacttccattttactctggcaagtagagatgccacaaaacccacagagtgcttgaaagggggtcgttctccttgttttcacctcattcttagattatttgtttcccactgtttttttgtttgtttgttttttggggggtcttttttggttaaaaaagaggaactgagctgtggcacagggtttttatgcagtggatcaatatgtgctgcttgtgggcaggactccacagagtgtcagcactgagtcatttccgccctcttacgtatctcagtttctctctccagaggtctatgactgctgagagggctcaaaagcactgggtgatcagcctttatatgcattttctggatgaaccatatttaaaattaattttaggtggggatttccctgcaggaccactgcatgttgtgggggctcaacatcccagacactcccatgaggcccccggttacccagggcacattttagctgggaggagcaaatgttctttctctttgaagctgagaaaactcagtttttcattagcataaaaaaacaatcaattcctcattcaaatgcacatagacaaaccaaattaagatgaattttgggagaagaccctttagaatgcatctaccaactagaattaagatccttaaacaacaacttactgggagagaaaagaatgaaacacaaaacaaaataaaaaaaaaacagccaagaccacttcctgcaaactgtgctcagccactcataactttgtagctctcattcgccattatacatgccaatgtcaaatcctctcacaatgcaaagtcatctctggtaccccaaagccaaaaaggtcaggtcatgtaacacagaaaaacagagatttagacttaaaaagaatctgcccatgactcttgaaactccacaaagaaaacagaatatcccaaaatggggtgagtggcacctttgttctgaattatttaaaggggttcaagtcattaaaagcttctctaaattttttgataccgcagatgacaaaggagcaaggaaatataggatggaagagaagtaaatgaaagaacaatttttaagacaggaagaaaacacagaaaccaaaaacatggtttttccctttctctttttttttttcttctgcagctatgaggaattttagccaaattacagaggccttgttacccataatttggaattctcactcagatttggccaagtcgggtagagtaggtcaaatccaatgggagaaagacgagaacaaacaacaaagaaaacgcaacaatactgtcactgagtgctctaatggcaaggagaaattaagatcagctggttgttaatcttaaccttagccaagacaaaattcaactcagttacttacctaaggatgggtctcaggctaaaggctgctctctaccatcctagaagcagggaaggaaaaaaaacaaaacaaaactcatcttcccagttggaaatgaactcaaactccataaaggagtttattatggagttccatacccgccttccttcatcacagaagcaggaaaaaacttgcctttcttgtgttggaaacaagtaaaactctaaacaaaagaggagttgtacagcaaaataaactttagatcatgtccaagttttgggagatcagggattctctggaggaggtgctctcagacctcagtaaactgtcctattggtttgagccataaagttagctcatgatggtagcaagcactgataggagatttgttaaaggtcaggggcatctccactcagaatcccttcatggttaccaaatgcaaaacccccaaaaattgaaacaggtctcagttaatttagaaagtttatttgccaagattgagatgcacacccatgacaaagccacaggaggtcctgacaacatgcgcccaaggtggtcagagcacagcttgattttatatattttagggagacataagacatcaatcaatacatgtaaaatgaacattggtttagtctggaaaggcaggacaactcaaagcagggaggggattccaggtcacaggtaggtgagagacaaatggttgcattcttttgaggttctgatgagcctttcaaaaggagacaatcatatatgcagtgatcccagtgagcagatcgatggctttgaatagaatgggacgcaggtttgccctaagcagttcccagcttaaattttccttttagcttagtgattttagggacctatatattttcctttcacacccaaggctggttaatttataaagaaaagaggtttaattgactcacagttcagcatgactgcggaggcccccagtcatggcagaaagtgaaggaggaacaaagtcatgtcttacatggtggcaggcaagagagtgtctgcaggggaactgccctttataaaaccatcatgtttcatgagacttacaatcacaagaacatcacgggaaaaacccacccccatgattcaattaccgcccaccagttccctctcacaacatgtgggaattatggtagttacaattcaatatgaaatttgggtggggacacagccaaaccatgtcaaatatatgtaattttttattaaatcaatatttgtgtttttattatcaatgataaatatttttttacagttcagatccagagtgttataattatatttattttaaagatatttctctttatttatttttaaaagattgttatgcttttttattgtacaaagttttggggtacatgtgataatttaatacattcatatatttatagagatcaaactgtagcaggacgagctgcagacaaaagccctcagacaccgagttaaagaaggaagggctttattcggtcaggagcattggcaagactcacatctcaaaaactgagctccctgagtgagcaattcctgtccctcctaagggcttacaactccaagggggtctgcatgagagggtcgtgatcgattgagcaagtagggggtacatgactggctgatgcatgcaccagtaattagaacagaacagaacagaacagaacagagattttcacagtgcttttccatataatgtctgtaatctatagataacataactgattaggtcaggggttgatctttaactaccaggcccagggtgtggtgccgggctgtctgcctgtggattttatttctgccttttagtttttatttcttctttctttggaggcagaaattaggcataagacaatatgaggggtggtctcctcctttattccccctctttgagaacttcactcattagtgggagttctcactttcattctcactacccatgtcttcttgcaagacagattgatagtgattcatatagtacacttgtgctaaagcattttggtgaactaaggtagcaatgaagctttctatcaattgaggaagtacaggtagcaaacaagggagcagtaagcaggttcctattatgattatgactcctattataaaagttttaaatcctcctagtgctgggaaccattttccaaacatgggcccaggttcaaatccatgccacatttgcacaggcacatgtgccagttttgtcatatctttaactatgtcttcaactacttgcccttgatcaactatgtgtagacagcaattagtaaggttaaatttcctacagacccctccttcagctgctagcaagtagttgagagccaatctattttgatagatagcatttcttgtctgagtttcttgctgggccagaatagtcaaggctttgccagtcttattagtgattatttctaagacagcttgtaactgtatgattcagttgagcatgtaaatgggggtgcagtatccccatgagccatcttgtgcccaagtaccaggcccataatattgtatgattctttcagagggccattcatcatctttccaatttcctatagctatgcttctcttttcacaggaagcacagacagggaagcccaggagttcacctgtctctatgggcagtaggaagaaagacggtttaatagtaccaataacacaactacctgcccactggtcaggtaatctggtgtaagctctatgcccacatatccagtataatccagtgggggctgtccagtcccagtgggactctgagtgcgtccacatgatttgcaactttgggaatttactaaatggatttttcttagtgtggtttgaactccactaggtggctgtttttgtggtactattatacagtttttgcccaaggcagctgaatcttctcacaggaagggtgaagtccttccccactcttgctatacaatattgtctaatgattgaggcttttaggacccagaagttatcagggtgattcttttgagctcggaattcatcaggaactgggtctgtaggtactaattctcaggcttcccatggccattgatctcccattacagttcctccacatacataacatgaggtgacattgagagactgagctacatgttcaccttaaaacaaatttcttgtttttcctggaatttctggtacaggcacattcagttcatcatagaagatttgaaatactggttcaggagagtgtttataaacttctcaaaccacaatatttacttgaggatccattccagccccaatgattcctagggttacacgctcccctttttttccagtgaggatcaagggggttggttattactagttctaaggggttacactgaccactggtaccagaagggccacttttcactttctgaaggtggacaggatccttttcattttttattgaagtagcctaaatgacaaaagaccagtatccacattgatttccacacagtcctaattcatgacaaatgtacttattttctgccatataacctctttcctaattaagagaaccacatcctattcctaacttattactattaatgacagcacagggatcaaacttcaaggtgacttgtttgggcacacctttttctcttgttttggctaacactttactcatattgtttatgagcccccaccagtcctcagtccttaatcttatttcaaaaactgtggtcatgggaggttcagatgggtcataacacacatcgggttggtcatttcctgggctacataccttgtatagaatagcattatacaaacaagttctttttagagtcccggtacacttataataaccataaaataataggactgcagcaattttttgtcctacctcagtgacttgatgtatacactgggaacagtcctcagtctgaggaaggtcagttgacgtccttattgtacagttcaaattttaaggaaaacgagtcccgtgatgagttttctcatgctttggccatgtgtggaccagtcaggttccgggtgtgaccagagcagggcttgtcatcttcagagtcacaatgcaggggttggcaaagctgctcccgcccacatacagctcacagtctactgatgttcaaggatggtcttgaaggttgggcccactagaataaactgagtccaatacctctacacagttatgttcaactgggctctctgataccgggagcaaggcggcagggtttagggtgttgcaaacttcacacatagcaagctttggtacttggttaatctagcatttgttaaccaatgatgtccttcggtattcatcaaagttaccatagcatggggggcttttatatttaggttttgcccaagggctagtttatctgcttcttatgctaacagggccattgctgccagggcccttagacatgggggccagactttggaaaccccatctagttgttttgagagataggccactggccttggccagggccccacagtctgggttaaaactctaactgccattttttttctttttgacacatagagtgtaaagggttttttcaggtcaggtagtcccagggctggggccgacatgagtttttcttttaacttatgaaaagcttgttgctgttggttgtaatagatgtagtttaaccaatttacatttttattaactgtcaccaaccaaaatattgactcaaatcctgtagctatttgatttcaagctttaaattgatctggtattccccgtgggactccaatcgcgtctaaatagaagtgagagtcaaaagacccataaggggcttctctcactttatgatgtcttatttttcctccctctggttgatgaaatgccagggtgaaagggatagccaattggactaaagtacaagtgccactccagttattcagcagggtgcccaggaaaggtccaccacaataccaccacacatccgctcggggatgaacaagggctgactgattgataagctcttgaaaattcttaagctcactgcatcccttcaggtctccaaggaccactaagtttcctccctgtcataagagtcatgaagtgaacttagtgttgagagtcagaggctggatggccctcgggggctgacctgcagggtgtcggactttgggatatagcagagcttggcacgacttattactccaggctgtagaatcctggaaaagagctaccatgcagcccatgcctggtcgactggaggaccaccttagtggaaaggggacaatctgggcctctggcctgctatgtgcacaagcataacaattgcttttgtttaatgtgtggatggaatatttgatccattccaaccaggcatttgcatcttggtatcctgctttaattgccaaagtttgttttaagtctttaacttctatgattctctagtaaaatgaatgtatgattttagaaaatcacaaaaaccggttggggcagtccatccttgctcttaagtggtccacagaatgttggaccaactacggcataagagctctacatcagggagcaagactcctggttgacgctggagtcttttttgaaatttccccggattaaatggtcctaatttactaatgcccagtctgaggagagtcaggagggacagaggtacttttctgaagtagagagctgtctttgacttggtaagtccccacagggtataacaaggcaagcattaaatgcaatagtttgaggcaaaattgacttggttatgttaataactagaaggtcagcaatagagtgaggaaagaagaaagagtaatagaatagatgaaagagttaaatttttctcagctttagtttggtagcgttttcccctgggactgtggcccacgactctggagggggtggcgctttcttgactcaggtgtgatgagcccatccttttttgctgtatgaacagcagtctcagtggttagcagcacaaggtagggtccatcctaggctggctcgagttttctctcttttcaccctttgatgagaacatgatcttcaggctggtgttggtttactagaaattctaggggtggtacatgtgcttaaaagacttttagttttgagggaaaggaaagtggaagataaaccaagtatataatttctaagaaactgaccttttgttttaaatgcgggggcatcagcagtggactttataatccctggtgcctttctactgagaaatttcctttagcacctatttttattagtttttggaccaaagaagccaaacaccattttacatttaacaatgcttcctgtatgatttttataccagataagctaaatttcacctttatatcagtgtgttattaatgttaaacttagttttaataaaactttgtagacatatttattcaatttttaatgttggaacataaggtaagatttttatagactctttttaaccttttataatctttgttaaagagcaggttagtgctttaagaaaaacccgttgtgtttttactttaatgtccagttcacagaaaaactggatgatacccctctaactttagctaatatgtttacacacagaattttctttgcaattaacgttttaaaacttgcttaaaccttcagaacaataatttttttaaccttttaatgtaggtaaaaatttatattcttatgccttcttataatccttttaccaaagttatattttacttttcttatacaccttgcacataaactgtttttttttttcaagttttacattcagggagcctagttacttttaaattatactacatttcttgcataaattctttttttatgacatttttctctttcacgacttttgcagacagttctttgacatgcctcaactttctgacttattacaaacatttctttctttaaacaaccagttaatttatttcaggaaaagaatttaccatataacactatttttacataaattatgcccccccttttttcccctttttttcgaagatgataaccattcttttccaaagcgaacttcctttatgtctgtgcaatagactgtctaaggccacaagattagaagatactataatacatgttaccatgttaagttttagcaaactttacttttgttgaaaaccttgtaagtttggggttttaattatcctttgctattaataagaccttgttttgtccaaattaacttagaagtggtatagatggcttttatttttttacttcaattactcgggaggaaccatcgattgtccagtcctgaagggagttcctcctaggtctggtcggaactttgtatggtaattaagatttagatgccctgttaggaaagcttctgggttaagggaattttcagaggctaatgttaaatcatcttctgaactggtgaggtgtgctcacaatgaggtttcctctaaaagttattttttttttactttcttctgttagcaaagcagttgccgctacagactgaatgcatctgggccatccacaggttactgggttaaggattttttataggaagggtgcaggttatcagtggcctcagtgcttttgggatacgtccttgtttacactgacaacaaagtggtattggagtgttatagggttatggataatactttccattatcaattataggttttaaatttaccctggcttttaaaggaatagggtacacttttttttttaaccacttgtatatttctctttttctttctttctttctttgactttctgtctctctctctttttgactttccttttgcctctgtcttttcctctttttctctctctctttttccttgactccctctttgtctttctgtctcttcctttctgtctcttcctctctctctctttgcctcttttcctctctgtctctttcctctctctctctctctgctggtctttccttgcctctgccagctgcttatgctgctgttctcttaaccactgttggggcgggggtgtgggtgactaaaaccagctataaccaagtgtctatgtacaggaactggtctgggtgccctgacgtacaggttaccttgtgccatacgtttgaaacaagggacctgtccaggcttccttctgatggccaacccacctctaatgctggccagtctatttcacacaaagtgctaagttttcctggtgtcatagtaacaccgtaatatcccttaaattatttcttgaaatttttcagcatagttcctagtagggtgggcttaccctgtgcctgacccatgctttcttgagacaaaacaccacgctcacaccacacacacaccacaaaacaaagaacgggtaaaaagggcacacacacactttttttttttttttttttttttgagatggagtcttgccttgtcacccaggctggagtgcagtggtgcgatctcagctcactgcaacctctgcctcccgggttcatgccattctcctgcctcagcctcctgagtagctgggactacaggcacccaccaccatgcccggctaattttttgtatttttagtagagatggtgtttcaccgtgttagcaaggatggtctcgatctcctgacctcatgatctgcttgcctcggcttcccaaagtgctgggattacaggcgtgagccaccgcgcctggccacacacttttatagtttacaccaaaccagaatcaaaaccaaaatcaaagtatcaagaaatccaagccaaaaccaaaaccaaagtatcaagcaatccaagtcaagtcaaaaacaaaaaccaaaggccggtacagtcacatcatgggtggtcaggccatgcttccactcaaatggagtggataagttccaaagaccagtcttaccaagtttcagatgtctggactccaagtgccagtttgttcccggtgttcagccactgtgttgatcctccgcgggggccggacacactgctctggtgaggtgttccaccaaggcaaatgcctacctgggagcgctctcaggatccacgtcactcaagctggccagaatgccccacagggatgctccacagggcaggcctcagccgcctaaggggctgtctcgaccgtaggttaatcacctcacttcctggtcagggaaccaagaaatgtagcaggacgagtcgcagacaaaacccctcagacaccgagttaaagaaggaagggcattactcggctgggagcatcggcaagactcacttctcaaatacggagctccctgagtgagcaatttctgtccctcttaagggcttacaactctaagggggtccacgtgagagggtcgtgatcgattgagcaagcaagaggtacctgactggggactgcatgcaccaataattagaatgaaacagaacaggacagggattttcacagtgcttttccatacaatgtctgtaatctatagacaacataaccaattaggtcaggggtcgatctttaactaccaggtgcagggtatggcgtcggactgtctgcctgtggatttcatttctgccttttagtttttatttcttctttctttggagacagaaattaggcataagacaatatgaggggtggtctcttcccttaaaaccagtgtacttggaaaatccatcaccttaaatattcatcctttctttatgctagaaacattccagttattctcttctagctattttggaatatacaatagattactgtaaattattgtgactctattgatctatcaaacactaggtcttttttattctattaaaccatattttatacccatgttcattatatttctttatttttacatttccttagagttaataattacctttttccttaatattctatgtgcctatcattaattcttacctcagccctactactaaatttcaataactcttaatacaatttaaacacagaagtcaatccccaattttgtttttgttgttgtttgaatattgcttctagaaccatgtgtcttgtttctctagactggttgttctcttggcttcctttggatttattttacaattttcctttacgttttttctgaaaatttccttcctcttgcctctgcgttagatccattatttcctgaactgcatgttttcctttgccttggtttaattcctcatttatatatttagaagcttctggtatacaggtttgcatctgagggtttttggagttttgaaaggctgaaaatgcttttattttatcctcactcttgattactagtcctattaggagaaagaaactacagatatatagaattaataaattggcaaagatataaaggaactgtatatggtgctatgactgaaggagagtgcataaaaagaaggaacttaaaaaggatttagacttccttagggaagtgatagttcaggtcaggggatagcatagaggtatgtgggtttgcgcaggctgtttccagtctgcattcactgggcaaggagcagctaacctgtcagagttcaggtgggagcaatgagtaataggtgatcagcactggagtatgtaaagaggtgcaggaatatgcaaagggagtcaaggcaccagttttcatgttgagaaggccacagaaatgttatcatcaggctgatgctgcaccattacagagagactgttctgggcagagctccaccagacgcatacacacacacacacactctctctcactctctctctctctccccctctcatatacacacacacacatccctaaggcctccccttgccacagcaggaaaaggcatgagagtttcttcttgcaatattcctccactgccctcaacaggagaaacttaacattgtgttcactgaaaagcagaaattccattgtttatcaggggaataaagagatctgagcactaataaactgataactgacatagctgaatacagaacctgatattttaaaacattcagatttttgggagcatttcttcactgttttctaggtttcagtgttgctgttaaaagtttggtggcattctgattttcagctctttattgtgggaggactttccccccactttagattattagaccttttttatttacactcaagaaatatttgctgagtatctaataagtgtgttctgggcaaaattatccctctcctttagtgttctgatattttatgtgatattacagtatctattagtgtgggtcagttttcattcactgtgctcagtaatcaatgacccttccaatctataaatacaatttctttaattttaggaaatgtccagttatgattatttgatatatttctccattccttactatgtttgcttctttctggaatgtctgttacatatatactgaaacttctagattgattctttgattttcttatcacttctctcccatattccaattgactttgttgctataacaatattttctagaatacatcatcaaatgcatttcatattctaattttgcttgccaaaatttaagttccatgaagttagggattttaattagttttgtttattcatatatctcaatttttgagaacagaatctatgccacagtaagtgtacaaatacttgaggtataattgttgaatgaatattaaatcttatatgttcatttttttcattttctgttcacaatatttcttttttaatctctgaattttcttttaataatatcctgtccttgttgcttgaacacactatttcccatttctttggaatcattagtgatatattttaagttattttctgccctctgcattgactgtttgctctaaatcctttctttttatgactttttggtttctctgtggcacatttgatgtttcctcaaataacaatgatctctggcttaaaaaagcttattgtaagttctatggtcatgagatgggcttgcaggcaagtagaattcactctaaatcagttaaggagcttgagggaaaaggagaaaaatattgcagtagaaaaagggactttgttgaggtttgctctgtaaaacacatcctctaatttaatttttacaattcacatggccaggcttactcttaataataatgtggtctttaacttgatttctgcttgtgttctttgtatctcaattcctaagcagggaaaactggtagaactgatttctaaaagcattctcagcttctgaccctaatgtcctgaaattattaaaacatttcctaacaacatctagtaaaattcaataagaaccagaagacagaatgaatgcagatttgatagctgtgttactgaaggtgagtgactaggcaatctaagggtgatatttggaagatatataatatgtgtctgaaggtcagacaaaaattctgcattgggatactgattttcatgctataaacatggatagtatatcatgtcattaaaaccaagtatggtttctggatttagtgcccgggaaaatgggtgaatgtaggtaccattaaaagagagagaaagtgcagttggagaaacagggttctttcaacagaggatgagttcagatttgcaaaagataaactagaggcctttttggaacattaaagtacatatatctaaaaggtagatagaaataggagaaaaacaataaactagagacacccaatttattttgttaacataggtacaagggcattacctccttcagtaaatcattatgggcctctttgagaaaattctcttttcccatttaacttatttatacatctgtcattgatgatatcacatgatgtcattatttatatatttttaagtttagaatttctaatgagaatatagttttttctaaaattgccacttttttatgtttctgaaaaatattttcgttgtctcatgcaacactgaattaaatgaaagacttaaaataaaagcggtctaattctctataggttatttaatacgtaatttgttaaaatagcatgagcaatatttctttctgaaatttctaggaaatttccttattccagtgatttgaaaactgtaatttaatttttttttaccttatgggttggcatttctattattataaaatgctaataaccataaaattaccattacatattggtgtcattttagtaccctgaagtaaataacaatgttgttttgcacagttcagggtattaaatagtagtaactataaaacaacacttaggacttctgtcatcgattattcagttactagtttcctattgttgctataaggatctgccacacacttactgacctaaaatacctggaggtcagagcaagatggcagaatagaaagttccattggttgccacccctaccaccccctacagggacaccaagtaaacagttatctacacaggaaaaaaaaacaaaacaaaacaaccttcataagaaccaaaaattaggtgagcactcatagtacctagttttaacttcatattgctgaaagaggcactgaagagattagaaaacagtcctgaatcaccaagccaccccgcctccacccgcagcaataatggtttggtgcagagagcatctctgggtgctgggggaaggagaaaacagcaattgtgaggcagaaaactcagtgctaccctgttcgagcagaaaaccagatcaaactcatctgatgcccatccagagagggagcatttaaatcagccctagccagacaggaaccactgatcccagccgtctgaacttgagtgtctgcaaaccttgccactgagggctatggcactccgtgtctccacgtaaacttaaaaggcagtctaggccacaaggactacaactcttaggtgagtcctagagctgaattaggctcaggaacaatggactgggggacatgtcacagactgagacaccatcagaggcagccaaaggagtgctggcatctgcagtactgcacagctctgggctccaaaagagaccccttccttctgcttgagaagtggagaggaaagaggagagggaggactgtgtctgcatctgaacaccagtccagccacagcaggatagggcaccagtcagactcgtgaggtccccattccaggccctagattctagatggcatttctagacacaccctgtgccaaaagggaacccactgccttgaaggaaaagacacagtcctgtcaacattcataacctgctaactgaagagcccttgggccccgaacaaccagcactcaggtacaacattgagggccttgttgaaactctgagacttgcaggcttcaggtgtgactcagcacataactagctatggtggctaaggggtaaaacttctgcctgagaaaagcagaagaaaaagaaaaggagacttcgtcttgcaccttagataccagcatagctacagggtagcagagcaccaagtaggctcttgaggtcccagactcaaggcttgactctttggtgtcatttctggatcttccatgggccagagcagagcccattgccctgaaagatgagtccttggtcaggcagaatttacaagctgacttaagagaccttgggccttaagggaatattggagttcatctggcagtactcctcatggcctgggttggtagtggttgtggggtgagggtcctcttcctttggaaaggggagagaagagtgggaaagactgcttcatgtggtttgagtgccagctcagccacaatacagtaggacaccaggtagacatctaaggttttgactcagtccctgacttctggactcactggggggcttgggggacctctctgccctgaagggaagaacacaggcctgactggctttgccacctgctgattatagattttcaggaccttaagcaaacataggcaatagctagagagtggttataacaggccttaggcaagaccaagcactatgctagcttcaagtttgacccagtgcagtcacagtggtggtaaccacagtggttactccacccagcctaaggtggctcagaagagagagacatactctgtatgtttggaacaaagtaagggaagggagcaagaatctctgcctggtaatctagagaattctagattttgtccaaaaccatcaacgtacctctaggaatctacaaaaaaccacagcactattatgcttctggtgccccctaaagtagatacagcttagatcaaaagatccaagtccttttggatatctaaaaagccatcccaaggaggatggctacaaataagcccagagagtgaagactaaaataaatacctagcccttcaatgcccagacactaaagaacatctactagcatcaacaaaatccagcataacatgatcttatcaaatgaactaaatatgataccagggacaaatcctgagaaacagagatatgtgacattttagacagataattcaaaatggctctgttgaggaaattcaaagaaattgaagataacacagagaaggaattccgaattttatcagacaaacttaacaaagatattgaaataattgaaaagaatcaggtagaaattctggagctaaaaaatgcacttggcatactgaagaatgcatcagagtcctctaatagcagagataatcaagcagaagagagaattagtgagcctgaagacaggctatttgaaaattcactgtcagaagagacaaaagacataagaataaaaatgaagcatgcctacaggatctagaaaatagcctcaaaatcacaaatataatggttattagccttaaagaggagttaaagaaagagatggggtagaaattttatgcaaagaggccaggtgcggtggctcatgcctgtaatcccagcactttgggaggccgagtgggcagatctggcggaatgggcagatcaggagttcaagaccatcctggccagcataatgaaaccccgtctctactaaaaatacaaaaaaaatcccacctgggcatggtggtgcatgcctgtagtctcagctactcaggaggctgaggcaggagagttgcttgaacccagcaggtggaggttgcagtgagctgagatcacaccactgcactccagcctgggcaacagagagagactccatccaaaaaaaaaaagaaaagaaagaaagaaaaagaaactttacagagaacttcctaaacctagacaaagatattaatatccaagtacaaaaaggttatagaacaccaagcagatttaacccaaagaagactgcctcaaagcattttctaatcaaacttccaaaggtgaaggataaaggatccaaaaatcagcaagagaaaagaaaaaaaaaaaaaaccatacaatggagctacaataatatggcagcagacttctcaggggaatccttacaggccaggagagagtgacatgacatatttaaagtgctcatgcggaaaaagaaaaattttaccctagaatagaaatctggtgaaaacgtccctcaaacatgaaggaaaagtaaagactttcccagaaaaacaagagctgaggaattttaccaataccagtcttgtcccacaggaaatgttaaacgaagtacttcaatcagaaagaaaagaacattaatgagcaataaataatcatctgaaggaacaaaactcactgataatagttaagtacagaaaaacgcagaatatcatacactgcaactgtgtgtatacactgcaactgtgtgtataaaccactattatcctaagtagaaagaccaaatgatgaatctattaaacctaataacttcaacaatgtttcaagacagtcagtacaataacatgtaaataaaaacaacaaaaagttacaaagtgtggggatgaagttaaggcatggagtttttattagttatcattttgtgcatttgtttatgcaatagtgttaatttgttatcaggttaatataattggttacaagatagtatttggaaatctcatggtaacccaaaatgaaaaaacatataatagacacaaaaaaataaaaaggaagaaactaaattatagcaccagagaaaatcatcatcactagaagggaacaggaaggaaagaaagaaagaaagaaagaagagaagaccacaaaacaaccagaaaaaaaactgggagaaatcattacttatcaataataacattgaccataaatcgactaaactctccaaacaaaagacatagactggctgaatagatgtaaaaacaagacccattgatctgttgcccacaagaaacacatttcacctataaagacacacatagactgaaaataaagggatggaaaaagatattccatgccaatggaaacaaaacaaaacaaaaagagcaggagtcactatacttgtatcagaaaaagtagatgtcaagaagaaaactataagaagagatgaaaacaaagaaagtcggtatataataataaaagggttaattcagcaagaagacttaacaattaaatgtatatgcacccaacaatggagaacccagatatataaaggaaatattattagagctaaagagagagataagccccagtacaataataattggagacttcaacacaccactgtcaggattggaaagatcttccagacagaaaataaacaaacatcagatttaatctgcaatatgcaccaaacggatccaatagatatttacagaacatttcatccaaaagctgcagaatacacattcttttcttcagcacatggatcattctcaaggacagaccatatgttaggtcacaaaacaagtctttaaacattcaaaaaaaaaaaaaaaaaaatcacatcaagcgtcttctcggaccaaaatggaaagaaaccaaaaagtaatgaaaagaggaattttgcagactatacacagaaattaaacaatatgctcctaaatggccagtgggttaatgaagaacttaagaagaaaactgaaaaatttttgaaacaaataataatggaaacacaacataccaaagcctatgggatacagcaaacgcagtactcaaagggaaatttatagctatgaagtgcctacatccaaaaacagggaaaacttcaaatgaactacctaatgacacatcttaaagaaccagaaaagaaaagaaaaaaccaaatccaaaattagtagaagaaaataaataatgaagatcagagcagaaatacatgaaattgaaatgagaaaaatacaaaagatcaatgaaacaaaagttggttttttgaaaagttaaataaaattggtaaacctttaaccagactaattacaaaaaacggagaaaataaaaatacgtaaaattagaaatgtaaaaggagacattacaactgatactgcagaaatgctaaggctcgttagtggctaccatgaataactatatgttaataaattggaaaatctagaaaaaaaaatagacaaattcctagatacatacaacctaccaagattgagccaggaagaaatccaaaacctgaacagacctatcacaagtaatgagatggaaggcataataaaaagtctcctaggaaagaaaagccctggaaccaatgacttcactgtttaattctaccaaacacttaaagaaaaactaacaccaaccctactcaaactcttccaaaaatagagaagaaaggaatactttagaacttattctatgaggacaatattaccctgatacccaaagcagacaaaaacacatcaaacaaacaacaggccagtatctctgacgaatattgatgcaaaaatcctcaataaaatactagtgaaccaaattcaacaatacattaaaaagatcattcgtcatgaccaagtgagatttatccctgggatgcaagaatggttctacatatgcaaatcaatcaatgtgatacatcatatcaacagaatgaatgatgctaaaaaagcaattgataaaattcaagatcccttcataattataaccctcaaaaaactgggtatagaaggaacatacttcaacataacaaaagccatatacaacagacagacagctagtaccatactgaatggggaaaaactgaaaggctttcctctaagatccggaatgtgataagaatgcccactgtcaccactgttattcagtatactactgaatgtcctagctagaacaatcagacaagagaaaaaaatatatgaactgggtgcggtggctcatgcctgtaatctcaacactgtaggaggccaaggtggacgggctgcttgaggtcaggagttcaagaccagcctggccaacatgataaaaccctatccctactaaaaatacaaaaaaaaaaaataataatagagaggtgtggtggcgggaacctataatcccagctactcaggaggctgaggcaggagaatcacttgaacctgggaggtggaggctgcagtgagctgagatcatgccgctgcactccagcctgagcaacagagcaagactctgtctcaaaacagaaaattaaaaaaactaaaaggcatccacattgaaaggaaaaaagtcaaattatggttgtttgccgataatatgttatcttatttggaaaaaaaataaagactccacaaaaaaactattagaactggtaaacaaattcagtaaagttgcaggatacaaaatcaatatacaaaagtcagtggcatttctatatgccaatagtgaataatctgaaaaagaaataaaatgtaaacccattcacaatagccacagataaaattaaatacctagaaattaacttaaccaaagaagtgaaagctctccataataaaaactataaaacactgatgaagaacattgaaaagaacactaaaaaaatgaaaaaaatatttcaagttcatgaattggaagaatcaatactgttaaaatatccatactaccaaaaacaatttacagattcaatgcaatttatatcaaactaccaatgatattattccaagaaatagaaaaaaaatcctgaaatttacatagaaccacaaaagaccctttatagcataagatattctaaacaatagaaaaaactagaggaatgacattacttgacttcaaattatactacagatctatactaactaaaacagcatagcactggcataaaaacagacacatagaccaatggaacagaatagagaatccagaaacaattctacacacctacagtgaactcatttttgacaaaggtgccaagaacatacactggggaaaagacagtctcttcaataaatggtgttaggaaaactaaataaccatatgcaaaagaatgaaactagacccctgtcgcttgccatatacaaaattcaaatgaaagcagagtaaacatttaaatctaaagcctgaaactacaaaactactgccagaaaactttagggaaaatctccaggacattgttctcaggaaagatttcttgagcaataccccacaagcacagacaaccaaagcaaacatggacaaatgagatgacatcaagctaaaaagcttctgcacagcaaaggatacaaacaacaaagtaaagagacaactcacagaataggagaaaatatttgaaaacttcccatctgacaaggggttaataaccagaatacataagaaactcaaaggactctatgggaaaaaaaaaaaaaaaaactaataatccaatccataaaatgggcaaaaaatttgagtagacatttctcaaaagaaaacaggcctaggaaaaggcatacaacatcactgatcatcagagaaatgcaaatcaaaattactgtgagatattatctcaccctagttaaaatgccttatatctaaaagacaagcgtgacaaatgctggcaatgatatggagaaaagggaacccttgtacactgctggtgggtatgtatattagtataaccactgtggagaacattttggagcttgtcaaaaaactacaaattgagctaccttttgttcagcaatctcactgctggatatatactcaaaagaaaagaaatcagaaaatctaatagatatctgcaccctatgtttgttacagcaccttttacaatagctaagatttggaagcaacctatatgtccatcaacaaataaatcgataaagaaaatgtgatacatatacacaacagagtactattcagtcacaaaaaagaatgagatctaatcatttgcaataactggaatgcaactggagatcattatgttaagtgcaaaaagccaggcacagaaagataaacactgcatattctgacttatttatgggatctaaaaatcaaatccattgtactcacagacacagaaagtaggatagttaccagtggctaagaagggagtaggggttttgaagggtgatggggatgattaatgggtacaaaaataatagaataaataagacctactatttgatagcataataggtgtctatagtcattaataattgtatattttaaaataaagaatgtaattggattgtttgtaactcaagggataaatgcttgagaggatgaaaaaatgtattattcagatattctggaagtcagatatgcaaaaacgaattttatgtggccaagaccttagtgtcagaagggctgcattctttttggaggctccagagagaaatttgattttccagctcctaaaatttcatgacttctgatttcttcctacattactccaaactctgcgtcccttatccccttatcactccttttttttttttttttttttgcacctctccaacattcttgcctccttgttacaaggacttttgtgattacatatagcccaccaggggaatccaggataatattccaccctggtattcttaaattaatcacatctgcaaagtcccttttgtaaggcaatgtagtccaacgatagtgtttggatgcatacatatttgtattaccatgcattactcagcttaccttttttttctgagattgaggtctcactctgttgcccaagctggagagaggtggtatgatcatagctcactgcagccacaaacttctgggctcaagcaacccttccatccagcctcccaagaagctagaactacaggcacttgccaccatacctggctaatttttaaacattttttagaagtgaggtcttgcctcattgcccaggctagcctgaggagatcctctcacttcagcctcctaagtatctgggattgcagatgcaagccaccatgcctggttagcttaccaaaaattttaaattgcatttaaattaagtaatttgagaaaaaatctatttaagataaattatctccatacctttctatcttcttatctttataattcttagaagctgatacttaagagacctagaccagatatgaaacaaaggattaatactgtaatctttactgaccctcattcttagcactttgtaccaacaatcttgtttttttaaataaagtacaaaggcagtagtgagtcgagtaccttttctttagtttgtagttttgataattatcaattagtattattccattatcttttccttaaaactgtactataaagttattgtatgtcaggctcagtgtgaggtgttgaggatgcaaatataaagatatattcctgcacttaagacacatgattaaatgaagaatgcagttctacaagcaaaagttatgttgtactgtaactaatactgtaggcatgaagaagatcaattgtcagccaattagtcgtgttttggcttcttttcattttgaatatttctttttagttagctatatattcttctttgatattaacattagtttaaatgttttatatagcatatcttctttatgtgaaaataatatgtacaaactaataggaactattgatttaccctagaataaaacttatctctacctcttatttaaatactcagtagatctatgtttgagttattgcaaccaacttccatagtgtgtcatcagtactacccttgagataacagtggctcatagagtcaaatatctaggacatattaagaaagtaggggaactcctacagggaaagttaacagcttatgtgtacctaactctcacaatcaacccagatgattgttgtgttccaaccaactgtacatttggctgaactgctgaacacctgtcctagtttcagtcacccctgctgagtgtgcccatgcttgaatcacttcacaaattaattattgcaatcccttaatgtttagtatctaaaaacaagctttaagaacattgcaaatttatgcatattcaaatgttatagtgcaacaaccaaaatatggaaaacaaatgcactggaaaactaaactttcatttataataaaataaaccagaaagcagcatcttatatgataattatcattttttttcagataattatcagattatttgactgcaatcaggagaaactcattctacccaagccaaacaaaatggatactatagaaaggatatttgaaacacaaaatccactggatactagaaaatcaaacccaaaattataaaaactaagatatctataaggtccagaaaacagaaaaaaaataacactgtcctagagggatgattatgatcagttatatctttgtgataactgaaaatccaacgatttaccatttcattgtcattctgctcactatccaattttcagaagttacaacatctagcatagaaaatgtgccattgaaataggaaaagttctcttatcccccttgtagggtgttcaatgggagtgtggctcacttctttggtgccccacagctcaaacccctagggggagcatgcagaaaggcaggtcacggggagcctgaggagacaaaggcagtgtctagtgttgagtgtttacaggccctaaagccccagtgggtatgtgttacagttaatcagctcaattagaccctctgccttatcacaaggacagagggctttctgtatcctgagctcttgctttagtgtaccagaaaaattggaatcacacatggactgggaggatgggtgcaaggttttttatggagtagtgaaagtggctctcagaagatgtatagggaggcagaaagaggatgcagtgagaaggtggttttcccttggagttaggccgctcagcagccaggttctccccgaccaccctcagctaaatgtcccttagtgtccacgtgattccaccatcaatggcctgcctgtgtctgtcagtgtgttcttctaccagtgtgttcctcttgatgtccagccacctgtgtctgtgcccactaaggtctcagggtttttataggcacaggatgcagtagtggtgggtaagagtagtcttggaaaattcaacatttgggtgcaaaaacaggagtgcctttcctcacttaggtccatgggcacaagcccaagggtggagccctcaccagggaccccacctttctctacccagcagtttcctgccccgctcccgtatcagcattggttagtgacaatagagggaagaagaaatttttctaaatgaaactgggtgtggtatgtaagtagattttagacattgaaaaaatataaaatattcactacataaaatgtgtactcctatttttaatattgcactctgcttagacaaaggaagattatatttgtctttgtgagtaagcaatgcttaattacttatgtagtgttaatgttttaagatagtctagtaagacttccagtttaagtataaagaagtagctaaaaaaaggaaagcttccgttcctatattagaaaaaagctgaacatgcagcaaattaatgactttttgtgaaactatcaaataatagatattataagacaaatggccttcccaaagtaagagagacaccttcagggagagacaggagctaagcatttgctatctgaggaacaaaatctcttggtacctgtgatggttaatattgagtgtcaatttgatgggattgaaggatgcaaagtattgttcctgggtgtgtctgttagggtgttgccaaaggagattaacatttgagtcagtggattgggaaaggcagactcatcctcaatctgggcacaagctaatcagctgccaatgcagccagaattaaagcaggcagaagaacatggaaagactagactggtttagtcttctggcttacatctttctcccatgctggatgcttcctgccctcaaacgtcagactccaagttcttcagctttggcacttggactggcttccttgctcctcaacttgcagacagcctattgtgggaccttaccttgtgattgtgtgagtcaatactccttaataaactctcctttatatatacatctatcctattttttttccgtctagagaaccctaatacaatatcatatcatcttaaagtgacaataaactaaaaattttgataaatttcagaggataagtgtgggctggtatgagaatgagaatctcttggaggatgcaatcatagggttagttcccactcttttagaggcttttgctctgagaaactccaggctgtcacaaagagaatgaagaaggttgctgataaaggtcacctattgagaatggccatccagatccatctccctcactaatctgtggagggaagagaacaacctgaggatacatgtcaagtcccatctcagttggaagaagggaacttgagcaaactccagttaccctgtctgtattggtttgctatggttgccataaaatatatcacagactgggtggttataacaatataaatttattttctaacaggtctgaaaactaaaagttcaagatcaggccgtctacaggttttgtttcttctgcagcctcttcccttggcttgtagatggctgccttcttgctgtgtcctcacatggacttttctctgtgtgtttacagtcttgatggtgcctctttgggtgtcctaatattcttttcttatagacaccagtcagactgaattagggcccaccctaacacttcattttaacctaaacatgtctttaaaggctctggtttcaaatacagtcacttgcagagatactagggcttaaggtgtcaacatttgaattgtgtgtgatacgattcagctacaacactatatcacctaaaagtaaaaggcacaagtattagtttgcaaagaaggacacctcaaacacatagactgagaacactggaagacgtcatcagagctgagaacaaaataggggaaggattaaaaaagctatacctatgaaggtagaacagaaacatttgtgaatgtcatactaagatacaggctcactgtgtacattagtgactgagacttactcataaccttatcatatgctcccctcccctacatctactaccacattaataggcctctagcaataatgccaagagtttttagctaggtgatctgtaaaacgcacactttttctgtggagtggtagaaagggaagattcagaatcaggagtagagagacaaataaggtcactatatgagtctggggtctctagtatgcatagcaacaccatactttaaaaatagcgcagcctctgactaggttagtataaatccccactttagaggcctattcctcagtattcactgacccatacaacatacccagctttcaacaacaacaacaacaaaattgcaaagaatgacaaaaagtaaagaaaaaatagaaaaaataaaggaattgttaccatcagactatgacacaaatattgatattatcacacagattttaaaataactatgattaatgtgttgaagttcaatggaaaatatagtaaaacatgctagatgagataggtaattttagcacaaagatggaatctataagaaataatcagaaatattagaaatcgaaaatgctgtaacaggcataaaaatgctcagtgagctcatcagtagactcaaacagacaaggaaagagtaagtaaacttgaaaatagggctatagaaattagacaaattgagatgtaaagcaaaaaattgttttaaaaaagcaaagcatatattctgcaatataacctccaatgatgcagcatatatagttgaaaaccaaatggaaaagaaagtgagaacacagaaatcgtacttgaagaaatagtggctttaaaatttccaaaataagtaacagacagcaacctagaacttcaagctcagagaacatcaaagaaaataaataccaaaaaaacaagcaaatgacctaggcatattatttccaaactgcaaaaataaataaacaaataaataaataaataaaagacaaaatcttgaaggcgattgaagggtggactgggggatagtgggggcactgtaccaacaagggaaaaatataagaattatggcagacttctcattagaaaccaggcaaacaagaagaaaatgcagtaaggtcttcaaagttaaaaaaaaaaaaaaaaaaaaaaagaagtgttcagtttagacatctatatccagaaaaattatcttcaaaggtgaaagataaataaatactttcttaggcaaagaaaatctgatttcattgacaacagacctatcctccaagatagtttataagaagatgttcagactgttatcagcaagatggcagaataggaagttcctagctagtctagtccaacacaaacaataatctaacagtcaccgatggaaaaaagtacctttctgggagctttcagatccaggaaggatattataaaatctcagtgaagcaaaattccagggagagctgctttaagaaggcaggcccaaccttcatggtaggctcaccaaacatggggccagctgtagaccaagaacagcccatccctctgtggactttgcttgagccctacttggctgcagtcctgcagctagccccgtcgatgaaggaaaccaggagaagtcatgcttgtctatgccccagtaacaggtccactagtaatggacttgaccatggattctaaagcagccctgtgatatggctcaaggcctactctgctggtccagagtgaatccttccttcacaggtatctggtaggaaacacactgtttacaagcctgacaactggtcctgactgcaaatacggaagtgatactgtaacccggctccagccttgctctcctcccacccagggatccagcaatgcctctacaagtccctgggagcaatcttgttgacctcagtcctagttgtaaaccccaaagtcagtcccagctctggagcttgaagcagcactgataatactagccccatttggctgtgatctggggtagcactaaccctccacacaaggaaattgacaggcaatatgctcatctgagcccctggtatagatccactgaccagtttctgactacagactctaaaatagccttgtaacgttattgctggtctagtcagtcttgccaactcaggaaccggataggtgccacacttgttctcacacctggtaacaggctcactacctgtggactcaactgcagacacaaaagagacccagtcacatagttccagccctactgaatagtggttccaaacgcagttcaattcaattgaatcaggaaaataattcattatccaaatgagaaactcaacaaagagagatatgccattaaaataaaaacaacaaaacagaaaacttggagttgaataactaaatgaataaaatagatatacaattgagagattcaaactcagattagatcaatcagaagaatacatttctcaacttgaagacaagtcttttaaaataacccactcagaggaaataaaaaataaaaaaaatgtattagtcaattctcacactgctataaagaatacctgagactgggtaatttataaaggaaacgggtttgattgactcacagttccacatggcatggaagcctcaggaaacttacaatcatggcagaagatgaaggagaagcaagtaccttcttcacaaggtggcaggagagaaagtgaagggagaaagagctccttctaaaaccatcagatctcatgagaactcactcatgagaactcactcactgtcacaagaaaagcatgggggataccaccgccatgatccaatcaccacccagcaggttcctcccctgacatgtggggattacaacttggattacaatttgagatgatatttgggtggggacacagccaaaccatatcattatttctcattcatttgtgaaaaatagcttttctggatgcagtattattgactgcggtttttttctctcagcactttgaataaatcatcccagtctttcctggcctgcaagaattctgttgagcaatctgctaatagttttatagggattcctttatatacatgacctaatgcttttctcttgcagcttttagaattctgtttgtttttgacttttggccatttgattataatgtgcctcagagaggatcactttgggtaaaatttcactgggaacatttgagcctcctgaatttggaagaatatctcttccaatgcttggaaagttttcagctattattttgttaaatagatgttttgtgcctttcttaatcttattttctttcagcatttctataatacaaatatttgtttacttaatgttgtaccataagttctgcagccttttgtattcattttttcaaatttttttcctctgaatgagttattttaaaagacttgtcttcaagttcagaaatttattcttctgattgatctaatctgagtttgaatctctcaattgtatatctattttattcattgagttattcaactccaagatttctgttttgttgttgttttatttttaatagcatatctttgttgaatttctcatttggataatgaattattttcctgattcaattaaattgaactgcctttggaaccactattcagcagggctggaactatgtgactgagtctcttttgtatctgcagttgagcccacagacagtgagcctgctaccaggtgtgagaacaagcaggcacctatccagttcctgagttggcaagactgactagaccagcactaaagttacaaggctgtttcagagtctgtagtcagatcactcttgctatgctttagcaaagagactggaggcattgtgcccctgccctagagagggcagaaaatagaggctagaaaaataagaaatgatcaataaaattcagagccagttttttaaaagataaaattaacaaaactttagaataactaagagaaaaagagaaacaaataaaatccgaaataaaagaaaagatataactgataccacagtgatataaaggatccccttcagtgatcttatgaatggataacttcaaataagtggataaattcctagaaacatacaacctaacaacaccaaatcatgaagaaatagaaagactgaacatagcaataatgagtaaggatattaaatcagtaatcaaaaatctcccaaaaacaacaataacaaaaacagaactacatggcttcattgggtaattttatgaaacaattaaagttgaattaataccaattccaataattccaaaatctccaccaaaaaaacaataaataaataaataaagagaagggaatacttcaaaagtcagtttacaaggccagcattaccttgacagaaaaactatagaaagatactacaagaaaaaaaaactcttggtcctgataaatatagatgcaatactgcacaacaaaaatacaagcagactgagttcaacaacattatcccttatacgttatatattgtgatcaattggggatcattccagggatgcaaaaatgattctgcatacacaaatcaatcaatgtgacacatcaatttaacataattaaggaaaaaaatgtttgtctcaatagatgcataaaaaaaatttaacagaatacaacattctttcatctctcaccaaattaggtacaaaaggaatgtacctcaacacaatatacaccatatatgacaagccaacagctaacattagacttaaagatgaaaagattaatgctttacttctaacatcgggaacacaagaatgtccccactggcccctttaatcaatatagtactggaagttctaatcagagcaattagaaaaggaatagaaataaaatacatccaaattgggggaaaaaagtaatattgttcctgcagaaaacatcatcttatatatagaaaaaaaacccaagactatgaaataaactgatagaattaataaaccaatagataaatatagtaaagttataggatactaaatgaacatattcattaagttaaatttttatcccctattaacaaacacttaaaaaaatagagaacaatcccatttacaataacgtcaaaaggaattgagtacttaggaataaatttaaccaggaatataaattatttgtaccatgataactattaaatgatgaaagaaattgcagaagacccaaataagtggaaagctatcctgtgtttctggatcagaagggctaatattgttaaaacgttcatgctatccagaacagtctgcagattcaattctattcctatcaaaattccaataatatttttcaaagaaatagaaaaaaaatactaaaattcacatgaaaccagaaagggtgctgtagccacagcaatctttagtgaaaagaacaaaactgaaaatatcacactacctggcttcaaatacactacaacgctactgtaatcaaaacagaatggtactgtcagaaaaacagacagagtcctgtggaacataatagagaacccaggagtgcacttattgtcctttgacctttgtcaaatgtgctgagaaaacaagatggagaaaggacagtctctttaacaaaaggttttgaaacaactggatagccactggcagaagaataacattgtactcttatttcacaccatataaaatatcaacttaaaagtgaatttaaaaaattaaatataaacttgaaactgtaaaactattagaagaataaatagcagaaagatccttgacactggtgtggtcaatgatgttttggaaatggctccaaaagtataggcaacaaaaacaaaatagacaaattggattcctccaaactaaaaagcttatgcacagcaaaggaaacaatcagtaacctatggaataagaaaaaaaattacaaaccatacatctgactaggggtggatccttcataaatagtttagcaagaaaataaataaccttatttttaaataaacaaaagagatgaataaacatttgtgagaaggaagcacatccatgaccaaaagtatatgaaaaattgctcagcatcactaattatcaggaaaacacaaattcaaaccataatggctaatatggtttgtatctatgtccccagccaaatctcatgttcaattgcaatcttcagtgttggaggtggggcctggtcgaaggtgattggatcataggggtggatccttaatgaatagtttagcatcatccttttggtgctgttctcattatagtgatctcagcagatctagtggtttaaaagtatatagcatacctcccacccccaattctctgttgctcctgctccagacatgtaagatacacctgctttcccttcattttctgccctgattgtaactttcctgaggccacccaagaagccaagcagatgccagaatcatgtttcctacacaatctgaagaaaccatgagctgatgaaatctcttttctttataaattatccagtctcagacatttctttatagaagtgtgagaaaaaactaatacagaaaatttgcacaagaattggggtattgctataaagatacctgaaaatgtggatgcagctttggaactgggtgaaggacagaggtaacatttttgagggctcagaaaaagacaggaagatgagagaaagtatggaacttcctagagacttgttgaattgttgtgaccaaaatgctgagagtgatgtggacaatgaagtagaagctgatgagatctcagaaaaaaaaaaacaaggaatttattgggaactagagcaaaggtcacttttgttgtacatcagcaaacaacctggcagcattgtgctcctgctctagggaacatgaaacttccaacttcagagtaatgatttagggtaactggtgtaagaaatttctaagcagcaaaatgttcaagatgttgcctgtttctaacaacctatgctcatagtgtgagcaaagaaatgacataaaacaggaacttaatttaaagggaaaccagagtgttaaagtttgaaaaacttgcagtccagttatgtggtaaaatagaaaagtccattttcaggggagaaattcaagcaggctgcaaaaatttgcataagttaaaaggagccaactggggaaatggccttgaaaacattttagagaccttcacggcaccccctaccatgacaggcttggaggcctgggaaggaagaatggtgttttgaaacaggccctgggtcctgctgccctgtgcagccttgggacactgctcctggtatcccagctgctccagctccagccatgtttcaatgggaccctggtgcaggttgtgctgctgcttcagatggtgcaaatcataagccttggtggcttttccttggtgtgaagcctgcagttcacagagtacaagtgttcaggcttgggggcctccatctagatttcagaggaggtatggaaaaatctggatgtccaggcagaagcctgctatagggggagagccctcaaggagaaccactaccagggtgatgtggaggggaaatgtggggttggagccaccacacaaagtctccacttggacactgcctagaggagctgtgagaagaggaccatcattctccagactccagaataatagaaccactagcagcttctgccttgtatttcctgagactgggtaatttataaagaaaaacgttgaattgactcacagtttcacatggctggggaggcctcaagaaacatacaatcatggcagaaggcacctcttctcagggtggccggaaagaaaatgagcgcaactaggggaaatgccagacacttataaaaccatcagacctcatgggactcactcactattatgggaacagcatggaggaaactgcttccatgatccaattacctccacctggtcccacccttgacatgtagggataatgaggattaaaagtcaagaggagatttgggtggggacacagccagaccatgtccttccactcctggctcctccaaaatctcatgtcctcacatttcaaaacacaatcatgtctttccaacagtcccccaagacttagctcattctagtattaacccaaatttcaagtccaaagtttcatctgagataagacaagtcccttctgcctataatcctgcaaaatcaaaagcaagttaagtacttcctaagtacagtggggttacacacattgggtaaatacaccactccaaattggagaaattagcccaaacaatggggctataggcccaatgcatgtccaaaattcaatagggcagacattaaaccttaaagctctaaaatgatctttgactccatgtctcacatcaggtcatgctgatacaagaggtgggttcccacagccttggacagctttgctgaagtggctttgcagggtaactcccccatcctggcttctttcacaggctggcattgagtttctgtggcttttccagatgcactgtgcaagctgttggtggatctaacgttctggagtctggagcatggtggccctcttctgcactagctccacgaggcagtgccccagtggggactctttgtgggggcacatccccacatttcccttctgaactgccctagcagaacttctccatgagggctctgcccctgcggaagacttctgcctggatatccaggcattttcatatatcctctgaaatctaagcagaggctcccaaacttcaattcttgacatctgtgcacccacaggcccaacaccatgtgaaagccaccaagactaggagcatgcaccctctgaagcaatggcctgagttgtacattggctccattagccacagctagaaggcagggcaccaattcccaagaccgcacaaagtggcaaggctctgggaccagcccacaaaaccattttttcctcctaggtctccaggcctgtgatggagtggctgccctgaagttttctgacatgccctggagacatttttcccactgtcttggtgattaacattccactccttgttacttatgcacatttctatggcaggaataaatttctgcccaggaaatggggttttattttctattgcattgtgaagctgcaaattttccaaagttttatgccctgctttttttgatgctttgcctcttagaaatttcttctaccagatattctaaattatctctcttgggttcaaagttccacaaatctctagggcaggggcaaaatgcttccagtccctttgctaaagcataacgagagtcacctttgcaccagttcccaagaagttccttatctctatctgagaccacctcagcctggactttactgtccatatcactatcagcattttggtcaaaatcattcaacaagtctctaggatgttccaaacattcccacatctttctgttttctcctgagtcctccgaactgttccaacctctgactgttacccagttccaaagtcacatccacatttttgggtatctttacagcaacaccccactaccttggtaccaatttattgtatttggctgttctcacactgcttgaagaaatacccaagactgggtaatttataacaaaaagagatttaattgactcacaggtccatgaagctggggaggcctcaggaaacttacaatcatgaaggaaggcacctcttcacagggcagcaggagagagaatgagtgcaaacagtgtaaatgccagatacttataaaatgatcagatctcatgagactcactcaatatcatgagaacagcatggggcaaaatgcctccattatctgattacctctacctggtcctacccttgacatgtggggattatggagattataattcaaggtgagattttggatggggacacatccaaaccataccacacccacagaccggaagagccatagacacacaacactcatccaaggagcagatgcagacactgtaccctgcaaagccacagcgacagagcttcccaaggccttgggagccaaccctttgcaacagtgtgtcctggatgggaggcatggagtcaaagtatattatttcagagctttaatgtttaatggctgcccttctgggttccagactcgcatggggcctgtcgtccctttcttttgtccaatttctgggtttttgtttgtttgtttgtttgttttttgaatgacagtatttacccaatgcctatacctccattgtattttggaagtagctaacttgtttttttgattttacaggctcacaggcagaagggactaccctttcatcagataaaattttggactttggacttttgagttaatgctgggatgagtaaagattctggggactgctgtgaaaggataattttatgttgtaatgtgaggaaatgagatttggaagtagccaggtgcagaatgttatggtttaaatctatgtccacactcaagtgtcatgttcaattctaatcttcatcattggtggtggtgcctggtgggagatgattggatgacatgggtggatgcatcttgaatggtttaccaccatccctttttgtgggatatctctttgtgatagagttctcatgagatctggttgtttaaaagtgtgtagcacctccccacaacaactttgctcctgctccagccatgtaagacatgcctggttgccctttgccttcttccatgattgtacgttcctaaggcctccctagaaactgagcagatgccaggatgccagaatcatacttcctatacagcctgtggaaccatgagccaattaaacctcttttttttataaattatcagtctcaggtatttttcctagcagtgagagaacagactaatacaatggtttatcacctcactctgttggaatgtgtattattaaaaaaaaggcagcaagtattgttgaggatgtagagaatagaaaatacttatatactattggttatgatgtaaattggtatacacattatagaaaacaatataaagaatgctgaaaaagttaaaaatggaactaccttatgagtcagcaatcccgcttctgaatatatattcaaaagaaataaaataatgttctgaaagagagatatgcaatttgcaatcccatatttattgaggcattattcacagtagccaagctatggacacaacctaagtgtctactggtagatgaatggctaaaaattgtaatacgtgtgtgtgtgtgtgtgtgtgtgtgtgtggcagtgggggtcagcagtgtacatatataaatatgtataggatggaatcatattcaatctaaaaagaagaagaaaattctgctatttgcaatgatgtatatgaatctggagcacataatgctaagtgaaataaaccagacaggaagaaaaatactgtatgatctcacttacatgtggaatctaaacaactggaagtcatagaaacatagggtagaagtgtggttaccaggggctgaggaaatagagagacattggtcaaatgatacaaattttcacttatcaaatgagtaagttctggagacctaataaatagcatggtgactatagataacgataatgtgttgtatgcttgaaatttcctaagaaaaatcttaacttttctcactatagtcacatacacagaaaacaggaaaggtaattatgtgaggtgattaatatgttaattagcttgattgtgataattatttcacaatgcatatatctcaaaacatcacactgtataccttatatatatttattaattatatctcaataaagatggataaaaatgaagttattaaggcagaagtaatagaatccgatcagaaacagattacacaaagatatgaagatataaaatatttggttgttttatagcatatataaaaatgtgaagagaaagactttttaactatgctccaaattcttatgcagcaactagctactggtattcctaaaatgcaaacaatgagaacatatttccttgacttgattagttaatataatttataatttgcttgacttgattttgaaagctttatcccattagttccttcccatagcatgttcttattctaattagatctttcacaatgtgcttatacaagtgtgactcttcttgaaacaacacattcccacttgcacagagtcaacattctttgacatgccacaattcacagagggttcctaaagaagccactccttgaatccctatgtcatttctagtaagagtagtttagccatttctttcaatcaaatacatagagcactttatttataatacataagcaagtcaggttcactaaaattatttaaaaagagtattatacaatacagattttaaacatagtttaattgttatattgatcatttaaaactggttgcattcctttctttcccccattcagttagcacacatcttgattaatttgtgctttattgagaacataattataaagtaattatgaaaacttaaaatgtcattaacttcgtcctccatggatttagcaacctaataagactcatctaaattcttgaactttcctttaaaatcagccaacacataaaagaaactaaaacttgtacacacaagttttagttgtcagacattcattcttctcttaaaatcatttcctcaaaattaccctattggtttattagtttgtcacattatatgtttctacaatctgcagtttcattagacaaaaaactgaatatttttattacatttctataagttttctctgtataggtatttattgtatatgcctacatttatagtgtacacacacacacaccatcccctccctcaccacacacacacacacaaacacacacacacatcattaaagtactgaagggaatacaatatgttcatgactggagggagaaaattttaatcaatagaaaaatttgcagaatatgcttattcctcatagataatattggttctaatttcaagttttggaccctcttgctttttcgtctttgatgtttattttgccttctgcatcttttgcagaatggaaacagaatcctgaatgaaataagttatgcaactttaaggcaaaaattaagcaattttttttgctacggttttaattagtagaaattaatagtgagagagttcaatttaattatgggtactaaggcatattactattcatctagttttcaaaaatcatgaaatctaggccaaaatatgaaaaacaggagaaaagaaaactgtctttgttgaaatatgtaagtagtcatgacacacaaaccaggatctaagaaattatctgccgaataatttaaatgtgaacacaagcaagggacctcctgagaaaagagaaaaaatatatacaacaaattatggtgatttgtttgtttgtttttataagtgtaatattttaaaaagccaagagtgacaagattaacgtctggaaacatactaggtgcttgcatatacacaaacaccacacaacaaaacatgtccacaaattttatacatagagagaaagagatgtaggttttcatccacagttcctggctcatgactcccattgccttgttacatcctttttgttatgatgttgggcgtcttatgtctcaggagcaggccttaggaaacagaatctctctgaccttctcctgccctcatttaacctaccacaaggcaagactctaattttccctgcctttctgattgtgggtcttaagaccctcactccaaagagggtcttcccccatatcctagggaggaagggcaatcatgaagcttccataaaagtccaagaggactgggtccagagagcttctggatagctgaacacttggaggtttttggagggaggtggacccaggaagggcttagaagctctgcaccctttcccccatgccacaccgtacgcatctcttcatatgtattcttaagtaatatcctgtataataaactggtaaatgtaagtaagtgtttccttgaattctgtgagctccttcaacaaattaattgaaccaaaagagagtgtgggaaccccagagtgaagttaatcaatcagaagttctggacttgtgactggtgtctgaagtgggtgagggttaatcttggggactgagccctcaacctgtgggatgtgatactatctccaaatagatagtgtcagaattaaattcaaaggtacccagctggtgttcactgcttgttagtggggaaagcttcctaacacagttggtcacagaagtctgtgcttattgttgtggtgtgaaaacaaataagaacataatttgagagtttttccaaaacaagctataacattcatgcattgtagttgtatatttgtggcaaattttactgaagttatggagagatagagaagaattattttgtcaaaatcaagacatctttaaaaaatgtatatatttatggatgaaacattctttatcttcttgtgtagctttctgctccctctctgcttcctccccattttatttactctctttccttactatatttagcagtattttttttgtcacaggttccccttatatgtaaagactccccaatgtgtttctcaaacatgagccatttacttcaagccctcttctttttgccctcgttgacagtgtctgcattaatttcaataacttttaattgtatatcctgtcatgataaaagagttactaacattttttaatgcccaccatattctaataatttataaatgtcttaatattttgatcctcacaatacattacaaagtatatactttaatctccaattatagttagagatcagagagcaaatatccaagataatagtaacttattcaaatttagtaactggtgaactcagtttaaaattcatctaaatatcaaaccctttttccattacatctatctccctgaccctaggtcatcaaagaatgattatctcatatgcaatacctcatgtttaataaggcatagaagtatgtaattcactttaggataatatccattaaaatggttaaaacagaaaataattgtggcacttaatggggcaaatgtcaattttctgaataattcatttaagtggaaaagctcttcctctgacaatgccagataaatgagatgtctctacatgttactgtctgttttgtttctgcttctgtgcatgtttctgatctccaactagcacttcattattggattcattttcatttactaatgaagctttcagtacatttaaggacctcaggcattttaaaactcggtcattttgcttcgtgccaacttatctccaagtttccatttcaaagtggcatcattacaattactaatactacagcatagtctgtgcttggactggcattaattctggcacaagctcagaaagttttgtttctgactgatcctgaaaggtacattgattttggctttatgtagcccctcctggcataccttttgtttttctaataacattaatctcagctgggcttgcaagcaaacttaaattcttctgggaagttttgcactaacccacaatttaaactatgttttattttttaaaactaagtctacggatgctttgtaagatgacataaaagttgtttttccttcaaaaccacctttttctgacaatatttgaaatggttagtttttttttttcatcatggtggttaaacataatgaccttgtttgtggattctcttattttctttctttcccatatttttgctctgtcttctgtacgctttagtattaagagagttgtatactgatttaatcaacctatatcaaagatgataatacactggaaaagtaacttctaaagttaagaaaaaaattgaaaggggtggctggcaagagtgctgaataggaaccactactacctacagctcccagtgagatcaatgcagaaaagggtgatttctgcatttccaactgtacctggctcatctcatctggactggtcagacagtgggtgcagcccatagagggtgagccaaagcagagtagggcatcgcctcacttgggaagcgcaaggggttggggaactccctcctctagacaagggaagctgtgagggactgtgccatgaggaatggtgctttctggcccagatactatgcttttcacatggtcttcacaacccgcaaaccaggcgattcccttgggtgcctaaaccaccagggccctgagtttcaagcacaaaactgggcagccatttgggcaggcactgagctagctgcaggagtctgtttttcataccccagtggcacctggaatgccagtgagtcagaactgctcacttccctggaaagggggctgaagccagggagccaagtggtctagttcagtagatcccatccccacagagtccagcaagctaagattcactagtgtgaaattctcactgccaacacagcagtctgaagtcaacctgggatactcgagtttggtggggggtggggcatccgccattactgaggcttgaataggtggtttaccactcacagtgtaaacaaagtcacagggaagttcgaaatgggtgtagcccaccacagttcagcaaagccgctgtcgccaagctgcctctctagattcctcctctctgagcagggcatctctgaaagaaaggcagcagccccagtcagaggcttataattaaaactcccatctccctgggacagagcacctgggggaaggggaagcagtggacgcagctgcagcagacttaaacattcctgcctattagctctgaagagagcagtggatctcccaacacagcactaaagttcttcttaaggacagactgcctcctcaagtgggtccctgacccccatacctcctgactgggagacacctcccagcagaagttgacagacacctcatacaggagagctccagctggcatctggccagtgccactctgggacaaagcttccagaggaagaaacaggcagaaatctttgctgttctacagcatcttctggtgatactaaggcaaatgaggtctggagtggacctccagcaaacttcagcagacctgcaacagaggggcctgactgttaaaaggaaaactaacaaacagaaaggaatagcatcaacatcaacagaaaggatgtcagcacaaaaaccccatctgaaggtaaccaacatcagagaccaaaagtagataaatccacgaagatgagggaaaaccagcacaaaaatgctaaaaattccaaaaaccagaatgcctctttttttcccaaggatgacaactcctcaccagcaacggaacaaaactggatggagaatgagttgatgaaatgacagaagtaggcttcagaaggtggctaataacaaactcctccgagctaaaggagcatgttctaacccaacgcaaggaagctaagaaccttaaaaaaagttagacgaattgctaactagaataaccagtttagagaagaatataaatgacttgatggaggtgaaatacacagcacaagaactttgtgaagcatataaaagtatcaatagccgaatcgatcaggcagaataaagcatatcagggattgaagatcaacttaatgaaataaagcatgaagacaagattagagaaaaaagaataaaaaggaatgagcaaagcctccaagaaatatgggactatgtgaaaagaccaaacctacatttgattggtgtacctaaaagtgacaggaagaatggaaccaagttggaaaacgctcttcaggatgttatctagaacttccccaacctagcaagacaggccaacattcaaatacaggaaatacggagaacacacaaagatactcctctagaagagcaaccccaagacacataatcatcagatttgccaaggttgtgatgaaggcagccagagagaaaggtcggattacccaaaaagggaagcccatcagactaacagtggatctccctgcagaaaccctacaagccggaagatagtgggggccaatattctagagtcttaaagaaaataattttcaacccaggatttcatatccagcaaaactaagtttcataagtgaagaagaaataagatttttcacagacaagcaaatgctgagagattttgtcaccaccaggcctgccttacaagagatcctgaaggaagcactaactatagaaaggaaaaactggtaccagccactgtaaaaacacaccaaattgtacagaccatcaacactatgaagaaattccaaaataaccagctagcatcataatgacaggatcaaattcacacatgacaatattaaccttaaatgtaaatgggctaaatgccccaattaaaagacacacactggcaaattggataaagagtcaagacccaccagtgtgctgtattcaggagacccatctcatgtgcaaagacaaacataggctcaaagtatagggatggaggaatatttaccaagaaaatggaaataaaaaaaaagcaggggttgtgatcctagtctctgataagacagtctttgaaccaacaaagatcaaaaaaggcaaaaaggggcattacataatggtaaagggatcaatacaacaagaagagttaactatgttaactatcctaaatatatatgcacctgatacagaagaacccagattcataaagcaagttcttagagacctacaaagagactaagactcccacacaataatagtgggagactataacacccactgtcaatattagatcaatgagacagaaaattaacaaagatattcaggacttgaactcagctgtggaccaagcagacctaatagacatctacagaactctccacaccaaataacagaatatagattcttcttagcaccatgtcacatttattctaaaattgaccatataattagaagtaaaacacttctcagcaaatgcaaaaaaacggatatcctaacagcctctcagacaacagtgcaatcaaattagaattcaagattaagaaactcactcaaaactgcacaactacatggaaactgaactaactgttcctgaatgactactgggtaaataatgaaattaaggcagtaataaataagttatttgaaaccaataagaacaaagacacaacataccaaaatctctgggacacagctaaagcagtgattagagggaaatttatagcaccaaatgcccacagaagaaagtgggaaagatctaaaattgacaccctaacgtcacaattaaaagaactagagaagcaagagcaaacaaattcaaaagctagcagaagaccagaaataactaagatcagaggagaaccaaaggagatagagacacagaaaactcttcaaaaaatcaatgaatccaggagttgttttttttttttttgaaaagatcaacaaaatagatagactgctagcctgactaataaagaagaaagagagaagaatcaaatagacacaataaaaaaaatgataaaggggatatcaccactgatcccacagaaatacaaactaccatcagagtatatacctctataaacacctctatgcaaataaactagaaaatctagaagaaatggatgaattcctggacacatagacccttccaagactaaaccaggaaaaagtcgaatccctgaatagaccaataacaagttctgaaattgaggcagtaattaatagcctaccaacctaaaaaagcccaggaccagacggattcacagctgaattctaccagagttacaaagaggagccaataccattccttccgaaactattccaaacaatagaaaaagagagactcctccctagctcattttcagaggcctgcaacatcctgatatcaaaacctggcagagacacaacaaaatagaaaatttcaggccaatatccctgatgaacattgatgagaaaatcctcaataaaatattggcaaacagaatccagcagcacattaaaaagcttatccactacgatcaagtcagcttcattcctaggatggaaggctggttcaacatacacaataatgtaatctatcacataaacagaaccaatgacaaaaactacatgattatctcaatagatgcagaaaaggcctttgataaaattcaataccattcatgctaaaaagtctcaataaactagatattgatggaacgtatctcaaaataataagagctaattatgagaaacctacagccaatatcatactgaatggccaaaagctggaagcattccctttgaaaaccagcacaaaacaaggatgccctctctcaccactgctattcaacatagcattggtagttctggccaggtccatcaggcaagagaaagaaataaagtgtattcaaatagaaagagagaagtcaaattgtctctgtttgcagatgacatgattgtatatttagaaaaccccatcatcacagcccaaaatctccttaagcttataagtaacttcagcaaagtttcaggattcagaatcaatgtgcaaaaatcacaagcattcctatacacctataatagacaaacagagaaccaaatcatgatataactcccattgacaattgctacaaagagaataaagtacctaggaatacaacttacaaggaatgtgaaggacctcctcaaggagaactacaaaccactgctcaaagaaataagacaggacacaaacaaacagaaaaacattccatgctcgtggatagaaagaataaatatggtgaaaatggccatactgcccaaagtaatttatagattcaatgttatccccatcaagataccattgactttcttcacagaattaggaaaaacaactttaaatttcatatagaatgaaaaaagagcccgtatagccaagacaatcctaaacaaaaacaacaaagctggaggcatcctgctacctgacttcaaactatagtacaaggctacagcaaccaaaacagcatggtcctggtaccaaaacagatacttagaacaatggaacagaacagaggcctcagaaataacaccccacatctacaatcatctgatctttgacaaacctgacaaaaacaagaaatggggaagggattccctatttaatacatggtgttaggaaaactggctagccgtatgctgaaaactaaaactggaccccttctttacaccttatacaaaaattaactcaagatggattaaagactttaacgtaagtcttaaaaccacaaaaacccagaagaaaagctaggcaataccattcaggacataggcacgggcaaagacttcatgacaaaaacataaaaagcaatggcaacaaaagccaaaattgacaaatgggatctaattaaactagagagcttctgtacagcaaaagaaactatcatcagagtgaacaggcaacctacagaatgggagaaaatttttgcaatctatccatctgacaaaggtctaatatccagaatctagcaggaacttaaacaaatttacaagaaaaaagcaaacaaccccatcaaaaatggggcaaaggataataacagacacttctcaaaagaagacatttatgtggccaacaaacatatgaaaaaaagctcataattactgatcattagagaactgcaaatcaaaaccacaatgagataccatctcatgccagtcagaatggcaatcattaaaacgtcaggaaacaacagatgctagagaggatgtggagaaataggaatgcttttacactgttgctgggagtgtaaattagttcaaccattgtggaagatagtgtggcaattccttaaggatctagatccagaaataccatttgacccagcaatcccattactgggtatttacccaaaggattataaatcattctactataaagacacatgcacacatatgtttattgtaggagtgttcacaatagcaaaggcttggaaccaacccaaatgcccatcaatgatagactgaataaagaaaatgtggcacatatacaccatggaatactatctagccatagaaaaggatgagttcatgtcctttgcagggacatggataaagctggaaaccatcattctcagcaaactaacaaaggacagaaaaccaaacactgcatgttctcactcgtaagtgggagttgaacaacgggaacacatgaacacagggaggggaacatcacacactgggggctgttgtggggtgggtgtctaggggacggacagcattaggagaaatacctaatgtagatgatgggttgatgggtgcagcaaaccaccatggcacaggtatacctatataacaaatctgcatgttctgcacatgtatcccagaacttaaagtataatttaaaaaaaagaaaagaatgaaaattgctagacagtttgaaacaggcattcaagctaaataaataagtatatagtttcatttctagcaattttttcaacatcttcctagctgaatttttttgcaagctgacattagcacctacaaatattttcagggaaaacaatgactaacaattgtttagggaacaccttgagtaaattttatctactaatcatacaaccaagattctcatttgcaatgtttaagggatatactaatttacagcattagtgctgttgttactaattttctgaaagattactcatattcttgagttaagtatgattttaaatgtaagtgcccatctataatttgggccatatgaggcatctggagatagtgaaatgttcataaactttgatgacatatatttctgccttcaaatcatgcctagctatccatttcaccttgctgtcactatacaaactctacaatcctgttttttcacctgtaagaaaatacctattttgaggaatcactttaacaatttaatgaggtttttaaaagcactaagtagattaactagtcaaatttagcacatgacaaatggaagctgccacccttataagttgcttagacaacaatatctgcatttctattaaaggaaaagaaaagaaaggaaagagagaaaggaaaggaagtgaagaaaaaataagggaagagaagatatttccaaaatgcaaggatctttaaattttaaggttattccaatttcattactttgaaataatttcataaaataattactagaaactattgtataaatatcaattgtttcagagaaaatatacattattttctggagaataacaaaaatgaaaaaaaaaacaccaagtgcaaatcaaagaataaaatctgtaggcacaaagataagcatgtgcataaccaaatattcagaaaactactgaatgtgtgctgtttttaattagtaaaacatagaaccctaatgtatacataaaatttacagggatgataaatttagattttgatataaattctactttcagtataaaatatctggcataatctacatctatacacagcaaatatttcttgagggcctactatgttcaggcactccgctatctgggattatatgacagtgcatgaggcagacttgctttttaccctgttctagagtaacagaacattgtactccactgaataatgtagaagacatcagcttcaacgattccacatcctggcacaatgtcacaccagtgtcaaataaatttctcccatgttaacaacattccttaaagagtatataaataaataatggtcaaagcaacgtggcactgagaatgacctactaaatcacaaataggtatgagtaaatattgttataaactatgatagttattgatttgtgatttaaggctgatttggggttttgttttgaatttttaatctcttcaagtcaagaatatagcacaaaaatttctcaaatcacaagttgaaagttaagaactttcataaatatgaacagtgctccagagcaaagccctgtcccactttgcaggcacatggcagaagttctatcagaatgacttggctgtgacattttactgaatatgtttgctctttttcatacttagcactaatgtatttgttaacattacatatattgcacttgtgttacatgctaagtaacataagtgtgacagattttgtgtgaaaattttgaaagtgtctcataagatgatgagtagattgtgatgggaagtggaaactaatatgagttcttattgagttcttagagcaattttcaacttgacctgtctaacctgacttcaatctataggcaatttttccttctatgtcaaaggcacccaagatgctcattcatctcccttgttactatgagatggtgggttatcacatgctttgaagagaaagagataggctttgaagagaagaatttgatcaagatggccttaatgttcccctcagcttgaccaaactttagacagatttcttcctgtctataggctcccggccttttttttctttaaaaaacttccaatgcaaattatttcctgttccttgagatataaatgttctttcagactcctgccagtttttcaaaccaggaatgtctttctcaagtacatggaagctatccctttgaaatgtaatcatcaagaaagatggtgcccctatgtctcatattctgtgagaggacaggagtttaactacactaatcactaattagcaaacacagatggcctaatgacactgaccaacctcccacctaacatcttccagtatttttccactagctcccccaacagagttgagcttaatagtcttcatccctattgccatcatcctgaataaaatatttgttgctcatctaagttgtcctgtacaattttctttgacaggctaaatattctctagggtactgatggtccacacttcaaacttcatgttctacaagtgtagtagttgacagttgatagtcttttctcacctgtaatcagaggcagagcctaaagctgaggtattctccacacagcttttacttttaaccaaaatcttttcattcaaactttctctattctgagtagtcagtctttttctcttttgtccccaaccaacatctggtctagcttcagaaagttaccatagttttttcaggtgtgcatccagtctttttaatggcctttgataatgaagctgcttttgcaaaagttatatcagtgagaaaattataacagtcagctaagctaacccaacccccaacttgcctttcctttaattattcatgggctactgggccaagataattttggaagacattcaggctacagtttaaatgataataggtcttgcccaaaactcaaccacttttgtaaagctaataggaggtcatcaggctaagtggggggagaggagcctgagacctgctaaggtgcagacattattccagaggttgtaagatatgcagtgtcttcaattgctcctgcaaatactactactattgtaggttggccttttaagatatctttccaggttttttgcatgtctgacacccagggcaccacctggactaacaaccccgcttctgtggccctacacagatttggctggcagcaggacagcttcaaccccctatgatttcatctgtaccctaaccattcagcagcaagcacctgttacctggcaacccccacccctttccccaaactgctcttgaacaacccctaatctatgagctctgaatgagatgatttgagtatgaactccatctcccatatggcgtggccagcctcatgtctattaaactctttctctagtacaatgctgcgctctttctttatgcagtgggcaggaggaaccccttgggtggttacaataagtagttgcttcttttgagctcttgctctccaagagattgagtctcatccgtattggagtaaaattggaaatgctatactaggggtacaggtgaaaaagccaagaagtggcagagaaaacactttgagatataaccctataattaaggggaaaaatagactcagggtagtaggaaaatgagtaatgttcagcttaggagaaatgaatttaaaagaaaaatagaaagttaagcaatcttgtaaaatgccactcttagcaatcaattataattaagaagagatgaggaaaatatttccagttcattccatgtagtaccacaactccaacagtactttaacttcccccaggctagaaaccacaacatctttgttacagaacaggcgaccagatccatagcccaagtgagggttcttggatcttgtgcaaaaaagaattcagggcaagtctgcagtgcaaagtaaaagcaagtttattaagaaagtaaagtagtaaaagtccaacaacaccatagacagagtagggcattccagaaagatgttacaggaaaggggtcctgatccagaccccaaaagagggctctttttgttcttttctataaaagtttttatagaaaaactgaatacccctttaaatttagctaatatgttcacacatagatttttttacaattaatttttcacaaacctttcataacttgctcaaagctttagctttattctatttaactgaaaacattctttaacacctgaaacttaggcaagaaatccacattcccatgccttcttataatctttcaccaaaaacacatttcacttcacttacacgccttgcatgtagaactgtttcttcagcagtctcaaatacatgttacactgttaactcttagcgacttacttttggtgaaaagcctggttagtaatcgattttgattatgtactaggtgtggagcctagcctaggacataccacgcagaagtgcagataaggtctgacattttctagcacagatagggggcatggctaactccacatgttcccaggccttacctagttgtaaagcaggcaagtcgtacagttatgagtcgtagtggcattttatgaggaaccttctttgcatagctagggggcatggctaattccacatgtccctaggccttatctagaatctaatgctccaaagtaggtacattgaacaattttcaaaagtcaaagaaacagcttatgaccttaaagcttttgtacaacttaatatctgacctgcataatttagaccaactgtctttattttaccaataatctttaaagctgtctttatttcccagagattacttaagtcatgtgaacaaaaagacattacactttttacttttctgacaaaatatttgatttaagctcttgttattgaaccaattaattaaagctcttttatattacacacacataatacatataaatacatagacagacagaagataagtgatcatcccccaagccgggaatttaatcctgaaccccagccaccactgtgatggtggagaccaagagtaggtactgccacatggctacaaggtcaaggtcccaaggacatgactcaccagaaagaaacctcatatagtttacacacccatccccccccccccccccaacacacacacacagaaagagacagagagaggctagaattctgactagtaagaaattcttacccttttgctggcacgtgaggcttttgtgttccctttctttgagtggtcctagtgacccggcggctggaccctagccctgggggccaagctgaaatacaaaggagaattatctcttttcatcctggccagaataaaatatctgtgacaaaacatagacattaaccactctgcttagtacccagtatcaaactggcaaggctcaaacttgccccatcatcgttaactcaacctccgaccaggagtttcaatatgtggtctctgggcaagatggtagccctgagtaaaagaaaagatagaaaagagagaggaaagcattgcatgcagcggggtagggaatgtgaaatgctcagggaggccagagagggacacacccattgcggcgacactgaaaagttcaggcggctgctgttgtgaagggatttttttttcagggagtcccatcagctctcaagtttccccttttcagggaggaaaaagctccccatgtcccacgatcctgtatatacctaatcctgtcacccacagctgttagcaaagagtgcaaggcagattattccaaagagaatagcagttaaaatcctgtagtgccaaacacattcctagccaaaagggactttactgagaagggcttttaacaccctaaatcttagactggattctaacactcctaagtcagacccctaacccaggatccatccggcgtccttgccttttattaagaggatcctttaaccctctctgtcttaggagagactctaactcccccaagttaggctgctacctcaaccccattctttacccagatatatgcaccccacttaagcaaagtcagccaattggtgctcgcagattatttccctttggatctcgggtctcttcagtatagtcccttctgtggttcaccagaaagatgttaccggaccccaccacttacccaaaggtagcctttgtgtcccttctgtggttgccagaaagatgttacaggaaggtggtcctcatccagaccccaagagagggttcttagatctcgcgcaagaaagaattcagggcaagtctgtaaagtgaaagcaagtttattaggaaagcaaaggaataaaagaatggccactccatagacagagcagccccaagggctgctggttgcacattcttacggttatttcttgattatgtgctaaacaaggggtggattattcatgccttctgtttttagaccaccacataggctaacttcctgacattgccagggcatttataaactgtcatggcgctggtgggagtgtagcagtgaggacgaccagaggtccctcttgtggccatcttgggtttagtgggtttcagccggcttctttatgacaacccgttttatcagcaatgtctttttgaccagtatcttgtgccgacctcctatctcatcctgtaacttagaatgccttaaccatccaggaatgcagcccagtaggtctcagccttattttaaccagctcctgttcaacatggagttactctggttcacatgcctctgacaccttgaccttcccatttcactctatcctgttctcattttctacatcaccccactttaaatccccagacctcttaatcataacttccttaaaattactgtaaactcttgcttatttatcactctgtcctcttcagacaaaatttaactcttgttaaagcaactctctggtaatcttcaacctggacccgcatattttaactgtttgtataaaacctcataactatgctaattggttatgcgataattaacctccagcgggcccttaatgcttgtcagctagcctaccatatttccgtaatcctttaacttttccactccttttttctagatcagtgcctctcaaacttgaatctgcatataaatcacctgaggatcttatattaaaaacacagattctgattcaataggtctcttgtgggagcagtaattctggagttttaacgagctcccaggtgatgagtatgctgctgatttggggaccccaccctgagtggccttcctttttattacattaacttgatgaccttgttcatatttcactgagaatcaggtagagcttccatatgcttttcttctctaaatctaccaatgtacttgcatctgtagtcacatgcccctaatttccctcctccaggaatagaattttatgcttctgtttttaaggccaaatctaccatttcttcactggcttcaactcatcttctactcagagccactgcttcagtaattcgcttctttcattcatgtgtacacaatttttcattacacatacagactcattctcaaatacataataaaccagtactttatttgaaaaaaaaatctttcttaatctcacagcctcattatttgcctgcattcctctggtctcccctttagagaaaaattccttgaaagagttgtctatatattatttttctacctcttatccctctcttttctttgaaatctactgaactatgttttataaatttactaaggacagccacattgccaaattcaatgaccaagttttattacttattttattggtctatcagtagtgcttgatatattgatttttccctccttcttcagtatttttacttgactctagggccaattctctctcaccatttcttcttggtcttcctttcttgtttcttattatctctgcaacctctacatcaatgatttttaccacttttttggctacacactagaattaactgaggacttttggaaacagatacctgaggtttacctccaaagaatcataaataattggtttggcatggaacctgggcaaaggtagcttttcaatatccccaggtgtttctaacatgagtccaggtttgacagctactgcccagcctcaattggacctcttcatcatttagatttactcctaggtgatgccactttgaaaaaggaaacacatttcttatcaagtgtgcgagacagtcagatatcaggagtactgacttaccaaataaagaacacagggcatatctgaagggtggaaaatctaaaaatcgatcgaagttactaaattttcattagtctattcacagtgggaagacaactttctgaaatgattattatattcataaaggccatgacatatatttagatatcaatatatcataactcagggattacttctttgtgttacaaattccagatttgtaaacaatatccaaggttttattatttcgagtaccagaaccagttaaagaaatcctattagttttgtttcagtctcagaatgtacagtttttgttttgttttgtttgcttgttttcaaactatggtgtatgaagtgctcaattatagtggaaacagggggaagtgtcagttttggtttcctgaagtatggctttaaatattatctatgtgtaaaattcccagtctgtacctttaacatagacaatgtctctaaattcctgatttgcatgtcctattacctgctcagcatctactactgattatctgtcatttcaaattcaatgtgttcaaaactgatatgtgcccccaccctatttttctaaggttgtcactaggtcaataaacacatctctattttaccatgtgcttaggctaaaaatgtgagggttgtctttagcttctctccttttctcataatctacatctaatccaccggaaaatttttttcactcaatctttcaaaaatgagaaaaatctcacatgctttatctcctccactgtcagcacctcactcaatgctgcattgtgtctcttctgaattaatcattcatttgcttcctagtgtttctctttatttctgttactgcttcctacgaagtattagacagtattttcaatagaatactttaattcttttaacacgtaagccagatcacatctttcttctgctcatgttgcttaaataacttcctatatcagagccatccttatggttattccctactcatcttctctaccctactttgcccacttcagtggtgtcttcttcccgttcctcaaacactctgagcacactgctgcctgtaagcctttgtactttcatacttactcttctctccaacttgaatacacaagatatacacaagcttgacttctcaattccttcaaatctttgttcaaatgtcatcttctatgaaaagtcccttttgagaactatatttcaaatcacagcatttcctccatccctcttctctttatccttcttttttactttgcttaatactgtgcatcgccatttgataggccatgttaaaacttgtttattttgtttcctcctctcataccccacactgaaatgtaagctccattgaaagcagggacgtttctttttgatggcagaatagtacctaaattagtacctggcacacaatatggtcttagtaaatgtttattaaatgaatgggtaccttagcctatggagagaacatgagcaccaatctcagttgctatgggccccatattaattcaaaagaaggctgcaagagactttctacttgttttgatttgttttgtattactaaattaaacagccatatgcaaggaaatatgagcagtccttacatcagggcctccctgatcccccgattcaaatcatagcgttaatactacaggcaacttatttatcttttgtaaattacacaaacatgcaaatccccttcttcatgcccagttcccagcacatacacacactcatagaaacacagcgacctcaatatttttggcagagacccacactgaattttcagatgtagaagagaataatgcagagaggaacgaacaccaatttctgggctttctttccctttagagttcttttcatttactaacctccaatatgctaattctgagaggcatcatattttatccccttcgacatagtccaaaaatcttttcccttaatacacattgtaaaatgctcctatagcacacgaggtttaaaaaatactgtagtgcaccctggctggttctcttcagtattttctaggactcccattttggaggtatgttgctgctgtgttgtgctctgcttgaattaaattgtaaaacacccctgctggatgggaatgtttgtctggccatacagctgaagagaatgtaattcttacattaaaacagtggaggcaaaaccatggagaaacattcaggtttatgttgaggccaagcatttgaatggtctcccagatttaaacttgtcttcacagatgtggtagcagcactgacaccatcatacatgccagggtcgtgtggtgactcaaagaaaaattgtccctcttggcaaaatgctcttcccagggagaatggcagcagctggctccactgatggtggagtttccaactatgaagccaagggtcaacctgggcagcactgattctagctcatttagtgctctggggcctggggttgagaaaaaggggcaaaggtgaaccactttcttcccaataggatgattcattttagtggctaacagcctgctccactttcctaaggtgagaaaaagcaagcacattgacattcctgcccacaataccttctgttatgtccatgtggttagctggcatcaagttgcctcctagaggaaataaaaaactaaagtgcttgttctgctaaagtttactgttttcttttctactttatttagctttttaggcattttatttcacccttatttctcatgcatatagatgtattaatttatttgagagagatttcagggtcattaaaattcatcttttgaaggtcacaaacctgcactgttgaatccatagttatgaaggagtctgcctttaacctttctaatacatagaccataaactctataatggcatatcgtatggagaaaatgctttattcagttatatctttgaaaagtaataatcactgctagcactgttggtagtccatcaatagagatagttttctaagagtgactaattctacctagtaatttaaataaggcttatgttcagaatgactgataaagattaagtaaatgctatgtaatattttgtacaatactgatgttttgttctaatcacacagtttaagtgtgcatttgccaaaggggaagaaagcacattaccatttttggatatggatctatctaaatttttataagcattttaatgcagacataaatatatatgtataccaaaagcaaatgcaactgaatatcattctggctgccaaaaaagctgtaggcaagtactattgaaattaaaaattagactttaacctctaatgtatttttaaacataattaaaacataagaaaccagctgggcttattataggtccagaaccttctgagttaaacagcatgtgttaaacaaaagaattcaatcatgcagattttttttatttttctgtaaccttattcagtaatatttaatttccaacaaatacagattgccagctgttaacatccttttactgcaagataagggtaagaaatttaatgctggttgttttgtgtttacgactgttgaccaaaaattgcacactggttacagtgagtatttgttagcatttttcttctatttgaaaatttattccaaatatgataaactgcctaattccctgtgaaacagcattagttgttattttgagaagctacttagtttgctcaaacattctctagaatctccataagcaactaagtaaaactagaattgggacaccaagaaaggatgtacaactcttcaaacgtacgatcttatcccattctggtcaaatctaaaacaggaaattttgagacataaaggggaaccaattttttgaaataatgataagagtctggtatgctttaaacaatttagataaataaagaagtaacgctatctagagaagaagagtgggaatgttcccaacgtaaagaaaaggtaaaggtttgaggtgatggatatcccaattacttctgattttataattacacattgcatgcatgtatcaaaatatcacatgtgccccaaaaatatgtacagctattatgtttcaattttaaaaagatacaaaaaaatgttagagtaatgctatcattagttaatttgagacagcagtttaaaacaagaacagacttggggcagaagaaaatgaatcaaccttaaactaagtcaaagctacttcaatagaactttgttatattttgtatagaatttcctaatgaacactgttaattgcaatctcatatattactagactaaccattctaattaaaataaacaattgaacagataggatcaagtgctcacttctctgaatggactttaagaaaaagaaagtgatataaagtatagaagatataacttctgatgtgtcctttaggagtagaaagttggaacaatggagaactgagtttaatctgaagaaggaggtagaatattgttaggtggtgaaggtactagtaagttcttagttgcataatccatttttttctgatgtaagatcaaaacaacctaagtttcgtgtatattaatgagaaaatgtaacagtataatgtaaaaaacagcatggtagtctaaggaagtggattataatatataccagaattagaaatacagcaaagcatttagggagaacagcattcattcagaactactagaaatgttgtagaatgatagatgtgtagagcaatgcaaccttacatgattgtagaagctgctaaaacaatcttggtttggctatttcttcatctggtgcgaagtgtgaagtcactggattggcagtcagagggaaagtggggaagagcagtgacaaccagggcacccaaggaacaacctggaacttgctgtttatctctcattggaatgaatccatgatgttctctgactatccccttgcccttctcacacaataatttggaggttataaatggaagaaatttcaagaggactggcctttggaatcatttgttgcccaaatcaacaagatgatctagcagctctgcaaagacatgcacaatctaattcaacctcccaagaataaatatggccattgcttcctttctgccttccaaatctcacacacacttgtcttgtgaccagtcttaaccagaaacattcttggaaatgtagttcagcttcgccagtttgacaaaccacagtgtcatagaaatctcaacaggagatttttggctgcataagtgtcttcttttgagaagtgtctggtcatatccttcgcccacttgttgatggggttttttttttttctgtaaatttgtttgagttctttgtagattctggatattagccctcacaccagttagaatggcgatcattaaaaagtcagggaacaacagatgctggagaggatgtggagaaataggaatacttctacactgttggtgggactgtcaactagttcaaccattgtggaagtcagtgtggcgattcctcagggatctagaaccagaaataccatttgacccagccatcccattactgggtatatacccaaaggattataaatcatgctgctataaagacacatgcacacatatgtttattgcggcactattcacaacagcaaagacttgaaccaacccaaatgtccaacaatgatagactggattaagaaaatgtggcacatatacaccgtggaatcctatgcagccataaaaaatgatgagttcatgtcctttgtagggacatggatgaagctggaaaccatcattctcagcaaactgtcacaaggacaaaaaatcaaacaccgcatgttctcactcataggtgggaattgaacaatgagaacacatggacacaggaaggagaacatcacacaccagggcctgttgtggggtgggggaaggggggagggatagcattaggagatatacctaatgtaaatgatgagttaatgggtacagcacaccaacatggcacatgtatacatatgtaacaaacctgcacgttgtgcacatgtaccctaaaacttaaagtataattaaaaaaaaaactcaacaggagttacagtaccgtaaacaaacttccactttaaaagttcttatgccctatatggattattttcttacagaatcaaaatgtattataagttacagatcatgattctgggctcaaatagccctagggtcactagtagatttaatataaatgaatttaaaggttttatttactctgaggtgtttagaatcaccagttgagaaggttcagcattatgggctgcattctctactgaaaagtcccttgttttctgttacttttctcaaagaatcaaaattcaaataaacgactttgcttctattttttatcagaaaattttaataagcagagaacctcatttgttagatgacaaatatattatctttagccttttgcttttcttttggccactagcttctcttgttgttttcccattggcatcttattttttatttccttccacaaagaaaagaaaaataagaaaagaataagaaaaagctacagggcctttctaccatatagtcttcattgatctggtctaactgtatcatagttttctctcataagcacccaaatttatctccattcctaaagagatcaacaaattttagcaaatgcattctcatcccttcctaattgtacagtaagctcttcattgcaagtctgctattttagaaaactccagtttagattgcttcactgattgaacttgcttctttaacctatataagacttctaaacaaattaaatgaagacagattttcctcagagggaatcagtgtcaggagagagagtgattttcactttccttccctcctcttaggagccagcacttggggctataaaccaggaatgttcatctgggcagcatgcgtccaagatagcaggtctgtggcaaatgggcaggatgagctgatccactactcgattagggccaaatggctttctaccaagacactattatgtatgagccaagatcctctccaaggtcacttcatgctattgacacacttggaaaaggaatttggaatacttaaattcattcaatcacattgcctcattaaaaagacaaggaagctaaggtgaattcacatcaaagttgctaactaaacttaactcatagtgaggtatgaaaatcccacttttttctctgataagaaattagtcctaaagagctctgcttttaatataagtgaaaaatagtatagagatcctaaacaaattttagggactaaactaattttagtcaagggactaatgtatagccctctgcctcaagaaatttgtggtaatactatcctataagacacacaaacgtatgtgcattctgcagaagctgcattaagttaaaggggcaagaaatgtttcacagactttttgttttgaatgagtagaaatgtctatgccagtatacaattcagaaattaattttccttcagtgctaataattgattccaataaaataagatagttacatggtaactttaaaaaacagaaagaattagagagcaactttataaaaatatattcctggtgatgattgatttttatatcattttgtgtgcattacaaaggaagccatttttctagaatcttttgtatttttcttacaacttccattgaacatttttcttattctcagtattttcttttttatacatctttctatttctctcttatatgtaccaatatatctttatttcattttagagctctgtagatgaattttaactcttagaatacattttttttttctttttcctttttcttccagtacagaaggtattctctatcttagtacacttcaaggtctactattatgtgactttcctttccctcctgtttcctattcccaacataaaagacagccattctggcacagatataaaattagttttgctcaatggatttcttgtcatgcatgtgcacaaagcttcatttaccttcaatttaggcttttgttttcctctggtgactcattttgctgcatctgtgtttgttctataacctgtggataaggcatgtttctctggcagggagctggctgagcacttgctgtaggctgccatgtgttagcaatttttgaatgcagttcaggggtaccccatcctctgcatcagatattactgctctttacataattcctatgtggttgtcagcttagatcttgtttgtttatctcagggatttgttgtcatttttattgttgttaattcatttagtataccacagatgcttttgttatattcccagtggtaaatagatacaagttttactgattgtggtaaaacagatcagatatttagttatggttaccagtttgccccttttccaatgctaaatgcggccataaagctttattctctcttttttttttttttttttttttctgatcttttgtaaaatttactctgtacatttcggtctttcttacataaaggtggaaacccattccagccacaagcttttcataaacagttcacagcctactgttttcaaatggattgctacttaaatgtctttgagatatttttccttctgaataactgcattacatcacctattttagaaattagtgttgtttaaatacttcttaagacatgagtcttagtttcagagtttatgtgattaaggtgtagggttagtagccagagaggaaagcagcttatgcaataagaattggcacagaaaaaatttattgagcaattttggagcttgcttaaatcttgtgtttttgatatttggggaagcaaagaaatttcaaaataattagatttaatttttgtatttaagcatagatggttaccaaacaagacttttcacatacttaaagagagaattgctaaccagtcatggggattgtttaataactccctttcttggcaaggctatttgattctgagagaaaatgactaatcacaaagtactcattccttggaaatacctcaaaacaactatagggaagtagaattgcttcaactgtgaaactggggaattgcttttgtctcactgtgacctctgttccaatttcaaagcttgttcatcccgtcacacgaacaataattttttaaaatcccagtgtcaaaaccatggctcttccttgtgtattaagtgatgttaattgctacactgaataaacccaaaaaagtccacaatgacttaaaaattgtatcactttcctagggatgctgagacaaagtgccacaaactgggtggcttaaaacaacacaaatttattctttcactgttctagatgctagaagtttcaaatcaagatactgatagggtcatgcttcctccaaagctgctagagaggagaatcctttcttgcctctttcagcttcgggtagccaggtattccttggtttgtggaagtgttactccagtctctggttccatatttatggctgtcttcccactgtgtctgtcttcatgtctttacatgatgttctctttgtgtgtctatgtctgtacccaaatttcccacttcttataaggacatcaatcatattggattaatggcctaccatactccaatataacctcatcttaactaatcacatttctaacagccctatatccaaatagatcacattctgatctattggggattatgatttcaacaggtcattttggggggaaacaatttaacccaaaacaaacactaagaagtttacttcttgctaaggtaaactgctgtataggtaaaacaggttgacagggttattctccatacactcaatcaagaacagactaacagaagctctgacatcatcaaaacatggtttccaatgttaccttggaatgtatagccatatcagacttccagaagggataaagaacatagagggcaggccgggcgcagtggctcacgcctgtaatcccagcactttgggaggccgaggtgggtggatcacctgagatctggagttcgagaccagcctgaccaacatggtgaaaacctgcctctactaaaaattcaaaattagctgggcatggttgcgtgtgcctgtgatcccagctactcgggaggctgaggcaggataatcgcttgaacacgggaggtggaggttgcggtgagctgagatcacgccattgcactccagcctgggcaacaagagcgaaactccgtctcaacaaaacaaacaaacaaaagaacatagagggcaaagagtgaaagatttttacaggacaaatgtggaaatagcacctgaaactcctgttcacaatgaattagctggaaagataaggaagcctgggaaatgtggtttagctgtgtgtccttgatgaaaagaagaatatgggtctttttttgagcagaaaggaatctctcattcttctgtacaattgcattctagggcattttatgagagaaaatgaacattatcctatatgattggggtaactatacttcctggattccctaggactaccttgatttacgcttattgtctctgaacaattattaatagcacttccactttttctataaactgacctgatttgatgatttggttaataatttatatgttcatcatatcagatgagaagccaaggaggagaattctccattttgtaaaagaatatatcaaatgtgcctattgaaaacaagaaatcaacctgctgggctcctcaaggaaaaacattttgtttagtatgtttccaattccactaaaatgagatttggcaagattttggaccatatgtctttagcattctctaaactggaatgactaaaaaggtgtttaaaaattttaacaaagtacaaatatacacctgtctagaaaatgtgtcctttaaaatgaatttctaagtcatctgaaaaatagtagtggcccctatattactttcttatctatactcaaaataaatatatcttggtgctttgttaataaaagttattattatcattttgttttgtttttgagacagggtcttgctctgttgcccaggatggagtgtagtggtgctcttatagctcactgcagccttgccttcccagactcaagccaccctctcacctcagcctcctaagtagctgggaccacaggtgtgtatgcacaccaccatgcctggctatttttttcaaaatttattttttaattaattaattattattatttcttttttggtagagatggagtctccctgggcataggctggtcttaaactcctggctcaagtgatcctcccaccttggcctcccaaagtgctaggtttacagggatgagccactgtaccaagcctaataaagtttttgataggtcatcgttttattgaatattaaggcagaaaaagacttcctaagagaaatctggtatcaagcccctaaattattgcaattctgcttacatgaattgagtctggcattactttgtaaaagcatatattgaagtgttcttaagattgtctgtccttctttgggctgctataacaaaataccatagaatggacagaatataaacaacagaaatgtatttctcacacttttggaggctgtgaggtgccagatcaagtttcagtgcctggcggaagtccaacttcctttttcttgtaacctcatatggtggggagtagggttgggattatttcccttgggtctctttcataaagacaaatcccttgggtctctttcataaagacactaattccattaatgaaggctttgccctcatgatttaatcacgtactgaaggtcccaccacctaataagatcacattaagaattttaattttaaactatgaattttatgatacacaagcattcagaccatagcttcatccttggaatttcttcaatccttctgagattcctcatcatcatgaaatgttctatatactatatttaagaaacaaagtagcccccttcattttaaaaataaatccaagtataaaaagaccttgaaagaactcatttatcttttgctacacctttatagagtactttcatagctctgtcaccaatcccttggtaaaaaagaagtcgaaacctctggaatttgagcttaaattctcctgtagatgattcaggaaagcatgctacaaaccttataatagataataagatttaagttagttttcataacacagctgcataataaaatatatatatatatatatgtatgcacttgcttttatataaataattcacataagaattcaagcatatgtgtcaaaggcgtgattgggaatatgtttcccattaagcattttgctggggtcaatgaattcagggacttcatgggaaggttcacagtcattgtgcatccttgccaatatctctcagttgacaataaaacacaactgaaaggctttggtttattcactggctgcaaacagaaattttctgaatgtcctctggagtcttatacaagtctcctctggtattatgctggaaaaaaaaatctgactccatttattttactattgcttgaaaatctgaaataatttttccttgacagctatccaagaaaatagggacagtattttgcacaataacagtaatgccaccagtggtttcaaatgtagtagactcaaaaatccctctcttattacaattatagatacatcatccagttagtatcctataaatttggatcataaaaatatgctcaatacacatgccaaaatactttctttagaaggtatttagacaagttcttgattacaaacaagaaaaaagaagaaaaggaaggaaggaagaataaaagcaagcaaggaaggaaagagaaaaaaatcaaataattgaaggggaagggaaaaagaaattaaataattggtgataacactaggttttatgcttttggtcttagcactgtgaaaaaaaggtagaatattgaaccagaaaacaccgaatttatatctacaatttcattgacatgtattccatatctactgtaatagcaattaacatatttttcactgatataattttcaagagattttgactcattaagatgggtaattagcactcgatattaataagtatatttgtaatccaggtataagtaattgcaacagtcagttaacttaataatcactccattctgcacaagtctccagattttctgagcacataactttggaagagcactttagaaaataaatttctcatttctagtagcctaagtgactctcacagaggtgcaatttttaaagagtgtacatagaatcaattaagacgtgcagaattagtaaggtgtatgattttagttctaacgatgcatgaaaataattttgggcatttgtttgataaatgtttcacaaatggatttaaatgccttatatactttttaaaaacacattattaagcaaagactaaaaaaaggttttcacaaacttttaaagaggaaagtgtcaccttccaaaccttatttttagatactctgagtatgagtcactgctgaattttgcatccaaaacctcatgagcaaaattggctataaatttcatcttatttttcttatcttttctctttcagaaatatttttgaatggttcccaagttattcttgtctaaatccaccattctcctgtacatattctgcctcacaaaataaattataaatatggttgacaaataatggcatctatttttaactcagccctaatcaatactgaaattgtgttaccatcactgaatgggcacctgcttactagtattgtggtgtcagtggcattgcttatatttattaagcaccactactgtccaggaactctgctgggggcacagaggcagggtggaaaaatcctaggatatagactagtcagatagacttggattctgaagttagcttcttcatttactagctgtgagcatgttaagtcactggggttttcttgagattttttgaaacttagtttccttatctttaacatattttaaattctacacagataggagagtctgaagataaataaaatgtactacttaaagtgttttccatgaagtaaatattcaaatattagttctagctcattcctgctttctactttttctcgattttatcagtttctttctttttcgtgattatattgcagaggtttatagattttctcactttctacttatatactttttatgaactcaagaaaagccagagaatgttcattctatctcaaggactttgctcttaaagagatttctacatttcctcctgaattgtcactactgtggttctgtggtctacattgaatgtttgtttgttttaattttgcactttccacactccatgtgtttctttgcagcatgaagttttcctctattccactttttttctatgctccacatttatgctgaataaagtacctttttggaattcatcttctacttatcaaagtgttttaggccatataatctaaggaaaatcccatggcttcctagtcaatggaattgactagcactgctttcttgttctagtgattcccctgactacatagaaaaactatgtttggctttttcctattcccttctgtgggatgcgagttgtagctaatttttagaacatgttttccccaatggaacaatacagtaaacatttttaagggttgtaaaatgtgccttaacatttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacgaggtttcaccgttttagccgggatggtctcgatctcctgacctcgtgatccgcccgcctcggcctcccaaagtgctgggattacaggcgtgagccaccgcgcccggccgtgccttaacatttttaatggctatgtatatatgatgagtaataattaagaccatcttgatctataaaactttctattatttgctattacaaacatcactaaatgtctgttaagcttatgctaaatgtttgcacatatttaagaatgttagttgtcaattgagaaagttctcctttattaaggatatttatcttatttaatatattttcaaatttttttccagattgtcttttgtctccttggttgattttgtctttgctgtttttgtgatttgttttatttcatgtactcctgtggcaaatgctttttattcctgtctgtcaatattttctgtaatattcaattttggaataccattaatatccttcttaattaggattatttaaatttttatcacatatagagttctagtaatatcatagtttaatttttaaaaattatttaaatattaagtctacccaaattaatttcattgtatagtattaagtggaatcctaagtctccatgtattaagaaaagcatttactattttaaattatcacactgatttcaaatgtagctttgagcaagtgtgcatgtatgtgtgtatatatgtgtttgtgttcacataaatatatttctcctttcaaattgctatgttctatttatctattttttatgctaattctatatcacttaattattatactttttaaataattgttatatataaacacactttacctcattagtattcattttcaactttgtcttcactatattcctgtgtttttatttagctattatatttgagaaaattgatattttcacagtagttatactgtatctttccatttcctcaagttctcagtattcttatgtttttcttcatttagttttaagttaatttaattttttcctatggcgacttttaaaatttccttcttagtacttattgttattatatggaaaactatgaattgtgaacacatgcagttattttacatctatcaggagtctgaatccacagtcaaatttgtaatagctatgacaaatgtattatactgcctttcttcacccttgcataacattgcagaccagcttcctctaaacagggaaaacctgacccaaaacaacatctatgttttcgctacagtttcaactcaaatataaaagcaaaaaaacaaaactttaaacctaaacacattttgattttgagcaaattatctgatctttccatgcttcagatgcttcatctggaaaagaacttaaggaaagtactgaattcttagtttattttgttgcgaagattaaaagggtcgtaaagcaaagcacatacatttaaatgtcaatcattgttaattttgacattgatattattattaatattgttaagaaagtcagaggtcatttttattttctgtttaattgtccatttgaattcattaaaacttttaatttcaggagacagaaacctaactctcataacctccacttgaaaaagccatggggaatgagatcaatagctttagtaagatgctcatcaattatgtacagaggacaatgatcataaaacaagttggtagcttttattggaacaatattttattcatttttaaaattatataaaaatataaatatatacttaattgtatataaatataaaattatgtattatataaataacttatttcagatatttatcttttacaactttctacttgtcttctggtatgcaatgtgctttttttctaatctgctgaattgaattcttaattcacttattttaattatttttgagattaaagatatttaaaactaaaatttgaattttttgaatacggctattatggcaactcatatgtttagatatgaagagttctctataccattatcaccataataagctgaaattgtagtcataattttcagtttgaaggaagaaatgtttaggagcctaactttttaaaatttttagtcatttaaaaagtaataagctgttatttccaaattttgttgaattcctatcataaattttgtctacaacatcaatctctggaaatatattggggtattgtggcatgccaaattattacccaatgttccatctgtaaacatatatttagcatttttaaaatacattttttaaattaaaaattttaaaatatcaaatttgttcagaattctagttattctgtagctttctgggaattatttgaatttgagccttgcaagcttatgacaagtcaaataaacttccttatctttgtgccatccctctttgaaggaaagttcttttgatatgataatatctgctttaaatggccactcaccagcctacacagaaaatagtcattacaaactgcattacctccacatcatgacaacgaaaactctaaactccttataattgtgtaaaagataataaatagctataagttttctgtctcaagaattgtcagtcttcatgttaatctctacatgtgtttttcctaacactctgaaatccatattatatagtcaacattttacaagtgggataaatactcttataagtattgtgtcataatatgtgctaattccatatgattaatcaggttgcttatattcatcctcagtctagcaatacaatttgtgactcagaaacaaaacaacaacaaaaaaagtagctgctaattatataaaattgaaactagaaaatgttagataaactcaaaacatgttgttgatatcctgggctaagcaattttagtattaattatttaccttaagttattattactataaaacatataaatctaaaataataaaatcagtggtgaacaattcagccttctgctttattttaacaagtcatcaatcacatttcttctttcttaaaaatgatagttttcctattggtgtttgtggataattactataaatgacttaatattacatgatttaatagtttcatgatttatgatttaatattttgagtagttaggaagttacagatagtagttaaccaactaatataccatcaaagggctttaagtagacattggcattctaaagctgactgtccagatataaatgcttgtctagcttactgtctctattctactacatgtattttttggtttatgtatttactttcttcccttcctctcatttttctttttctgtcatcagttctttctccttcattcttccctatggagtcaaactttgatgtatttactgaggaaattgttatatttttcattatttttaaaaataggtgagtggaaagaagttgatattttcttctataaagaggacccaaaaaagagttatcattagatgtcattttctgtaaatcattgattctctacaatctctattaaggagaaagtaattaatattcactttgctataccacccctttttgcatttaagtccattttgatggaaattctttcaaactcagctaaattttagcaaagtatttttgtgctctccaaaattcttacagttgtttttcctgtgctatatagttaagaatcatatttttctcattgtattcatcaaattattctcccttttgtgcagatactttccagctagacttaggtaacagttgacaagaagcacagcctataaaatccttttatacaaggcttgagttgctgttacaattgcttctttgtttcaagacctccatgattccaggtttgctcctcccctttttctgtatcattaaacattacctttccttgtaaaaattgtttacagttaccctcaggaggtactctaataatttttaatactaaaggttactgtcgggagaaattgtttcataggtaacaaaatatacgctgagctcccattgttatgtgaaaaatattcctttttattgtcctcatattttttcctcaaatgcactacaaatttcctttatatcatatcattatagagcagcttctttgatgcagttgacagaatgaaataaaaatcttttatatctacagatagtttttgcctaaattcaactaaagtagtatttctttattaaataatgcttaagatattttaattaaaatattttaatataatatgcttctatgttttgtgtaattgcaactgtatcactcatttcaggaatcatagtaaaatattaaaattatagaactatagttccttaatatagaatacagtatattaaaactcttttttaatatacttcttaaagtatgcctttattgtaatgccattcatgcatctagaaattttgctttttagaaatgattttatattcattaccaaagcttaatctagacacactgggaaacctatgtaaatgtgatttaagtttaataattgattggataactttattaggtatatccctaaggatcaagggcaagatgtataaggtaatttttaaaaacttaattattattcctattttttccaattgaatttttttgtatcaggtagtgtgtcaaattttccagtagtatatgctgtataaatatctaacataaagctgtcagtcttgttttttgcttctatgatagactctattatctgtgagacattctcatgggctactataaagataaggtaaatttcggattgagtgtaatttctcttcactatctgtaactttttctcataactgagttacaattcaccataatatgtggttatgcatatgcagttgagttgtcctaggatatctcataaattcttctagagtatcctaagtactcagttacgtattctaaagttcctttcagaactgagtctcttcactacaaccaactgaacaggtatattggaaactacttgaaaatcctcctacaaaattggacaaattggatctatttgtggttttgcttgctgatgtacaaattgacagtggcagatgcctagggattcattgaggtgggagtgtaccacggcagaaatagattgctcatttgcttgatggatagacatagaaaagcaagcagtgtacaaagatttccctaaaggtgactgttgtttatggctgtgggtgtgaatggaggaatcactttgtctggcttagtgacttggctgctgaattggaagcaataactgctatgctgggcagaagatttagagatgccgtgtaccctctgcttctgctcttttaaccaagaaagaatccattgaacccagaacaaaatacaaatttacatttctgtagtgacaatatggcataaattaggtcacctgagaaatggaaagttttctattaaatgtgtaataataaatatcttcgtgccataatgatagtttcctatccttctattaagtttggcttcaccttgaaggctttcaaggcatttctccatgaaagttctgccacaaatctatgagtattataaatagctaatcttaaggaatcaatgtttctcataagggctacttaatggcttagaaatcatagtagtggtatcacttgactcagatatgattgcttacaagatatagactccatttggattcaactggactaattttaatatagatctgttctaccagttcctagttactcaggaaatgtagtaatgtgtgctttatactgcatacaaggagctatcaatccatctgtcttttaaaaatttggaacattagaaaaataaattctatctcatcttctcataaaattctagccaactcttgatttagcagttttagatctcttgagatgaaaagattttcaagacttcattaaatgtacaaaataattgataaaattttactatttcaaatgttatttttccaaaagtatttcaaattttgttgttattacataccattccctttttccactgatgattcggttaattaatttctactaccaccctctaaaaatgaataattgcttgatagatgccctgaagcaatttgtgcacgccttttaataccatatattttattgaatacatggtccctggattttctattattcaaattatgtacatacataccttttaggcactaaagtgctgataatttataggtataattttaagttagattttatatatgacaactctatatgtgaaagtgggaaatgcattgagttacaaaatttacagttaacttgttccagtcaggctagtaatggaagtaaggaatatttcatttatatatatcaaaaatgagataattatatgttttatattttattaaataatagactaataaaatagtatcctataaaaagagataaaacactattcttttcttgaaaaatgtgttttgtgaaggtttcagataagctcttctttgcatagctatagatgttaataaaaatgtttttagtataagaaaactaatgcctttttctttagggtttatatatatattatgatatatgtatacatgagatatgcatatattcttgtgtatgtgtttccaaataacgagaaaattagccaggtgcatacctattgtctaaacattttactattgaattaaaaatcctattgttaaactatgagaatacatgttttcactttgtgttttactgcaaactattctatagaacttcaaattatgaaactataatccagtgcaagaaaccaacgtcatctgtattgacagaattacatcaagtgtagaattcaacttaaattaaggtgaactgtaaactgttgagtggtgaggaaggtgcctgtgatatcactgtattcctcaaaatgtggttatacacaataagcacgtaatacatatttttatgaacatattgaattttggatgatattatgcatcttttcttctgcaataacccatgtgatagtaaatctaaagggaaaggttaaaacaattcaccaaatatgccatgaaaataaactatgtttgaataagacacttcaagtagcatgtaagccattggtataaatatctaatacagtttggctctgtgttcccacccacatctcagctggaattataatccccatgtgtcagaggaggggcatggtgggagacttatttataatatctatataatatttaatatatatttatattttatttgatttatttaaatttaatttatttaatgttatatatctcatatacatatttataattatgggaatggatttttcccttgtttttcttgtgatggtgagtaagttctcatgagagctgatggttttaaagtgtggcagctcccctctcactctctttcccctgcccccatgtaagatgtgctttgcttcccctttgccttctgccgtgattgtaagtttcctgaagcctctccagccatatggaactgtaagtcaattaaacctctttcccttactaattacccagtctaaggtagtcttttatagcagtgtgaaaatagactaatagagaaaattggtactggaatttgggggcactgctatgaagacacctgaaaatgaggaagtgactttgaaactgggtaacaggcagaggctggaacagtttggagggctcacaagaagacagaaagatgtgagaaagtttggaacttcctagagacttgttgaatgattttgaccaaaatgctcatagtgatatagacaatgaggtccaggctggggtggtctcagatggagatgaggaacttattgggaactagagcaaaggtcactcttgctatgctttagcaaagagactggcagcattgttcccctgccctagagatctgtggaactttgaacttgagagagttgatttagggtatctggcagaagaagcttctaagccgcaaaacattcaagatgcgacctggctttttcctaaagcatacagtcatatgctttcataagcatgccaactcaaaaagagatggtctgaaattggaatgtatgtttaaaagggaagcagagcataaaagtttataaaaatttacagcttgaccatgtggaagaaaagaaaaactgattttcttccttttaaaaatttaatttaattttaaattctgggatacatgagtaggacatgcaggtttgttatataggtaaatgtgtgccatggtggtttgctgcacctatcaatgcatcacctaggtattaagcctcatgtgcattagctaattttcctgatgctctccctccctccaccccccaacaggccccagtgtgtgttgtttccctccttgtgtccatgtgttctcattgttcagctcccaattataagtgagaacatgtagtgtttggctttctcttcctgtgttagtttgcttaggatatggcttccagctccatctctgttgctgcaaaggacatgatctcattccagttttttggctgcatagtattccatggtttttacgtaccacattttctttatccagtttatcactgatgggcatttgggttgattccacgtctttgctattgtgaattgtgctgcaatgaacatatgcatgcatgtgtttttatactagaatggtttatataccattgggtatatgcccagtaatgggattggtgggtcaaatggtatttctggttctaggtcttcgaggaatcaccacactgtcttccatagtgtttgaactaatttacattcccaccaacagtgtaaaagcattcctatttctccatagcctcaccagcatctgttgtttcttgactttttaataatcaccattctgactggtgtgagatggtatctcattgtggttttgattggcaattctttaatgatcagtgatgttgagcttttattcatgttttttggccacataaaggttttcttttgacaagcttctcttcatatcgtttacccagtttttaatggggttgtttgtatttttcttgtaagtttgtttaggttccttgtagattctggatattagacctttttcagatggatagattgcaaaaattttctcccattctgtaggttgtctgttcactctgatgatagtttcttttgctgtgcagaaactcttcagtttgattagataccatttgtcagtttttgcttttgttgcaattgcttttgatgtttttgtcataaaaatctttacctgtgcctaagtcctggagagtattgcctagattttcttctagaatttttatagtttggggtttcacatttaagtctttaatccatcttgagttaatttttgtataggtgtaagaaaggggtccagtttcaattttctcatatggctagccagttttctcagcaccatttactatatagagaatcctttccccattgcttgtttttgtcaggtttgttgatgatcagatggtcatagacgtgtggtcttgtggtcttatatctgagttctctattctgttccattcgtctgtgtgtgtgtgtttatgccagtactatgctgttttggttactgtagcctttaagtatagtttgaagtcaagtatcacgatgccaccatcattgttctttttgcttaggattatcttggctatatgggctcttttttggttccatagcaattttaaagtagttttttctaattctgtgaagaatgttaaggtagtttaatgagaatacattggatctataaattactttggacagcatggctattttcgtgatatttattcttcctatccatgagtgtggaatggtttttcatttgtttgtgtcctctcttatttccttgagcagtggtttgtagttcttgaagaggtccttcacttcccttgttcactgtattcctaggtattgtattctctctgtagcaattgtgaatgtgaattcattcttactttgtctctctgcttgtctgttgctggtgtataggtatgcttgtggtttttgcacattgattttgtatcctgtgacactgctgaagttgcttatcagcttaaggaccttatgggctcagatgatggggttttgtagatataggatcatgtcatctgtaaacagagacggtttgacttcctgtcttcctatttaaatatgctttacttatttctcttgcctaattgccctggccagaacttccaatattatgttgaataggagtggtgagagagggcatccttgtcttgtgctggctttcaaggggaatgcttccagcttttgcccatttagtatgatattggttgcgggtgtgtaataaatggctgattattttgaggtatgttctatcaatacctagtttattgagagtttttaatatgaagggatgttgaattttatcgaaggcattttccacatctcttgagataattatgtgctctttgtctttagatctgcttatgtgatcaattacatttattgatttgcatatgttgaaccagctttgcatcccagggatgaagtcagcttgttcgtggtgcacaagctttttgatgtgctgctggattcagtttgccagtaatttactgaggagttttacatcactgttcatcagggatattggtctgaagttttctttccctgttgtgtctctgccaggttttggtatcaggatgatgctggtctcataaaatgagttagagattagaacttttcgtccttttcaattgtttgggacagttttagaagaaatggcaccagctcctctttgtacctctggtagaattcagctgtaaattcacctggtcctgagattttttttggttgacagactatttattactgcctcaatttgagaacttgttattggtctattcagagattcaacttcttgctggtttagtcttgggagggtgaatgtgtccaggaatttatccatttcttctaggttttctggtttgtttgcatgaggtgtttataatattctctgatggctgtttatatttctgtggggtcagtggtgacattccctttatcatttttatttttgtatttgattcttctctcttattagtctagctagcggtctatctattttgttatttttttcaaaaaaccagctcctggattcattgttttttgttttatttttgtttttgttttgaaccatgaaaaactgattttctagggagaaaataaagctacctgctgaagaaatttgagtaagagaagctgagtgtaaatagtcaagacaatggggagaatttctccagagcatttcagagatcttcacggcagctcctctcatcatagtcctggaagcctagtaggaaaaaatggtttcttgggccaggtcccactgctctatgcagccttgagacatggtaccctgcatcccaggtgctccagctccagccatcgctaaaagggtcccaggtacagcttgggccattgctttggagggtgtaagccctaagccttggcagcttccatgaggtatttggcctgcaggttgccagaagacaagagttgaactttgggagcctctgcctagatttcagaggatatatggaaatgtctggatgcagaagtctgctgcagaagcagaaccctcatggtgaacctctattagggcaatgcagatgggaaatgtggggttgggaccctcacacagagttcacaactgggcactgcctagtggagctgtgagaagaggaccactgtcccccagattccagaatggtagatccactgacagcttgcactgtgtgcctggaaaagctgcaggtactgaatgtcagcctgtgaaagcagctgagggggctgtaccctgcagagccacatgagtggagctgcctaaggcttcatgagctgaccttttgcatcagcatgccttgaatgtgagacatggagtcaaaggagattatttccagactttaagattttatgcctaccccattgggttttggatttgcatggggactgtggcccctttgttttgataaatttctcccatttagaacggaaacatttccccaatacctgtatccccactgtatcttagaagtaactaacttgttttttattttacaggctcatagattgaagggacttgccttgtctcaggtgagactttggacttggactttcaaattaatgctgaaatgagttaagactttgggggaccgttggaaggaatgattggttttgaaatgtgaaaatgacaggagatttgggaatggccaagagtggaataatatgggttggctctgtgtccccacacaaatctcatctctaattataatccccacgtgtcaggggatggacttggtgggagattactgaatcatgagagtagatttctcccttgctattcttgtgatagtgagtgagctctcatgagagctgatggttttaaaatgtgtcacttaccctctcactctctctctctcctgccactatgtaagatatgccttgcttccccttcacctctgccatgattataagttttctcaaacctttccagccacgcagaactgtgagtcagttaaatctctttcctctataaattacccattctcaggtaattctttatagcagtgtgaaaacagataaatacaatatctcatacaggaaacagaagcagagctttctactgcaatcccttttcccaaagcaggaagtaagtctattcagcctgaggagtcaagtctgtcaattacttagctattgttccaaatgtatattctctacttcttttcatcttgttgaattattgtatagcattaatatgagttgattcattattttaaaaaggagacattctcaaggaattaaaagatcttcccaaatgtgtaaaatttctgatacataactgtaaagcaagtgatgtccacctggattacttttcaaatgcatgtagaaggacagagaataaatcagattgaatcttttcaattaaatcttttagccacagcagaactcaggtctatgagtgatagaaggccaattccaattagtacctaaagcagatttttccaaaatctcttcagcaaccttatttgtaaaggagagtcatttaagggaaataattcaccatattttcaccattaagagaaagaaagaaagtatctagtgtctgggccaaatgttttctttgagagttttggtaacttgccaccccataaggtaggaaaagttgtctttgccaagaaatggtcacagcattatgttacaaaccactcattggaaagaggctagcatcagtgaaggtttggccttagggctaaggcttattctcatcctttatagtaacgtaactcaactgtgcagaaccactttttatttagctctgtatgacattaaacatagatcttagataactttcatctttagacacggtaagaaggggcagtcaaataaacgtttagactgactaatgcgcttgacagactcggagacttcatagtcagcaggggagttactttgccaaaaatcaaatgaatcaaagaacttgccaaggaaccagctagcagggagggggtttgtgggcagccgccatagagcccaagtctgctcctagaaaatctgttcaagagcttggcatctgggtgttagcttgccagctgccaagtgtgtggccacagctgttagtttggagggagaagctgaaagtacacaagggcaaaagggaagtgtggtcaagaacacaagagacaacaacgccaaataggtcttaaaggcaaagaggtttgttttcttgctgtcttaatatttgacaacttttgagaagaggtggtcaggctttttcaagtttttataatgtactatagagaaaaaagcacacaattgaaacgaattctccaatagtctttgaaaataacacccgtggtattttagccaatccaaaactgtgtagcaggcaaagatagtttggctgctctttctctttttctataatcacaaaggctctggctaatgtaatgtaaacctatagcagttcaatgatcccttccagtgctgtgcttatacttttcctctgaggttaagccctagaagataagcctttttccttatgtcattcatacagtcaaaatcaatccttcagaagcttcatttttacatatctattttctgttctagaattgttacacaataaggtatattattattattgttaagggttttatattaacaaaagcatctgcctatttctgggtctgtcaatacccttgagttttgaaggaaaatataataaaatgtggattactaaatccaaagtagccccctctgtaatgtttaaggcaataaagatcagaatcggactccctttggaaacccttaatgatgtgtaggagcttaaaatgtgtagcagatttatcagattctattgccagactttccttcattaggtaccatgtcatctgaaaataatctgaatatcttggagacattcacactttgggttctcctcttaaaatgtggtgaaggtaactattcatctaaagagttcagaaaaatctaagttcacatgagaaagacaagatccaaaggcagataatcctgtctagcttaatcaaggacacccacctcggccattcaggaacaccatgatcaaaaactttcccataatgccttaggagacaacacactctcttctttataatgttctttgtgaatatttaagctaatatttaagagcaatgtttatttttaataaaagtacatttagttactacttgctactttaggcccatcattttttcaacttgctaaagatttttttccagatggacgtctgtacttttagttattttaaaaagcaaatttacctctgagaacaaggaaaaattaaattaatagggtatttggggaagttcagatagtctagagagtgaggtaagggtacaagtctcacaggaagattaaaatagttttgttcttcatctgcttaagtaaaaaataacaacaataatttactgtgtacctagaatgcacaaagcactacggttaccaaaatggataaggcacttcctttccttgatgtaataagtactatttatgcaaaaattataataataagctagacttgtatagacacatgcaaagctttttttttttttctttgacagaatctcactctgttgcccagttggagtgcagtggtgcaatcttggctcactgcaatctctgcctccagggttcatgctattctcgtgcctcagcctcccaactagctggaattacatgcgtgcaccaccacacctggctaatttttgtgttttagtagagataagttttcaccatgttgtccaggctgatctggcattcctgtcctcaagccatccgcccacctcagcctcccaaagtgctggaattacaagtgtgaatcaccacacaggcaggagccactgcacctggccacacaaagcatgtttaagtgaggttctcatttgaggcttagagttatccagcaatctggatactaattccatttagcctgacattaaatttcataaatctattttattgatgaaaatgaattataattgtaaatcagccttaatacagtaataccatacatatcatacatcttatgcccataaagtggtttcatggtgataatttaggtgtgttattctcaatttgtttgtagccctgtatcaaatatcatttctttttatgccatattaatgttcagatcccaatttactcagcattttgaatgcaacaatattttaagaaaaacattgtgtatattctctttccccacccgctgcccccacctctacttttaaactatgcattagcccattaagcattaaaaatatttatttgtcaaaggggagattaggagttgttaaagaatgaaggcatagagaaagatgaggtaatagttcacttctggaatatgaaaacagaaatttgaaataagaaaacagattattatcttgacaaaggaatgcctaacaaaattatttttcttttttttttttagtttgccaaggtccgagtctaaaagataaggtttattgaattcctctattaaaaacaacccattttgcttctaatagcaaattaaggaaacacactgctcaatgctagaggcagatagcaaatattatataggcagtgataattacagatatctaacagtggttacagcacagtctctgcttattcagagtagacactggccattccaggcagccctagactgtacttgctaagtcagaattaattcttttgtttctggatgacaagtaaatccaatgggtgtcaaagagaggactggatgtttgggtggcttatgggctttgggaatatcacagaaatggctatttgtcaaactgtatggaagtatttcaatattttatcaactgcttgatcatactgttgcgtgccatttgaagggaagaaatgttatacatattaaataaatgaataagataatctactgctttgatgaaaataaaacatagaaatggcatgagagactaatcatgagctttagatttgagtctctaaattggtgacatttaaattgaaatctggatgacaagaaggaaagaacactgcaaaactgttgggaagaacactttaggggatgtggccagcaggtatactatgaaatttttttgttaatttaaaaattaaaatgaaaatcagcattagagcagatatagtcgtaagttccttaccacttagcaattaatatgaaaagaatatataatgacaatgctggggtaaaagaaatggaaaaaagaactgaagcagaaggaaagctgtcaacatgggaaagcttagagaattatggttataagtataacatactatagaaatttgaagtcaatctaacttctctatgataggtcattaattataattgtttaaattatatatataattttaaatttttaagaaagcctttgatagaagaattgtatgtgaatcagatgcctaatttccaaggtgccaagtatgagccttttgactcatgagtgtgttcaagtatgaggttgttaatgtaattgcaaacccttggttcatagtctcttgaattcaggctcttgacaatgaatcctctaacaaacctgggcttggccatgcagtctgctttggccaagcaaatacaatgcaacaaagactgtaaaagtttttgcagattgggactttcttttgctgctttaattctgagatcatcatgtgaagaaatccagctagcctgctaaagaataaggggccgcttggagcaaagaagctctctgagacaaccagattaagcagccagcctaccacaggtttttctgagccagccatgaagaaagagagagagagagtgagtctccctctatcacccaggatggagtgcattggtgagatctcagctcactgtaacctctgcctccctggttcaagcaattatcccacctcagcttcctgagtagctggcattacaggtgcccaccaccacacctagctaatttttgtatttctagtagagatgggtttttgccacgttggccaggcttgtctcaaactcctggtctcaagtgatccaaccacctcgacctcccaaaatgctgggattacaagcatgagccaccgtgttcgtaccagcgcttgttatttcaagtcactaagttttgtgttggtttcttgcacagcaaaagctgacagctacatggacaaaggagaaaaaagtgtgagtagcaagtatctcatataaaaatgaagcagatagtgacaaaacaaaaaatctctagaagcctggatcctgaggtagtaactacatcactaacaagaaaaactgctgatacatataatgcacttcaattataattcaagaaaaattatataagtagtataagttttgtgccaggcattgtgctaggtataaaaataaatgccccttctgtcaaggagctcaggggttagggatgaaactcacacagatgcagggggtagggagggtggtgaaggctttactgttaataaattatttcaacttcatgtcagtttccacagaccaggatccaccaactgtgggtttttaaaaattgtgaattaaaccacatttcttttttctcctttgaaaatagttctttgtctcccaaattaattatactatttttagcatatatgtaaatatttgaaatgcttacaaattagtcctcttcacagagtttagaaaaagacagcttttaggaatgactatgagtgattttagaggctaatgactgaaaatatcgtacccatgatttaccaggtatctttaactctcctactccttttaccctttcttaccttctacaatgggagactggctaaaagaatgagtacatcttcctcatctactctgtcctctcaaagcggacattggaacagaataagaatggctgtaaacaacaacaacaacaaaaacaaccattataaggaatataaactggcaatcttcttctttgtaatatggctatatatatatatatatatatatatatatatatatattttaccattttctttctcaaaaacaataaactacgatccttcctggtcatggtattctctacccaaaaacacacacagattcttctttgcagttctacaaaggcgtgtgaggatatggggtcacttaaaagcacaagtaggaaaccaaaaagttactgttttccacagatttttgacctttctctcctgtagttgcagctactccaatggtaccaggaaccatttagagtccataacagcatttcttccccattatctggcattcccatcttatgctctagatcacctccccaagttattgtttgcagattgtttacattatttaaggtctattttttcaaaggtcttatttattttataaatgtaacactaggtttttattttgatggattaaatacactgtaataatttgagtttctcatggaattcaatcagaagaaattaggcttgtcacttgcttttctatttttttagctgtatttctctgaaggaatataggtgtttttgtcttctttttatctttataggcttatagcaattcatgatctgttccaaaaattgggtaaaaaatcaaaacttaagtaaaatattaggaaatggaatatttttaaatatgcatacttataggatgaagacaaaatatactgctaagaaggactaactgcaggcataattataaataaatgaattttaaatgttcatcccctttgtcctatttaccctatctcactgggtacttctcagtttcacaggatcagaattatgcccccaatttgctttgggctcctcagtgtgatgacttattggatcctatattttaatttcattataaacattaaaattatttccatataattttcccactaattcccatttttgcaggatcatttcatgaaaaatatgcatgaggtaatttgaggcaagacacaattattattatctatactcttcactacttttcacccagtgcctaacactataccctgaatatatatggccactaataaacacttgttgaataatcatctgattctttttgcattttaaatttcctactcccagaaacaaaagaaagttatataaattcctatgtgaaaaagattttcagttgtaaggagcaaggctatttacaatagttgccccagcatacatgtccagaggtcactctccacactgtgatctatggctcctccatctgtggagtcatcatggtcaatctgaaattactctattgcagtttaaagtcccttaaacttaaatttgaaaagttcaaatatatgaaagaatacttatctcacaccagtgtaggaagaaaagtaggtcctcaccaatgtctgggattgagaactgggagttcagggaggggcttcaagatggctgactagaggcacccatcactcacctcctccacaaggagacacaaaaatggtgagtagataatcacacattgaatacaatgtctatgagaaaatactggaattcatcagggaagtgacaaggaactgttgaggcactgaaggagaataaagcaaagcaaccagccttgccagaattagctgagagccaggaaaaactgcccagtctgaggaaacagtaagaccagaatgtagaccagtggaccacattcccatcatggactcctgtgatcctagccatgggagagcccctcagccattaaaggccctaagattagtataggaagctgcttggagttttcccaagacattgtgctagagggggattttgtgctgggtcccacacactctaccccaagacccaagcagttgtagcacagcaccagtttgagtgcccagttactaccagatgtcatcctcccatacagtccaacagcccctacatctccacattcctagagctccacttacatccactcacaccacccagagggcctcagcatcatgatgctggctattctcagtggtgtgactgagtacccagcaccagcccatgaagtgtcctaaatcccctaaaaaggatggtgcagcattccagggaggctgccctagggataaaaggtgccaaagcctccccagaatgtgaaagccacctaccgagggctgctgccactgacagcagtataccccgcagcagcagagccagtgagcacttgcaccagcaccttcagtgggcctggggatcaccccaccctccccactgttatagaaccaacaggtttatattcccactgtgcagtaacagacatattacactaagacagcagagttggtagcagagaaagaatgtaatgatcacagggcactgagtgagagggctgggggagtccctcaaatctgcctctctaaggagtcctaggatagagtttttaaagggattttggagagcaaggggctggaaaattgggttgttgattgattgggacaaggggcataaagtcatcaggataggaaaactgcattctttggtgagtcagcttattatggggtccctcagaccagctgagccagtgaagtcctttagaccagctgatgtaatagtttcatttgtacatacaacttgaaggaatgtctcaaagggaaaacttaacgcttcatactgttcaagttgttttctatggggaaattaaggggaactataatcttgtaacatgatctacatgattctaggaaaataggcaccaagtaactatgaggaagcaggtcagagagtaagctgatctaatgattaatatgaaatgagctgcaagcttggtttatttttgttccccctcccttcttccctgattaatttcataaagttcataggggtggttttgccaccacagcttgtacctgtatgcccaatcatgggacctgacaataggcccagctacctggcaccaccctgccagagcccagatatgctgtctgggggcctaaggatcatcccaccctctctgccacttctggcacatgcttgaactataaagggccttaaaaacaaacccaacccacttgccacaatcacccaagcctactctctggggactagaaattgcccaactcttgcccatcacagcctgacccatgcaaagcattggggggcctaaagacaaactcaccttactcaaagccactcctgcaagggccagcatgttgtccagagaccagatgatcaatctgtactgctcgttgccaccagaactcatgcacaccttgccggagcctacaccactcaccagcactgatgtctgacatatgcacacacctcctgggagcatgaagaaggaacagctcagcctgccaccaccactgccaccagcactcagccatacaaggcatctgggggcctaagggtctggggactggccagcccaacccaccactggcacttgcacatgttgcctgaggcccaagcgttggcccatcaccactacagctattgcatgctcaccacccacgggcttaaagaaaagcccacctacctgacccatcactgtcactgctggcacctgagcaagctccctggaagcccaaagatagacctgcctagacctaggaacaccagtgcctgtgtacaccacttggggttccaaggatgggcatgctcagcctgtggctatcaccaccagcccacttggcagtcccatccccaacaaaacctccccagagcctccattaacaactgcagtctgccatcgagggactcacagacatcactgacaattttcatagcccaaaataccatatagagactacactaatgcatgcactcaaaatcaaagctaaagcaccctacccaaccaacactaatggtacctctagaggaaaaagtcttttcccacaaaagcctatccaaaaaagtgaaggttatacccgatgtgcaaataccaatgtaaggacacacacacacacacaccacaaaaaagcaaagaaacatattacctccaaattaacatgatagttctccagcaacagatttaaacaaaaaagaaatctatgtaatgcctgaaaaaagaattcaaaataatgatattaaaagaagcttaacaagatacaagagaacattgaaaaacaacacaaagaaatcagaaaaacaatatatgatctgaatgagaaattcaacaaattggtagacatcatgaaaaatggccaaatagaaatcctggactgaatgaaataaaaaatacaactgagagcttaaaaaatagaatagatcaagcagaagaatttctgaacttaaagacaagtcttttgaaataactcactcagacaaaaaaaaagagaaaaaatgaagaaagcctacatgacatatgggacaacaatataatgcaagaaaatatttgaattttgggttttcctggaagaggatggcaaaggcatagaaaacctatttaacaaaatgattcctgaaaattcccaagtcttgcaagagatacagaaattcatatacaggaatctcacagaattgtaaatatatttaatccaaaaagatcttctccaagtaatattatagtcaaactatcaaaagtccaagagaattctaaaaacatcaacagaaaaaccgtcaagtcaaatataaagaaaatcagacaaacaccagatttctcacaaaaaccttacaggccaggatagaatgagataatatgtttaaaatgctgaaagaaaaattttcaatcaagaatgcaatacccagcaaagttttccttcataggcaaaagataaataaactattccccagacaagcaaaagcaaaggcaatttatgaccactagaatgttcctacaagaattgcttaagggaattctacacctggaagtgaaaggacaatatccacctttatgaaagcacataataatataaagctcacaggtagagcagacacacaaataggaagaagaaagaactcaaatgtgaacactacagaaaaccatcaaattgcaatttgacaaataataagaagaaaggagggaacaaagaaaatacaaaacaaccagaaaacaataatacaacagaaacaaaacctcatatattgatagtaacctggaatgtaaacagaataaattgcccacttaaaatatataaactgcctgaggccaggcacggtggctcatgcctgtaatcccggcactttgggaggccaaggtgggcagatcacaaggtcaagagatcgagaccatcctggctaacacggtgaaaccccgtctctactaaaaatacaaaaaaaaaaaaaaaaaacagccaggcatggtggcaagtgcctgtagtcccagctacttgggaggatgaggcaggagaatggcatgaacccgggaggcagagcgtgcagtgagctgagattgcaccactgcactccagcctgggcgacagagtgagactctgtctcaccaaaaaaaaaaaaaaaaaaaaaaatatatatatatatatatacacacacacacacatatatatatatactgcctgaatagattttttttcatgacccaacaatatggtacctacaagaagctacttcacttttaaaagcacatatagactgcaaatgaagagataaaaaatgtttccatgcaaacagaaaccaaaagagaggataattaattatacttacataagataaaacagattttaagtcaaaaacagtaaaaaagaggtaaaggtcattatataagaataaggagaccaattcagtctgaggatataacaattctatggatacaggcacccaacaccaaagcacccagattcataaaacaaatacgactaaatataaaggaagagatagattccaatacattaatacttggggactttaacaccccattcttagcattggacagattgtctagacaaaaattaacaaagaaacattagattttacttgattttagaccaaatggacctaacagttatagaacattttatcgaacagctgcaaatacacattatttgcatcagcacatggaacattctccaagatagaccacaagttaggctacaaaacaaattttaacaaaattttgaaaatggaaagcatatcaagtatcttctcagaccacaaagaaataaaattagaaatcaataacaagaggaactttgaaaactatacaactatatgaaaactaaacatgcacctgaaagaccaattgttctatgaagatatcaagaagaaaataaaaaaatttgttgaaagaaataaaaatcaaaatataatatactaaaacctatgggacacaggaaaagctgtgctaagagggaagtttatagcaataaatgcctaaatcaaagaagtagaaagatttcaaatgaataacctgaagatacacctcaaagaactaaaaaatcaagaacaaagaaaaccaaaaattagtagtaggaaacaaataataaggatcagagcagaattaaacaaaataaatgcaaatcaaaaccacaatgagataccatctcacaccagttagaatggcaatcattaaaaagtcaggaaacaacaggtgctggagaggatgtggagaaataggaacacttttacactgttggtgggactgtcaactagttcaaccattgtggaagtcagtgtggctattcctcagggatctagaactggaaataccatttgacccagccatcccattactgggtatatacccaaaggactataaatcatgctgctataaagacacatgcacacgtatgtttattgcagcattattcacgatagcaaagacttggaaccaacccaaatgtccaacaatgatagactggattaagaaaatgtggcacatatacaccatggaatactatgcagccataaaaaatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggtgagggatagcattgggagatatacctaatgctagatgacgagttagtgggtgcagcgcaccagcatggcacatgtatacatatgtaactaacctgcacaatgtgcgcatgtaccctaaaacttaaaagtataataataataaaaaaaagaaaaaaaaagaaactaaacaaatacaaaaacaaaagcaaaaataacaaaaaaggtttttaaaaagatagacaaaattcataaaccactagctaaactgaccaaaaaagagagagaagactcaaataaacataagcagaaacaaaaaatgaaatattaaaactgttaccacagaaatacataggatcttcagagactattataaacaactgtcatctagcaaattatgacacctagaggaaatgcctacttttctggacacatgcaacctactaagattgaacaaagaaagcacagaaaatctgaacaggccaatagtgagtaatgacactgaatcaataataaaatttcccaacaaagaaaagcccaggcctagatggctttactgctcaattctttcaaagtttaaaaaagaactaatttttctcaagaacaccaattcttcttaaactatttcgaaaaaaaaaatgaggaggagggaattatgcctaactattcaaagaggtctgtattaaccagataccaaaataagacaaggacacaacaacaaaaactacaggccactattcctaattaacataaacacaaaaatcctcaaaaaatactagcaaattgaatcccataacacatcaaaaagataatacaccatgaccaagtggggtttatccaacagatgcaaagaagtttcaacaaatgcaaatcaataaatgtggtacatcacatgaatagtacgaaagacaaaaactatatggtcatgtcaatagaagccaaaaaagcatttgataaaattcaacttcccttcatgataaaaactctcaacaaactagggtagagggaacatacctcaacataacaaaggccatagatgacaaacccacagctaatatcatactgaaaaggaaaaacgtgaaatgctttcctttaagaactggatcaagacaaggatgcccattctcactactcctagtaaacatagttctggaaatcctatccagagcaatgaggcaaaagaaagaaataaaaggcacccaaagcagaaaagacaaattctaactttttttctttgtagacaacaagatcttacatactaaaaaacctaaagagtccacaaaaatctttggaactgatcattgatttcactaaagttgcagaatacaaagtcaacatacaaaaatctatagtgtttctatgcaacaataacaagctagattaaaaagaaatcaagaaaacaatcctgtttgaaatagttacaaaaaataaaatacccaggaataaatttaaccaagaatattagatacatctacaaaaacattgatgacggaaaatgaagaggacacaaacaaatggaaagacatcccatgctcatggattaaaaagattaacattgctgaaatgaccatactacccaaagcagtctacatattcaatgcaatctgtatcaaaataccaatgatattcctcacaaaaaaggaaaagcaatcccaaaacctgtatgaaataaaaagtccagatagccaaagcaatactgaaaatattaaaataaccaagctgaaggtatactacctgacttaatctacgaagctatagtagtgcaaagagcatgtgatttgctataaaaacagacacatggactaatggaacagaatagaaaattcataaataaatccatgtgtttatagccaactgacttttgacaaaggcaccaagaacatacattgggaaaaggacaccctcttcaataactggtgctgggaaaatcagatatgcatatgctgaagaatgaaagtgaaccctttcccctcactatatataaaaatcaactgaaagtggataaaagacaaacataaaacagtaaactctagaactactagaagaaaacatagaagaaattttacaggacattagtctaggcaaaggttttgtggcaaagacctcaacagtataggcaacagaaacaatcaacagagtttaagagacaacatgctgaatgggagaaaataattgtaaactattcacccaacaagagaccagttttcggaatattcacggaacttaaaaaattcaacagcaaataaaataatcccattagatggtgggtgaaggatctgaaaacatttctcaaacagagacatacaaatggccaacaggtatttaaaaaaaaatgtttaacatcactattcatccgggaaatgcaaataaaaactatggtaagttatcgttttatcccagttagaatggctatttcaaaaagacaaaatataacaaacactggtaaggatgcatagaaaaaggaactcttatacactgttggtgggaatgtaaattagtacagccattatgggaaaaagtatggaggtttctcagaaaaatgaaaatagagctattatccaatctagcaatctcactgttgcatatttttccaaaggaaaggaaatcaaatgaatacttgcatcccaatttttactgtagcactattcacaatagctaagtaaagctgttgtaaaaatggaagaaacctgagtgtccacaaatggatgaatggataaagaaaatgtggtatctatacgcaatcgaatattattcagccattaaaaagaatgaaattctgtcattttcaacaacatgtggatggaactggaagtcactatgttaattgaaataagccaggcacagaaaaacaaatattatatgttttcactcatatgtgggagtttaaaatgttagtcttatggaggtagagtagaacggtagttaccagaggttaggaagggtatgtgtccagggtggggaaggggatgtagaaaggttgattaacgggaacaaacatatatttacatagaagaactaagttttagtatttgatagcacagtagagtgactatagctaatatgttgtatttttttaatttttttaaacttttatattaaattcaggggtacaagagcgtgttttttacataggtaaacttgtgtcataggggtttgttgtacagattatttcatcacccaggtattaagcctagtacccctcagttatttttcctgactctcctcctcctcccaccctccaccctctaaaaggctccagtttgtattggtcactatttgtccacatgttctcatcatttagcttctacttataagtgagaacatgcagtatttggtttcctcttcctgtgttactttccaaaggataatggcccccatgtttctgcacgggacataatcttgttctttttcatggctgcatagtattccatagtatatttatgccacattttctttatttagtctatcattgatgggcatttaggtttattccatgtctttgccatcatgaatagtgctgcaataaacaaatgcgtgcatgtgtttttataatagaatgatttatattcctttgggtaaggatttctgggtcgaatggtatttgtgtctttagatctttaatattttaaaataactagaaaagaatatttgaaatgttcccaacaaaaataaatgataaatgtttgaggtgatggtatcctaaataccctgatttgatcattacacattgtttgcaggtatcaaaataccacttgtgttccataaatatgtacaaatatgtactaataaaaacatttttataaaactggaagttcagaaaccaagaatactctctctgatctctaatgctcaatggtttctcatttctttctctccacacactggatttgttattaattctctctggagactggctttttctggttttctctagttctgtttctccaggcattccagcttgagtgtcaaaactcactcaaacatatttaatataatctcagatttttggaagaagaaattgggtcaggcatccacatcaactgtgccacaaagcagggttaattatacctctattttctcagccagaattctgggaattagaacagcaatttcaatgagaagaagcatgagatagaaacgaaattctaggtattaataggacataagatatcgccaaatttgttctcattatcttccccgattataaaccagcaacttttttttttttttttttgtgagatggaatctcgctctgtcacccaggctggagtgcagtggcctcatgccattctcctgcctcagcctcatgagtagctgagactacaggcgcccgccaccacgcccagctaatttttttttttttttttttttttttttgtatttttagtagagatggggtttcaccgtgttagccaggatggccttgatctcctgacctcatgatctgcccgcctcggcctcccaaagtgctgggattacaggcgtgagccaccgcacccggccttcttataacatgtctattttggaaaatagaaccatttataaacagagtttagaaacatccttaactcctctcagaaatctataactaattattctttacagattatacttctgaagccatttcttcctttccattgccattagacctgttcttattatcttatctgaacttttaaaatagctttctaaaatgtactccacactacaataatttgcttcatctcattcttgtcaacactttaataagaaacaccatacctacatttatgtcattcccctgataaaaatgttcagtgaacacttctttcctttaaaataacctacaaacttcaccctttaaagttttccacaatgtgaaccaaagttacctttcttggtttgccttattctacatactaacaaatacctcatgctccaatcaaactggactatgctatttccaaatatatcctgtatattcagctccatcgctcgattcatagcagattttctttttaaaatgccctgttttcctatttgtattagtctgttctcatgctgctaataaagacacacctgagactgggtaatttctaaaggaaagagttttaattgactcacatttccactggctggggaggtctcacaatcatggcagaaggccaaggaggagcaatgtcatgtctttcatggcagtaggcaagagagaatgagaaccaagcgaaagcagaaaccccttataaaaccatcatatctcttgagacttgttcactaccatgagaacagtatgggggaaactgtccctatgattcccttatctcccactgggtccctcccacaagtggaaattatgggagctacaattcaagatgagatttgagtggagacacaaccaaaccatatcgttattcaaatctaaatatctgctataaaaattattttcatcatttaaagtccaaaccaaagacctttgctaaagatgctcctgattggttgtgatctcttactactttggtcttcatatcaagttgctcgcactttgtgtgtgacatatatattaacagtatgctaataacacaagagctttctacattccaagtgttagtctaaatacctttttaatacattttctcatctaatgcttatatcaaataaacaatttacatactataattatactcattttaaggatgggaaattgtggtttagaatgtttaattaattgtcccaaagtcacctagctaggaagtagctatattttctagttactctatgtctctctttttatcaatcttaaatgaaaacttgagatcagctttttatctcttcaagtacctagcccagtattgtgagtaagtgggtaagcagatagattagattaactggattaaataatatcatgaagaaaatgtcaacagggaacttcagtctttaatttgtaaacatgggttggtacaaggtttactgggggatattagaaactaggtttatatttagtttggccttttgtgactatgttaaaacaactatactcatgagttgtgagattaccctgctatacaagtgagcagtttttcatatgtgagctgcagtagataaaccaattcatttcttttccaaagcactacaaataacaatactccagcacatccctgtaaaggagaacatttttggtttgcccttacatgtgttgtctccctattttgagatgtattcattaagactagtttcaattgttgttgaaaaaacattttctattaaattggatttgaatcatagagactaagaaattaaatctttagaaagagtattttcaaaactaattagatatttcaaggctgtccaatcatacaatttaagggacaaattttcttcttgtttggttaaatgccggtagaatttactaaggatttactataatatttgctaagattagatgagcaggtgtggcctatatttcattaatattagtgaccacctgcagcctaagaaaatgcattttaacttaaatgtcattcagctgtacttttcaaacttttattccatccaaattctccatagaccatcagggaaatgtgcttaccattaaccaagaagggaattactgcacacaatatgtataggaactgattggggtagtatcctgatgttcagtttgcttgactatatccagagcagtacaaatcaaatttaattcctaaatatttgatcggatctacttaacgcaggaaaccattttttttaaagtagactgtgagtatccatctgattgatggcctatgttcaacttctatgatagtgagcaaaagtcaatctgatcacctaaataaatattctgagagatattaatcacacattattaaggctagaagactttagagatcatctggttaatctggtgaatgccttctcttaatttagcaaactcagtctcagacagattgcattttactcaagtttttacttggaattagtggaaaagccaagctgaaacttcatatttcctacctccaaagaactacactttccagttagcaatttttgtgacccagggttagggcatcaaagggatgattctgaggaagggatggagcagtagagagaaagaagaaagaaatgcttctgtaaggatattgatgtcctgtgatgttttaatggaaacttggcattctaccacccatgataagctacctaaatatttacgtacaagagcctaggaaactgtcacaggatattataaattagttccattttctcaagggtcatttgcatttccattcaggtaatttcctcatcataatgtggttattattatatttgctgaggtaaaactagatcatcttttttgcattaatataaaaccatttattcagtgatatgttggagaaggcttatacctggacaaagcaattattaaatttttaaaaaattttgtgtagttgatgttaaatacagctattactaaatattaaattatataaatgtatagtgaagtagattataataatatcatagggaatcaatacttaaaactaatcagtttccatttattttacttggaatttattatttagcatttactattacctattttgctattattttgagattatttatgtctattgtactgtatggtagaaataccatacaacatactgctctacaaaaatcactttccaacttttcatttagtaagtacatttggtagcttggaatcagtcacagaatgagtatttacaccatgaaaattagaaaacactacaaagcaaggtttggtatgttgatttttcttctcgaagaagccaacttttaaatatttcccagcataccactgcttaaaatccacttatgattcacctcatgccttaacaggtacatgaaacctcaaatctacaacgatttgaccactgctacattgaccactaataggcatgctgtgtattcttgcatagggtgtcatggtattctgaacagcattgtttcagatcaagaaactcactttatagacaaagtgtagcagtgggtccacattcacggaattcactgttctcctcatgtttccagccattctaaaaatgctggcttgatagaacagtggaatggccttttgaatagtcagttacagcatcagctaggtggcaatacttacataattggggcaaggttttctagaatgctgtataggctctaactcagtgtccaaatatatggtgctatgtttcctgttgccagaattcacaggtctaggaatcaaatagtggaaatgggagtggcactactcactgttacccctggttacccacaagcaaatttttgattcctgttcccatgaccttatgctctgatggtctagaggtcttagttttaaggcaaagaatccttcgaccacaagacaatgattcccctgaactcgaatttaacactgcctcctggccactatgaagtcctcatgctctaaatcaacagaaaaggtgggagtttctatgctggctgaggcgattgatgttgactacgaaaaagaaatagacaaccactccacaatggaggtaaagaagagtatgtacaaaatatatgagatcctttatgcatctcttagtattaccatcaatgattaaggtcaatggaaaattacaacaaccaaatccaaataggagtactaatggcctggatccttcagaaatgaaagctggggtcatatcttcaagtaaagaacacaatcagctgaggtacttgctggacacaaaagaatatagaataggtagtggaagaaggtagttataaattccagctatgaccatatgacaacttatgcaaacaagggcagtaattatcatgagtatcttcctattttattaaaatatgtgtgtgtttgtgtgtatatacatatgcaatctttgttttcttgccctctcttattcctttatcatgtagcctgagctacatgatatttatatatcacaatatttattgatttttatttaagttacaagatatcaagaagaagagtaaatgtcactcaagaactttacctactgtcctgaggaaaaggttattgcactttcagtggtatgcaggatatttataacatgtaggagaaattaggactttgtttttttttttggacattaagtatggtttaaggacatgcttatgggtgccagctagataaagaaaggacttgtgatatttaattttgtatgtcaggttgactgggtcacctggtgcccagatatttggttaaacattattgtgtgtgtatctatgacggtaattctgattctggataagataaacaattggtagaccgagtaaagcagcttacccttccccaagtgggtcgacctcatctaattagttgaaggcctgattagaagaaaataaaaaaaaaggctgaggaaggaaaaatcctttctttctgcctcattgtgttggaacatggacattagtcttttgccttcagacttaaacttgaactggaactataccaccagctctctggggtctccggcttgccaagtgtagatcttgggattttctcagtctccataattgcatgagccagttccttgtaataaatatctttatggatatatctactactggttctgtttctctagataacccaaacaaattcaaatagcttgatacaatggcaggaaactggattatagaggtagatggaccaaagtcccagttctatgcctattcttgtcaacttgcagcctgtttttcttaactttcccgaagttatctatttctgtttggtagtcaacatcaatcaccctagccagcatagtaactcccacatttcctgttgattcccagcattggtatataattaataaacactaggacatccttctcccaaaacaacaataacaataaaacacctcattgtaacccagtctgatgtttacaaatttagatttgaagccagccttgtgtaagtgccaataggattgaatttgactatatatttgccacaaatgttacaaccatgcaaggtgcagtgactagtaaacctaagtttacctaagtactacaatgtggatacctcataaaaacaaaaagtggaccagacccacagagtctttgaatccatcttgcatatagaggcatagctttagattatcttaatcgaagtaaaaacacactgccagcctacttcccaaacatcattcctcccacaagtatgttaaagtgtttgccctctaaatcctcatgatgttctatctccatagagtcatctatttacagaagcctacacaccaaaacaacagatttatgaaaatgtcattgaaatattttttcaccaaaatagttaccatggaggttctcgtgcagctcttaagccagccgttattcaagtgtaatattgtatgtgttttttaaaaaataggccaggtgataaggatgcaaatattgagtttttcttcagaaaaagtagactgccacagaaacacactgtagacaatattatatttgaaagggtctctacacatccagccagagaaggtctgattttactaacttacgtggtcaccagaattatactgacaatgaaaacgctatgtacactcatgggtaggcctggctctagcaatttgatgtggtgattttcagaatgaatgtatcaaggctggaagaaaatgggtagaattcttttagggctcaacctcaccctgaaaaagagagaacaaaatgttggtagagggaggatgcaagtggcgataaaatggttacagaaataagttttgtaatggatatgcatgctaagttactactcatttttaattcttcaatccttgtaaaactgaaaatatatcggtgatttctctgaaaaattgtatctcttctcttttctcctaaagcaccttcccatttagagagagtccttatgtttgaattttaggctgttgacctagagctccctcctgccagagtattcctgctgaataacctaatctgaatcactcaagcagccaggcaaataagcccatgttagttctcacagtccatttcaattcaggccatgtaagcaatcaatacagagtgtaaaataacaagaacacacttggatacttatctctgtatgcctgagttaccacctcccaaacaacctcaattggtgagtacacaattacaaaatcatgacttcttactatgcctatttagaaaatcgtctttggctttcatggctcacggtcctatagagatccactaataacctgtataaagcataatccccagtttgcagaactggtatgcattattataatttcttttcttattgattattgaatatggatatatttcttagaaatatttataaaataaaaacatactaatttagtaaccatacatttatttaaaatatatttgtaaatatgtatgcattaatttttattaaaactaagaattttatcttaagcattagatggtttcctgtttagaatcagtctaatgtagtggtttttgagacatgcaaaaagtgttgtaaggagtcttcctgattctagcttgttttaattgcagtgtgggcaatcatcttttgatcttttgtttttatctaagacatgaactctttgaattatagtgtaaacttgagataatatgccagcaataaaaccacttgaaatatcttatagaatgaaagaatcctataaatacccatctactccaaaatcactcattggattttccttggtaaacaaaagctggagttggagtacagagaataagataaaagaactgctctatgtcaatttaaagctcttaggagattgctgtatgtggaaacttctgcacagtgttaaaattccgtgtggatgtgtgtttatctcaatacccagtaaatggtttgtatggaaatattagagcatgacaactatattgtggtattaagtgttcagttcttatctttactctgtatttatcaattttgatatattagacaaaacatttagcacttagtgtcttcatcagtaaaattacattttttctttccattttgatatctctaaaaattatctatgttaatgaattaaattgcaaattcaaagctctcaaactactatacaaatgccaactcaaattcttcatttactgagatgtttacatatctacattgattgagatacccaccatttgtatgaaaattgtatttaaatgtctatcaggacacttactctagttaaaaatttcagttgtcacactttttctccttttcagctctgaatttgatgaataaagcaaaaccccatgtaggaggtattgtttaactctatgttcagtagatcatcttttaatagatttttttctaacaaagtatgtgagtgtaagttaagaagagatatagaaaaagttaacatatgaatgttctgagcacctacacattttaatagagacaagaattatcataacagtaggtaaattcaattttttaactactagatttgcataaccaatgctatttacaagaaatatgtaaacatattcatgactttttcaaactaccctcatatttgaaactcataaatgagttgctgtattttaaagtttgtaagttaatgcattttaaaatggcttgcattttttaggattggtaaaaactcatactgatattgatcaattctggtgctggagatggtggataaataagtcacaggccattacactagtgaatacaatatcaatgctaaccttaaatgtaaatgggttaaatgctcccatttaaatggcatagagtggtaatctggataaaaagacaagacccagccatctgctgtcttcaagaggctcatcttacatttaacaacatcaacaggctcaaagtaaagggatagagtaatatctaccatccaaatggaaagccaaaaagagcaggagtcaatattcttctatcagctaaaacagatctcaaaccaataaaaataaagacaaagaagaacattaaataatgatagagagtacaatccaagaagaagaattaactatcccaaatatatatgcacccaacactggagcacccagattcataaagcaagttcttcttggcctacaaaaagacgtacgcaatcacaaaataacaatgggacacttcaacatctcaatgacagctgtaaacagatcatcaaggcagaaaactattaaccaaactttggacttaaacttgacacttgaccaactggatccattggacatctacagaacactccactaaacaactacagaatatacattcttctcatctgcacatggaacatattccaggtttgtccatatggtcaatcataaagcaagtctcaatgaattcaaaaaaattgaaatcacaccaagcacactctcagaccacagtgaaattaaaacagatatcagtatcaagaagatctatcaaaactacaccaattcatggaaatcaaacaacttgctcctgaataactcgggtaaacatcgaaaataagggaaaaaacaaaaattatttgaaattaataaaaattgaaatacaatatacaaaaaaatcactgagatgcagctaaagcagtgttaaaagtttgtagtgctaaatctcttcatgaacaaggtagagaaatctaaaattacaatctgactttgaacatagagaaattagaaaaaaaaaaaaagaacaaaccatcccttaagttagcagaaaaaaaaataactaaaatacagaagaactgaatgaaattgagatacaaatattcattgaaaagtcaatgaaattgagttggttcctcaaaaagtaaacaagagtgatatactgatagctagattaacgaaaaaaaaagacaatacccaaacaagtaaaatcaaaaataataaacataacattacaactgatttcacagacatacaaaagattctcagagaacaatatgaacaactctatgcatgcaaatgtcaaaatctagaggaaatggataaattcctgaaaacttacaatcccccaagattgaataatgaagagattgaaattctgaatcagccaatattaagctctgaaattcaatcagtaatacaaaacctaccaaccaataaaagtcctggatcaaatggattcacagccgaattctaccagtagtacaaagaagagcttgtactgattctattgaaattactccagaaaatcaagaaggaggggatcctaccaaactcattctatgaaacctgcaacagcctaataccaaaacctggcaaagacacgacaaaaattaaaacttcaggccaatacccctgatgaacaaagacacaaaaatcctcaacaatttacaagcaaactgaacccttcagcacatcgaaaagttaatacatcataatcaagcaggttttattcctgggatgcaagtctcattcaacatacaaaaatcaattaagtacgattcaccacataaagagaattaaaaacaaaaaccatatgatcatctcaataaatgcagaaaaaatgtgataaaatccaaaatcccttcatgataaaaattatcaacagatgaggcactgaagtagcataccacaaaataataacacccaattataaaaaacccatggccatatccctgatgatcatcgatgcaaaaatcctcaataaaatatgggcaaattgaatccagcagcacattaaaaagcttacccaccacgatcaagtcagctttatctctgggatgcaaggctggttcaacatacggaaatcaataaacataatccatcacataaacagaaccaatgacaaaaaccatatgattatctcaatagatgcagaaaaggccttcaacaaaattcaacagcctctcatgctaaaaactctcaataaactaggtatcagtggaacatatctcaacatagtaggagctatttatgataaacccaaagccagtatcatactgaatgggcaaaaactggaagcattccctttgaaaaccagtacaagacaaggatgccctctctcaccactcctattcaacatagtattggaagttctggccagggcaatcaggcaagagaaagcaataaagggtattcaaatagtaagggaggaagtcaaatttgtctctgtttgcagaggatataattgtatatttagaaaaccccattgtctcagcccaaaatctccttaagctgataagcgacttcagcagagtctcaggattcaaaatcaatgtgcaaaaatcacaagcattcctatacaccaataacaaacagagagctaaatcatgcgtgaactcccattcaaaattgctactcagaaaataaaatacctaggaatccaacttacaagggatgtgaaggacctcttcaaggagaactacaaaccactgctcaaggaaataagagaggacacaaacaaatggaaaacattccatgctcagggataggaagaatcaatatcatgaaaatggccttactgcccaaagtaatttatagattcaatgcgaccccatcaagctaccactgactttcttcacataattggaaaaaactaatttaatcttcatatggaatcaaaaaacagcccacatagccaagacaatcctgagcaagaagaacaaagctggaggcatcatgctacctgacttcaaatattactacaaggctacagtaaccaaaacagcgtgttactggtaccaaaacagatatatagaccaacagaacagaatggagtcctcagaaataacaccacacaaccaccaacatctgatctttgacaaacctgacacacacaagcaatggggaaaagattccctatttaataaatggtgttggaaaaactggctagccatatgcagaaaactgaaactggatcccttccttacaccttatacaaaaattaattcaagatggattaaagacttaaacgtaagacctaggaccataaaaatcgtagaagaaaacctgggcaatgccattcaggacataggcatgggcaaagactttacatctaaaacaccgaaagcaatggtaacaaaagccaaaattgataagtggtgtgtaagtaaactaaagagcttctgcacagcaaaagaaactatcatcagagtgaacaggcaacctacagaatgggagaaaatttttgcaatctatccatctgataaagggctaatatccagaatctacaaagaacttaagcaaatttacaagaaaaaagcaaacaaccccctctaaaatgggcaaaggatatgaacagacccttctcaaaagaagacatttatgcagccaacagacatatgaaaaaatgcccatcatcactggtcattagagaaatgcaaatccaaaccacaatgagataccatctcacgccagttagaatggtgatcattaaaaagtcaggaaacaacagatgctggagaggttgtggaaaagtaggaatgcttttacactgttggtgggagtgtaaattagttcaaccattctggaagacagtgtggtgattcctcaaggatctagaactagaaacaacatttgacccagcaattccatcactgggcgtatactcaaaggattataaatcattctatgataaagacacatgcacacgtatgtttactgtggcagtattcacaatagcaaagacttgggaccaacccacatgtccatcaatgatagactggattaagaaaatgtagcacatatacagcacggaatactatgcagccataaaaagtatgagtttatgtcgtttgcagggacatggatgaagctggaaaccatcattctcagccaactaccataagaacagaaaaccaaacactgcatgttctcactcataagtggggagttgaacaatggaagacatggccacagggaagggaacatcacacactggggcctgttggggggtgaggggctaggggagggataatattaggagaaatagctaatgtaggtgatgggttgatgggtgcagcaaaccaccattgctcgtgtatacctatgtaacaaaactgcacgttctgcacatgtaacccagaacttaaagtataataataaaataaataacccatagccaacatcatactgaatggggaatagcttgtaacattccacttgagaactggaacaagacaaggatgcccactttcatcactcctattcaacatagtactgaatgtcctagccagagcaacaggcaagagaaagaaaaaaaaagacatccaaacagaaaaagaagaagtcaaactatctctctttgctgacaatattctttacttagaaaacactagactctgccaaaaggttcctagaactgacaaacatgatttttgtaaggtttcaggatgcaacatccatgtacaaaaattagttgcagttccatacaccaataacattagatcaagaacacagttccgtttacaatagttagatcgagaacataattccatttgaaatacctaagaaaacatctaaccaatgagaaaaaatatctctataaagagaactacaaaacactgctgaaagaaattggagataacaaacaaatggaaaaaaatgaaaaaacatctcatgctcatggattggaagaattaacatcattaaatgaccatactgcccaaagcagttttcagattcgattttcctaacaaactaccaaaatcatttttcacagaagtaggcaaagcaatcctaaaattaatatagaactaaaaaagagcccaaatagccaatgcaatcctaagccaaaagaacaaagctggaggcatcacactacctgacttcaaattgcactacaacactatagtaaataaacaggatgatactggtataaaagcagacacatagatcaacggacctagaaataaagtcacatatctacagccaagtaatctttaacagtcaaatgtaacatacacggtggaaagcacactcttttcagtaaatggtactggaaaaattgggttgccatattcagaagaatgaaatgaagcttgactccatttctctccatataaaaaaatcaactcaaagtggattaaaacttaaatgtaacacttaaaactgtgaaactattagaagaaaacatagacaaaactcttctggatactggtctttgcaaagaattcatgattaagaccttaaaagcacaaccaacaaaacaaaacaaaaaaagtagacaagtgggatttaaactaaaaagcttctgcaaaagctaaaatcaacagagggaacagacaatctgcagaatgggagaaaatatttgtaaactatctatctgacaggggagtaatatgcagaacatacaaaaaactcaaacaactcaacaacaaccacaaccaccaccacaacaaaaataatcccattaaagggtgggcaaaggacatgaattgacatttttcaaaagacacacaaatgtccaagtatatgaaaaaatgttcaacatcactaattatcagagaaatacaaattaaaaccataatgaggtatcatcttacaccagtcaaaatggctattattaaaaagacaaaaaaaaaaaaacagatgttgttgaagatgtggagaaaagggaacacttatacattattggtgggaatgtaaattagtacaacctctatggaaaatcgtacagaaatttatcaaagatctggaaatagaactaccattcaattcagcaatctcactattggatatctacacaaagaaaagaataattataccaaagatatttctgtattcttttgcaaagcaatgtctttgcaatatcttactttgtttatccattctactattgacactagctccatctctaatttttttatttcaatagtttttggggtacaggtgtttttttacttacatccataaattattcagtggtgatttctgggattttggtgcacctgtcacacaaacagtgtaaactgtacctgatatgtagtatttttttcctcacccaccttctaccctttccccttccccgagtcccaaagtccattatatcacgcttatgcttttgcatcctcatagcttagctcccacttacaagtgagaacataggatatttgaatttttattcctgagttacttcacttagaataatggccttcagttccatccaagttgctacaaggacattatttcaattctttttatggttaagtagcattccatggtgtatatataccatcttttctttatccattcattggttgatgggcacttatgttggctccacatttttgcaattgtgaattgtgctgctataaacatccctgtgcatgtgtctttcatataatgatttctttcctctttaggtaaatacccagtcgtgggattgctggaccaaatggtagttctatttttagttctttaaggaatctccatactattttctatagtggttgtactagtttacattcccaacagcagtgtaaaagtgttcccttttcaccacgtctatgccaacatctataattttttgactttttaatttctgactgctatgaataaaactgttatgaatagtcttacgcaagtattttgtcaatatgtttttatttctatttggtaaacacctagaagtgggaatggtaggttacagggaaggtatacagttgcctcccaggatacatggaattcattcccagacccttgtatataccaaaatccccacatattcaagtcccacagttggccctgcatatattgcccctccatatacaggggtttcacatcctgttaatattgtattttcaatccacttggttgaaaaacattcagaatgtaagtggatcctcgcacttaaaactcatgttgttcaagggtaaactgtataattacttttgttatgagccttcagaccttttctaaaatggttgtatcattttaccattctaccaaatacgtatacaaattccaattatttcacatttttctcaacatttgattttatcagcttttaaaattttagtcattctgatgaatgggtggtagaaacatatttttttaaaatttgtattttctggccagtgtggtggctcacacctgtaatcccagcactttgggaggccgaggtgggtggatcaccagagatcaggagttcgagaccagcctggccaacatggtgaaaccccatctctactaaaaatacaaaaaagttagccaagtatggtggcaggtgcctatagtcccagctactctggaggctgaggcaggagaatggcatgaacccgggaggtggagcttgcagtgagctgagattgcaccactgcactccagcctgggcgacagagcgagactctgtctcaaaaaaaaaaaaaaaaaaaaaaaaaaatatatatatatatatatatatatatatatatatttcttgatgactaatacattgaacacttttttatgtaaaataatcatttgcctttatggacatatttgtttatattgtatcatacaaattatatacaagcacctttctgtccgtgagaataaatcattaaaatggaaatagcaagaaaaaaaatgcaatatttttttcccttttacctcatgtatatatagaagtaaatatatggtaaattaatcattttaatacagaaaaataaaatgaaaaacaaaatataatcataattctatttttatttaacatacaaacaaaaattatttatggtatgatttgggacaagagacaatcttgtaaatcttctagctttctttttctttttattcttaaaattttagtttatttaaaatttaaagttttcttagtaaacttcatgtcagcttcatttatgttgtttggtaaatctgtttgaaaaagtaaaaaaaagatttcaaaattcctctccaactttaaaatgttggtacagaaaagtttaatcagaatatatttctatgcatttgtggtaatgagtaaaaatattttaatttttgtgttcatttgatttttattcattcataaaaagtaaacagatgaatttcttaaaaaatatcaaatataattttacctatcttttttttttttttttttgagacaaggtcttgctctgtcacagcttggagtacagtagctcatctgcagcctcaacctcccaggcccaagtgatcctcccatatcagccttctgagttgctggaccacaggtgcatgccactatacctgtcttatttatttatttattttatttatttatttatttatttttttgtagagatgggatctttctatgttgcccaggctggtctggaactcctgggctcaagctatcatcccttgcttggtctcctttagtgctgggattacaggtgtgagccactgtgcccagtctttgataatttttctaccacttcaatcattcatcttttatttattaagtatagttctgataatctggtaagtaacagagtgctaaaaagctaatggatgttaggattattgaaatataaaaaattcagcggtcttctttaaagatagtatttaagggcattttttgactgaattttccatgtgattcaattttcctttttctattttatatgtagataattaaaaagaattaaccagcaaaacaaaacagctgggttattcttttcccctgcaaattagaagtaaagttcattttatggttttcattttatgttactaatatctctccagatactgattacactgattatcaattcatagaacttcagaacttggaaatagcctcaggcatcacctaattcagtattattcaacatggttcaccaaaaacatctactttagaatcagatcactcaaatgtttgttaaaaatgaagatacctttgctgtgcataagctttttaatttgatgtaatctcatttgttggtttttgtttttgttgcctgtgctttaaaattcatatccaaaaaaaattattccctatgctgatgtcatcaagcatttcccatatgttttcagtttctggttatacatttaagtctttaattcattttgagttgatttttgtatatgtttagaaataagagcccaattttattcttctgcatgtgaatatttagttttcccaatcacatgtactgaaaagactgtcctttccccagtgtatgttgtggcacctttgccaaaaatcaatcagctgtaaatgtgtggatgtatttcagggatctctgctctgttccattggtctatgtgtctgttttcatgccagtatcatgctgttttggttactaatgctttatagaatgttttgaagtcaggttatgcttatgcctccagctttattctttttgcttaagattgatatagctatttgtggatttttgttgttccatacaaattttagaatttgttttcctatttcaatgaagaatgtcattggtattttgatagggattagagtgaatctgtagatcactttgggtagtacagacattttaacaatactaatttttccacccatgaagacagtgtatcttcccatttatttgtgtcctctttcatttctttcatcagtgttttatagttttcattgcggagatctctcatatttttggttaaatgtattcctagaggttttattttttaaagatattgtaaatgggattgttttcatagtttctttttcaaatagttcaccattaccttatagaaattccacagctttttgtatgttgagtttgtaccctgctacttaactgaattttttagttctaacagttttttggtagagtcattagggttttctatatataagattatgtcatctgcaataatgacagagacaatttaacttcctcctttcaattgggatgccttttatttctttctcttgcctcattgccctgttgctctgactaggactactagtcctatgttgaacagaattgatagaagtcggtgttcttgtcttatgccaaatcttagagggaggtcttttaatattttcctgttcagtatgacattaactttgggatgatcttatatggcttttattgtgttgaggtacattccttctgcacaacaaagggcaaaatcaacagaattcattgaaggtctacagaatgggagaaaatatttgtgaattatacatctgacaaggagttaatatccaaaacatataaggaactcaaacaacaataacagaaaaatcaaataacttaatttcaaaatagacaaaggacctgaatagacatttctcaaaagaagatgtacaaatgaccaacaaatatagggaaaacatgctcaacttcactaaacatccgggaactgcaaatcaaagccacaatgagaaatcatctcaccccagttaaaatggctattattgaaaagacaaaagataagagtttttgaagatgtggaggaaaggcaacacttacacagtgttctgtggtgggaatgtaagttagtatagccattaaggaaaacagcatggaggttccttattttattttttatttttggagaccgtgtcttactctgtcacccagggtggagtgcaatgatgcaatctcggctcactgcaacctccgcctcccaggttcaagtgattctcctgtctcagcctcctgagtagctgggattacaggcttgcaccgccacgtccagctaatttttgtatttttagtaaagacaaggtttcaccatgttgaccaggctggtcttgaactcctgacctcaagtgatctgccacctcagaaaggttccttaaaatattaaaaatagaattatcatacaatccagcaatcccatttctatccaaggaaataaaatgaatataccacagagatatttatggtttaatgtttattgtagtacctttcacagtagccaatatatagaattaacctaagtgttcatcaaaagataaatggataaagaaaatgtggtataaatacacaatgggataccattcagccacacacacacacaaaagaaatcctgtcatttgtgacaacatagatgaacctggaggacatcgtgttcactgaaataagccaggcacagaaagtcaaatactgtatgatcttacttatatgtgggagccaaaaaagtagaagaagaaggagaatgtaatagtagttaccagagactggtggttagggggaagaggctgacggggagatgttggttaaaagatacataattacagtttataggaggaattgatttcaagagatacactgtaaagcaaggtgactatagtaaaggaatatatatattatattcttgaaaaatgtaaaaaagtagatgttacatgctgtcaccacaaaaatgataactatgtgaggtaatgcatttgttaattagctagatataagtatttcactgtacacatatatatttaaagtatatatttatatatatatataaagcatgtatatgtgtatatatatttaaagtatatatatatatacacattaaaacatcatgttgtactccattgaaatgtacaatgttatttgtcaacttttaaaaaattaaaatgaaaaggtaattaaatcatttattgaattgtaaaaatgaaagtatataatctatacttcaggcatgataaatcagaatcttataaaacatattagtggcaaagctaggaaaaaaataggttttctaacttctggcactattttttttccctttacactcttcttctactacaaataatgtatctatattttgtgatataaaatttttaagttgtcaattttatttttttatcaaaataaagacatggtattgtgtagataggatcaaaatatttctgaaactatgtatgtcaattgaatctttttcacactcttagatttaacataattcctctaagtggcaagatttgagtacaagggtatctgagctacccatatccaacctttttaatatttaatttattgtgatttttactaagcttttccttctagtttatacctaggtcaaaatgaaagcatttggttaaattatttatattatttaagtgcatttagtctatcagaattcctaattaaatatttcagtatcactgggataaaactggtaaccaaatacattttctagacaaagaaaaatatttccagcaaacaagaaacccaggggaagttacgttttaaaatcatctcctcgttttttaaataagcattgatattaataattttatcttcaaaaatatgaatccttgacagtctaattaagcatcatacagcatctttaaagagcaaacatcaagtgcttgagagataaagactttatttttattcaatttaaattaaatttattatttttttctttctttgagacagaatcttcctctgtcattcaggctggagtccagtggtgcaatcacagctcactgcagccccaacctcccatgctcagacaatcctcccacctcagcctcccgagtggcggggactgcagacatgtatccccacatctggctaatttttctatttttttgtggagatagggtcccactatgttgcacaggctagtcttgaactcctgggctcaagtgatctgccctcctcagccttccaaagtgctgggattacaggcgtgaactactggccaagactttttaaagaaacactgaaaactctgtcattaacaaataaattaatcaaaatttaaagatttcaaagttggaatcgtatacaaaaagtattaaaaattcaaatatatatttaaatgatttatacagaacacatattttctcctgacttgtaaatatttataagtagacgactaaaatattgttttctgctttgatcatgtaatgtttactaaactattctgattcatatcatttgttcagtttgtttcctaatgggtttaatcttgctgcacaaattgttcaaagaaatgtaagttctcaaatcctctgtgtctttttgaactataccctcattgaatctttataattattttataaattcctctgtcccaaggggatgagtaatgcagatgttaaattactgtactgtaaatactccaggattcaaaatgtgttatgaagtcataatgaatttttttcaggagaaatgaacacaaaactgatacaaaaaataaagtagctcaaaacctaccagtgttcaaaataagttctgggacacagaagtgctcaataaatatttctttaactgatttaaactatattatgcagcatactatgggaatatttgaatccagaaatatttttaaagtacaattttaactatataatactataactgagtgagaggaaactgaagtcagtattgacaaagattccagagctaatagcaaaagaaggactcaaatccaagtctgtggattccaaagaccattctttatccactgtctacactccctctctttaaggataggataatgcacaaggcatttgaaacacttataaaataaaactgtgtagaactccatcacagaaaattttaagccctaaatacgtagaacaatcagcatccagaatcaatcttttcccaaatgcttcaaaaataaccattctaaatatgtatttgaaagcaatgaatattacacatggatcaatttcagtatgcccatatgggtaacactacctttcctgtggttggccctttaaattattttctctattgagttgtaaaaagaaattttaaaggtagctaatatccagaactcagaacaattggccttccaatatcgatcttgatattggatctatttcctttggtttgaaaatctttcttcaacacccttcaggcccttggtagagactacactactttctgatctagcctctgcattatcatttcttgatcagctctatactccaagcttagcatcttcccttgtgggtgaggctctaatactccagtcctgtgtgacctaactctagccatgttttatctgttgaaaactctatcgctaatctctactctctttaagagggaccatactgataatatatcatccataaggtatgtcagtacatagagatattagctttatttagctacagaagtaactttgcaagtactttcctggtgtttacacattgaccccagaactacaagcaattataaattacttcattgccaatgacattatgataatagtttatccaatatggtagtcatagtaattttaattttaatataacatcttagagatcagaaaatatattatcacccttctttacctttaccatcacctatgcagtttggatcgtgtagtagaaattgatgacaaggaaagtcttattttatggctttcataagaaattgatatgagatccacaagcacagattactgaaaatcactgaactataaaaatgaaatatggaaataaatatttaaaataaagatagcatattaaattaagtttatgtgctaagcaggtatttatcataatttttatgattgatattaggtaacagtctcttccatgttcatttaattttggctaatgagctacatttcctaaacaattacaatgtaatggatgtatatcctggtgttattatcatgttagtgctatagagttcataaaaggtactataaaaatggcacaaaatatacactaaaattaattatgacatgagtctttgttgttgttttaattttctttggaaaattgacatatttatttcaaaaacttatctttctcattactattggtagtgtatttgaggtctatattacaaaaatatagactatcccatattatattttaattgtgtcagagctttggaatctatctatctatctatctatctatctatctatctatattagagagacagagagagagagacatatatacttatatttttaacatttaagtttttgtttactccttagggcatttcccaatattttcatataatttaatattatgagaagcactatcaatcttttgataatacatttaacaattaggtgatcaaaatcctatcctgagtaacacagacacttcattcatttctttaacaaatactatggagatgtggctatggagtactgtaacaagtaaggagataaacaaaatactgcacaaaatgtttttcattacaatggtggtaagcaccataaaggaaaactttctattgttacgatttgtggaaaagggaacaatacctggttgtattagtctgttctcactctgctaataaagacatacctgagactgggtaacttataatgaaaagaggtttaactgactcacagttccacacagctggggaggcctcacaatcatggtggaaggtgaatgaggagcaaagtcacatcttacatggtggcaggcaagagagcatgtgtaggggaactccactttataaaaccatcagatctcatgacacttattcactatcatgagaacagcatgggaaaggcctgctcccctgatttgattacctcccactgtgtccctcccatgacacatgggaattatgggaactacatttcaagatgagatttgggtggggacacagctgaaccatatcactgctttaggagattgtatgtgagaaaatgttccctgagcttagtcctgaaggatttacatgcaagacactgacaaaaactggggataaatcattgcaggcagagggactggcaggtatacatttgtataatatgatgtgacaaaatttttatcttgcagaagaaactgaattaagttcaggttgtctggagtatgtttgtattgaagagagattcaaaacaagattatagatgtcattagtgaattccatttatcactcttataatacatgtaaaagattttctacaatatccaaaaaacatgggaagccactgaaggattttaagcaaaagagtgacatattcaggtttgtatattttaaagttatctctggctgtactataaagaatagatttgaggtgaaaactgaagaagagaggaagcccttgcaatagttcacatgtgaattgatggtgattacattaagagttatggtggagatggaacaaagaggaaaaattaaagaaatattttatagctgccatttggtaatcaacatattcatctttggtctataggatctttaaagacaagattcactgtatgtattatttcatttctacaaatattccaatatttttgtttctttccactatctgaaaagaccatttatccagtctttttatttttttttaattatcttatttttcaagatggctgactaggaacattacaagcccattttcctcagaaagaagatcaaatttaccagtgaatagtcaagttttaaaagaaaaatggtgggaagttagccaggacctattggatcacccatgggaagatgttggggcacataaaacaaaaacagcaagagtctggcttagactcctgaggaactcagagcacagtgaaaaggatagatgggaaggcttttctgctcccctaagccttctggcaatctgctaaccacttgctggagagcccttctgccctcacaacctggggcaacaccataggtggcaagtagagaacttcctaagaacagagaactgggtggccagctcacatagccatgccacaaccctaacacccaaaatgagatggcatgcaccatactggtggtgcactcatggtgtcactcccctgtctgggtatcctctgctctttaaccactgcaccaccagaacacccacagacatatcccacaacccactctgactttggcaagcacagggaaatggcaggtccccagggagttgtgggccctctggaaatctcacccttggcatgagccattcctaagggaagagagagtaaaacccacccaaaccctctttgatacaaaggaaatgtgagcatggtataaaccaatgaaggaggcaacactaatgcctggcaatggatgtggagaggcggtcatcttttaccctccttctgcccacacacccccaatacactgttacacatgcaacagcagttcttcccatcgagccactgagtactcatggaaagaaagaacttttcccactttcctagagcctccactccactgaaagtaaactggcatctgctcacgcttccatgaaaagtgaggcccaacttcctttcccttcactgaacagcagtgccccagaaactaaggagagactgtggagtttcctgctctggtcttggggaagaggttctgctccaagccctattctagctatagtcttcagagaggtggatctgcagcccacagctgtactaaggccaggaatcaaaggagaaagcctttataaaaacagaagattgttagactcaaaacaggtgcatgatagggaaatggatcacatttctgctaactcaggtcaaggaactggtgtacccactcttctcccaatatttcagcacatcccatcatgatttctaggtgccaacctcattagggcagtttgtgcccactaggcaccaggccacttgcccgctcttaatgttaagtgccatctactggagtgtagtctgaactgcatcactaaacaaaaatatatcactacatcaagaagcatctgagaaagcaccacacagaacctatttgcaaccaagacacacatacagagacttggccccctcaaaataattgaaacgaagccaatggatcatatacaacatacaccacagtaaaatcctcaaggggaaaaagaattaaaaattaaaaagccccatccaaaacaaagaaaaacaaacaaacaaacaaaaaaatagaagcaacagctgctccctcaggtgagagcaaatcagcacagaagctctggcagtacaaaaaacagtgttctgtcacctccaaaaattgcattagatccctggcaatagatcctaaccacattgaaatggctgaaatgaaagataaagaattcaaagtatgtattgctggaaactcaatgagatccaagataaagttaaaatccatcacaaagataacaataacatgatccaggatttgaaagaagacatcactatattaaaagaatcaaagagtgcttatggaattaaaaatgtcactacaggaatttcaaaatacaattggagactgtattagtccatcttcacactgctgataaagacatacccacaactgggcaatttacaaaaaaaaaaggggggttattggacttaaagttccgtgtggctggggaggcctcacaatcataatggaaggtgaaaggcacgtcttacatggcagcagacaagagaatagagtttctgcagggagactcacatttttaaaaccatcagatctcatgagtcttattcactatcacgagaacaacaagggaaagacctgcccccatgattcagttaccttactgggtccctcccacaacacatggaaactaaagatgagatttgggtggggacacagccaaaccatatcaaaatccttagtaatagactagatcaagcataagaaaaaatttcagagctcaaaaatcagtctttttgaatcaaccaaaccagacaaaaataaaggaaaaagattttttaatgaaaacttttgagaattagaaaataatgtaaagccactaaacatataatttattggcatttctgaaagagaagatgaagatgaaaaagtaagcaacttggaaaagggatttcagagtataatccaggaattgctaaaaacgttgacatgcagcagatacaaaaaaaaatccagagcacttcagtgagacaatgcacatgacaaccttccccaaggcacatagtcattagactatcctaggtcaatgtgaaagaaaaaatcttaaagacagatagagaaaatggcaaaattacctataaagggaattccataagactaatagcagacttctcagcagataccatacaagccaaaaaagattggggacctatttttagccttcattatgaaacaaaatgccaaacgagaacttagtatccttttaaactgagcttcagacataaagtcttcctcagaagagtaaatgttaagagaattcgtcaccaccaggctgaacctacaaaaaaaaagctcagtggaattctaaacaaaaaacaaaatgatgatacttgctaccacaaaggcacacataagtacaaagtccacagaccctataaagcaaatatactactgagattacaaagcaactagctatcaaccatatgagaggaaggaaacctcacatatcaatattagcctttaccataaatggtgtaaatgctccacgtaaaagccagcatggcaaattggataaaataaatgatcttctgctgtcttcaagaaacccatctcacatgtgataacaatcatagactcaaactaaagagatggagaaagatctatcatgcaaaccgaaaacaaacaaaaggcaaggttgctattgttatattacataaaacttactttaaaccaacaatagtgaaaacgtacaaaaaagggcattataaaattcaacaagaagatataatcattatatatatatatatatatgcacccaacatcaaagcatcctaatttatgaaacaattactattagtcctaagaaaagagatagaaagctacacaacaattatggggattttaacaccccagtgataatgttagagagaccattgatgtagaaaactgacacagaaattgtagacttaagtggaacacttgaccaaatggatttaatggacagctacagcatactccacccaacaactacagaatatacattcttctcatccacatatggaacattctctaggactgactacatgcttggccataaagcaagtctcaataaattcagaaagtcaaaattataccaaccatcctctttgaacacagtggagtaaaattagaactcaataccaagaggaattctcaaaaccacacaaatacatggaaactaaacaacttggtcctgaacgacttttgaatacacaaggaaattaaggcagaaataaaaaaaaatatttgaaacaaatgaaaatagagaaacaacatgcctaaaactccgagattcagcaagagtaatggttaagaggaaagtttagagcactatatgcctacatcaagaaaatagaaagatttcaaattaacaacctaaagtcacacttaagggaaatagaaaaacaagaacaaagtagacccaaagctagcagaagaaaataaataactaaaattagagcagaactaaataaaattgagaccaaagaatgaacttaaacaaaggatcaacaaaataagaagttagcttttgaaagggtaaacaggactgatagactactagttagattaacaaagaaaataaagagaagacccaaataagcaccatcaaaaatgacaaagggacgttaacaactgatctcacagaaatacaaaaatcctcagagattactacgaagatctctatgtgaacacacaaaaaaacctgtaggatatggataaattcttggaaacacacaaacctctcttcattgaaccaaaaagaaactgaaaccctgaacagaccaatagtaaattataaaattaaattggcaacaaaaaactaaccaaccaaaaacacttctggaccagttagatttacagctgaattctaccagatgtacaaagagagctggtatcaatcttactgaaattattaccccaaaattgaggagacgtgtttcttcctaactcattctataaaacttgaatcatcttataccgaaattcggcaaaaacacaagaaaactgcaggccgttatccctggtaaacataggcacaaaaatcctcaacaaaaggactagcaaaatgaatacagtagcatatcaaaaagatattttaccatgaccaagtgggctttagtcctgggatgcaaggatggttaaatttcagcatatcaataaacatgatccaccacgtaaacagaattaaaagcaaaaaccatgtgataatctcaatggaagcaaaaaaggcattcaataaaatccaatatcccttcatgataaaaaccttcaagaaagtaggtgtcaagggagcatacttcaaaataataacagccatttatgacaaactcacagcaaacatcatattgaactgacaaaacttgaaaacattttcccaaagaactggacaaaaacaaggacatctactctcaccacttctattcaatatagtatggtagttacttgccagagcaatcagacaagagaaagaaataaaaggcatccaaataggaaagaggacattaaattatctctatttgcttacagtatgattctatacctagaaaactctaaacctccctccaaaagactcctagatctgataaactactttagtgaagtttcaggatacaaaatcagcatacagaaataactagcatttctatacatcaatacagttcaagctgagaaccaaataaagggtgcaatcctacttgcaatagccatcaaaaaaaaaaaatacctaggaatacatctaaccaaggaggtgaaagagctctacaaggagaattacaaaacactgctgaaataaattatttatgacacaaacaaatggaaaaacattccatgctcatggattggaagaagcaatattgtttaaatgcccacactacccaaagcaacgtgcagattcaatgcaattcccataaaattactaacataatttttcacagaattagtcaaattaattgtaaaatccatatgggaccaaaaacatgtccaatagtcaaggcaaagcaaagggagcaaaggagcaggcttcacactactccatttcaaactatactactagtttctaataaccaaaacagcacggtattgtacaaaaataggcatatagatcaatagaacaggaaggagaactcagaaataaaaccacacacccacaacaaactgatgtttgacagagtcaacgaaaataaacaatgaggaaaggacaccttttcaataaattgtactgggaaaactggccagtcatatagaacaaaactggatccccacctgtcactatatacaaaaattaactcaagatgtagtaaagatttaaatctaagatctcaatctataaaaatcctagaaaaaaacccaggaaaaattattctggacatttgcctaggcaaataattcattactaagaacacaaaggcaaatgcaacaaaaacaaaaattgacaaatgggaattaattacactaaaaatctctctatacaacaaaagaaacaatcaacagggtaaagagacaaagtacaaaaaaggaagaaaatatttgcaaactatgcgtctgacaatggattagcatccagaatctgtaagcaacttaaacaaataaaaactaaataacaccattaaaaagtggtcaaataacattaacactcctttttcaaaagaagacaaaaaagcagccaagaaatttatgaaaaaatactcaatatcactagtcttcagaaaaatgaaatttaaccacaataagataccatctcacatcagtcagaacggctattaataaatagtcaaaaaataagagatgggcaaaaatgcagagaaaagggaatgcttacacactggtggtgggaatataaattagttcagcctctgtggaaagtagattggagattcctcaacccaccaaaaatagaactacctgttactgatatctaactaatggaagagatgttattctaccaaaagacatctgaactcatctttattgcagaactattcacaacagcaaagtcatggaatccacctgtgtgcccaaccatggtggattggataaataaaattggtacatatacaccatggaatactacacagtcataagaaagaatgagatcatgtcctttgcaggaacatggaggcaactggaggtcattatcacaattgaattaatgaagaaacagaaaatcaaatactgcatgttctcccttataagtgagagctacaaaatgggtacacacagacacaaagacagaaacaatagacactgtggtctccaaaagtgggaaacgagggagggaggggaccaaggttgaaaaactacctattaactactatattcactatttgggtgatgagttcaatagcagcccaaatcctagtactgtccaaaatatccacgtaacaaacctgcacatgtaccctcttgaaactaaaatttaaaaattagaataaattatcttattttcacattgatgtcatctacaacaataggcacattaaatgggtttaccttatgttattttaaaattcttctcataacattttgatcaatacacttgtatttacaaccatggttcccttcattacatgtcagtcatcaacatatcaatttggcttatctttcagcaaatacaaggtaatatttttgctgcttaataaaacaataattctgaagtctcctgcattgtcttctaattaccactaggaaaatatatgcaacctcttttttctttacatattctttatttctatgtcaattttcagattcttcttgtctaggtcatgttcagcttttcacttcctaagatgcatgcagtccattgtcttgtgcctacttcatgattgtatcttactgttcattatcaggtatatttcaatcagataagcagacttactgttaataatatgaatagagtgtgcttttataggattttgaacgtgctcaattgtgagggcaagttaagcagcctatttaaggctgttgattctgcttttggtgctggattttgtcatcaggtcgaacagcaggaaaaaaattggatgtgaaatatggagagcaaggacaaactagcagctctgatgatgtggtggaacctctgggacaaattaaaatcattgtctgtttctcaacgcctccagccaccaaattcacatgaggaaaacgttagcaactttcccatgaaaccacacaggtatgaggcacaggaattagagaaaatgaaggaggaaaatttgtatatactacatacacaagcttcaggcacagctgttggcccacaccaacaaagtgacccagcagaccagagacaacgtgcatgaattgcagcagcactttatccaactttaactaactaagcctacgggtggctgctgcttcacttctgccttccaaatattgcagagaattctcctgtggaaaatcctaacctggaatcacatagggaacagacttctagggaacatagtttcactttagccttgttaacatagtacacattcattacattattcatatatatgtacatatttctggttctcataatctattgagttaaaaaaaaccacgtccattttaatcttaagagctacgcaatatataaagataacagaacaggctgaataaaaatagggaggctataatttattatattttcttaattgccttaggaaatacagtatacataggatggcttcatcattataattagtattagcaagagtaaaatctgcatgagtcatcaattactactgcattgaatgttaaataagattgttaaaaaattatagtgtatactgctttctatataatgatgatgaaactcattgttttcagtaaggacatataataaatcattctcaattatataacatttcaaagtttaactgctgagtttcatgtgttagattaatatgccttaggtccttatattttatattaatttaactcagagttattatgtacttgttcaaggtcaaccatttggtatatggctgtaaagaaacttaaattcagatttatatatcttttgactctaactacagtgctctttcagctgtaacacccacacaaacataaactctcttatgtttaaatacgtatctatatgccttgtgattcaaggttacaaattaagtctatacattgatctactttatgcaaagatactaataagatgataatgaaaggtttttaaaggtataaacccatgacaatgaagatcatgggaaacagataatcataaaatgaaatatttcaaatattttctggaaggtgaatataaatggaagtgactaaagaaggaaattaaattttcacaaatgagaatgcgtgcagaaaggttttaaccaaagagggaattcctctccttggaagaattctagacaagttcaaggatgcaggacaggaggggatgcaagcataagatgtaggactaaaaattagggattcaattgcaacagtatttaagaatcccttgtctacatgctgtatatccagacatgcaaccaacattcaatatcaactgtagcagaaaacagtctccaagcattaatgttggacgaacacaaaaacaaaattagttattttcaacataaattcaatatactattttaggagaaacagagcaactcatgtaagtgaagctttcttaattgtgttctttaaagaaacagcagcataatggcttgttagctgctcagttgccctagaccaatgttgcaggtaagtaagctttgccttgcattgagtgaattactgttcttctcaatgattcattttaggtagaaatagaaacaaagaatcaatacatatctgatatatcttctgaaaaaaggaattataacgataaacaaattttaaaaaccaagaaaaaaagaaaatcctaagatgatctgataatttaaatatcttaaaatttcactttgaaaagatcaagaaaaatgtatatctataaaaaaacaaattaatatgagaaataaaaaaaaacatttaaaaagacattgaaagtatgcaatattttcatgaaatatacatacaaaatgggcttaaatcaagtcatacagctctatgattttaacaaagtgaatatatccttgtaatgagataaagatcaaaacacagtataatatcaacaccacagatgcttttgtcatcatcatttccagcctctttccctcttgtcagcaaataaaattactatattggttagttttgcttattaaaaaaaaaagttacatgtatttatacagtaggaactcttttgtgattggcttcttttgctcaacactttgtttttgtgattataccctgctatgttgctcagtgataattttgctcactttcactctcagtaataggtgtatttattaatgccacttatgtctgcattgtttccagtttgggactattatgaatagtgttattataaacatcattgaacttgtctttcagtgtacatgggtccacatttctgttacatttacacctgggaggagatgtgctgcttcaaacagtatgcagatgctaaagattagcagatactgccaaattattttccaaaatgattctaatcatttatactcccaccattagttgctccacacccttgtcaacacttggtgtcagtctttttcatttttgcaatatgaatgggtgtacagtagtattatactgggatttaaatttgcaccttcttagtgattaactaaatttagcattagtcgatatgtttattggacatttaaatgctgtatattgtaatgtatctagtcaagatttttgccacatttctttggagttttctctttttttagtaattcataggagtcttatcagtaagtatacaggatgtgagttctttgtcagatagaagtattgtaaatatcttctcccaatgtgtggcttgaatttctattctttcaataatgtttttggaggaacagaagcacttggtgtttaatgttgataaatctcatctcctatttgtatttttttgtgtgcttgtaaagaaatcattatgtaatctaatgccattaagatatttttcttggttttctaataaaaactgtaagaattaaagaaagaggagagaaacacgaagattggctttacagttaacagggacaggtttattttaaacgaatctgagaggggttgctggccaagttagattagagccacacttttttacagactacgagtttttaaggatttagggtacgagagtttattagaggattggactgcttttgtgtctgtttgttgtgtttatctgagagggagagttgtgtgtttgttcccatacatctctctgcagctgcaggcatatcccccggagtttgcttttagcttccctaccttactgcacctcaagggaaaggaatgttcttattaaggcccactgttttactggggctcactgtatgagggtgaaatttggcagtaacccaagagactttccccctacttttctctgtgcccaagctgtcttatctgtgttttactgtctgctctttctgtctggttgtagttagaagagaagtgatttccttgaaacgcatgaagctagaaagggagctggaactcaaagtggcagtgtttgtccaagatgacggtgctcctgctctgtcattaaacattatagtttacttgttacattttgatttgcaatatttctgtaactgtttttgcatgtggtattaagtaggtcaagatttttttttcacataaatagctaatattttcagcaataattatcggcaaaactgttattcttccatcacactttagtgttacctttgtcataagtcaagagacagatatgtatgagggtctttttttgactctcagttatgttttattggccttttctatgttggtacatacactatattcattactgtatctttatactaggttttaatctctaacactatgaatacaccggatttgctattctacaagattgaattgactattcagattttacaaatttaaaatataacttccataataattttttaaatcagtagaagtcttggaagataaaagcaaaggaatatggtagaatggataacttaaaaataaaacctaaaaagtgaaaagaaatataccaaataagctggtacaaattccctaaaatataaattcatggaaaaataagagatgggagaggcagttggcaatcatagaataattttttagaacaattaatggtattttaatggaaattctagggagctctacttccaactcaaattctattcccatctttagtactttgaattaagaccagtggaaccactactcatcttgctattctaagtatctgagattgaaaacattttttaaagctaaagtaatagctcattctcccatggattaagtgaggacatatatggcaaaaagtatttgatttaggataaagatatatctttattcaaagacttaagtatctcaacactttaaaaatcagggttttaaagttttgtagtattttaacacatgagatttcacttcacttaaaaactgtgtttcttaccatgtactaaattgctctcctgaaatatagacataatatgaagaaacaagttgctaaagtgtgtattcaaaatgcgcagaaaattaaatgcattttacgagtgaatagtttgccaaaattcttaatatacaattttatataatttaaagtaagtcagcttcagtgtaggaagcaagtaaaggtaatatttttgaaatctttattgttttgtggtttgtatgtttattatatttctcttaataataagcctcatgtgacatagagaatgcttcaataaaatctgtttgaaagttcaaattaacttccacatacttatgttaacaaattaatgaatctgtgaaaacttttaaggttcattgcagtgcctcttgatgccatggggcttcacatttgaattacgcccttgtcaaggagtctggactatttgatttggggtgtgattacaatgtagttcttaaattaatgtgtactagtttcatggcataactctctcttccaatgttagataatacttcaaactcattaagatataatgatatataagaaactattattagtcctaatattaattctctgttctcaagtaattgaacctaatagcagtggcacaggaagaattactgatttaatttaggctatttcttagtgaacattttatgctaagtacaatataaactaccttgaattgacctaagatgaatacaaataatattatattaaaataaggaatcacttatttggaaaatgttggtattataattgttcaaattatacgggtggtgctaatgtgctttttcacaattactaccactacactctatattcagactgctttaagtatgaaatctttgaggtcagcatttgtacttgatcttgttgcagaactttctccttagttcagctaaaactgggttcttgtcacatgaccaaaaaagactaggttcatggacacatagaagggtggggaacaaaatttattgagtgaaaagaaaaaaggaaaaaaaaaactcagcaaagtgagatggagtcctgctaacaggccctccatctcacagattgaatcccaggtcaccacacaggaactgaagaggccaggctcctcctggctgcaaatggcatgaactgcctgaggctccaccctattctcccagggtgcaggtgggcattagtcagagagaatcagtcgggaaaggggaaagggtgggcttcatccaggagcagcagtttgatttttcagccttcatgctgttttaggctagaaggcagggttttgccatggacccttggctgtctcctgtctgtatcagtcctacttgctctagactgcagatgttatgaaggagtatggagaagagaagtctaaaaaggagaaattctaacagatttatccaaattttaaaagatccttatgttttggataaaatataactatactgtgcatttgatattggttaagagagcaaggagtcagaggaggtatagatgaaaagaaaacagtattatttgttgagaacttattatacatgtaattatgccaaagttatatagattgcctatctcatttaatggtcatgaaaaccctggaagatagatattattactcctgctataattagagaaactgacagccacagtgttaagtaacttgttcaagggtacacagatagcaattgggctgtatgtgcaaacatatgttgttttttgccagtcttgcatcttttccttctatttttttagtaactattaactagttttcttctagtgaccatggcatgctggcttcaattcagagaattcagaggatctcagtgaacttcagggagacctgacacctatccctgatggttttggaggtatatatatgaattgggtttggccaatttcaaaccctggccaaagtaattggttcagaaatagggccatgacctaagacaaaagaattcatctttaatttgatatatcaaaaaatatgttctttctaactctagtgaacttgaaaattaactgggacctgttagctcttatctaatgtagcttgccagagaattgcacccaatggatgaaaagtaagttatcataaggagagaaacagtatttaaatatagcacttgatttcctaggttgatgtgtctaaagtttgaccactaataaagatccctgtcattttattttttatatttttgcttaagccaatttgggttagattttctgtaaatgacaagcaaaacagtccttattagttgacaaagttaggattcaaacccaactctgtgtactctttgtgtgtacttgctacaattgtccatgttaagtaactttaattcccacacactaagtagatctaattattataagttgaattaaaagcaggtgaacattttcagtaaaaaagttataatgttctaattcagtaaatatcacaaaaaaagtttagagagacatttcacaataaatagaaagcatagtttgtattttagagctttgagcttaccgtctacttaaaaggatataaaatttcttaggttcatggatcagtgttaagagatctctagctctcctgaaattatatgccaaaaattatgtgtgtgtgtgtgtgtgtgtgtgtgtgtgtgcatttccctgggctgaaattagtagctattgtttaaacaattcttaatagtgtccatgctcctcaacaaatttaaagactattaaatcaaagcctagctcataatggtgataatcaaggaagagctactgattacctgaactgctgatgtttgcctagttccagagaaagaatggaatagcttttgtacctactactgcttactgagacattactgaaatccacattagcaaaagtccaaaaaaagaaaacaaaaagttaccaaaatattttaatagatagcaataattttaaaaactatatctagatattatacatgggaataaaaacttttattgtataaaatatatgtttatccatgttattcatggggctgacgatacagacaccttcctctcttgagctgccaaagcctcagccatgtgcagttatatagaaccaacatcagactctaactctgccaggttttcagccatggtctttgttccctggcctcactggggcacattagtgtaaattctgcagcttgccaatagcgcatgcttagtcagaaatggggaaataattttcatttttattcctgagtcttaaccatttaatcccatcatctttcattacattttctgtagaaaacaaaatcatctctacctctctcccagcctctcattcttccatctccattattactactattgaaagatgtatcagaatctttttcctggagaaactgagcacaaaattttgcattattaactagttttatttggcataatttattggtctagcttcctgattcatttaattaaagaccacaataggcacattgaaatcctagcaatgaacatacattgaataaatatttatgaggtgaaagggttataataatagaatgccataaaagtgtttcattttcattcatctatatattacttcatttagtttttacaaatatttatgtattcattcattcaagaaaatttatattgactgcttactatgtgttaagcagtgctctaggcatgacacataaaacattaaagttaaacagacttctagccatcatgctgtttatattctaagaaacacaaaaggaaattagacatgtaaaacacatacgatgcaaattctggtaataaacagggaaaataaacctagaatgaaaaacttgtggatgaaattccaactaaacagaaaggctaaagccaaagatctgaggcaggaacaatctcagcctattcaggaattatctactattctagtagtcatgcatatttttcacaaagaaagaaagtgagactcatataaattgtatgaccttgctcaagaccacacattttgttggtaagactcctagaaccagagctaagattggtaactggtaactcatagctcatgcaatgaagatggttctttctaataaaaaggttacccagtgaggttctgtgaaggaaaatgtggcattgacatagtggataaatacagattagggatacacactgtctctcaaatatccccttaagacaaaaggcttaattttatgcatttttgtattcatatgcattagtgttatgtctactaaaaaacaattaatataaatcaagattgcatttaattctgagatttggagtttggcatcctgtgttcaaagatatatcacttaataacaaaatactcttggttaaatcacattgttatcctgaatatttccttactttaaaaaatacaaaaacttatacttgcaataaataatagtgtgcatatgaaaagtttttattagatatcatattcagggtatatatcatagctactaaactattatattttcacagatgacgtttgctgagagcataggaaaaacacccatattgtcaatgctaaagtataatcccaactcggcatggtgaatatagtccctaagtagccaatattttaaaacacttggggataatgcaggctgtgcctttgagaatcttaaggaattctcctgttaaatatatgtggtaacatcagggtaaagaataacagaaaagacaataaaaaccaaaagcagaaaatctagaaaattcacaagttcctacatacatacaacataccaagactgaacaagaagaaatccaaaacctggacagaccaataacatgtaatgtgcttgaagtcataataaaaaaaagtcttccagtaaagacaagcccaggacctgatgacttcagtgttgaattctatcaaacatttaaggaagaactaataccaatctactcaaactcttctgaaaaatagaggaggacatacttctaaactcattttatgaagccagtatctaataccaaaaccaaaaacacatttaaaaagaaaactacgggccatatctatgatgaatattgttgcaaaaatcgtcaacaaaatactagcaaaccgaattcaacaatacattagaaagatcattcaccatgaccctgggagatttatccctgggatacaaggatgattcaacatatgcaaatcaatgaatgtgatacatcatatcaacagaatgaaggacaaaaatcatatgatcatttcaattgctgctgaaaaagcattcgataaaatttaatgtcccttcatgataagaaagacattcaaaaaactgggtatagaagaaacacaactcaagataataaaagccatatgtgacagacccacaactagcatcatactgaatagagaaaaactcaaattctttcctctaagatctggaacaggacaaggatgcccactttcactgctgctattcaacacaatactgggagtcacagcattcagatcagagaaggaaataaagggcaatcaaactggaatggaagaagtcaaattatccttgtttgcagctgatataatcttatatttagaaaagcccaaagactccacaaaaaaactgttagagctgataaacaaattcagtaaagttgcaggatacaaaatcaacatacaaaagtcagtagcaattctatatgcccatagtaaacaatatgaaaaagacatttaaagggcaatcctatttagaatagccacacataaaattaaatacctaggaattcacttagccaaaaaagagaaagagctctacagtgaaaactataaaatactgatgaaataaattgaagaggacacacaaaaaaatggaaagatatttcatattgatagattggaaaaaccaatattgttaaaatgtccatactacccatagcagtctacagattcaaagcaatccctattaatataccaatgacattcttcacagaaatacaaagaaacagtccttaaacttacatgcaactacaaaaacccagaacagccaaagtcatgctaagcaaaaggaacaaaactggagaaatcacaatacctgactttaaattattaaacagaactattgtaacaaaaacagtatggtactggcataaaaacagacacattaactaatggaacagaatagagaacacagaaacaaataaacacacctacagtgaaatcatttttgacaaaggtgccaagaacatatactgtggagaagacagtctcttcaataaatggtgctaggaaaactggatatccatatgctgaagaataaatctagacccctaactctctctatatataaaaatcaaatcaaaatggattaaagacttaaatctaggacctcaagctatgaaactactacaagaaaatattagagaaaatctctaggacattggttggggcaaaacttccttgagcaataccccacaagcataggcaaccaaaacaaaatggacaaatgggattacatcaagttaaaaagcttctgcacaacaaaggatatgatcacaaagtgaagatacaacaacacagaatgggaaaaaaatatttgcatactattcctctgacaaaggattaatatccaggatatatatggagttcagacaactgtataggaaaaaaaaatctaataatctaattaaaaatgggaaaacttgccaggcacggtggctcacacctgtaatcccagcactttgggaggctgaggcgggtggatcacgaggtcaggagttcgagaccagcctggccaacatggtgaaacctcatttgtgctaaaaatacaaaaataagccaggtatggtggcacgcacctgtaatcccagctacttgggaggctgaggcaggagaattgcttgaattggggaggcagaggttgcagtgagccgagatcgcaccattgcactccagcctgggtggcaaggcgagactctgtctcaaaaaaaaaaaaaaaaaaaggcacaattttaaatataaatttctctaaagaggacatacaggcaaacaggcatatgaaaaggtgctcaacatcattgatcatcagagaaatgcaagtcaaaactacaatgagatatcatctcaccccagctaaaatgacttttatctaaaatacaggcaataacaattgctagcaaggatgtggagaaaaaacccttgtacactgttagtgggattgtaaattagtacaaccagtatgaagcacagtttggaggtttctcaaaaaaaacaaccatagagatagcgtatgagccagcaaaatcattatatttaagagatatccatacactcatgtttgttggagcactgttaatagacaagatttggaagcaacctaagggtccctcaacagatgaatggataaagaaaatatggtacatatacacaacatagtactatttagccataaaaacagaatgagattctgtcatttgcaacaacatggttggaactagagatcattatgctaagtgaaataagccaggcacagaaaggcaaacactgtgtgttctcaattattcctggtacctgacaatcagaacatttgaattcctggacatagagcgtagaatgatggttaccaaaggctgggaagggtagttgcagggctggggcaaaggaggtgcagacagttaatgggtgcaaaaataatagaaacattgaataataccttttttttttagaaagatgccagctctttactaccagggaagcgggcgtgcacacgcgtggaccgcgctcctcggagtagaccaggcccttgccttctcccgtttgtcagaggtgagtcctggtacctgacacaggaagttggtggcctctggggaggctctgatagtttggcctctgctgcttcccggctcagggcttgctcctctcaaggaacctgcgggacaccatgtgcctagagagcccctgaggagggggagcgctgacccagcctcctcatggcacgctgccctccagcgctccgcacttcacctgcttcctggcttgccgtggtcagggtcagtatttactccactgattggcacattcaggttctgaaggaatgcaaactgcgtgggtgctctggcgacattgtttgcactgtttatacaaccagacagcgttttagactaaattcgtgtccaaactaacacgcacgggaacaggctccagctgcagctcctgggtccatcaggccagggagcggctctaccggaagatccggtaagtcctgagcaggcgcccgtccttgctccacagggcggtctggatgtgcttgtaagcgggcaggtcggtcgatttgcccagggcggccactaccggcttcccctggagtatcttagaagcaactctcttcacgtcttccggcttctcgttgcggatgaacgtgcacagctcctgcggcagctttctggagcgagtggccagcacctgcctccccacatcctcgaagatcacaggcctggactccaggttcatcatgagcatggacgtcagctgcgtcttggctcgttccagctccaccgcgtccacggttccgcccattaaaataaactcctttgtggtgatttctaccatttctggaacctgcctcgggtcggcgctggcaaggatgcacaggaggccagtgtcctcgtagctgaggtagtaggaggtcgcgttatatatccagtggtgcctgctgagcacatcgaggtagagcctggagaatatgcccttgctgggcctgccagccgagaaggagccgcctccgcccatcatcatgttcaacaaagcgaaggggatgaagtcctcctccaggaaggagcagctctccagtctgatcccccatcggggatgggggtcgggcccaggctgacgtctctttctagcttggcaatccccccagtgtactgggccactgtcaacatccacagcctccgcgctccctcaagccgcctggacccccaggaggtacttccgggcacattccaccaggtgctggtcctccacactcacgccagccagtaccacgcggtcgggggtgtagtaattccgcaggtaggaatgcagcacttcccgattgatctttgctatgttttctgtgggacagaaacggtggaggccaactgtggtgcctgttgagcacgttgaggtagagcctgtaagccgcttcatgaatcatctcggtgaggagtggctctgggtcaggctgcatgttcgggtcctccagctcaaactggaccgccatctgcatcatctcgacttcttcatctgttagctggggctgcagaaccgcatcagccagtaagccgaacaccgtgtccaagcctttactatcagcagacacagcatacgtggtggtgtcacttgatgtctggcagtcacaaatacctccatgcttttccaacgtaagcagtatttcatctttgctgttaaatcgagcattagaagaaaatgccaatttttccaaaaagtgagcaattccactaaggtatgttgcttcatatcttgatcctgaattaataagaattcctactatacaaaactgtccaaacttattttgagaggccacgcgaaacccgttatccaatgtggtttgaaactttggattcaaacttttcctgtccatcaactgtagcaaaaacatgcttgggtactccaggtaaggcagaagagagggggatgttgggataggtgccaccactactaaactgtctgtacgcaggaggtccaaacctcagccgctagcggccccgagaacctgagcccctcagcgaccgcgtagccgccagcaccgtagccgccatcttgagtctccgcccattgcttctgtccgagacctactttttgatagcaaaacagagttactacagtcaataataacttaattgtacattttaaaataactaaaagggtatgataggattgtttgtaacacaaaggataaatgtttgaggggatggatgccccattctccatgatgtggttattacgcattgcacgtctgtattcaaatgtcccatgtaccccataaatatatatgcacttactatgtaccacaaaagttaaaaatttaaaaaagcctaaaattataaaataaaaaatactgtaagtaaacaacgattataaagatctcaggctacagaaacccagatttatctttaaaatgttgttttaataaaccacccgctgcatgcttcggttatcctggataaaaatatcagagtagtcttaggcacataaagaaggtaatatgagcctattggtgactgttaatttaaaacaatgattgcagtatcatataaccatagaacctgatgattttaaaaatactattgcagaaattcaatagtaaactatgaaaccaaatccacagctatttttttttttaacagataaaagctgtatgacttgggtggagtagcctatagaaattagcttggctgaagcactacagtgagaatctatgtttggctgagaataaccttggattatatcctatgtgcaagctaacttgtttagtcatggatgctggcaaaagatacgaggcttgggtcagaaacaaaggaacttcttactctcatgacatagcaagcagtttaagctttgtacttactttggattgctctgtttatctccaagcaccactaacataattagaatggcccaatgcagggaatttgtgttatacagtcaacgaaccctgaatctgagaaacctcaactttgcccgagagagagacattgtccttactattctcaacaacagacaaacctgcctctcctccaaatggaaatacaatctttattatgtttcaaggctgtttgctatacaaatatctttgaaaagatagtctggaacgaaagctgtcaatgcttctgctcagaaaacatatggaaacccaacattcataaagagttgtctccaacaggtaagctaagaaaaattcatgcaggtccttcaggggttttgaaggttgggcctaattaatgatctataacaatttaagattttaagctgattttatttgacataaaaagggggaagaatgttttgttttagcattatgctaacagaaagaccagttataaaataaagaatgggaaatgttagggtctgtacttaaatgttatcagtaagaaagagtttattggaaaattcaatggaaattgtgcagtatttctaatgggaactaataacactataggaaataaaagataaggaatatttttaagtgacatcatccctacatataaaatttaatatatgaaaagggtgcatcttaaattaattaacaaaaaagtatatttaccaggtgtgtccaatcttttggcttccctgggccacactggaagaagaagaattgtcttgggccacacataaaatacactaatagtagctgatgagctaaaaaaaaaatcacacaaaaatctcgtaatgttttaagaaagtttatgaatttgtgttgggccgcattcaaaactgtcctgggccacatgcagcctacaggctgtggttagataagcttgttttaaaagatattagagcaattggttagttatttggggaaaaaataacttagactttcaccctttaacactttccaaccacatgtagataattttaaaaattattgagtttttaaatttaaaaatttataaaatggatgtattagaagaaaatattgtgtgtgtatggatgtgtgtagaggaaattaacgtgaagacattatagctatttctccataatattatagataaataaccaagccataaaaacaaatatttgtgtcattgtgagaaaaaccttcctaaatacacaaacaaatatggaattcataaaggcaagtaacttataacacttgcttttatttacactgtcacttttacactagttttcatctcactctaattgagatacattttcaacaccacaaaatattattagttttattttatgcagtgaaaaataatttgtatttactcatagatttatcttttccaggactctccatcctttcctgaattttcttacttctgtctttgattatttagcttttgatatgaaaccgacaattccacattttattagtctcaagtttccatgtatcagcttggttgtgacctggctcaactgatagctaggttctgtcatgcttttgtggtcagttggcagtccaactgattgcagcatgatctagaatggcccgccacatgtatgagatagttgacaagccattggtctaggatgtgtctgagttgggaagacacagctgtaagactttaggagtatttcatcttccactatgttagcccactatttttcacatagtggtttcagagttctaaagaatgataagaaagcagttcccataagcttttccataatttccaaaaggcgtaatctcttttcaagcttctggttatgtcctgtttgccaatttccattgtctaaagcagtatgcctgtgtattagtttgctagatttggtataacaaagtaccacagtctgagtggcttaaacaacagaaatacattttctcaatgttctacatactagatgtccaaaatcaagttgtcagtagggtggattttttctgagggctgtgaaagaagaaggtttcaggtccctctccatcgattgtacatgaccatctttccagaatgtctcatcacatagtcttcccactatacatttctatctgtgcccaaatttcccctttttataagaacaacagtcatattggattaggacctaatgacctccctttaacttgatacatatataaaactctatctccaaataaagtcacattctgaagtacttggtggttagaacttcaacgtatgaattttgggggtgcacaatgcaatcaataacaacctaggaaacgggttcaattgatggtttcatagactccaaatcctgatgggaggatcagggacaacaaggagctaggtggagggggggtaaaaaaaatggccacttttataatccacaacaatccaaaatcatcttctttcctgaaaaattatttaatatctcttctggtggcatgtcattaataacaaaatccttcttttttattcctgaaaatgtatttcacctaatttttgtcaccacggctggagtgcagtggtgcgatcttggttcactacaactctgccttctaggttccagcgattctccagcctcagccccccgagtagctgagactacaggcgcgctccactgtgtctaactaatttttgtatttttagtaaggatggtgtttcaccatgttggccaggctggactggaactcctgacctcaggtgatctgcccacctcagcctcccaaagtgctggaattacaggcgtgagccaccatgaccagcctgaaatatattttaagtgaatatagaattatagtttgccagttatttcagcactgtaagggtgtctgtcattgtgctctctggcttccctggcttatgatgaaaagttggccattacctttattattattccttgaaggtaatgagtcgtttatctatagttgattttataatttttctttggcatcagtttttcataagtttacttttggaaaatgcatagactatgaaaagatcatcatgaataagttctagctcaacttcttgttgtgtggggtctggcattattctaatttctcttatcttcagggcaaaaccaaaattgaatctcaaactgaaagtttggggtgtttacaagtgcctctactatttggtaatccctgagttccagtttttgtctttccagccaaatgagtcttttgctctctttacttaacattttatcctctaattaactgtgttttgcttatattcacaataacttgccctgggcatatgcagttcaagaatcagtaaatgcctcaaaaggaaattgcaggaagactatcaggctcacttctctatacagtatttttctttcctccaagattttgactcctcaaatcatggttgctttggcagccttgagctccaatttttgtctacaaagcccacagagactgccacaggctctagaatgttgttttctgtttgacgtttatgtccagtgtagtgaatgagcaaatgcacccagaagaaatgtaatctcacctcaatgtgtttcttctctgcagaaactgtgcccatcaagacctggctgccttgattgctttataatatataatatatatatatgtatatatatatgtatatttatatattatatagttatataatatataaatatgtatgtatattatatatacgtataatataaattctacataatttatataaaattatataaatatataatatataaataaacaaaaatataatataaaaaatatataatttttttttggtggagtctctggctctgtcgcccaggcaggaatgcagtggcacagcatgatctcggctcactgcaacctccacctcccgggttcaagggattctcctgcctcagcctcctgagaagctgggattacaggcgcctgccgccacacccggctaattttgtatttttagtagagatagagtttctccatgttggtcaggctggtcttgaactcatgacctcaggtgatctgcctgccttggcctcccaaagtgctgggattacaggcatgagccaccatgcccggcttgcaaacaggtttttaaaacatttttttagtcttatttttacagctcctgttagtaggatggttagtctgatatattcagtcatagaagcagaaatacccataacaaaatttaaaggccaaacaacatttggcctttagagagagtgtggcctttagatagtgtgtgtggacacacacacactctccctacatgagttaattatgaaacatatgatatcatggaatagaatttaaggcaaatttgctcatatttagatggatacttgggacttttatggaacttaattgctaaatgtgaagtgtagaactgagaatgtcatgtcaaagtcatctattagaggagttgtgtactctactttttaaaaatatttgttattcctccatgtgaatttgcttcattcttccactttttaatgcaagccatctgtctttgtttgtgtttctataaagtaatacatgagactggctgatgtatgaaaaaagaaaaaaagcttcatttggcttattgttcttccagctggaaagttcttccagctgggcactggtgagggcctcagctccttccactcatggtggcagaagtcaaagggaagccagcatatgcaggtatcacatggtgagagaggaacaagaggtagaggagggaggtgccaggatctttttaacaaccagctttcaggagaactaacagagcaagaactcactcactacagaaggataacaagaactaattgagcaagaacttgctcattaccaagaggatggcacgaagacattcatgagggatatgtccctatgacccaaacaccttgcattaggacataccttcaacattagggctcaaacttcaacatgaggtttggtaggacaaacatccaaactatagcaccatctaatttctgattacttatacatttacttggccaaaatttggaggcagatttcaagtccattgaccttatatctacaatacctatctccagctaattgaattgagatttgtattcatttttaaataatgttaatttttaatgttgacaagatgaaccaagaaagcttgcttacactcctaatttaattagcatccatattctcttcattgctctcttgtttcaatggatggattgtgtctgctcctgcctgatcgccagttcctccatcccttctcaagtacttaactacagtacttcaacagttttctttttttctgcttcatcaattttccgtctcaattgaatcatttaaatggaatatttaaccttatttatgtggttaataattaataataaccttattattttctcatctcaaataataagtaatacacaaatttaagaaacttcaaacatctcttttctatttctctctctagatactgcctccatttatcttgcagcctttactgcaatacttctgaaagtattgtctatacatacattctctcattttctctagaatctacctcatttagaatttgccctgtctgattcactgaaactgcccatgtcaaggtcaccaatgatagtctccaattattaataaatgtggtggtcatttaatttaatctatcagctgaacttgatcattcctatttggaaccctttttcacttgcttccaagacatttcattcactagtatctctcctatgataatcctggcctttttttcttagtctttttgcttcttctttctcaactcccaaccctgaaatattggtgtacactggagctaatcactggaatatttttatcttcactctcaccatatgtgatccccaatctcatagcttcagatttgtatcctgaagatctctaccttcttcctctccctaattcccagactcacatatccaactgccaactgacatttctactgaaacatctaataagcatctcaaatttaacacatccaaaaacctgctttttacttctcctccaaaatgttctctgtagttttccgtaattccctacatgagttaataattctattcttgcactttatcaggccaaaaccttggtgttatttatatttcactatctgccaccatatccaatcaaaaataaaatcttattacatctattttagaaatatattcaaaatttgactagtcattgctactcatgctatcaataatctggtccaaaccactaccatgtgtctaaagtactgcaatagtctcctaaatagtatccctattatacccttgtagttctccagtacattctcagcagaaaaactgggtgagcttattaaaatgtatgtcatatcatgtcataattgtatttatcaacttggctagattaagggattcctagatagctagcaaaacattatttctggatatttctgtgatggagtttctagaagagattagcatttgaatcagtagactgagcaagaaagatagatcctaaccaatgtatgtgggcaaaatccactctgttgagggcctgaatggaacaaaaaaactaagaaagggtgaactctctctcattttttgagctatgaaatccatcttctcttgcccttgggcctcgagactcaggacttacatcagcatcccccacctctacctctcttcaacctcagactgggagtcacaccagctcccctgtttgctgttacataggcctttggactttaactgaattatactaccaactttcttactttatcagcttacagacagcatattatgggacttctctgccttcataatcatgaaagctaattctcttaataagtctcctctttagatagatagatagatagatagatagatagatagttacatagatacatagatacatggatacatagatgaaaaaagaaagaaaaaggaaagaaaagaaagaaagaaagaaagaaagaaagaaagaaagaaaaaaaagaaataaagaaaggttctattggagacttttgactattttgcatagaattagattaaagcccgtctttactacgttttgtatcgtcttgctccaaaaatatctcttcaacctcatcagcaactattcttccacttacttggtgtactatagtagcagtgccttttttgttgtctcttgattacataacaaatatattaaccttaggacctttacacttctgttccttctgcctagaaatgctcttatccaaatatctgcatactggcttccttattatcttaatatatttattgacatcttgtcagtgagactctctctacactctgtaaaacttcagcacccttgacaactttctcaggccagaaccttggtgttatttatatttcactatctgccaccatatccaatcaaaaataaaatcttattacatctattttagaaatatattcaaaatttgactagttattgctactcatgctatcaataatctggtccaaaccactaccatgtgtctaaagtactgcaatagtctcttaagtggtatccctattatacccttgcagttctccagtacattctcagcagaaaaactggggtgagtttattaaaatttctttctttcatctatgtatctatgcatctaggtgtctatctatctaagaggtattgctctttctattgatttattatttctatgactattaactacaaaaacttatattctcacggttgcgggaagtctgccatcagggttccagcatggatgtgtggttcggttctggtgtaggtttcttcctggcttacagatagtcccttttttgctgtatgctcacatggccatttcttggttgatgcctgtagaaagtgagaaagagctttccctcttcccttcttataaggctgtaagtcctaaaggagtgggatctgatccttatgacctccttaaactttgattatctcttcaaagttctttcttaaaatataataatattggaagtttgggctttgacatatgaattcagtatacacttcagttcataatgatgatataaagtgtatgtataaataaatctatttatcttgatgatttttgctttctttctataatgtaagctccatgaagtcttaggtgtttgtttgtttaattcactgctgcattctcatgactaaaaattggtctggcacatggagttcaaacgtatgtatgcaaatgtgaaccgataccaaattatcagagcacagtttggcaatatacattcaaatcacaaaaaaaaaactatattctctattggtaatttcagtattaggtactgatactaaggaagtaagcatttgcttagattcagcactttttctgagaaccaagattgaaaataacctagtaagccacatgtaatggattagttcaatatattctaatgttatatagtaggatattatgtatcacttaaaaagattatgctgaagtatgtttaacattttggaattattatatattattatataatgtatatataaagaaatatatacttcaaacattattccatgatattaaatacttcagtataatctttttgtattatgagtatttgggaaagtatcttataaaagttttaaaatacctgctttgttatttttatattaaaataatagagaaatacttaaatctgtagacagtggtttcttaggtttgctattaattgcaaaatataattggggaagggttatttatattttccaaattgttcacaaaaatatgttgattgtataatcataacgtatattaaataatttgatataagaatcacactataaattattacaaagaaataatgagaaattattaacctttgcatttggaatgacttctataaaaatgaaaggcaatatactttataggtaaaagttaaaaaattacttttatgaaaaagaaaaatctgagaacattgtcacagaaaacaaatcttggtctcagatcaactattatgttggtctgttttttttttttaaagttattgaatgcccttcctttgagagaagatgctaaaatactgctgcacacaaaaatattatataaaacgtagacaaaaaggaacttaaaaaagattgtactgtgggatgcttgaagtttatacaaacattcaaatgtacagattttatagtttggaaatttagacagaaacagactgccaacattctaggtcatcctgacccaaactcttcctagaatcgatttatacagatattccattctatttcttatctatgcttgaaccgaataccaaatcacctgaaaaaaatactgtgacaacataaaagatgtcagtaaatgaaatagattcacatgcttggaggaaaagagtactgtaaagatgccaattctttcaaaattaatacataaattcaataaaaatccatcctaaatctctttttgatttgtttgcttttttgtggttgtggttgttttataacttgacatactgattctaaatttcatcttggagattaaatgtatgaaatagctaaggaaataatgagaaaaaaagaagtatggagagaggttttcatcataaatctttattaatggaaagtgtggggctgatgaaggaatagtcaaatagatcaatggaaagcatggagaatatgtgtatatgataatttactatgtaataaaggtggcacttcaaatcaatgaggaaagatttgattattcatgaaatgactacgtgtttggaaacagaaaaagtttatttcctatataatgttaaatacaaaaataaatttctgcaagattatatatggaaataaactataaattatgaagccaaatataatagaatatttttctaattttgagataagaaaacatatttaaacatttcataaaatctaagtaaaattaaatatacaagtaagaccagataatattttttaaagtttatgtagtgaggtatttcatgaacaaactaaatagaaaaagaatttattatgtgaactgttttaaagcaacttttagctgttaatacgtcagcactaattgcaattatacaacagttttggagagatatttgctagaatatataaagaggcttgaaaattgtgacagcctttatgttagatgctgtggtgtgccagaccatcaggaaagaacttattcctccactttttcttgggaatgtcggcagcagaaaaccctctttgggaacagctatgctgtgtaaatccttcttacctgaagtcttgctcccttcccttaaccacctcacaaccggtaactagtaaatgcattggtaaaaagatttagcccttctacctcaactcaggataagtctgaaggagtatttcagcttacagtttcacatgaagttctctgagatcactttgatcatgcatcaaagcccaaattctccctctacccaattcagcgctcttccctgccaccttccttgaagaaatccatccatctcaaagttaaatatctgggaaattgacctacaagtagaaaatgaacccagatacagggaaaaatatacagggtcatcgagggattgtttacaataagaaaaagcttgaaaacacctaaatattcatatattcacatatgaatatttgaatataatatacacatatataatatgtatatatacacatatgcatatgacattgtaatataatgcagcaattagatttacttgcaaataatgtgtgatagcatcagaaattttactgttacaatgttaaatgaaaaaaaagtaacttttagaccagtgaaactactctgtatcttgctataatggaatgtacatattattatctatgtccaagcccacagagtgtacaacatcaagaatgaaccctaatgtaatctatggactctgagtgatgaggatgtgtcaatgtatattcatcaattatttaaaaaaaatgtaccactctggtggagaatgttgataataggggagtatatatctgaggaggtatttgggatatctttgtaccttctgcaaaattttgctatgtatctaaaactgctctagaaaatagtctaaataaactaattaattaactacatttttaaagttaagtaacaaaacaatttatgtaatgtgattcctattatgtaaacacatgcatagaaatgaagagaagaaataaatatacagtgagtaattctttttctccctatgcttctaaattttctgtttccctaaatgtcatatataaattagaaaaataatttatattttttaataaatctgttaaaatggtgatccagaaagataattattaccttcaatttatacagtttataactgcaaatttgagacttattaaagcaaatcatgtcccattcacataatactatcagcagcagatttgagagtcaaacttaagtgtttcaagtgcagtagtctttcgcttgatcttcatacactgtaaaagaatcatagtatatgctaatctattttatagatatatatgtgtatatatatatatatatatacacacacacacacacatacacacactcggaatggcttagtcaacataaacatggcctgagttatataaaatattgttatgattaaaaagttaaaaaccttacattgagttaaagatttttcttagattcatgatcttttagcagaagaacatgtatatcttgtatttaatatagaataccttttgcagaggactcccatataccaggctctgaaagatactcacttaaaaaagtaaattctaacactgagaaatttaactctttatctttttattttaaaatcatgttggagttaaagaagtgtttcaaagacagtaaagagacttcccttattcctttctccaagttccccatatgttacataatcatcttacatcaatcaaagctaagaaattaatgctgatacaatattattaacaaaactataggcttattcagattccaccagttcttccactgacatctttttatctgtccaaggatctaatctagagtcctacattgcatttctttgtcttgtcttcttactcttttctaatatgttacagttcctaagtctgtctttgtttttttatgaccttggcatttttgaaaaactctggttaatggttttatagaaagtgcatcagtttggttttttctaatgtcttctctagttagattgaagttatggatttgagcaaagaacaccacaatggtgaggtgccccttagtgctttatgtaaggtgtgtgtgactgtaagtcttaatactgataatattaactttgatcacttggtgaaaatggtatcttccaggtgtctctctagtaaagttacacttttatactttgtaaataatatttatttggggagatattttgagactatgcacatatactgttttaattaaacacatcctcttcttaatttgcacaataatctctattttatgcttacagtaattattacagtgttctaacaatgatattctatttctttctttcttcaaaattgattaattaaaactcttctgtaagaaggaattgtcccttctctttattatttctttatatcagtttggcatatgagtatttattttattttatgagcaattattttattatgctacaattcaacattatcattttttttgctgatcaaattgttccagctttggagattgggacctctttcaggttaattcttaggtctttcaaaaggccccactctttttaattgaaacttccttctaggaacataaaatgacccacatttaatttatatttttcttgcatatccctagaatcaatcacatctttaaagagtcctggttccttgtacaggagaatactatttaaaaataaagatatgttgggaggcatcaagtttgttcactgctactagggtacactgcctataggctgctcagaagacaaagctagaaaacttatatatgtatatatactaacccatgtttacacccacctatatccatctctctctctgtgtgtatctacatgtgtatatatattttatacagatatctttgactccgctccaggagcacagggtttttttccattctctctttgcttaattatgacatctatctttaacaattctctttatctatatttgcccatttattcagtccaagtatagctataaaatagtttcagaatctgaccggtttccttgtgagaagtagccattttaatcagagtacagagtttgtgtacagttattttgtttttagcttcacaatatccagtcaaaacactgttttctaaagttacttcggtaagagcttttcttctccactccctatatttagagatgtcattgatgtgtaataaggttgaattcatttgtcacagtctatggtccttcttgtttcctatatattctggtgaaatttttatttgcatacagtaaaattgtctctttttttgtacagttctatgggctttggcaaatgcatagatttttgtctactatcataatgtcatacagaagagtttcatcacccccaaagttgctctatgctccacccacccccaaaccctgggaaccagcaactaatccttataattttgccttttccagaatgtcatataaatggaaacatcataaaacatgtactcttagggttttgtttctctcacttatcaaaacgcataagatttatttatgttgctgtataaaacactacatcatgctctttttggttgctgagttgtattctattgtatgagtatactaccatatattaattcacccatttaagaacttctgggttctttcaagttttttgttgttataataaagctgcttatacaaaaattgatgtccaagtttttgtgtgaaggtaagttttgaattcacgtggtcaaaaaacagagtaagattgatggggttggatggtaagtgtacatttaactttataaaacacaaccgtgtgcaagttagttacataagtaaacttgtgtcatgggagttcgttgtgcagattatttcatcacccaggtattaggcttagtacctaatagttatttttcctgaacctctccctgttaccctctaccccctaataggcctcagtgagtgtgtgttgttacttaaaataaaagttaaaaaaaaaattggaaaatatgagtcacaagtataataatgctctctgaatattttggccatgatgaagcaggagaaataaaccatttaagagaattttttaaaaataattcaagcagttttctcaaagtggccataagttcgtaccatcaatgtagggcagtttcagttgctctgcatactcgctgattcttagtattgtcaggttttgttattgtttgttttgttttgccattttgatagctttgtaatggcatcacactatagtttgaccttacattttcctaatgaagaataatattgtgcatgttttaaaatactcatatgtcatatgtattggtctgttctcttgctgctagcaaagacatactcgaggctgggtaattgttattttttatttatttttatttttatttttatttttgtttttttttacaattttctttttctttttttttacattttattttatttttttatttttttaatttattattattatactttaagtttcagggtacatatgcacaatgtgcaggttagttacatatgtttacatgtgccatgctggtgtgctgcacccgctaactcatcatctagcattaggtatatctcccaatgctttccctcccccctccccccaccccacaacagtccccagagtgtgatgttccccttcctgtgtccatgtgttctcattgttcaattcccacctatgagtgagaacatgcggtgtttggttttttgttcttgcgatagtttactgagaatgatgatttccaatttcatccatgtccctacaaaggatgtgaactcatcattttttatggctgcatagtattccatggtgtatatgtgccacattttcttaatccagtctatcattgttggacatttgggttggtcccaagtctttgctatcgtgaataatgccgcagtaaacatacgtgtgcatgtgtctttatagcagcatcatttataatcctttggttatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaactgtctgttcatgtccttcacccactttttgatggggtttttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtgctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaacagggaatcctttctccattgcttatttttctcaggtttgtcaaagatcagatagttgtagatacacagcgttacttctgagggctctgttctgttccattgacctatatctctgttttggtaccagtaacatgctgttttggttactatagccttgtagtatagtttgaagtcaggtagtgtgatgcctccagctttgttcttttggcttaggattgacttggcgatgcgggctcttttttggttccatatgaactttaaagtagttttttccagttctgtgaagaaagtcattggtagcttgatggggatggcattggatctataaattaccctgggcagtatggccattttcacgatattgattcttcctacccatgagcatggaaagttcttccatttgtttgtatcctcttttatttccttgagcagtggtttgtagttctccttgaagaggtccttcacatcccttgtaagttggattcctaggtattttattctctttgaagcaattgtgagtgggagttcattcataatttggctctctgtttgtcttttgttggtgtataagaatgcttgtgatttttgtacattgattttgtatcctgagactttgctgaagttgcttatcagcttaaggagattttgggctgagacaatggggttttctagatatacaatcatgtcgtctgcaaacggggacaatttgacttcctcttttcctaactgaataccctttatttccttctcctgcctaattgccctggccagaacttccaacactatgttgaataggagtggtgggagagggcatccctgtcttgtgccagttttcaaagggaatgcttccagtttttgcccattcagtatgatgttggctgtgggtttgtcatagatagctcttattattttgagatacgtcccatcaatacctaatttattgagaatttttagcctgaagggttgttgaattttgtcaaaggccttttctgcatctattgagataatcatgtggtttttgtctttggttctgtttatatgctggattacatttattgatttgtatatactgaaccagccttgcatcccagggatgaagcccacttgatcatggtggataagctttttgatgtgctgctggatttgctttgccagtattttattgagtcaatgttcatcaaggatattggtctaaaattctcttttttggttgtgtctctgcccggctttggtatcaggatgatgctggcctcataaaatgagttagggaggattccctctttttctattgattggaataatttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggggagtgtatgtgtcgaggaatttatccatttcttctagattttctagtttatttgcgtggaggtgtttgtagtattctctgatggtagtttgtatttctgtgggatcggtggtgatatcccctttatcattttttattacgtctatttgattcttctctctttttttctttattagtcttgctagcagtctatcaattttgttgatcctttcaaaaaaccagctcctggattcattaatttttttgaagggttttttgtgtatctatttccttcaattctgctctgattttagttatttcttgccttctgctagcttttgaatgtgtttgctctgcttttctagttcttttaattgtgatgttagggtgtcaattttggatctttcctgctttctcttgtgggcatttagtgctataaatttccctctacacactgctttgaatgtgtcctagagattctggcatgttgtgtctttgttctcgttggtttcaaagaatgtctttatttctgccttcatttccttatgtacccagtagtcaatcaggagcaggttgttcagtttccatgtagttgagcggttttgagtgagattcttaatcctgagttctagtttgattgcactgtggtctgagagacagtttgttataatttctgttgttttacatttgctgaggagagctttacttccaagtatgtggtcagttttggaataggtgtggtgtggtgctgaaaaaaatgtatattctgttgatttggggtggagagttctgtagatgtctattaggtccacttggtgcagagctgagttcaattcctgggtatccttgttgactttctgtctcgttgatctgtctaatgttgacagtggggtgttaaagtctcccattattaatgtgtgggagtctaagtctctttgtaggtcactcaggccttgctttatgaatctgggtgctcttgtattgggtgcatatatatttaggatagttagctcttcttgttgaattgatccctttaccattatgtaatggccttctttgtctcttttgatctttgttggtttaaagtctgttttatcagagagtaggattgcaacccctgcctttttttgttttccatttgcttggtagatcttcctccatccttttattttgagcctatgtgtgtctctgcacgtgagatgggtttcctgggtacagcacactgatgggtcttgagtctttatccaatttgccagtctgtgtcttttaattggagcatttagtctgtttacatttaaagttaatattgttatgtgtgaatttggctgggtaatttttaaaggaaagaagtttaactgactctaagttccacatgtctggggaggcctcacaatcatggcagaaggcaaaggggaagcaagacatgtcttacatggcagcaggcaagaagaagtgctgagcaaaagggggaaaagccgcttgtaaaaccatcagatctagtgagaactcactcactatcacaagaagagcatgagggtaactgcccccatgattaaactccctcccaccaggtcccttccatgacacatggggattacgggaactacaattcaagatgagatttgggtggggacgcagccaaaccatatcatcatatttacaatttctttagtaaaatgtcttttcaaattctgaccattttttatctgctgtttattttcctattgtgaagctttgggggttattctgaatagaagtcctttatcagatatataattttcaaaaattttctattgtggcttatcttttcattctcttaaaagtatcattaataggacaaatatttttaatttggttatcattcaatttttttttctgttataggttgttcttttgctacactatataaaaacccttcaccaaaaccaagatcacacagatattctatgaattttttgagaagttttatagtgtataaaccattttttaattcattctaagaaccatttgaattcttttaaagaaactataaagcaacttaaaggttttccttcattttgctttgttttgcatatagatttccaactgtttcattggtgtatgttgaaagactatcctttgtctctgactcttgctctcttatgccaggattcacgaaactgtgacaaattaacttgttagcctgcaaacagggctaaagctcaaacactcatcattttttgacaacaaagagttcttatgccttgaaatggacatgtatttccttgtgctaagcctccagtaagttggatttagttgatctaattaagacttgaactgggttttaggtttattgttgctattgttagttttagtacaacacagccattaaaatcttttagggattattttgtttagtgtaggtgttgatttgccagaattttccccccattatttactctactgtgaggtttaggttttccctttgtactgcacctcagaaatgctttgtttcctgcaagtaattctttctttattgaacatttgttaacttgatggtaaaggtggggaattcaatgttgttctgataaaatttaactacaaggtagatagggtgtccctgggtctctgggatattactgtaactacccagtgagttctccttgcccagtgcccagacagcagatttatcaagacaggggaattgcagtagggaaagagtttaattcacacagacatctggagttttattattattcaaattagtcttcctgaaaaccaggggatttgggtttttaaggataatttggtgggtaaggggtcggaaagtggggaatactgattgatagaatcagagataaaatcgtggtcagtagaagctgtcctcttgcactgagtccgttcctgggtggagaccacaagactagatgagccagtttattgatctgggtgtttccagctgatccatggtgtacaggatctgcaaaatatctcaagcactgatcttaggttttatattaaggatgttatccccaggagcaatttggggaggttcagtatcctgcagcctacagctgcgtgactcctaaaccataatttctaatcttgtggctaatttcttagtcctgcaaagacagtctagtccccaggcaggaagggagtttgttttgggaaagggctgttatcatctcggtctaaaaattaaactataaactaagttccacctcccacctctccacaaagttatcttggcctatgcccaggaatgaacaaggacagcttggaggttagaagcaagatttagtcagttacatcagatatttttcactgtcaaaattttctcagttataatttttgcaaaggtggattcattacctctttaatgattctctctccagcacagttttgagcccagtccttatttgccaggggtatatggttcatggcctgtccctttctcccagcagtagtgggttttctccagtgcctgaggacaattcgtttcctttgtctcagagattattgcatttcttccttagtggagatgagggagaatgcccccagagttccttactgcttttgcattggtttctattctcctctcctttggttctgtctccctacactgcagagtttttctggactctctcgaacttatttggtggggtatgtgcacactaagacttcagaaatttgccaatcatcttacttgaactctacaggaatccaggagcagcctgcccagataagccagtgttctggttttatgccatactcacaggtgcctgcctctccttagattttgggccctgcaacctccatgctctgatgcgtttaaaaaatatacagacttctggcaaatcaacacctacactaaaacaaacttcttgtttacttgacttttgttgtttttgttgtaaggttgagaatgataatccttctggctctctatatacctgagcagaaattgagtgtcaatttaattcttttctaaaatttaatttcaaaaagcaactgactgaaaatttgtacctttttattttgagagactctccataataatttagagttctaaattatgatgatttttcttaataattcattaattaggtacagctctgctgatttaatgaaacaagtaaattcatgagtccttggagcatcacagccttgagaaatttccttaatacttctgtgactctgtgactgaattagtaaagcaataataacaaattttccatctagttccagcaatataatgaagatttaagaactaaaagtgttttgctattttcaaaaggtaatttttttaaacaaaaatatttgttcttacggattattaactgcactgccatggaaattttatctagtataagtaatgtcatgactaaccaaagtagaacagaaaaattgaggacaaagaatggattctttacaacaaatgacataaaataacagtccttaaaaagttaaatcactgtatttttacaaaataaaattattttctgaccttttaaagtacatttacatttgaaaaatacagaaataattctaaaattaagggggaaaatttctgactatggaatataaactgtaatcaaaattaagctacaaaaatttgggagcgattacctatcccctaaaattttatgtgaaatttcactggaaaaactccaaaattttcttcatcaccctgcatatctgctttataggccccattcttattagaagaaatatcacatattaaggacagttataagatgaagaaggatgctcaaagttataaagaagctgactaaacaacaaacttgaaaattgtttcacagcaaatgataagagggcttaaggagtcattaaaagagagacttaagaataagtaggaggataatgatgattaccatttaatcctggttaataatgcaaaggttagaagtcatatacagtaacttgcagtgtattattttaatgttttattactgtgatggaaagcatctgacataaagattgattggatgcaagtcaccccatcaactcttctgtcgaagtgggtaaatctctttgagaagatatgtctgcagcctgcctgactctgacctactgtgttgagaacaactggactataccagatgtgtttcattctgcttattattgtgactcagaaatgctttgatcttacaaaactttaactttgaagattaggcctgatgtgaaacaaggagccattataaggaataaattccaaaggcctagatactcacacctttaacatacagatttagtaggaggaattatatttatagaaacatgaaaattaatttgttccccataattgaagcaatgaactattttttaatgaattcagactaatgatcttaaattattttctgattgcgaagaatttcttttttaaaaggcatatttgaataacaaaatttttttcacctctgaaataaagtcccaatccttttatacaaggtgcataaaaaatctcggtacaatgttttttccaagttcaactttgcctgattttcttcaacaaaagtctactgctaaaaaaaatctgaatactactaaccattctacttatttttttatattatgctttatttttgtaacacaatgtatgaataaattaataatccaagagaattaatatgcttaaaatgaaatacaacagtttctgctctattttcagacatttcaaatcagcaaccaatgatagttttaaatttttcttttgatgtttatcaacatatgccacaaagcctaacctattatttggctataacccttgtttggtacttaaatgtgctggcattaattatttattatttctcgattgtttatatttattaaagaaactccaaaaaagggccatgcacttgctatgacaatttccctagtcccgtaaatagcgtactaattgactaatttgaagttgtgtctctgagtgtatctggtttaccatgattcatacttctattgttacaaaaagttcctccaaatgcttttaagattctcatttacaacataagtagtcatttgcaaaatatcatgataatctacataaagctataaatataaataaatagttgaaggtattgttgaacaattttttaaataataaatggaaaatggaataaacttttagatatgttcaaaaagctgaaagagaatttgtatgtttgacaaagaaaacatacaatttaagtatttccctatagaactgttaataaagaattattaacaaagagttgagatgttggtatttgtgacatgatttttcccatttgtagctttcatcttggcttatttaatgctgtatttttttcttgcagaaatagctaccttagtctttgaacactggaattatccatccattgtgttttcatttaaataagagcacattaagattctagatgattaatttttttataaaaagagatataaatcaatgaaaataccctatttttacactagatacgtgtgaaaagtgcaaccattgcatttcagtttcaatagtggcttctgtttacatattgttatgttttaactggatgatagacctgtacaaccaatattataaagtctattttaattacatcagaattggtttattctgagatgtttgctctaaatctaaaattttaatggatctgtaataatcctgactttgtgtaagtctgcatatatctaagtttcatcttgtaaattaaagtgaaaacactagggtaatttatgtatatgttgacttagcatcatacatatgtgtatgtttatatagatatatgtgtgtgtataattttactcataagttaaatatatggaactcttacaacacacaagacactatctttagtaatcctcccagaaaccctataggtaggattatatatattaacctccataccagcacaattcagacagagaaaagtaacactattaataattttcctggggcaataggcaaaattcaggatgaatagtcaccccacctagagagtaaacattttccagactaactcatttgagaatgatttctgcaattataaatgaggacaccaaagtttagagagacaaaggaatttattcaagtcacacatctattaagcacattaggtaaaattcaaatttaggatatataatgagagagactcctattatataaaatataaaaatatagtagtttcagaacagaaattgtagcatattagcaattgattaaatgtacatgtggggttttttggaattctgagagacatatgtctggaaagacatacaagcaaactgttaacagtggttacccatgaagaatgagtggttggatatggggaaattttcactttggtatgtataaatttctccattttcaattaccatacaatctatccccctatgatctcctgacacagccaaagagcatgtgttattttactgaaagaaaatatgtcaacattatttatattttaactttttaaataaaagacacacaaaagttaacttcacaaacatcctgtacacataaatgacatcctgctttgaaagtaatagttaggattacactaatttcaggtttatcataactggagctaatattttgtattttaataaaaaagctttaaaacattttaattgtctaaaacattgaaagtttgaaagtatagtcatatttcagtgagaataaaataggttatattaaataattttaaaatgcaattaaataatggactctacttttcaaatctaattgagattgtatcctattattttcttgctttaaaagtttttggtttagataaataaaataattagtttaataaattattaagctcatatgtttgtatagaaacacagaaaaatattcacaatgataagatcttatattacagtaaatgaagtaaatcaaagtcctttttaagtcaatcttggttttcataaatttcatacctcagaggctcatctaaattatgagtgactttgttgcaagtatactggaaactttatagtcttagaagggaagattatttgcttaaagaaaaaatttacataaaattttgttccataaaatacaaatcccaaataaccaaagtagccacacaattttagcgtacttttctatgcaaggagaagaaagaaacaatcctgaagtggacaattgcttgaaaagaatcactggcaactcattagagagttacagctacttgtggtactctataggattaaggtcagttactctttcccttatacccagtagctatgcagtaaaaagtttggtaactggaagctatcaattttgaagtgaggaattgatagaaattgtatatacatttgtgcttgattgataaaagttaggatgtgagaattgttttttaacaagcataggccttatcctgtccattcttacccaaacaagactgatgactcaggaggctgaacttctgttttatccatctgtaaaagggagataaaatagcataaacatcaaagggttgttgtaagtgttgaagacacaaaggatgtaaatagcatgtattatatgtaaataaaaggagatatgtggtataattaacttttttactagtattatttaaaaataacagaataggcttaaggaatgaatacaaactaatatattttattataaaaaatgtctgaatttcagttactttaaaaaccgaacagctatttacgacctttcatatgtatagcataatgaaacaagttctatcattttggaaaaacagaggatatctgattaaaaataatattttgtggagagattgttccaagatggctgaataggaacagctgtggtctgcagctcccagcatgatcaacacagaagatgggtgatttctgcatttccgactgaggtacctggttcatctcattgggactacttggacagtgtgtgcagcccacagagggtgagctgaagcagggcggggcacctcctcacctggcaagcacaaggggtcaggggatttccctttcctagctaagggaagccttaacagacggtacctggaaaatcgggacactcctgccctaatactgcacttttacaacagtcttagcatatggcacaccaggaggttatatcccacgcctggcttggcagatctcatgcccacggagccttgctcactgctagcacagcagactgagagcgaattgcaaggtggcagccaggctggggtagggacatccaccattgctgaggcttgagtgggtaaacaaagtggccaggaagctcgaactgggtggagcccaccacagcttaaccaggcctgcctgcctctgtagactccacctatggaggcaggacatagctaaacaaaaggcagcagaaacttctgcagactcctagtctctgataaaacagactttaaaccaacaaagatcaagagagacaaagaaggccattacataatggtaaagggataattcaacaagaagacctgactatcctaaatatatacgcacccaatacaggagcaaccagactcataaagcaagtccttagagacctacaaagagacttagactcccacacaataataatgggagatttcaacaccccactgtcaaaattagacagatcaacgagacagaaggttagcaaggatatccaggacttgaactcagctctgcaccaagtggacctaatagacatctacagaactctccaccccaaatcaacagaatatacattcttctcagcaccacatctcacttattccaaaattgaccacatagttggaagtgaagcaatcctcagcaaatatgaaagaagacaaatcacaacaaactgtctctcagtccacagtgcaatcaaattagaactcaggattaagaaactcattcaaaactgcacaactacgtggaagctgaacaacctgctcctgaatgactactgggtaaataacgaaatgcaggcagaaataaagatgttctttgaaaccaatgagaacaaacacacaacacgccagaatctctgggacacatttaaagcaatgtgtagagggatatttatagcactaaattcccacaaaagaaagcaggaaatatctaaaatcaacaccccaacatcacaattaaaataactagagaagcgagagcaaacacattcaaaagctagcagaaggcaagaaataactaagatcagagcagaactgaaggagatagaaacacaaaaaactcttcaaaaaatccatgaatccaggagctggttttttgaaaagatcaacaaaattgatagaccactagcaagactaataaagaagaaaagagagaagaatcaaacagatgcaataaaaatgataaaagggagatcacaaccaattccacagaaatacaaactaccatcagagaatactataaacacctctactcaaataaactagaaaatctagaagaaatggataaattcctggacacatacatcctcccaagactaaaccaggaagaagttgaatccctgaatagaccaataacaggctctgaagtcgaagcaataattaatagcctaccaaccaaaaaaagtccaggaccagatggattcacagccgaattctaccagaggtacaaggaggagctagtaccattccttctgaaacaattccaatcaatagaaaaagagggaatcctccctgactcattttatgaggccagcatcatcctgataccaaagcctggcagagacacaacaaaaaaaagagaattttagaccaatatacctgatgaacatcaatgcaaaaatcctcaataaaataccaccatgataaagggggcttcatccctagaatgcaagcctggttcaacatatgcaaatcaataaatgtaatccatcacataaacagaaccaaagacaaaaatcaaatgattatctcaatagatgcagaaaagtcctttgataaaattcaacagtccttcatgctaaaaactctcaataaactgggtattgatggaacatatctcaaaataataagagctatttatgacaaacccacagccaatatcttactgaatgggcaaaaactggaagcattccctttgaaaactggtacaagacagggatggcctctctcaccactcgtattcagcgtagtgttggaagttctggccagggcaatcaggcaggagaaagaaataaagggtattcaattaggaaaagaggaagtcaaattgtccctgttagcaggtgacatgattgtatatttagaaaaccccatggtctcagcccaaaatctccttaagctgataagcaatttcagcaaagtctcaggatacaaaatcaatgagcaaaaatcaccagcattcttatacaccaataacagacaaacagcaaaatcatgagtgaactcccattcacaattgcttcaaagagaataaaatacctgggaatccaacttacaagggttgtgaaggacctgttcaaggagaactacaaaacactgctcaaataaataagagaggacacaaacaaatggaataacattccatgctcagggataggaagaatcaacattgtgaaaatggccatactgcccagggtaatttatagattcaatgccatccccatcaagctaccaatgactttcttcacagaattggaaaaaactactttaaagttcatattgaatgaaaaaagagcctgcatagccaagacagtcctgagcaagaagaacaaagctggaggcatcatgctacccgacttcaaactatactacaaggctacagtaaccaaaacagcatgacactggtaccaaaacagagatatagaccaatggaacagaacagagacctcaaaaataataccacacatctacaaccatctgatttttgacaaacctgacaaaaacaagaaatggggaaaggattccctatttaataaatggtgctgggaaaaatggctagccatatgtagaaagctgaaactggatcccttccttacaccttatacaaaaattaattcaagatggattaaagacttcaatgttaggcataaaatcataaaaaccctagaagaaaacctaggcaataccattcaggacatagtcatggacaaggacttcatgactaaaacaccaaaagcaatggcaacaaaagccaaaatagacaaatgggatctaattaaactaaagagtttctgcatagcaaaagaaactaccatcagagtgaagaggcaacctacagaatgggagaaaatttttgcaatctacccatctgacaaagggctaatatccagaatctacaaagaacttaaaaaaatttacaagaaaaaatcatacaaccccatcaacaagtgggcgaaggatctgaacggacacttctcaaaagaagacatttatgcagtcaatagacacatgaaaaaatgctcatgatcactggttatcagagaaatgcaaatcaaaaccacaatgagataccatctcataccagttagaatggcaatcattaaaaaggaaacaacaggtgctggagaggatgtggagaaataggaacaattttacactgttgatggaactgtaaactagttcaaccattgtggaagacagtgtggtgatttctcaaggatctagaaatagaaataccatttgatccagtgatcccattactgtgtatatatccaaaggattataaatcatgctactataaggacacatgcacatctatgtttactgcagcactatttacaatagcaaagacttggaaccaacccaaatgcccaccaatgatagactggattaagaaaatgtggcacatatacactatggaatactatgcagctgtaaaaaaggatgagttcatgtcctttgtagggacatggatgaaactggaaaccatcattctctgcaaactatcgcaaggacagaaaaccaaacaccacatgttctcactcataggtgggaattgaacaataagaacacttggatacagggtggggaacatcacacactggggggctgtcatggggtggggggctgtgggtgggatagcattaggagaaatacctaatgtaaataacaagttaatgggtgcagcacaacaacatggtacatatatacatatgtaacaaacctgcacgttgtgcatatataccctagaacttaaagtataataataaaataatataatattttgtaattatttgcccttagtattctactttaagcatgaaagtgcatgttctttgaatatggtgtttttttctggcccccttcactatagaatctaccacttagtagtgtgtcaactagatattgacctttaattattactgattattgctgatgttggtgattaaagaatgactaaaaagtgatactcgtgataaaattggagagaaagaaataaagaaggaattttggtaagaatgaaaaaaggaaagtaagagaactgttttgtatgtgatttactgcaactgattacgtgaaagttgaaagtggttctactatccggcctttaatcttttttaaaagagcctacactgacttggaaatgggtgaactgatacagagaaaaactgaggggaggatactggtgtcaaaggactcactttccttccatctgtaattgcaggattatctgccatgcttccagaaacgggagcaagtgagagaaaggggaagacagatggcttcttggtctccctgctgtgcctagatgattgtacattttagagggaaaaaaattaataatctgattttttaaatcctcacccacacttgatcctcagctaaatatttttgaaagtgacacttttaggttaactttcatttctttcgattacactaccctctgctccagtttttagttgagatttcaaaggtcatgctccaaaaaaagcactttattgtgatattctgagtcaaaattaaagtgaaaaattgtgactagtctcataggaactcctaagggagcaaggctttgtcttcttttaaacacagtatgtttgagggaacttcaaaggttgtagaataaaaattaattttgaaatcacataaaattcttatctctaccctaagtaatctgaagagttttctacttctactcaaaagtcctataattgttggaaaattaaggctacaatgcaatttaaggtaatttggaaacaaatacgttcatataactgaggggaaaaatgatggtgctgaagtggttttcgtgattttctcgtttatcctcacacagtatatggtagcatgttgttatagtgagcaggtgggcaggtaaagaaatgataccagttaagtaatacattttccagttgtcattctgctgttgccaataattacttgattttttcttaaagaagcctatttaacattttgagtttggggattacaatcatgtacttaaagttaaaactcattttagtcaagtaacaggaaagaagcattatgattaaattatgcttaaccctggctttcataaactcatcaatattatttgttcaatttgagttaaattgtacatgtaaactcatatttctacacaaatatagagtgaaagcagttgtcacctcccctagtttcattaacactctcatagttaaatggaaatcaaattatttacaactatcatctccatctctcactggtctgtctcttatttttggtcatcattggcaattaagatttcccttactgtcagcatcaacattttcctatagctaaatacagcattcttcttagacgcttagctctgtgctaagagcagatgatcactttgggtttttccgctatcccacttctaaaattaaaacaaaaactaaaacaaaaaacaatgtctcattttggtgttaataatttgatatgtatatttaaaaaggcttggggactaggccaacacccacctcctcttcaccctgagaagtgcctctactacagaaccacagatactagccagcgaggtttgtgacttttctatgaggacatgaccttgtccctcagtccagcttacctaacaggggctgtcagtcaactgcttagaaacatcactattgtgtctgctgtattctcattgctgattttatgggatttaaggtgataagcctaatccttaacaggagcagtcagtgctatacactcagtgtatcgcaaatattcccatcaccaaaataagcctccaagggagctcatcgatcaactttctgttattttccactgcctctgaactggtgggcccttgagacatcctgtatacctggatctcctatcttctatatgcaggttgtggggagccaggagtatatttcacatttttgctactctattggaccaaggttcgaacttcctttgcctattttttttctcttaagccaactactactcctaagtcttgctgccttttgggatctgaaagtcaaaagcagtccttctcaatgtgtaatatccctgttttattccttgacacttctttccagtgtctgaagagcttccccttcccatgttatgggaactcatcctattttatatattttatctttctagatagtatttgctcttccaatatctaatgcaataatgagatagtgctgaatgaaatggaacaagttaccaagaaaagaaaaaaaaacatgtgggagaggcaatggagatggagtggggaaatcagttttattatcccattaatatgaatgccaagttttatatatcattctatgtagggagacaccctgaaactattgctacagaataaaagatgaattgctcctgattattgtaaatacaaaattgcatgcaggattgtgtaaagacaatgccaggttggactgccagaatgagccaataacgcatgatgtgcttccccctgcagagagcctatgaatggatgtgcagtcgaggaggtttcacatcaccaagattcctatcccagaaaagcagatgttcatagctctgggaatggaatgtgacccttgtggagagcctataaacggatgcatgggggggtgcctgtccatatggataagatagggctacaaacgcccttatcttgccagggctcttctaggcctctttagggttaaggcatactcccttctgagaatttctggtctaactggttgtgtagcttcacatcctgtttctatggattgtttgtaaccagcttttgctgcaactgttactgcttattaatatcttgctaatcataggttgtggaaagactgtgtttctgttttaaggctctgttagaaattactgatgcacacattatattgtaaattcttatctctgtatactgtacttctgcatacagatgttatgttaaagaattacttcatccccatgtgaccatctcacctcataatcaaatgaccctaaatccctcactaacctatccccaccctcactaaacttaataataaatgctggtatatccagtgcattggtggcaccacgggaccagaagacggtgacccccctggacccagctttcagtatcttgtgtgtgtctattatttctcgacctgtcaatccacctgggaacaaagagagagccccgttacattgcgggctgctggccagagcccacaataattctaaagaagataggaaagtacagagaccaaaatgccaagaaacttattttccaccccagacattctttttataggaaggcctttacatctgtctgataggaaccctccctatgtcaaatatgccttcttccctaaaagcacttaaccccttaccagtatgtgctattgttaccttcaggtaataatagctgaaatgctgctcagaaagaaatcagattactaaaatgggggaaaagtcttgtggtggagtagaaaaatgcattcttatcacatttggaagcatatgaaccctactgaagaataaaagaagagaaataagaatattgattaagggtcataaatgtgggaaagtagtgctgcagatgaaataatatagagattttgataaagaagctagagtctcagaacagaagtataagcatattgttaggcaaactttcttaagttgaaagcaatctgagcttacaacaaaaataaagcatagtatttatcaataagacattagtaaaaagagaaatgtcttgacaataatgttgaatgaaatgcaagttctataagcatactagcaaaaaaaaaaaaaaaaagacaggttacccatctgatatggttgaatgtgttccatccaaaattcagatgttgaaacttgatggtcaatgtgatagtgttaggagatggggcctttaagaggtgattaggctgctccctcatgaatgggattaaggcccttataaaaagaagctttgtgcagtgttcagatctcttgctctttgaccttatgacatatgaagacacagcatttctctcctctggaggatgcagccctcataactgaacctgccagtacagtgatcttcgacttcccagattccagaactctgagaaataaatttctgttctttataaattacccagtcccaggtattttgttacagaagcaagaccagactagaaactacacaagtgcacaattcatgataagcccagatttttccacaatattaaatgtcggaattatttaaacaaacaaacaaaaaaactaacttgaatcaactctttttcatgtgccacagactgaagtaagaacctcatgagaatgatctcacataacccccattagaactctgtgcatagttaaaactgtgtacctgttaacctacaactccccatttaaggtttcagttatgtagggtgaatacttcccaaagatcttatctactgcatggtgattatagtcaatgatacggtattgtacacttgtaatttgcaagagagtagatattaaatgtcttatcacacacacacacaaaatgtaactatgtgaggtgatggatatgttaatttgctttattggggaaatcattttacagtgtataggtatatcaaaatatcacattgtataccttaaatatgtataattttatatgccaattatgtctcaataaagctggggggaaaagagccctatgcagtatttactgttaaaatcacatttcacaacagggagaaacagaagttcaggaagctctctgattggccgttaatcatagagtgtgtacccagcaagttaggattgaaggttatatcagtcaattattgaatgaggtctacatatatgtataattaaaagatagattaacaaatattcactaagccttgtatgccacaaagaatacattagattttacagcataacatttaacagaattgaagtctgcagaaaaaagtcaccaaattaaaagagcaaaaattttacaaatttggttttatttccacaatgctaaagacacaatatagaaagtagtaataaaaactttccaatcatttggaaaatgtgctttaacagtccacttaaattatgacagttgttccaacaaattttactatatgcggtggataaggtttgaattctttctggggaggcgtctcggcctctaagaaaatatgctttaggagacttggagtacctggtcactagacaaatccactcctctgcaaatctttcttagactcaagctgaggcctttgctatattttcttcctcccaaatatttacaacttcctgccaagttacaggttcttgctagaatttctcaccattcccacaacttcctctctatggaaaaccagtcggctaagctttcagggcactcaggtaaaatctgccaggtctgctttgagggaatgattccagtatcatcaacatttttgatctgtctttgtcagacctttccactcatctcaagaccattaaggcagcctcattttcagtgaacaatctttctaaaaaaaataaaacctgaaaaactttattagcccaatagttattcctggaggaagaggagaaaaaggaaggaagaaaggaattgttgctagtcctatatagaattgccagcattttattttcccaaaattactaatttaggaaaaaaattttactacaatttatatgtattatgaatacttttttcatagaagaaatataatactaaaaataagttaaatgaatttagccttagaaaaacttattttgctaaaaattatcaaaatcttatataaaccagtattcttggatcacagtttgggaaatactaatttcttttgtagatctaatgagaagagggctgaaagttcaaaaataagaggcactgcaaaaaccacgcatcaggttaaaaactgcgcatatatatatatatatatatatatatatatatatatatatatggaaattacaaaatatcaatatcgaagacatgtggaataaaggttatctagtaaaatgtacacttgggtataatttattaatgatagctaaatggctcactgaatgtaatagaaagtagcaaccctcattgtattctatttaaaaataagctatgatattagaaacttaaacttcatgaggctggtaataccaatagaggcgtgctgagctacatagattgtgaagtagaaaagttgaacagtaaagaatgtgtttctccagcgttgtcctaattagagttagctgtgactaatggacacaaaataaagcaggagtaagtctttattttctgttttaggataaatatgaacatttaagttgtttgctatgattccacaaacttgattctcatttcaagacaaataggaaaaattaagatattatagaaaatgaaaaagtggtttcctgaattcaggttaataaattttgttgtgaaatttgtttagcataatatacactaataaaccctaagacaatagataaagtaaaatttttaattatgcaagatcagaggcacctcagccatatcacatcttaatgcacaaaatcatatcctatttcaagaggttttaacccaaagtttagaaaagaaattccgtattttatctcataaatcatgtgatctaacttagagaatgaaatcaagggctttttgctcttagtcttaaaagagacacaagaaaataaacatattcttcaatttcaatcattcatttgcctaaaatttatatcacattatttttaactttaatatgtgaaactatttcatccaggatacagaacttagtacataggtataaataaacaagttagctttttcaattaaacttacagacaggtaagaatgtaaatgctttttcctatttatcaaatactaattcaaatgcaaaatgtaaaagattttcttttagccaaataatagacaatcttattgtaatataaattagattataaatctaaataccagttgacactcaacttctgatatttacaataatcatagttaagtcattctggagcataaaagttaagtgcatgcaataaaaagctgtggaattacatatatatagaaattgtacaaaactcagtgaagtgctactaaccactcttatttcaataaaataaggaaagattaaggctttgatgctttttaaaaagtgacatcttatgaagaaaatctgcttttaagtattctttcaaaaaccaattttttacatctccaaagtagtataatttctcattatcactttatttctacatagaaaagtagacttttatgtagacaacgttgacataaatactcagatttcttttaaattaaaatgccattcacatgagattctaaatttttatatacatgagaatagtttctgccaaaatattattcttatggaaataagctaacacttccatttgattggcactacgtgtgttgacaaagctgagccaatattttccaattgggaaatggaaaagtttaacttattagataaccagaaaggcagattagaactttctctaggcaatttagtcaatagtcacaatttatgatgcaaacctaagtgtctttagttttgccttgttaattccacatttacagaatacactttgatgatttcctcccactagactatttaaagacatggaacagcaaacaaaagcgtttctgttcttatccccaaatcgattaaaaacctaagcctgattaaatgggaacattttctattctttgggttttaaaaatcctctactgaattctaatcctcattccatcccattctccatggcagtccaggaagcccaaagttcttgatcacttttgtaacaaggaaaaggcacaattcttcctgtgatgtatagaaatatttcaggaataattttacatgaaaataaaggcaaaacaaaaacatggagagctctactagttagaaagggtggctttatatttttttctaatcatatatggtttcctgacatcacaatgtatctcaagcttccagtttaaactaatcattagttcatataatctgattgtcaataaagtgataaaatttacaatgatgtaactaatttcatataaaaattattaaaaatattgcaatgctggttcttcttttgaatcccattatcttttctccttgttttttttataagatcgtttcctatacatactttttctgaaactgcatgtatataggtatatctgaactacaatttaaaatcactttcatttgataatatataatgtttctagtattatactatatcttatttttctcatatttatcttcacacattttgttttctaattttacctaattggtttcatatcctgcccccttttaaattataataagctatctttaaaattatgaatgactcatctaaaaatgaaaggctatatcataattgaagcgaggccatggtaaaagatatatttaatagtcttatgatatcacaatagcagagattaaataattttcttcagtgaagattttaaatttccaacaaattatttttcataccttttatttttattttatttatttattgttttgagatggagtctcactctgttgcccaggctggtgtgcagtggtgcaatctcggctcactgcaaccttcgcctcccaggttcaagcgattctcctgcctcagtctacggagtagctgggattacaggagcatgtcaccacgcctggctaatttttgtatttttagtagagaggggtttcaccatgttggccaggttggtctctaattcctgacttcaggtgatccacccatctcggcctcccaaagtggtgggattacaggcgtgagccattatgcccgacaatttttcttatattttaaaatccatttaaacaaatgaaatatacagtatttttactctacatataaacaaatggaaatttgattaattatgtacctttttcagtattttttaagtggacatttttagatcatcggttttttgttttacttaatgaccaaattcaaataattattttgctctgaacttcaattaattctaacaaatatccactatgttaatatataactctgttttcatttttgtcatgtcaaattttttgtctattctgacccaaatagtcaaaatgttcaattgacaacaaacctattttgaccaattctaactaattgaactaattgcttatttacctcactgagtttattaattttgttgtggttgagatacttcacatgttgaatatagatttcccttcatgttcaacattcagtcccaccatagttacacggggattcaaggagacttttgtgagtgatggacagaattctttatgtatggcaagctatcctgactaggttctaacagtcctctcattgttatcccctggctttcttaacttccatccctctttgagtaaatctaactgcatgccttttggtttttaatgcaattgctccaaactatgtgagtcagactgctttgactgacaaagtttcccatttgttgcccatttggcctcaaactatcaaagaaaaattgaaatacccatagtcatatggatattctaaaaattttcatgaggtggaatcccaaattactgaaatagaggttaaatttacagcagaacttgtagcatattcataaatgtaattcaggtactacaattcttgtctttggtcaatagaatgtgtgtatatatcactgctaagtaatggagaattttgtctgaggaatcaaagttattatttctctgatcaaattatctcctaagttactctcttcactccctatccccagctgttgaataggaaggagggaggaagaacaccaaggcggtcctgtactctgggtggtagcttgctattttttcctgttttattctttcctcattaccaaatagatatttgagattcagacatctaacactaaaaattgactataagactgagtattctcctgatgcttgaaatctttggaacatctgtctccttcacaatcttgaattacaatataaagcatgttctatttacttagctttggaggcagtatgttcatcaacctcttcttaatacttgggttttcccttatttgcagcaaaatgagagaaaactgatcttgtttcaatgctgcagctcatcatgttccctaagtctgtgtgtgagtgcgcacgtgtgccagcacaagggcacactgcctgaaaatgttatctgtgcattcactataaacacgttaaagaacttcagactatttttgtttttaatccaaaatattaatcagttttataatgctagatatctgtaagtcacataaacatagcacttaccactcaatcagtgtcagctgttatcattactagcataatcataattttttaatttatttttttcttgacacatgtttgttgagcacttactaaatgacaaacactaaactaggtactaaatgaacaaaacagatatatgaattatctttatggaattcagtactatattgttacttcttattcagctatgaaattttcactttagtccacatctgaaaaatagggataataatagctcaaaatatttgtaagaatgaaaagaatgaaatgaggtatacaaaataagtgtgtctcatagcagtgggcacaaaataaatactcaataatttgcacttatattactattaacaatgtttctattttgaaaatgttgtccaatgtggtagaagacttaatattacaataggtgcttgtcttaaatttaaaaataccatacatgtattaattcaattgaataattatatgttattataacaaagatcttatacaaggtaatatttatcattgttactatttttattagcttcgtttcttatacatagtgtggaagttattgctattcctcatatctcagttaccaggcaaaaaacttgtagttttctttcacttctctttctccatgtactcatatatccagtgagttacaggtcatccattttgagcagttgtaatagtatttctttaagtctgttaccttctattattcattgatgtaagcacaagttggtttctcactcctagactatccaatagtcttaatactgttcttcagcctggaatttcatgttccatgtagttttatggcaaactacttttctagactattactcatacaacttcatctttggaaccctcatctctggccaaattattataaacatgatcttcaccaccttttctgaacattttaacactcattctttgtaatatttttctagactcctgaaataatatcccttcaatatctaccactcaaactgcccttttcttttgacacgcttcaatttcttccttgattacaaatcttcaggcaagagtcttaactcatattgctaataaacatctgaccctttcttttgctggttaatcatgtacaggcattatacttcaaatttattagtgttcaatttttatgaatcaatcatattactatttagcatttttttgtgtgtttgtcttttttttttttctctgaaacagagtcttggtctgtcatccaggctggagtgcaatggcgtgatctcagctcactgcaacctctgactcccaagttcaagcgactctcctgcctcagcctcctgagtagctgggattacaggagcatgtcaccacacccagcaaatttttgtatttttagtagagacggggtttcaccatgttggtcaggataatctcaaactcctgacctcgtgatctgcccaccttggcctccccaagtgctgggattacaggtgtgagccactgtgcctggcctgtgtttgtcttaaattcacatgtatactgaaaatttcttgagaaaggctcctttttgaatccccaggaagaaagatttcagacattgttattggttcatataatttttatctctatttattaatatatttaatttaaaattcgtgttactactacgtttagaagtactaatactgataaaattgcataagcagtgtgtgatagtaaaccacttacacttctgtagcattttgttaatatcatttaattccaaagtgttccccccttctagtcaatggttgaaaagtatgaattacatctgaatgccagagtaaagctgacagtgtaaccataacaaaatagaacttttgattcaaacatgataggacagttatgtcaaaatgagcccaaaagtaagtgtttaaaagaaatattttcatgaaagctttccttgggggagatcagtgacctatcttttcaaagatgctgctttggatgacaatccatatttgtgtttgtgtatacaggtgaaaaactaaaacacgatcagcagtttttctacatgatgaatgtaggaagccagctaccaagtaactgctgcccatggccttatgcatcaatctattacttgccaggatgtattgtgtagaaacaacatcatgtatttaaagcctgtactctatatccagcctaaattttcatattaagataatctgaaaactgtcctctaactaatattttattctttttttgacagctcagcagcggacaccaatgagcaatttgtattattttctggtcaatttattaagtaattattggtaatgaaatttatggtatttttatcttatggcttatttgatctcctcttaaagttcacatgtaaattgccccattaatttaatgttcaatgtcatattatttgacattaaatctacttacaataaatgtagccacccaacctaattaggcaaaatgcatattataaagtaaaaaataagttttagaatttaactagaactgtgacattctctgtatattcatatggagacatttattttacaaaaataatatataataagacatgctttgatttgtatcataataatttctaatatacacacaaccatataagatagaactaatatataaagtatataacatatataatatttatgtaatatatgcatgtatatgcatatatctgtaatcaaatcattaccaaaatgacttttacattttgaaaactggtgaagactaaagattatacagccaatgttgtttctgccatgaatatgatgcacaaataaatgatatgcctgctggagttcatattgtaccatgaaagggatttagaataataaaatatatacaaagcaaggctaaactttcaatttaaaaatgttgatgatttataagagaaatctaacactagattactctcagaagtatagcaaaatataaattgtagaaacaacacttttacatttactaaggacatttaattgaattaatagcacacattagctaccattatctaaaacttcagaaagtggatttaaaaatacaattctctagaaaaccctatacctctctgaatctaaaatattacagttgtaatggtttttgtttatttttattattcattgttgatttattcaattattacagaaaccccaaaaccacacaggtatgaagtaactttttgggacaggatgtgtcctagatgttggtaatcattaaaacagtaaatttacacacatggtcccttgtaaaacttatcttctagtacaaatatcatacagggaaattttcatttggaactttctatcaaaaagacatatgcacttttattctcatcacagcaccattcacaatagcaaagacatggaatcaaccaagatacccaccaatggtggactgaaaagagaaaatgtggtatgtatacaccatggaatactgcatagccatgaaaaataataaagtcatgttctttgcaacaccatggatgtagctggaggccattatcctaagtgaactaacgcaggaacagaaaatcaaatacttcatgttctcacttataagtgggagctaaatattgaatacacatggacataaaaatgggaacaaaacaatagacactaggactgcttgaggggggaaggtgggaggggggcatgggttggaggttacctatggagtactatgcttactatattggtgacagaatcatttgtacaccaagcctcagcaacacgcagtttacccatgtaacaaacctgcacatgtagccccgaaccaaaaataaaagtagaaagaaaagaagagaatgaagtgaaaattgtgggatgaaagagaatgaaaatgttattacaagcagaaattcaaagtttgctattttggtggctgcctcgttcacacatgaatatcatctctatacaaattctgctgaataaaacagtcctttcttgtgcatttgtgtaagaaaatctttagactaaacttgttttaagttattgcacatgtcaaagtgctaataaattagcagctgcatctatctctgtaatccagtagtaataaacaagatgctttaaatctctttctaggagtaatctacatagtacacagtaagttaacccactaacatcttaacaggttgcactgttccaagtcaatataataaaaagagaaaagcaagaaagaggcccaatgccctgtttatgccaattatcagtaattagtaagcatttatttgaatttaagacatagttttaaatatattaaacattccttatatgcatttaaattttatgctaaatgctaagcaggattaggacattgtcattcagaagaacaaaaggagaaaagacaaaggataatgaagagaagatgaagaaatgaaaaaattaaaaattaacagttgtcattcaatttataaaatttatctatgagtcacatttttgttcttacattcatttagtgaggaatagcagctaatttcaattaaataaacttctctttggatctatcaaaaagtaattaaagcaaagcataacaaattctagggtagaagcttgtatagttacaaatttagttttatttgtaacatttgtaatgctatgtagagagtcaaacagaaaatctaaattatcctcattgcatagaagtaacaaataaaagcaaatacagagatatattctctagatagggaaattttaaggaaaatgacttaaaaatatcttcttcttaataacatataatttctatttgattcagtttatcaaaaatgttttaagcatcctacagagaactgagataggcataataacaagacattccactttttatgggttcattccttcaaaattgtatttgagatttttccacatttatgtatagagtggttcaactccaatcttacatgcacaaagcataagactcccaaccatagctgtatggcataaaattaatttgtagaattttcccataacatactaaatagtataaaaaacaaaaatctaaaaaaaaaattgagcaaacacagtctaatatggaacaaggtgtagagagaataggatgaaaaggtattgtaagaaatgagaagttaagtacaagggaaaaagaaaacaaaataaagtaaatcaaaattcaaaaatgccaacaagaattttgtatgaccacattatgtgtggttgctttgtactaatggatggcaatattatggtaaaagaaactgcttgtaggaaggaaagagtccctctaaaggggcagatgagtcaaaaatgcaatgtttaagaagatagtaaaccatctatgaaatgtaattctaaaagttcaaaaataacctttgtttttatgtactcaaacataagtgcatttctttaggaaatgaaattttctcttatctagaagtgcaggtggcatatagcatttgctcttctatttcagctttttttcacacacatggacgtgaacacaagaacagtatttaaatgtggtagcatagttttctgtatctccgtcttcaaatattttggaggaaatgttaatttttactttaaaagttttgctattgcaggaatttgaagccaacaagacatttaatttttgtcttctcaaatgcatgagtgagtttttaaagtatctggcctacatgacccgaatttaatccaatttttttatattaaaggaaaaaaaagaacgttattatattatttacctttaagtcttaaaattatgggaaaatatattgatgatcaattattctaaattagttaagcagacaaaaaatatttgagaaatttgaaagttctttatgagagtgaaaatctgtaaaaaaaatagtaatcagtaaatggcaaagttcttttttcagctatagttttcaaaaagctaaaatgatcatgactgccatacaaatataaaaagaacatgcgtcaaaagttttatttaatgtactaactaataaaataactagtaacttgtaaaaaaaccaaagagcatttgaaagggtaggtatttataggcaatgttagaaaaacaaacatgattcaagttcaacagtgacactgatctttgcaatctttgaggtttttttcctattacacagaaattacttgcattttcatgttaaaaagtctacaagttaacttcttttccttgttcaatggatataatattttagttgtgcaagatgaataaattctagtgatctagacaacatagggcctatatttaatggtactctactgtgcacttaacaattgtattaagggctaatctcatgtagtcttaagatatttgaaaaagaaaataaaatgaaatttaaactaagcatatattcaaaaaaatccagtaattttgtttgtctgcttctaagtttagggcaatttttttgatgctataaaatgtaagtgtaatgaaaaactctttaaaggttgatgatgatgaagcccaaacaggtacactttgtgaaagctggtcaggagattctgatacccgcttagagttaagagccacaataaagccgaaaattgttgttttacccatggggaaaaaaaagtttaaagtgttagtcttttcttattatttacaaggctatttaaatgttcaattgagaggtctcaaaaggaatcatatttttcaaggttttttttttaattccccataattccttgaaatagcaagaacaactgcctctactgctccacatactattattttattttcttcccttggtaaggtaattatgtgagaggtcatggaaaattttcgtgatgtatttatacagtccattaaaaatttaaagtttgaatcaggtttcattactttctgtgatgactgagaagagatttcctcaatgtgaaattataaaaccttattaggtgagatataaaaatgatcaattttagttagcatagtgtttgttggtccagcatccattgactcccttttgttgtagcacattctgattttccttagagaaaccatccttcctcctttctgagtatatgtgttttgcatggagctattcccaaccactctctggctccaggggtagccctaaggcctgtaccagccaatctgagtcactacaattggttcaggagtagtcacttgacacatatcaacccactgagagtcattgcagtaattatgaaagaggcaattgctgatgttgctcactgtataataacatagttgctctggccatctttgccaccacaggctgcctaggaaagatacccatacacagtaagtcagaccccacaggaaaaagtgccacctcactgatgagggcatttcagcactcagatttatctgttcttgaacccagatctattcttggactttgaattcaatgaaccaatacatctactcagttttttattttttcctctgaagcaggcacttggatttgttttctctcacttaaataaatagtcatatgcttccaaaactgccatggaaacaattgaacatataagatcaaaacccaagccaaattccagagcaggatatttagacttaagggcttagagatcatagtgttgaagatttgagaaaataagataggatattgatgagtactggatgcctatggcatacttactcaaaactcattcggttgaaaattacagaaatcaatgcaatctggttaagaaaggcttttttttaaaataggcagtttaccataagattactgaaatatatgggagaaactggtcatgtcactcgggatcaggaaccgaggcagtactctcattcctactttccctgtctgcacctctgcaccttccctacttcgtatagttgaacaagttgaaaagtagagtttgctaaaaaaaaaaaaaaaattctactaagcaaaaagtaatcaaacttggagttatttatccaggaaagagcaatgtgcctggaaaatgattagggtgaccaaaaatattaattttttttacaacccttgacacattccccaggtcacatcttgtcaattcctgagcaagtagacattgtccttgtctccggatcctaatccccaattcatggaagagagaatcctattgaatcacctaggtatggtttggctgccagaatctcactccagttaataagacaaatagggtggaggggagggacagggggagatggcagttgtcagagaaaaggtgtcattgagagttgggaagatatccaaaaagtgttcaatatacattttatggtctcaaactggtttgagcatttttccatttcctacaattgacaaggctggcacattttgctacactaaagaccattataatgaaactctacattgaataactgtcaaatggcaaaacaaattttagtgagtattgtttatgatttttctctttccttattgtttttcttttatattttttgttccttttagccacagatgctgaaacttgagttaataattttcctcacttactgtcacttggccatgcaagtctctctttcatatttattatttgccccctttctctcttctttttcccatccttgtcctcctcccattaaccataaagccaataattctaatttatttgtcttaaatcctttgaattatctgtattattgcacaaatgtaaggtacatagaattgtttttcatgcatgtatttctgtttgagtaaattttattgtgctatagacttttatctatttatttctgtcttttttctactcagtgctgcttttatggcattcatttttctgtttgtctcaccagccacttacttctcttccttacatagtgatcccctgaaatgtacatatattgcatacaattgcctactaccgcaaagctgtgacgaagtcttcttgaatgtcctgtcatgttatctgaggaaacctctgggatattttccaagaagtgaaattgcataaccattcaactgcatagccacaggaatttcaaacacttaatgtggactttatacatttaatataactgagagttgccagatagctctacaatgcctcctttattccagagtctcattcactagggtttctacatgtctaataacacttatgtttactccttattcaattattagccattatattggggtaagtggtattttttcctttaatctagcgcatctcctaaggtacttcctagctatttgtttttccagtctatgaattatttgtcaaataatatgcccatcgttagtgatttcctgtcttattttattgatttgcaggagatctttgtatctggtcactgtatctagtgcctcttctgtgaaatacaaactactaactttgttataatgaaatccacctatttttcttcttgtggtttgtgctgcttgcatctggtttaagcatatttttcttatgacatagtcataaatatacaacctatacaactatgggctttctattactttccttatttatatctttcttggctattttctactttgatatatatttcaaaaaacactttttaagcattgaacaccttttaagcatttaaaatgttggcatcagtgccaacgttttaaatgaataattaataaaaggataaatttaagcattcattgatgtggtccactaaatacaatttttagacctgaaattctactctttttttgtggaagtaatacattttaagaaaattttaaagcaatttgttgtctacccagtcatgaggcttgtttctggtaagtaagaaggatgataatgactacagaaaagtaattcaagcaaataattaaggcgccactgcagattcaaaaaacgtttgatcctggtctcagccacttatttcagttagatgtacctttaagtgatgcttgctatgaatgttttcttattgctatgagatcacgaatctatagttacctctgccttacctgaggaaaatattccatagctctaaattgacctctattattttgctaattatttcaaactttagttcctagattgactgattagtaaactttatactgttttagtagagactatcaagccatatcttatcaaaattaaatgtgattaacacaagcacattctcctaagtgaaattttactttttattttgctttacttagtagaaagatttttatggggttctgatggattttgccattgagaaagattttctgccaaacagatggttcccacttaacaattagatttgcctccagaatgcaaatgaatggctaagggaagaggaaacggaaagtgctgagggaaaaaagggagtttgttctggtggctgatcacattaccatgtgtgttcactgcttataactcctctccctctaagcaccatttcccagcacactcatttcaaagatgacagttcattgcacactatcagctactgtgtggagcactttgcacttattatcttatggaatttaatagtcacacgaaccctccagtttatgtgttctcattttatagaaagggtattgggatacagggaagttatatccaaggatacatagcaggtgctggagtagggattcaaacctaggtccctccgactccaaatctactctcttaacttcagtgttatactttctctccatttgctaaactttccctgagttttattccagaaagtatccctcttttaaaacaactaattaaattttattgtaccttgtctaccttgtatggtgtatagcacagttcaataattttccttgaacatctttcaaagtgtctgcttgtagtttttacatagtagtaaatctgtgcttactactatgtttttgataaggttaaattttttgctgatatgtctctcgaaaatgcctatatttttccatttatttaggtgatttgtctgtgtgtttattttttttcacttgcaagtggaaattgtcatactggttaattttcagattaaagtggtttcagattaaagtggtttcagaaatgtgaataaatttaccagttaaacaaggatgtatattttctgaaagactgttcaatctctcatataattatgttatagtacaaaagtattttattcacattgtgctaacaggagaaagccacttttcgtatggtgctcctaatatctaacctatattttgctttctttagcttccagtctttgctctttgtcctcgtgtcttctgagactatgaataattcccttctttcattatgttgttacccaggaggtattatttataggttgtgaacatggctcacttcactctgctcttttctggaatacataagttaattttgtatttctgtttcacttatctttctccattttttgaaccctttctgttctcttttgggttttcacaaattatcctcaatacttcttaaactttgcagaacagaaatatacagaagatcaaaggagcagtttcagcctgattcaactgggcaattaccctttttttccagtgttacatcactagctgagatatgcagattgaatttaactgtttctggcattagccaccactgggtaaataagcttattctgcaaatgtagccagtcattatatggccattttaatactctcaggtctaagtttctactagaatctgatttactaaattattatctttgtggcgataagttctaaaattttcagtttggttagaaattataagctcaaaatagaattagtacttttgatcaccctaattatattccaagcataatgctatttattaggagttttaaaactccaattttttgttaagttttgcttagtagaacttcctaacaaattgtattttaaacttgttcaactatatcatttgcttttggaatttagaaatttgttcatttatagaaagccatcatttacttggtaacactgactaacagacagcatattccaaactataagaaccaaaaaatatatattaggaaccaagatcagtctggaaaacctatttgtgtgaagtttacagagattcaggggaaagagttcaattattgttctgttctagggtaggtcaaacaccctatatctgaaaatacatggagattttttttttaaatcaaatgcattatgaaaaacaggccaaaagaacagctggtattttggaagggtgaaaagagggcaggagagggaaagtttgacagctagtgtacaaagttctcagcttctaatcacaaggggagattagttttaagtgacttttcttttacttttccactaatattgaactttatttagtaaactattctgcttcttaacccaattcatatctggtacttctgttttttttttgttttttttttttttttcatgaaggtgagcaataggaatagaagtgctgacctagaaatgtgggacagtgtgctcatttcccttttagcaaaggttttctgataatgataaatgctacacttaagaaattggaacactgaaattctccatctagccacaacctttgactctttcccctctcttaattctttactcccaataaacctactgtttcacctcactgaacctctggtcactcaacccctctttgttctctaacttcatcagtccctcctggcagacctcccctcgttactcacactggaccccatcatccatcatctcaaatatactgttagtagcaccttctcattcatcaccccgttgactatccgcctcacctgtctcaccagtctccaacctgaaaatccattttctctgcatttgctcttactttgccaattgctatgaaggaaaatcccataactgagcttatcgtctccaacacaagtttaatttttaacctctgctggcccctcaattctgtttggcaatccttttacttaatactaatcaacaacctttttaatttctcttagtgtctattccaaatcttgcccatattcctcaagccctgtgcccccaccctgcccacttctttttggcaggctgagagctcactactttaccaggaagttacaagccaatctgtatgaactctccaaactttcatctttctgccttcagaattatatctgtatttcacctgctcatgcttctttccctcatgtgtcagagaagaaataccctgatacatttctgaagctaactagtctacttggcttttgcttctagctgcttttgtctataccccgacttggcttgttaattatattttgtcatttgcaagtataatttctttctctacataggttcctttctttcatgaataaatacacccaactttcaaccactcctaatattaaaataaaacctgtcttagcattttctatttgccaacttttaattcaacgtaagtattgagtatctcccaattgcaggcattgttatagcctatgaagatgtaccaataaatgagacccaagctccagccctcatgtagctaccagatttctcaaaagagtagtctctacttacttcatcacacttcttaaacactgtaattggtcacctacctaccattctatagaagaacactgcttttatttacaagtctgagacaaatgttttgcatcctcatgattataaaatagtctctataaactttatataattaatcaaggaagaagggtgtgagagaaacaaaaataaagcttgtagcacattccacactgatcattaggtcagcttgctctctacctgcttcctcattgttgcttggtgcctattgtactaaaatcacatagaccctagattagtttcccttaaccgctctatagataacaatgtgaacattatgaaacattaagttttctctttgatatattctttccaatgaaactactgatgtcaactggtctgatgaacctcacaagaagctgacccaccaaagaatgttgtttccggatgatttcatctctcttactccagtgaatccatgaccccaattttctagtcccttgccttccatgatccccttataaactccacccctgaactccaggagatggatttaagaatctcccctcatctccttgcttggcaccctgtgaccattaaactccttctctcttgcaaaccctgctgtctctgtgtatttgtctcttactgcacatgaacctattggtcctgtaacaattatatgctttgttgattcagtggccttggaccatgaggaaagaatgctatattggtttcctaagattaccataacaaagtgctagaaattgggggacttaaagcaacaaaaatttgttttctcacaggactggacagtagaaatccgaatgaaggagtcaggaggttcatgctctctctaactcttctaggtgggaattctcatttttgcatcttctaccttctgatgttctctggtgatccctgatgttcttttgacttgtagatgcatcattgtagtcacatgataatcttgtccctgtgtgatttcacattgacttttctctgtgtcaaaatttcacctttttaggctgggctcagtggctcacacctgtaatcccagcactttgggaggccaagacaatcagatcccttgaggtcaggagctcaagaccaccctggccaacatggcaaaacttcttctgtactaaaaatacaaaagttagctgggcatgtggtggatgcctgtaattccagcttcttgggtggctgaggcaggcgaatcacttgaacccaggaggtggaggttgcagtgagctgagatcgtgtcacagcactccagcctgggtgacaaagtgagattctgtctctaaaaaaaataataataaaataataaaatgaaataataaatttcacctttttaaaaagacagagatcatattggagttggactcattctaaccgcataattttaacttgattacctctgaaaagactctatttacaaataagattacatttggaggtacttggggtttgaactctaaatatatctttcttgggagatgttagtcaactcataagacatgctttactcaacagtgaagcccctgctgtgtctgaatgaacaggaaattcagatgtttggtctgatgagtggaatgattaatcctgattattaaggtatgtattgcatgaggtgtgccctaaaacctgcctggcgtattaataaaagtaaatagaaaagtgcaggcaggactcatagggttatcacacacctaaagagagaagttttgggtcacaataaaggtattcttcatttaggatattagctgagcaccaaagtaacttgagattacttcagtccgtaatggaggataaacagattagattggagaccaatctgattagctcaaaatctaatttctaagattctcttgcaggtagagctttattggtacctcccttctatccgtaagatttattcacacatcaggcttggggaaggaagaaagcatctgtaagtggtggccatgtggaagaaatcaaatttaccaagcaaggggcaaaagcaactaactggttcttctgagacatctgcagggaagtgcctgggtgttggtgcctagtgttagagatgccaagcaacagttggaagcagcagtcctttgttttgttggaaattgcttttcctgaatgcatcataacttgttgctttgttcttggcactgatacaaccacacccaggtctctggatctcctggagattccacaagcttcctacattctgataaaaaataaataaataaataaataaataaataaataaataaaaattctggtgcttccagcaagtactgctactgataaaatgtattgggaactcttctacgtttttactcagtatcatatttggatcttgaatatatagtagcacctctccctcccagttgtggcaatctaaaataaaatgtctccagacattaccaagcgtcccctgtggaataaaattgccccaggcataaaccactgttctagtggaataattacagctagaattattgagaaccaagtgcctggtaattatctaagcatttcacatgtaataacgcatttaatcttcaaaacagccgtttggagaaaatacaattttccccattttacatacaagaattcatgcacggagaatttaattcactttcacaagtaatagaagtaggagtatatctagaaatatatctaatctagagtagatgctcttatttaccactatatcccccccaatgctgtaatgtgttggtattcatgattgtctataagtcttaaagctcttgctgatcttgagatggaggatcaccatttgattctgaaatgaaacttaaaataatttattttgcctttatactatataatttgacaatctaacagtaagatttcatcttacttttcagagcatcctctattttgcctctaggtgtttatctaaaacataattcttatcttgcaactctcccaaattctcttaatgttttccttcaactacagacaaagtctccattctttagcattttgtaaatggaattttacaataacttatatatccaagccaatattctgctacttttgtgtcatgagcataggctaagcaccagccatacaaaatttcccactattttggagaataccccaagctgtgccaatatataagtaattctctctgtctagaatatcttcttttgtcttctgttcctggagatatattcatcctacaggctttgctctaatgctatctacttgttaagacctatgcatctccattacttagctgcaaaattaatctcctggtttccatggcatgtttatatacctctgtaagattatttgttatattaaactgtaaatattggactttacatatttctttccacctggacattatgagctaattgagggctacactctaccttattctatgtgctcccatcactgggcatggtgcatgacccatagcaggtaaaaaaaaattagattaataaatgaagtccccacaagttctgtatagccataacagtgcaaatggaagtagtccttatgactccagcttttaggatgtgttcaaagggatgatggacccctcacaacttgtctgtctctcatacctgcctttttgcccctgaacacttaaaaagcttcaggatttcctgtgttttacctgcccattgatagggtttcacccaggttccaagctagcttgataatgtaatcaacaggtgttagggtttttccaatttaatagcttgaagtaatgaattacgtaaaattctaaatgcatttatctatccaaatctatgaaatgatacctctactattaaaattatttggattatgtgtatatgatcattcatttgaagtctagcgtacttatataaattaatgctctcttaaaattacatatgaaaacattagtttgctactatgtcattaaaacaaacagaattgatgatgctttgtgagaaaaaaaaatgtcctggactagaaatttgaagactgactcctagtgccagctgccttggaaactacttgtgagaggcaccttgagaatgacacaaagtttatctgactctttatgtccttatataaaaattagaaatagttgtcctggtcactaaacatcgtggttaagagactaaattatttatgaaacatgaaagtgcttaaaagtgcaaacaatacaaatacgaggtatttttattaaaagcatttatttcaaaaaacataacttcttacactcatgccaatgtttgtggcttattatctttggtgccaattgctaaaacaatcactgatgtgtgataaagtgtttatatattatcagtgatgtcaccttaaaagggtgacattgaggtttaaagaaaccaccacatacattactcaagggaggaactgctaattagctaagctaaagagggatttctttcaactttgattttagaagtgcattttagtaatcatttccatttcaaagttaccaactttcctttgcagtgcttttttttttttttggtgattacaaaatttaaaatataattgggttgtgttaaaatacttgctctgtcttccttttcccactgtgcatgacaatttcattgtgctttgcttttgtttttgctcaattatctaataaaacaaaaatgaaaagaagtgatcgttatcacctacacatctgaaggtgcttttagaagattggactggttcttgcaaaaagaatgggtgagctgtggccctgaagcgtttccaagggcgggggtagattttggaagttatgcatcattcattcattcactcactcattcaacgtgtatttattgtgaatgttctaaatatatcactgctcctttatataaggaattaaaaaacattatcaacattttttatattaaatttcaggaagtcaatattatgtgtaattttccaagtaatcttgcattaagctcccttcccattaactctggatttttgaagattaaaaaaatcttaaaagattaaaaagttttcatatgaaaatccttatatatatggaatttattaataaaactctgcttcatacggataactcccctgttcaaatagttcacatgagtgtattaaagatactgaaattattcactgtttcctccaattttttttaaagatgctacatatttgtatcctcattattaagaactcatttctttacacacttcccaggagcacacaggaatttaaaccatgctctggggatagggccattgcagcccaatatggaagctagtccataggtggccctggcctcctgccactctcattcccaaaagctctatgttgcatgggcaaatcccagggtgccaaggattgtaggtacaaaacaaaacaagacagacatcagtggtcatttctgagtaatatttctgccatattctattattggcttctgtttgtctactcattcaaaataagatatttgttcaatttctagaaacctatcttgtactctgtgtatctttttataaagtgatttttataaatatttagagtgatcagttagacatagcagtttataatttatcacaaaggatgtgcttccttcttacatgatgctattcagaagaatcaatttaaaatttttaataaaaataatgaacaaactataagtgcacagctttgtgaattttcagaaagtgatcacaccagaatagccatcccccagaggagttatcagtcccattaaatgcacccagtgccccatccattccagacactatttgatctcttctccccaaatatgatgtttcctcctcccataaattgcatttacctggctttgtactttgttaatggaatcacactgtatattttactatgtgtgatttatttgctcaactttataattatgtttgatccaaggtattgcaaatagcagtagttcattcatttccattgctataggcagcattccattgtaagaatatttgaccattatttttatccatttggtttgttttcaaatgtttgctattatgcacaatgctgctataaacatctttgtactcatgtgttagtacgtatttgtacaaatatctgtggtagaatacacttaagtatgaaatgctgggtaattgggtatcatatgttcagctttagaagacgctgagagtttcccaaagtaattgtacaaataggctccccaccagcaatttaaaaaattttcggctgttccagagaacttctgtttgctccacttgttattgtatatatattagcaattcttttggttgtgtagtcatatcacattgttgttttaatttgcattttctaaatgaattattaggctaagaatgtcaatatatttttatgtcttttgaagtatttgaaaatcttttttttgaaaagtgcctattcaaatagtttcctcatgttttctattagattatatgaatctgtcatattttattgatttgtacatcttccttatatatcagtagttctcaattgtgattgattttatcccccagaccacatttgtcaatgtctaaacataattttgtttgtcaggactggaagggtgctatgagcatccaacgagcaggggccagggatgctgggatcctaaacacacaaggtagcctacaaactacaaagaacatctggttcaaaatgtccatagtgccaaggtggagaaactctgaaattcgtgtgtgtgtataattaaaatataacatatattgtattatatttagcaaaatatatcaaatcttccacttagggatttacttttcacttttaattgtttgtttattggatagaagttcttaaatttaaagtaatattttgttgttaatagttaatattctcagtgtttattgaaaagatctttgccttctacaagatcatgaagatactgttcttcgtatctcctagtgttgcactgtctaatacagtagcaactagtcacatgtgctaatttttaagcacttgaaataaggctattcaaaactgagaagtgatgtaagtggaaaatatacaccagatttcaaagaattggtttgaaaacaagaatgtaacatatttcattattttttatattgactcaatgttgaaatgataatatcatgtatatatgacattaaataaattgtatgataaaatcaatcgcacgtgtgggccacattatatttctattggacagtgctttctagaaggtgtattgatttacattttacatttaatcaacaatatgcttttaactgattttttatatggtgttaagcaggagtcaatatccattttataccatatgattattcagttgacccatatattaaaaggtgcattctttctctgcagtgcttctatggatcctttatacttactcaagtgatctaatatgagatggacatttctgagctctttattctgtttcaagaacatatatcatattattccaccaataatacactgactttttactatctcttttagcatcttttgatatgtggtgatcagagccctcaattctgttattttgggccagttccatttccactttatttatttatttatttatttatttatttatttatttatctatctatctatcttttaaagacagagttttgctctgtcacccaggctggagtgcagtggcatgatcatggctcactgcagtcttaacctcttgggctcaagtgatcctcctctctcagcttcctgagtagttggaactataggcacatgccacaacacctggctaatttttaaaaagttgttttagagacagggtatcactttgttgcctaggctggtcttgaactccttgcctcaagtgatcctcccaccttggcctcccaaagtgctgggattacaggcataaaccaccaagaccagccttcacataaaattttcaaaatttcaaaaacagtcctgctgaggttctaattggaatgaatttaatatatgatatatatggagataattatcaacatagtaatcatattgaatcttctatgtcaaacattgtataccccctcccacttatttagttcatttatttcttattgtaatgtgattggtgtaaagtgcttgaaatttcctggtaaatacagtcctaggttattgatgatttatttcactaaagacaattgtattattttttgaaattaattttcaaagtgttatcgatatataattaatcactgaccttttatcaggtaatcttgctaaattagcttattagttaaaaaattaccttttatcaggtaatcttgctaaattagcttattagttacaaaaaaagcttatctgttgattctttgtgatttttccaagtaaacatagtttctgcaaataattacaattgaattttcttgttttctatatattccttattatcctttcttgagttgttgctcagagtcagaaactcaatacaatgttgaaaatgaatgatagcaactactcttgtctcattttttatctcattacataggctttcaatattttatggatatctacaatgttttctgtagtttttgttatttttttgtttttgactttttgttaccctttacaaataatgtttctactattcataacttgttataatttttatgaaggagggagtttcacatgatcaaaagctttacatgcatctgttaaagtgagcataatattgtgtttttaatctaatgtggtgaaataaattggtttttgaatatctatgcatccttggattacttatatgaatccaaattaataatgatgtatttcccttgtgtagctctataggttaaatattttacttctttttaatatattttttacatctaatatttatgaggaacataacaggtctatagtttccctttctttaatatttaatattctgatgggcaatatatttccagatataagatcttgacatctgcgaagtggcaatatagttttatcttttccaatttggatgtcttttatttcattttctgttctgattgctctggctagtacttccagtactatgttgaattggagtggtgaaagaagaacccaagtcttattccagttctgaaaataaaaggctttcaatttttccctattcactatgacctttattattttgaggtatcatctttctccacctagtttggcaggagttttgagttttttgtcatgaaggtgttagattttatcaaatgtttcctctgcatctattaagataatcatatttttgtcctttattctgttgatgtaatgcaccacatatattgatttttgtatgttgaactattcttgcacctcttatgtaaaacccacttgattatggtatattacctttctgatgtgctgttggattgagtttgctagtattttgttgaggatttttgcatctatgttcatcagggatattggcctgcagttttctgctgtgttgtttcattgcctggttctgatatcaaggtaatgctgaccttgtattaggttggtgcaaaagcaactacggttttaaaagtaatgccaaaaactgctattatttttgcacaaacttaatagaaggagttagagaagattctctcctcttcaatattttggacaagtttgaggagaattagtagcagttcttctttatacagttggtactattcaaccatgaacctatccaattctgcactttcctttgttgtgagattttattactgaatcaatttcactattcgttattggactgttcaggttttctattactttctgatccaatcttggtaggttgtaacattcccagaattcactcatttcctctagattttccagtgtactagcatatagttgttcataataatctgtgataatgtattgtatttctgtggtatcacttgtaatgcctcttttttttttcatttcagattgtgtgtatttgcatcttctttcttcttttcttggttagtctagttagtggttcaccagttcgtttatcttgtagaggaactaatatttcattttgttgattatttgtactgttttgtctccattttttatttctgctctgatattgattattattatttttgctaatttgaggtttggtttgtagcttttctagtttctggaggtatattgttagattgtttactttaaaactttctggattttcttgatgtaggaatttattgctattgaaggagcacaggaaatttactccaaaatatgtctgcctggtaaaattaatatggatatctacccttagagattgacaggccttagaacagacttttctcttatctacataaaggctggaaagatcaatcaagaaaaacaatggtttttctttcctcttcatgttgtctcattttctattgtaggaaagaatatcaagaatgtaaccagataaggtccattggtttttacaaaataatgagtctctcaggctcattcagttgccaaagagaaccacatacaagcaaatctctgttctccccactcatttattctccctggtaatcatttgttgactctccacagatttggtgatatttcctatttccctcctaccctctgaaatggggatgtgtaactatttgtgaaagataattttgttggaatagtatctttgggtgacaaatttttgtctctagcactttgaatatatcctcgcattcactctgggcctgtaagatttctactgagaaatctgctgtcagtcagatgagggctcctttatatctgactagatgctttgttcttgctgtttttagaattttctcttttccattgactttagactgttggactattgtgtggcatgaagaagactttttgctttctatctgtttgggaatggatgactgaacttccaatatctgaatgtttaaattattttcgtagacttagaaaattttcattgattatattattacatagatttttaaaaaactgtttcattatctttttgccttctggaatattgagaaatggtgttccatatatcatgaagactttgtttataattaaatttttttctttctgttcaattttattttattttattttaagttctggaatacacatgcagggcattcaggtttgttacataggtaaagttgtgccatggtggtttgctgcacctatcaacccatcatctaggttttaagccccacattcattagctatttaacctgatgctcttcctcccaccaccactgtgacaggccccagtgtgtgttgtttccttctttgtgtccatgtgttgtcattttcagcttctgcttataagtgagaatatgcgctgtttggttttctgttcctgtgttagtttgctgagattaatggcttccagctctaaccatgtacctacaaaggacatggtctcatttttttatgactgcatagtatttcataggttatatatgccacattttttatccagtctataattgatgggcatttgggttgattccatgtctttgctattgtgaatagtgctgcaatgaacatatgagtatatgtatctttataatagaaggatttatattcctttgggtatatacccagtaatgggattgctgggtcaaatggtatttctggttctagatctttgaggaattgccacacagccttccacaatggttgaactaatttatattcccaccaacagtgtaaaagagtttttatttctccacaaccaaaccagcatctgctgtttgttgacttactaataattgccattctgactggcatgagatggtatctcattgtggttttgatttgtatttctctaatgatcagtgatgttgagctcttttttcatgtttgttggccacatgaatgtcttcttttgagaagtgtctattcgtgtcctttgcccacttttttatgggttttcttttcttataaatttgtttaagttccttgtagattctggatattagacctttgtcgaatggaaagattgcaaaaattttctcccattctgtaagttgtctgttcactctgatgatagtttcttctgctgtgcagaagctctttagtgtaactaggtgccatttgttaattttagcttttggtgccattgcttttgaggcttttgtcatgaaatctttgcctgtgactatgtcctcaatggtattgcttagattttcttctatggtttttatagtttgggttttacatttaagcctttaatccatcttgagttaatatttgtataaagtgtaaggaagggatccaatttcaattttctgcatgtgtctagccatttttaccagaaatatttattaaatagggaatcctttcctcactgcttgtttttgtcaggtttctcaaaaatcagatggttgcagatgtttgagcttacttctgagatctttattctgttccattggtctatgtgtctggttttgtaccagtaccatgctgttttggttactgtagccttacagtatagtttgaagtcagatagcatgatgcctccagctttgttctttttgcataggattgttttggctgtatgggctcttttatggttccatatgaattttaaagtagttttttttttccaatactgtgaacaatgtcaatggtagtttagtgggaatagcattgaatctataaattactttgggcagtatggccatttttcacaatatttgttcttcctatccacgagcgtggaatgtttttccatttgtgtcctctcttatgtccttaagaagttgtttgtagttctccttgaagaggtccgtcacatcccttgttagctgtattactagatattttattctctttgtagcatttgtgaatgggagttcattcatgatttggttatctgcttgtctattgttgatgtataggaatgcttgtggtttttgcatgttgattttgtatcctgagacactgctgaagttgcttatagcttaaggagcttttggacttagacaatgggttttctagatatagaattgtgttgtctgcaaagagagacagtttcatttcctctcttcttatttgaatatcctttatttctttatcttgccctggcctaaacttctaatactattttgaattacagtggtgacagagggcatccttatcttgtgctggttttcaaggggaatgcttccagctgttgcccattcagtatgatgttggctgtgtgtttgtcataactggctgttatattttgagatatgttccatcaacacctagttcattgagagtttttaacatgaagggatgttgaattttatcaaagctttttctgtttttattgagataatcatgtggtttttgtctttagttctgtttatgtgataaattatatttattgatttgtgtattttcagccagccttgtatcccagggatgaagcctacttgttcatggtgaataagctttctgatgtgctgctgaatttggtttgtcagtatttcattgaggatttttgcatttatgttcatcatcaggaagcctggcctgaggatttctttttttgctgaatctccaccaagttttggtatcaggatgatgctggcctcataaaatgagtaaggaagaagtccctcctttccaattgtttggaatagtttcaaaaggaatggtaccagttcctctttgtacctctggtagaattcagctgtaaatctctctggtcctgggcttttttttattggtaggctatttattactgcctcaatttgagaacttgttattggtctattcaaaaatttgacttttttgtggtttagtcttgaaaggatgtatgtgtacaggaatttatccatttcttctaaattttctagtttatttgcatagaggtgatttgtattagtctgttttcacactgctaataaagatatacatgagactgggcaacttacaaaagaaagaagtttattggacttacagttctacatggctgaggaggtcccacaatcatggcagaaggcaaggaggggcaagtcatatcttatgtagatgacagcaagtgatgagagagttgtgcagggagactcccatttttaaagccatcagatcacgagacttattcactatcgtgagtatagcatgggaaagacttgtccccatgattcaattacctcccacccggtcctcccacaacatgtgggaattcaagatgagatctgggtggggacacagccaaaccatatcattcctcccctgtccccttccaaatctcatgtactcacatttcaaaaccaatcatgtcttcccaacagtcccccaaagttttaactcatttcagcattaactcaaaagtccacagtccaaagtctcatcctagataaggcaagtcccttccatctatgagcctgtaaaatcacaggcaggttagttacttcctagatacaataggggtacaggcattgggtaaatacagccattccaaatgggagaagttggccagaactaaagagttacagccccatgcaagtaaaaaatccagcagggcactcaaatcttaaagttccaaagtgatctacttgattccatgtctcaaatccagatgatgccgatgcaagaggtggattcccatggtctgggatagctctgtccctgtggctttgcagggtacagcctcccttctggctgctttcacagactggcattgagtgtccacatcttttccagatgcacagtgcaagctgtcagtggctctaccattctcgggtctggaggatggtggccctcttctcacagctccaccaggaggtgccccagtatggactctgtgtaggggctctgaccccacatttcccttctgcactgcaatagcagtagttctccaccagagccccacccctccagcaaattctgcctggacatccaggcatttccatacatcttctgaaatatagaaggaggttcccaaaccccaattcttgacttctgtttactggcaagctcaatatcaagtggacactgccaaggcttgaggcttgcactctctgaagccacagcctgagctctagattggcccctttcagccatgactggagtggctgggacacagggcaccaagtccctaggctgcacatagcatggggaccctgggcccaacccacaaaaccactttttcctcctagtcttccaggcctgtgacgagagtggctgccatgaagaactttgatatgtgctggagacattttccccattgtcttggtctttgaggctgctgatcttcggatggggtttttgtggggacatttttgttaatgctgttgttgtagctttctgtgtgtttgttttccttttaacagtcaggctactcttttgtagggctgctgtgatttgctgatggttcacttcaggccctattcacctgggtccctcccgcacctgtagatgtcacttgaagaggctgaagaacagcaaaggtggtggctgcttcttcctctgaggtctttgaggagcaccaacctgatgtcagcaggaatgctcctgtataaagtgtctggtgactcctgttggggtatctcacccgtcaggggcacaggatctgggacccacttaacaaagcactctggctgtccctttgtggagggggtgttctgcacttgggggaaacccactggtctgggctgcctggattcctcagaactagcagggggaaagactaagtctgttggtcctcagagaccacatccaccccactccctagggctcaggtccatagagatcagagttctgtccctaagcctctggctggagttgctgaagttcctggagggatggcctgcccaggaggcacggggcagagtttggcctaaagacgcagtatgtctacaatctgccacagccagtgtgctatcctgtggggaatacctcttaagtccaaaccattcagtctccctggcattgcaggggaaaaacagcggactgaagctgcaggggtggctgctgccctacccccaccgccagcagttcagtcatcttaggcagcaggcagctgcagtgatggctgccgtcccttgcctggggtgctcagttttctaaggcagcaggcagcagcagtgatgatggcctccccttcccctgggagctcagtagtcttaggcagtctccagccaagtggctattgagaatctgtgtgactctgtggttgggacagaatccctggtgggatgggttcatgagtatgatctccctatccacgggttgcacagatccattgaaaaagcatggtttaccaagctgggtagcacaatcactcactgcctcccttggctgggggttgcggctccccttgccaggtgtggctctcaggtgagccatcgcatcacccctcttttctttgctctccatgggtcatgtcaacctactagtcagtcctgatgatagaacatggatacctcagttgccagtgcaggattcacatgctattttggttcttcttggtgggaacctgtaatggcagctgtttatagtaagccatttggccccctatttatatttttaaaattattttttttgattgttgtctgacttatactttttatacttttaaaattctttttctctttattgttttcagactgggttatttcaagagacatgtctttaagttctgatattcttctgcttcatctagcctgtctttgaagctttcaaatatattttgtatttcattcacggagttctttattctagaatttctgcttggttctttgttatgatatctatctctttggtaaatttatcattcatatcttggattctttttctgatttcctcatattgtttttcagaattcttttttatttcactgagcttttgtatcataattttgaattctttttttggaatttcatgaatttcttttatattgtgatctgttgctggaattattatgtccttttgtaggtgtcacattttcttgctttttaatttttttttcaaattttcttttgtaggtgggtactttttcctgaaaatatattaatagtgttggttgggtaagaccttttagcttttattctgggtgcatgagacagtgtaatccctgaatgatttttcagctgtgacagcctgagtggtatctgttatttcctcaggttgttcagggtgcagttattagtggaggctatggtaaaattttgcggcaaacaaggatgccaggtaggccagttttcagacccccatggtggcagcagtgggtaaacatgcctgtttttgtgctccagggtagaatacactgtcatcaatgttaatggaatcagatggactgattcttgagcctccagatagcttgctcagatggcctgagtggcaacattcatctaggtaggtgagcagattcttgggtcctgagcagtttgcatggtatatgggtgatagaagcatggtatataggtgatagatagcagcagcaggatgattctcttggtcctgagtggtgtacactggtgttggtggtgacgtggtaaggggttgacacccagtctcagacatgcagctcccaggcttgccactctcagtagcagcagcactgcacagggtgaggacacccatctttcatgggacagtccatgcatggaggccataccacatgtgggggtacactcacaactaacagccccagaaaggcagccattcagctctactgccccagcctcctgaggtagcaacagcagctgtgcctacagaagtgcaaggagcaggagaagggattccattttccatgtgtcggtccaagcgtagaagccactctgccagtgggaagggatatcactctgtttgcaaggctgagc[450 bp omitted]tacaggacttctcccatggttaggattgcagcagtccatgctggagatgtggactgctgaagttctctcccttaccttttccttacaacactgagcacccctgggctcccagttgatcccgatctcgactgagctgaccactcactttcttcttctatgccccaggtatttcttgtggcttttctgttggactctagtgttcgctcctagatgttctgttccaggtacaattatctattcataattttgattcttccttttggacagggtgggtattcaatgtccctagtcactcatctttaatatttattatatacaatattatataaaaatataatatttttatgcacttaaattatctgatgaaattttaatgctattcactgctagtggccatacttctgctttttccagtctaccttcaaataatattactctgcttcatgtatcatcaaaggaccttgcaacatttaattttatttcctccgaactgatttttgtgctttgttgttatacattttacttacatcagggttatagacctcaaaataattcattttacttaattatatttcaaaggtactaaaaattaaaatttcaaagtgttttatattcatgcacatatttaccattctagacactgtcattccttgtgtaaattcaattttccatctggcttcatttttcttcatcttcagggaggaacttcttttaacatttcctgttatgttcatctgctgacaacaaattctatcagattttgtcagattttgtctggagaaaaggtttcagtaaacctggatatagaattataagtgaacaagttttttgtgtttttttccctttcatcttagtttaagtgactttccattgtatccttcacatgcacattgttttttttctgatgagtagtctgtgataattcacatttttttaattctgtacacataaatttatttttcttctctaaggcatatacatcctgttggatcaaaatccatgtctttgtccaatctctgaaaacagctctgccatatatttaatcctgttttctaattgtttatcagtggaagggtatgttaggctgttcctgtattgctatcaaaaatatatagactgggtaatttacaaagaaaatacgtttaattggctcacagttctgtaagctatacaggaagtgtggtggtggcatttgctcagcttctggggaggcctcagggaacttctacacatgggaaaaggtgaagtgggagcaggtacttcacatggtgaaaacaggaacaagagagggagtagggggaaagtgtcacacacttttaaatgaccagattttccaagaactgtctatcacaaagactgtgctaatccatgagagacccaccctcatgatccaaacacctcccaccaggatacacttccagtattggggattacaattcaacatgagatttgggcagggacaactatccaaagtacatcaaaagctgaacttaggcccagtatatggcatcatggtataaaatgaaagtttttttgccttattacttttaattggatgacagaaactgcatgaggaaaggtatggaatcttttgatgtgatcttcctcaagaaacaattgttttgctggtcttggtagtcactgagagtaggagaaaataaccttaatcttgtcaggaactaaagtaatttgcagatcagctttagatttttgggagaccatctaatttctgattatctggtacttttagaatttggaattttagaagtttagaataaatttatgggctgtttaataagaccattcactatcaggctctaaatgccaatttttccttcccagaactatagcatcaccaataatttttgttagatatttagaattttatcaacagctttctgtttgccttctctacctcccagcctgatctgcctataaaaggaaaaaagtcttttttttaaatatactttaagttctaaggtacatgtgcacaacgtgcacgtttgttacatatgtatacatgtgccatgtttgtgtgctgcacccgttaactcgtcattcacattagatatatctcctaatgctatccctcccccagctccccacccaatgacaggccccagtgtgtgatgttccccaccctgtgtccaagtgttctcattgttcaattcccacctatgcatgagaacatgcggtgtttggttttctgtccttgtgatagtttgctcagaatgatggtttccagcttcatccatgtccctacaaaggacatgaactcatcctgttttatggctgcgtagtattccatggtgtatatgtgccacattttcttaatccagtctatcattgttggacatttgggttggttccaagtctttgctattgtgaatagtgccgcaataaacatacatgtgcatgtgtctttacagcagcatgatttataatcctttggatatatacccagtaatgggattgctgggtcaaatggcatttctagttctagatccttgaggaatcaccacactgtcttgcacaatggttgaactagtttacagtcccaccaacagtgtaaaagtgttcctatttctccacatcctctccaacacctgttgtttcctgactttttaatgatcgccattaaagaaacaataaattctgtatcctgggcttcattattctactctcatctccaaactatagtcctgcaagtctgcttacagtggtagataacttttcaagtttgtccccccagtccagtgtgactttgaaaagcttctctgcctcttagcagctactgtctctttgacttcttacctctctgcacatattacttttgaattgaaaattttgctggaagaaaatcagtgtaaagtgatagaatcaccagaacactgcaagatgttcaaacactttgggtggaagggtatattttagccctctttgttcttattctcagcagaaagtcccagaatttcattcattttaaatgttcaaatttaaaaggtaagtggaatgctatggcaaaccaccattggcctaaattaaggaatgttacaagatatagccatattaaattgacactatatctgttgtagggactctcataaagataggagattatattaactataataagaatttgctttccaataggagagagcgttatgcatgagtacactgttgaatttaagaataaccatccaatatattaatgattgagatataaaaattaaagccttctcattagttaatctaactcaatgcagttatctcaaatattttttaaaataaaataagtagttagaagtaaaggagggaggaaagaaagtcagggtagtacaaagtgaaaaaaaggagggaagttagaattcgtatgtgtgcatttttcttctgttacatttttctaaattgcattattttattgtttcattctgtttttgcttacgacatatatagacacttctctggaatatatatatatcagttaaactctgtttctctcattaatcaggagaccctttggtctgaaattgtatacatatttgttttaaaatatgtataaagcaatatgtaatatatctatgctttaaaatattttatatatgtgctatatattgtttttgctttaaaatatcttaaaaataataataatttactagttaattttgattctatttaattttcattttgtgttttcatcaacaaaattcttccttggattcagtctcaccctttagaatgttaatcctgctgagaaaagagatgccttctttctttttcctttgtatttctagcacctatacagtgcttggcacatagcaaaaactgaaaaaatatctattaaggaaaaaaatggaataacactgagttccacaattttatgaaatgcctgaattataggacagaaaaacatatacctcaggctgatattgccagaatgaatcagtgaaggaccgagagaaagagaaaaaggcaaacaaaactttctcaaaattaggcaaaagtatcaagctctacaccagagaataacgttaattatccagaattgtctttttaagttctactttgttttaagttggaaacagagaaactgataagcattacattgtaaactaatcttagtttctgagaatagagtcttaagagagcagttacacacactgtggcttttcttcacttgtgctggtgatggcaagagaaaaagctaccatactaccactcaagcacctctcttcacttttttccccagaggatgggtgaaagatatcactcttatacattttttaaaaaaatggtgtccatccttcattcactcatgcattttgtacttacttcactccatctctgtattctttattctagaaaagaaattctatttacttctgatatttctttacgataaatattctaaatttaagggaggctacgcttatgtgaaaggatatatattttacttggctgagtttacatttacagagattaagccaaaatatacaatcatctttaggttatcaaaattctgaatgagaaagaattcacatgaaataaaagaactattgtaaaatttttatcatccttcctcaaaaatactatttcgtaacttttataaatgcttccgtgcttttcccttataacattattttatattgcatgaaatcccaggagtacttggtgaggatgtaaggtctgttattttttgttctttttacccctttttcacttctcataaacttctgaaaaattctcctgtattactagtcacagcccaaaggcaaactttaagatttttttctaaattggtttatagttcagaaagaaattttgaggaaacatgatattaaaaagaagaaaaagaaagcagaggaaaaaggaaaaactgaaaatatcagaaatatatttagtaattaacaataatttatgagctaagtatttgctttaaaatatcttgtgaaatgacaaaaacatatacccagtaagtaaccaagttttacagtttttgtttccatgtgtttttttgctgttgtttgcttgctataacaaaagtatttgcttttcatttttatctcccattgtctttggattgtcactactcaaattcaagtccatattatggaggagtcatatttagaagtcataccaaattatagaattcatctaatgtaaatgcttttacttaatagtcgaagaaactaaagtcttgagagaccaatcattgtcaaaaatacactaagagctaacacttgcaatccagtgctgcatttaccacaataatagcttcctaattgaactgctacctccgttagaagttttttctcccttctaacatgcatattgcttccagttaaatcaatcattttatgtctcaagaagtctagtagccagttagactcctatagatcccaatctgtatgaagcactccacaatctgccccaaagctcacttttaacacttattttccttttataagccctctacttcaatcaaacttgtattttctctttctgtgcctttatataacatcattttttcatctcaaatatcttcttatgtttgtcaaacattacatgtgactcaactggcaaaacaaatccttccaccacagaaactatttatatctaaaaactctatcaagagcactgtgtagagggtagttttactaccataccataaataagttaattgaaactcagattacattatctgtctaacacaaagctactaaagtttaaaaaaaatcagttcaaaattaggtgaattttttttctgactaccccagtatcattgctgaggtaatttaagttacaataaaatattttgaagcttattaatacaagactctcttacctgtgtcagtcctaaagtatggttcaaattccatcattgtcttaaaggttacacatactagaacacatatatgctcatgaacgcataacaggagatgtctgcaatggagcacagtttcttacattttaatcagtgactgggcagcttcttccattataacattcctctccaagtgtgctgctggcatagtgaggaggtaaaaagtagattacatgaattgtcctgtgccttttctctcagacattgacgacactcttgctgtaatcttgatgccattaaatcctactctggataaagaggaaaaatagaaatttcatattcaaaataatatacaggaattaaagaaaaaaatttcatgagaccgtgagacattaaggatttgtccaatggcttctcttttacttgtattttaatttggtaataatgattttacaaatgtttcttgaactcatcaagttgaatgatggcataagccccatcagatacagtggaatgttttctgtagataagtatctcatgatcaatttttaaacaataaaggcattaattttcccaaatgtaaatcacccataaggaacaatatttctttggcctaccattttggcatacagtacaactctagcaacaggaaaatactctgatgttgaaggaagtaagaagccttctttctaggacctcacacttcctggtaggatcatgttgtaaatctatctggtggagtagaaattttcagagttgatggtctagtcccattattctatacctcagcctctttttgtaaaaaatacctctcaacctgatacgtataaagaggtacagatgttagtgcctgtccttatttagaaactttgcttctattcattcactgagttttctgtattcttttcaaacttctctaccacaatattaaaaaaaatatagtccagccctgcaatttgtgggctaatgacagtgtatgcttaaagaattattgagtgaagggtgacatatttttataaacaaaaatgttatttttgcataattgtattattcatgcaaactctttatcaattaggacaattgaaattgttaggaatatctataagctcagttttactgtggagatctaaaagggacacaaatgatttaattattggatgtcaaactggcaaaaaaaaaaagtctacggtcatgaaatacgtttatgttgccctcatgaaatttttatgatagaccagtatttctgcaggcttcctcctaagagaatactggacccttctataagtaagcaagttaatcccacttctcactggaatagctaccagtttaccttcttgttaaaatgaatcactagcaaatacgaataatccctcacttgatgtttagcctgctggatgctgctctgttatgagtgatttatgatcatacctttaaataattatattggtcctgttgtaatatttcatcacagctaacaagaagatacatgcagataaatgtattacaactcccctctcttcaagtattttcctctattagaaattaaatacctctaaaatattaaaccaaaaatctctccccagtggaacttaaagaataagcctacgttattatacttttattttataatttacaagaatcaaaacattcatagctaatgtttccacagctaccttctactaaatatagattggagtgtatttcacatgagagaaaaaattaaactttgcctctttgtagaagaaaatataactaaaaggtcaggagaaattgctttagaaatcaaaatcataaaatgggtacttaaagaggaaattatatattcagcacttcatataaattttagtaaagtagaaaatattttaaataattgagatggtaatggtgatgatgatgatgatgacaataataaaccattctgtggggagagaagactatccttgctttagaacaaagtgctggagtgctgtcacatttcagaaactacacatgagagaattattcttttgataagaaaacattaaataagcatccagaaaccacaacaactgtactgattataagccatccctggcacttagaatcaatgctctacagcttgctcagtctcgattttgtccttcccttttttcctagggttctattttttccagtaaataaaatcatggccagtagccatggaaagaaaaaacaatgctgtatttagaaacagaggttaaggtcaagtctccacttaacaaagagaaataaagaattaagctcaggccaaggtctcaagtttctcaactgcttacatggaaaaaaatgcaacaaaagtaagtaaaacattgaacaatgatctggttcatgcaaaaagaataatgtgccaacatttcattaaataataaatgagatttattgataagatttatccagattacatgatgataactccaaatagtaacttccatctgcattacatttattcagcagatgtggccaagtaactgcatttattttggggaaaataattaagtggagttaagaattgtatgctacaattatttttctaaatatttgttttattaaataccaatatctcatgttattatttatactcatatactgtttaaaaatattaacatcaatttgaatactaatatttgcaaataacagaacactaaattgacgtaaacaagaaatattattttcataaaacaaagttggaaggttagcacaattatttcatgaaaactcagattcttacaactttctgttctgccatcctgagcatgctggtttttatcctgatgctcttctgccttatggccaaaggattgctattcaagtatcacagatcacaaagtaatgtggaagacaaaaatgttatttttgctttagcatttctttcatttgggggaggaacttttcaaacaattcatttcacacatcttcctggccactcctacagcaatcattagcaaaaagaaatgggaataccatttaagattctgaccaattcttcattattttcctgggcctgagaagaaactgaaatgccctgaccacagtatctttgaattcttcaaccaaattacagacttgacagggaaaaagagggagtggctgatgggaaagaatattagggtctgccccattcacatgatttaagtccaatgatatttaaataaatatctcaatcaacttttatatttttgcttttaaatttttagtttatgttggaatgtttttttccacaggatgtgtaatcatgtcattttctttcaagcaaggctctaattttctatgattaatttatccacaaacactgttactctcaaattcaaatatcaaaaatcaggtattttttatactcccacataaataaatacacacacaaatctatacacataagatttttaatttaatcacattttaaagtttggtttagaaattagtattaagaaattatctaaaacttagaaatgttattataagatatttcagcatttcatttcagtatcatactgaaaagctgtttaacaggatcacccaaagaatacttaattttccaaaggaatgtactttcatgtgactttgaaatttactaaaaagttaagacctcggacacttcaaagttacatactaatttgcagaacttgtctgaattttttctcctgctaaataccatcacaaaagttatggttttattgccctgtaggacactaactatcttgttgaacttatgtaaagtctgtactatataatctttgtttttctaattctcgtttggatcagatttttcatctcactggtttcctcctttatgtgttgaacaaaatctttgaaatgtgatcactgtatatttgtatgacagtcatgctttacgtttttgataattatactttgacattaaagagtaaaccaatgatactcactgataatgacttttatctttgtcatatgcttcaaatatttagaatcactaaacttagagatgtactaacatattcaggcaatcaggtgtgacccaggaagccacttaattcaatcaggaagtttttttactgtgctaagatataaaacaaatatttctaattcttttgtgcaagagttgaatcttatttaggatcttatcaaaatttcaaataatacctcagaattttttaaattcagagatgaagaaataatataaataaccatttttaactataaattaatttttaagatgttaacctgctccactgaaatgtagagtagaaaaattaaaattaccaaagggcagagagggaggggagcaaactacttgtcattcttctgtccctgtcaaaggattttgctgggcaaaataatttaaggatattttcactgaaaggtggtaagataatttcattacacatttccattaagtttcttaaacagaaattttctcccagtacagagctgtgcattaaagaagtaactcacttctcaatttctatttttttaaataaatgtaaaaacaatttggctcattttttacttatttatgcccttaatttcaagcattatttgtgagaaaatgaattggaaatataaaattggttcagctgtttcatcaagtggtgctcaattttctaatttctctatcacagacaatcaaagctttgaagcaacctgttatctctttcagaggtgacaaattgtctgtgaaaaacttcaggatctttaaccaccagaatctgcattgccaacctaaaaaatgcaatctcataatcatgttatttgtatatgtttgctttaagactttcaaagttcgattcttatttgacatcactctcctaaaggcaatcaggccgaataagtaaagaaaatgacatcaaaaatgttcttgggagtgcttatttattctgtgttttaatcaggattataaaataagaaaaacaaattcaaattttgatgagatttcaaaattcatagtcatagagcaaaagtagcaagacatctgcattgtaatgcagaaaatatttgtattttgctttctcattaacatataaaatataactaaaaagttaaggaagagtagtaaggaataatttgcagataagaaatagtgaccatgaataaattaaaatatttattttgtcttataggctatacttctgggtgtaaaatcattgaaacaagtcaaaattctaataaattgggaaggtggaaaattggaaaaatgccctttgataattactaacaagtattaagaagaaactattaagaatatcttctaaaaatagtaatttacatacacagtaacatatgtttctttttacttagtttgttaagcgccctcaatctttacctacaaacccttgcgtacataggagggaatgccagagtagactctgatggaattcaaaagagaaaatttatgcttctagtcttaaatcaattatgaccatgtaatctgcttcagattagaatagttacatattcagataaaaagagaaaaaagacagtatattttttctaactttgtgtcttatacttaatatatatccttgtctcacctaatttttcttcatttaactggttgtaccaacaacctcaactacaaggttgttaatctgaatactgtcaaggattgttgtttgttatgctttccttctcacagtataatccagattgtctccttacatcagcaatagatataagagctctactttgcagcagtgaattaaaatttgatgcctctttttttactttgccgtaaacactcccttcgttttattcatcttgattttcatagcgatccccttctaatttctttatcgtgcctcaccttgtttggtcctcaatcccaaataattataaatttccaagctagttgtttaaccaaaaattaaccctgaaattagtttccacctatacaggacattgaacagaaataaactacactgttttaacttctttttctaacttggcacctggatcaaaagtctgagatcattgttttcatttgtgtctttagctgtggcatactattgaatatattgttgattatatttgcctggcaaagttgaaacccataatttaaattgaaagtatgatatttaaatggatatatttcatgcacaataatccacaaaatattaagctagttagtgtcataatatcacagacccaggcttctgattcaaactgagagttgttttcaatatgctacactatctgcttacataccccatctgttgaatttttagcatctggcaactcaaagtatggcctccaactagcagcaccttcatcaccttggagctttttagaagtgctgaatctcaggtaccacttgaaaaactggaatagaatacacattttagcaagattgccttgtaagtgcaatgaagttttaaaagcactgtcttagtatatttcacatataagcaagagtaaaactcatctttcttacttaaattccagatcagggtacagtaatcctttttcttagaaaaataaatttcattttacttcagtaaaaaggctggcttctgttatataactctcttatctaaactcttttgaaatttgtttattcattcatattcatttattctcatgaaattattaagaaccgaatatgagccagatattattccaggttctgggaatttcatagtgatataaagagaaaaccttgccctttttgaaactacattatagatgaggtagacaaacaatatacaagattaataactaaaatatacaataggttacatggtaaaaagtacaaaatatgataacaaagcagtaaggaaaagtgaagaatgtcagagcaagtttagcgttgcaaatgtagagaaggttgtcagaaatttagaactaagtattttctttcaaagcatattttcctttttatggcctcaactccaatctccaagtagaaaatatccaagcctaaactttagccttaatttcccagtggtgttctggctccaaacacataacaatattttgatagatcccctaacaatttaacataatagatttattatcataaaattattatagtctgatgtcttttgaggacttctttgaccataatattctttcctcaaccccttccaaagcctatgactggggaaaccctaagcttcatcaatttgtgcaaattcacaaacactcattctcgaaggatctctttctcttcagggctccttcagggctttgtctgtgtggcctaaacacaaatatgaagttcaacgctttttcaaattttgaaaaaaaaaaatcatcttaaaagcattcatgagcaatgtcaatttaataaaagattctataacaaaggtagaaaagaatgtttgcattgcagtcataggttgggtttcccaaaatgagattgccttacagggggttgattggagagtgctgtcaggaactacaccagaaaggccatgacagtgcagaactgaaaaaaggaagaagttgaattgtgatgattaggttgcaaaaacgacctcaaaaaactggagcagcgggagttctgaagttcagatggccttctggagatgctcataagtgcagcaagtgttcaatactgctgctttaaacagtcaccctcctctatctttgctatggaatcttctataaagtttgctgtcatagtatcacttatgttgtgtcaggtcctccaagaaaaagacaccaagagaggattagccatttgccatatatttaaaatcgccataattgtgagggaaattgggaaagagtaagaaggaagttggcaatgcaatgacactttgatgaagatctaatcctagttaaaggagagagaagattgggtagaagcatctcagattcaacacaattataatagagattggcaaggctgttagggagtccttgaatcaaatttgcttgtcagaggagtcctctacctcctatgactagatttaccttagtattctttacttggtaaattattggctgggaatagtccatgggaagcatggacttaatttcagagctcagacaattaaatgcacctgcagagatctgcaaggtgtattcttataactgccacaatgaggtgctagagttgctgttcctgaatcagggcatggaggacatgagtctggaatgtgagaaattcactgggatatcccctagtgcttctttctctgtgatgagagtaagtgagcatttttagcaatcatggactgagaacaccaaagtattgagaggcgtagaaacctcaggaacaaagatctgtgcccacgaggaaatggacctagacagtaacaatcccactaagatgaatggtctccgaaatgggaagtagagaaagaagacattgaatataggttgaatatagattatggcatctaatctgtagcagcagatacatttcactaacaatcttaatttaagctcttattttagatactgagtacagccactattttgaaatgccagcgacagagtggaatctttcatgcacgtccgtgtgaagagaccaccaaacaggctttgtgtgagcaacatggctgtttatttcacctgggtgcaggcaggctgagtccgaaaagagagtcagcaaagggaaataagggtggggccgttttacaggatttgggtaggtaaaggaaaattacagtcaaagggggtttgttctctggcgggcaggagtgggggttgcaaggtgctcagtgggggtgctttttgagccaggatgaggcaggaagaggactttcacaaggtaatgtcatcacttaaggcaaggaccggccatttacacttcttttgtggtggaatgtcatcagttaaggtggggcagggcatattcacttttgtgattcttcagttacttcaggccatctgggtgtatacatgcaagtcacaggggatgtgatggcttggcttgggctcagaggcctgacattcctgccttcttatattaataagaaaaataaaacaaaatagtgttgaagtgttggggcggcgaaaatttttggggggtggtatggagacagaatgggcgatgtttctcagggctgcttcaagcgggattaggggtggcgtgggaacctagagtgggagagattaagctgaagggaggccttgtggtaaggggtgatattgtggggatgttagaagaaacatttgtcgtatagaatgattggtgatggcctggatacggttttgtacgaattgaaaaactaaatggaataacagaaggagaaaaacaggcataaaaggtttaagaattgggatgactcaggatatctgattagagagtgcctaaggagattcagcatagtcctgccagcaaagattatttatttacttcaagagttaagagtggcagtttggggatagcaccaggagatatcagctgtgatggcttggaaaaacagtgtaaaccagcagtgaaaacaagagcagggcatgtatgagtagttgagaatggtgaataggagtatgactagacaaaagatagtagggatgacaagtttttttggggcacagtctaagttggtctggtgtcgaatgagactggggcctaataaaaaggagcatctatacaggagcttaaatgggctgtaccctgtagcattctgaggacaggcctgaattctgagaaacgaaagtggtaaaagtattgtccagtcctttttaagttggtggctgagcttattgaggtgtgtctttaaaagatctttagtccgttctacttttcttgaagatggaggaccgtaagggatatgaaggtttcactgaaccctaagagcctgaaaaactaattggctgatttgagtaataaaggctcgtctgttatcagactgtatagaggtgggaaggctaaactgaggaattatgtctgacagaagggaagaaatgactgtggtggccttctcagaccctgtaggaaaggcctttacttattcagtgaaagtgtttatttagactaagaggtattttagtttcctgacttgggcatgttgagtaaagctaatttgccagtcctgggtgggggcaaatcctcgagcttgacgtgtatggaagggagggggtctgaataatccctgaggagtagaatagcagatggaacactgagaagttatttccttgagggtagatttccacgatggaaaggaaatgagaggttctaagaggcaggctagtggcttgtactatagcatagcctgcctttgctggtatgtggcgattaggcctggtggaactgccatcaataaatcaagcgtgatcagggtgaggaacaggaaaagaaggaaatatggggaaatggggtgaatatcaggtggatcagagagatacagtcatgggggtcaggtgtggtatcaggaataatgtgggaggccagattgaagtcccggccaggaacaatggtaattgtgggacttaacaaagagtgagtacagctgaaggagccgggaagcagaaagtatatgcgtcagatatgaggaagaaaatatattttggaagttatgagaaatgtagagagtgagttgagcatagtttgtgatttttagggcctctaaaagtattaaagcagcggcagccgctgcacgcagacatgagggctaggctaaaacagcaaggtcaagttgtttggacagaaaggctacagggtgcggtcctggctcttctgtaagaattctgaccacactaaccatgcctaggaaggaaaggagttgttgttttgtaagggattgaggtttgggagattaatcagacacaatcagcagggaaagcacgtgtgtttttatgagaattatgccgagataggtaacagatgaggaagaaatttgggcttgattgaagtaatgggggctgtctgtgaagccttgtggcagtacagcccaggtaatttgctgagcctaatgggtgtcagggtcagtataagtgaaagcaaagagaggctgggatgaagggtgcaaaggaatagtaaagaaagcatgtttgagatatagaacagaataatgggtagtagagggaggtattgaggataggagagtatatgggtttggcaccacggggtggataggcaaaacaatttggttgataaggcgcagattctgaactaacttgtaaaccttgtctggtttcaggacacttaaaatgggggaatggtaaggagagtttataggctttaaaaggccatgctgtagcaggcgagtgttaacaggctttaatcctttcaaagcgtgctgtgggatgggatattggcattgagtggggtaagggtgattaggctttaatgggatggtaatgggcctgtgatcagttgccagggaaggagtagagatatcctatacttgcgggttaaggtggggggatatgagaggaagactcgaaggaggctttgggttggggagaagggcggcaatgagatgtggctgtagtccaggaatagtcagggaagcagataatttggttaaaatatctcggcctaataagggaactgggcaggtggagataactaaaaaagagtgcataaaagggtgttgtctaagttggcaccagagtgggggagttttaaaaggtttagaagcctggctgtcaatacccacaacagttatgggggcaagggaaacaggcccttgaaaagaaggtaatgtggagtgggtagcctccgtattgattaagaaggggacggacttacactccactgtgagttacctaaagctcggcgtccgtgatggtctacggggcttctgaggtgatcaggcagcgtcggtcttcagccggcaagccaagaaggagtcagtcagagagccttgggccagagttccaggggctctgggagtggctgccaggtgagttgaacagtccaatttccagtggggtcccacacagatgggacacggcttaggaggaatcctgggctgcaggcattccttggcctggtgatcagatttctggcacttgtagcaagctcctgggggaggaggttctggaggaacgcctggctgctatggttcaggcgtttggaaattcttgtgtgctggagatgtgtctgggctttgtctcacagtggaggcaaggaattgcaactttttttctgttattgcacaccttgaaggtgaggttaattaagtcctgttgtggggtttgagggccaaattccagtttttggagttttatttaatgttgggagcagattgggtaataaaatgtatattgagaataagacggccttttgaccttttagggtctagggctgtaaagcgtctcagggttgctgccaaacgagccatgaactgggctgggtttttatatttgatgaaaaagagcctaaatgctatctgatttgggataaagaaaaaggagcattaaccttgactatgcctttagctctagccacctttttaagagtaaattgctgggcaggagggggagggctagtcacagaacgaaactgtaagccagaccaggtgtgaggaggggaggtgataaaaggattatagggtggaggagcggaggctgaggaagaattgggacctagctcggcctggcgaggagcagcctggggaggaagggagaggtcagatgggtctgtagaaaaggaagattagaaagactcagcgacgcttggtgttggtactggggggacaggcaggagggaaagaaggaagatttgggacaagttgcactgggcacagagactaggaagggactgatgtgtaaaagaatgcctggacgtcaggcacctcagaccgtttgcctattttacgacaagaattatttagatcttgcaggatggaaaaattcaaagtgccattttctggctatttggaactactgttgagtttgtattggggtcaggcggcattgcagaagaaaataaggcatttaggttttaggtcaggtgtgagttgaagaggttttaagtttttgagaacacaggccaagggagtagaaggaggaatggagggcggaaggttgcccatagtgaaggaaggaagcctagagaaaagagagagtagagaaacggagggaagggatttgggggttcttatcttccagaaaagtgggaaaagtggttggggtgcagaaataagggattggggcacagagatataaaaggttggggcacagaaataaggggttggggtgcagagatatgaggttggggctcagaaataagggattgggacacagagataagaggtcggggtgcagaaataagggattagggcagagagataagaggtcggggtgtggaaataagggattggggcacagagaaaagaggttggggtgcagaaataagggattggggcacagagataagaggttggggtgcagaaataagggattggggcacagagaaaagaggttggggtgcagaaataagggattggggcacagagataagaggttggggtgcagaaataagggattggggcacagagaaaagaggttggggtgcagaaataagggattggggcacagagataagaggttggggtgcagaaataagggattggggcacagagaaaagaggttggggtgcagaaataagggattggggcacagagataagaggttggggcgtggaaataagggattgggggttcttgccccgtagaaaagcgggacttgccgctaagggtgcaggagaaggggttgaggaatagttgcccctctcccaaaaaagcagagaaggggtagagacaaggagagaaggggttggggtacttgccccttccccagaaaagtgggacttgccgctaagggtgaaggaccaaggcaggcattcctgcgtggtctgacacccttgaaaggtgggtgtataatcagagacgcgtccctgcaatgattaaacaccaagggaaggctgccttcccagtctgtgaccggcgctggagttttgtgtccacggataaaatgtgtctcctttgtctctcccagaaaatgaaaggaattgaaattaagagaagggagggattgaagagtgaaagggagaaagtggttgagggacagtgagagaggttggagaagagagtaagaagaggccgcttacctgatttaaaattggtgagatgttccttgggctggttggtctgaggacctgaggtcataggtggatctttctcatggagcaaagaacagaagtacaggggattgatctcccaagggaggtcccccgatccgagtcagggcaccaaatttcatgcacgtctgtttgaagagaccaccaaacaggctttgcgtgagcaacatggctgtttatttcacctgggtgcaggctggctgagtctgaaaagagagtcagcaaagagagataagggtggggctgttttataggatttgggtaggtaaaggaaaattacagtcaaagggggttttttctctggcgggcaggagtgggggttgcaaggtgctcagtgggggtgctttttgagccaggatgagccaggaaaaggactttcgcacggtaatgtcatcacttaaggcaaggatcagccatttacacttcttttgtggtggaatgtcatcagttaaggtggggcaggacatattcacttcttttgtgattcttcagttacttcaggccatctgggtgtatacatgcaagtcataggggatgtgatggcttggcttgggctcagaggcctgacagaatctgtattggatgtaagcatatctgagcagtgcaagaggtagacggtagccaacacaatggataaagcactcaatatttccttggcttgcttgtgtcttcacctgcaattgtggagaaaaaaatgcccatctctcagtagtactatccagaagcatattcatcacagtttgtcagaggatactcagcagaagtgagtcccaacaatccactcattaacacattctatgctggctttttctttcttccactctcacttttcctattctctggctttttttttttttttaatcatctactaaataaagtactggtatccaagtttttatatcatggtattttgaggggactacaaactaagatgataagaaaactaggctttgttcttaactgtcaggaagctttttagatagcatttactattttggttccagtcctaaaaattgtttataaccttccagcaatatagctggaaaactgcaattgttcattactctgatggtctcagaatgttagtaacaaaatcatctcctatagagaggaaagcattttaacctcatgattttattataattggaaactgatggcctatgttatttttcattcttaatgtaataactattttggtagttttgaagaaacttcactcacacaccacaaatcattttaatttattctcttctggtcaaaacaggttaaatagattcaaagagcatgtacattttttttttagttcaaaaaagtttctgtaataattatctcgaaatatgcttatgaaacaagatagtgattgcaaaatgcatcatttagtgaaataaattatttttgtagattattcagttattcacatgctaactagaaggtaggtgtcacaaatatttaggtgaagaagagaaaagcaagatatttctcctttttttctcttctaatataaagtataaagattgaggaatagaatattgaaatgtggtttattacatggaaagctttagtgaggagacatgcatcaaacaaagaaaagatcttttcaccaatgccttttcataaagtcagtaatggtgtttataatggtgcctatctctggttaaacaaacagctagttttgttttgttttctttctaaaagaaattaaaaatctgagtgaccaccaaaatttcagaatcaacattgtaagttcaaaactccacatttcactaaatatcatcaataatggtttaaatttcaagcatcatgaaaccttgctaacattttcccttatcatttctttatgtttcataaatatttgaaaaatatcattgattaaaaatcccatcattttaatagtaagttaatttttatagtaaattagtacaaaagtgcatgttctgaaactcaactggccagaaatgaaggaagaacctacttacgtcttttgtacccagaagaacaccattactggaagacaaactattaatatgatcttgtaggaaaaattaactagacaaggaaatgccttaaaattcctattttatttcagagaaatcaaacattaaagtctccacaatataaaagtttaaatatttaatatttttcatgtaacaagttttggaattgtatttcatcattttgaataaacatggtaggaaaataatgcttctatgctttaataatgattctaataattttactttttacagaaatttaatatggtgggactaaggaaaatgctaatttacattctttatttttcctttctaaagacaatgatgcgtttacatttctatggtaatgatgcagttctgaaatagattcttttgcatgcacagctttcaagaaattgtatgcatgccacattcttaagaatcagcaactatgtgaaatgaatattcaaagaaggtacaaatctctaaactacttctgcagggctagttgagtcccttgttaaagtaggtagagttctcagtgctagagtataaattcaagccatctaagaaatcttacacagatgagactcactcactgcaggaaaatctaggcaaagtaagattcaaggcagtaaaacattaaaatagttagattacaacagcatttctcccatgattgagtggttcttttaaactgaaatatttctagacattctgagttagagaaaagtgcagcttaagacaatattctactgaggcttaggaagatatttttgattccctattagatggtataaagaaaagtagtagacaaaaatgaaagactggtgtgaatctgatagatctcatagatcaggtatttgagcactctgtattaaaacagaactttaggtcacaccacaaaaatatatttctttcccaagcctttttttaagaaaaaggaaaagcttggggaatttaaaactaagacttcttgatggaaatatgaaagttactaaaaaaagaacttacataatgtgggtaaatgaataaaagcatttgacaatatgttttcatagatgagtcggtctttacttctgcaaaatgaattgccaaatgtatcttgagtttagcagagttatttctttcttttcttttctttctttctttctctttcttttttttttttttaacagagtcttgctctgtcattcaggctggagtacagtggcgcaatcttggctcactgcaacttcagcctcccaggttcaagcaattctcttccctcagcctcccaagtagctgagattacaggcacaggccaccacatccagctaatttttgtatttttactagagacgggggtctcaccatgttggccaggctggtcttgaactcatgacctcgtgatccacctgccttggcctcccaaagtgctgggattacaggtgtgagctgccatgccaggccctaccagagttatttctatattttaaaagttatttttttttcatcttcataggtaagctatttactagtcttaggatgggagattgccagaagaaatacacagcatgaaaatgaagaagtggtagatgtattttctcaaatgctttattaaaatatgaaaccaaatatagacatggccatatgtctatcctgcaaaagaaaagaacaatatatgtcataaagtaacaatatatctcttgcataatggggttttatttcctcaataatgaatagcacagaaagccaaagcatcgatttgggagagttttctttgatgtctgccaatcatatgcatattgttttaggaatgttatggttttcaccaccagtttttttgatttgactttacaaagccagaaagcattagattgttatctaggcctgttccttccatcctggtaagctctcaccacatgcattgctatcaacatttaaaaatgtactttaaaaattacttaacatttaatctttggccataatatcagattgcactcactcgtattttcaaaagaaaaaaacattagttaataaatatttttttcccaaaacctgtaaggtttcacatggtgttttgtttttctccagacttcaaagcataacaatctttaaaattatttttctgcagttaaacttgaattctgagtattaggatacatatgcattagaataaaagctccttgaaggcaggggtctttatggctatatcctcaatgctgggcaccctgcttggcacatagtgacatgaatagaataaagaaattactcaccactgggtgctttaaaaaaactagagtattcaggccaggcgcggtggctcatgcctgtaatcccagcattttgggaggccgaggtgggcggaacacgagttcaagagattaagaccaatcctggccaacatggtcaaaccccgtctctactaaaaatacaaaaaattagctgggcatggtggcgcccacgcttgtagtctcagctactcaggaggctgaggcaggaggatcgcttgaacctaggaggcggaggttgcagtgagccgagatcgtgccactgcactctagcctggcgacagagtgagactccatctcaaaaacaaaacaaaatctagggtattcagtggaggggggaacaaagattactggaatagtgcaatgatatttccaagaaaacaaaatgtaaagaacaatcctgaaccaaaagaagacacataaatttcacctgcctatcaaagagatcattcactttctgcaaagaaatctctactctagcctgctttcactttttttctcatcaaagattccttcctacttttataatcccaaagcagaaatgtaatatcatactgaattctgaatttaggtgagcatagtaaaactgtctttaagttatgacatgaaaccagatattttataggtagcatatactttccttttgtggtgtacttggtctcagatcaggaaaaattaatattttatgtaccttacagacaaattcttttttgtttatggatgggagccatgattttatgtttttctctcaaagtcacacatactgaatttcatagaaccattttaccagcttatttggaactattcctccatttataaatagagattactaatcagaataattttcctgtttttctgactttcaaaatccatgtaagcaataatttttctaaaatcattataaaagtttaaactttactgtagcatattttgcttacctataatcctcctaaaatgtagtaaagtatttgatcacagataatatctattttctagacttctagaaaagtaagaatagatgtatcaatctgataaggaatatctatataatctcaaaacaaatgacatctttatggcgaattggtaaattattgaaaaattagataaagtatgcccactattagcatgtttaatgtacattatcttggccatattatccagtagaacaataataataacaatgaattaagctaattatggtgtgtttgcatagtaggatagtatttatagcattgaaaatgaacgggcgaatgctacatgcaacaacatagatgaaacttataaacaaaatgtaaaccaaatgaagccagtcacaaaagaaaactgttttcatttatataaagttcaaaaatagacatcaagatacagaataggaagtctcaaattctactacctatctctccctgaaagaaagttcaaccagcaattatcctcagaatagaatatacttttgaaaagctcaacacttgggaacaagtctgagacacctatgtagtccatagaaccaaattaagtttgaattagaaggataagaataacggtctcactctgaccatactacacaacccctttccctaatttggtataatgccagatgaagagaatttccctgggcccaccatttctacatggggaagagaacaccaaaagtattcgtgcagcttttctagcattatgagacacttcccaggaagcccactgtggtctcaccaagagtgcaacaccagggaaaacagcacagctagacttctcaggatcagatagaaacaaagaaaggaaacagagatcatattgaccaacatgtggatcttgttggtgcctctattttcctgccagctgtggtgcttgataaccgataccagccaacctcatagctcacccgcaaagctgaggtgattaccttcagaagcatggtgggcagttcaacctagcttgaattcctagattgctagcctacctgctcagcctcagagcccattctaaccactctgggagataactgtcttcacccattttggagaagctaatgggctagatcagtttgacctgggaagccaagaagcagctccattcagctgagaagcactcccagtgaccctactatcacagagatgttcatcttcatgtatttctgggaagtgtagggactaaatcaagttgatctgggaagtcaagaagcagttcctctcaaccaaattgaccaaaattacaatagtgatagataacacatgcatattttagctaatacatagcatgcttaaagggtacactaaatgttttatacatgtttttgtatttaattataaaaatcatactataactctattataaataatacataatacagtaaatgtatataataatacagagaaaacataatgatacctaacatgtcatgcttaatgtgtgcactgtcttaagtgctttatatgttcatatacttaattgtataaaatattacatgaacctattattatcttcaactttcacatgagatagcaggggtacagggaaaacaggagaccagatatatgctttgtccaatgtcacacagctccttcatggcagaatgtattataaagacagctatgtaaaaggaaggaagagaattctccatcagcatcaggtacacatttgagatgtgcctttactatctcatcatacaggcatagacactattttggtgtaaacgagagatattcctgctcctggtcagtactgacttctatttgtaaattaatttttattctctcatcaacttgttcctgcaatctttcctcgttgtttccaacagtagtgttcatgttgtggtaaaatcaccattcaacaagtaatctcttagtgagaaatcacctacaaaaactggagctaaattctgcaggtaaagttttacccccatgcctaccaccccctacttctccatgaaaatagtgcaggaggataaatgcattacaaaaatatctgaaataataaattctgtgatcttccattacaaaaatatctggaataataaattctgtgatcttccaatttaattctgccatcatgagatgaaacatactataccctagctgcattttctttttcttttatctttcttttttttttttgagatggagtcttgctctgttgcccagactagagtgcagtggcccatctcggctcactgtaacctctgcctcccaggttcaagcaattcccctgcctcagcctcccgagtagctgggattacaggcatgtgccaccacacctggctaatttttgtatttttagtagatttgaggtttcaccatattggccaggctggtctcgaactcctgaactcaaataatccacctgcctcggtctcctaaagtgttgggattacaggcatgagccactgcgtctggcccctagctgcattttctattcactttgaattggatttttgataagacaaaattaaatccattatttgaacatattattttacttaaatgagtctttacttccccagttaatatagaggtcatgatgtaaaaaacaacaaaagaggagatggattggacagagtcgatatgcatttttcaggctacataataataccaccataactatttgtgcccctaagtggtagacttgttaatattttcatacctgcctctttagtacacagtattcagtaagtctttaagctgcactttttcttctcaagcctcctacatgtaataagtaagggatagattcatacagtattgtgctatttcatgtgatttccctttatcttgggtttacttccattgcaaattgttcacatcttaaaattggatagtatctgtgacaatttatgcaactataaaaggtggaaaactctctcttaattttttttcattttttaaaaaagttttatttttaagtttcccttaaatctttcaagtagatttttaggttggctctactgcgtatgtacagtgaattgaagaaagaaaacaataatcttcactgatttggtctaagcataccagttatttgtggttttgtgcgtatgcttcaagtgctgtttttaatcacctcattggtgtaccatgcaaaacaaacttgatttttcagaggtcccaataatgcagttggaaattatctattcaaatccacattttataaataaagataggaaaacaagtattgagtggtttgttgaagcccacaatatctgtcactgatacatccaattaaaatttctaggctgcccaaaagtggaaaatgcattatttttctaatgtaccatattttttttttcttggaaatgctatcatcaaagcaaggacagtagaataagaggctataacttctgcataagagtgcagtatttaaatttgtattattgccttattaattagttacatttgagctagatggatttaagatgaaggtaatatctttaagtcaataaggtttatacttttattcagcatgctgattaatataaattatttccccaatcttcttagcttaattgaatacaatgattatatcttttttgagtttttaaaaattatttttaatagacatgataattagacataggtatggggtacagagtgatatttcaatacatgtatacagtatgaaatgatccaaatagggtaattagcacatggatcacctcaaacattgatcatttctttgtattgaaaacattcaaaatcctgtcttctactttttgagattatacaagaaattattatttactatatcaccttacaatgctatagaacactacaatttgttccttctatctagctttaattttgtatacattaaccaacctctccctatctctacctcccctacccttccttgtcagcctctagagtagcaactattctaatctttacttctatgagatcaacatttttagcttctacatatgagtgaaaacatgtcattttcatctttctgtgcctggctgatttcacttaatataatgtcctccaggctaatttgtgttaccattaatgacagaatttcattcttttttatggctgaatagtatgacattgtgttcatgggtaacatttacttatctatgcatctgttgatggacatttagattgattacgtatcttggctattgtgaagaatctgtaatagacataggagttcaggtttctatttgacatattatttcctttggatatatacccagtagggtgattgcttgatcatatggtagctctagttttaacatttagaggaacctccatactgttttccataacgaactaacttatattcccactaaccatgtataagtatttcccttttatgctgcatcaccaccagcatttgttattttttgtcttttttataatagcccttctaaggtgagataatatcttatccagatttgcctttctctgatgattagtgatgctgaccatttttttcatatatttctttttgtatggccatttgtatggcttctttggagaattgtctattcaaatcaattgcccaatttgaactgtattattatatttagtcttttgctgttgagttgtttaagattttggatattctggatattatttccttgtcagatgaatattttgcaaatattttatcccattcacaggttgtctcttcatttcattgattatttcctttactatgtagaagctccttagtttgattcaattccatttgcctgtttttcctattgtttcctgtgattttgaggtcttatttttaaaatctttgtgcaggcatatggcctaaaccatttccactatgttttcttctggtagtttcatagttttgagtctgatatttaagtcttgaatacattttgaattgatttttttttttgtattgtggcatatgagagtctattttcattcttctgcatatggatgtttagtttttgcagcaacatttatttattatcctttgcccagggtattagtccattttcacagtgctgataaagacatactcgagattgggtaatttataaaggaaagaggttcagtttactcacagttccacatggctgatgaggcctcacattcatggcagaaggcaagtaagagcaagtcacatcttacatggtggcagggaagaaagaaagagggccaagagaaatggggttccccttataaaaccatcagatcttgtgagaattattcactatgatgagaacagtatcagggaaactgcccacatgattcagttatcttccaccagatccctcccacaacatatgggaattatgggagtacaattcaagatgagatttggttagggacacagccaaaccatatcatttcacgcctggcccttcccaaatctcatgtcctcacatttcaaaaccaatcatgccttcccaacagtcccccaaagtcaactcatttcagtattaactcaaaagttcacagtccaaagtcttatttgagacaaggcaagtcccttctgcctatgagcctgtaaagtcaaaagcaagttagttacttcctagatgcaatggaagtacaggcattggataaatagacccattccaaatggaagaaatgggccaaaacaaaggggctaaaggccccatgaaagtccaaaatccagtggggcagtcaaatcttaaagtttcaaaataacctcctttgactacatgtctcacatccaggtcacactgatgcaggaggtgggttcccatggtcttgtgcagctccacccatgtggccttagggtttagcctctactcctggctgctttcatgggctagcattgagcgtctgcagcttttccaggtgcacggtccaagctgtcagtggatctaccattctcgggtctggaagacagtggcccttttcacacagctccactaggcagtgccccagtggggactctgtgtggggtttccaccccacatttctcttctacactgccctggcaggggttctagtttgcttcagggggccctgactgcagaaaatgtctgcctgggcatctagacatttccatacatcctctgaaatccaggcagaagttcccaaacctcaattcttgacttctgtgaattcacaggctcaacaccacatggaagctgccaaggcttggggtttgcatcttctgaagctatggcccaagttgtaccttggccccttttagccatggctagagtggctgggaagcagggcaccaagtcccaaggttgcacaaagtaggagggccttaagtctggcctacaaaaccatttttcctcttaggcctccaggcctgtgatgggagggcctgccacaaatgtctctgacatgccctggagatattttcccatggtcttggagatcaacatttggctccttgttacttatgcaaatttctgcaacaggcttgaatttctcccctgaaaatggttttttcttttctttctattgcatcatcagtctgcagattttccaaacttttatgctctgcttcctcttgaatgcttcactacttagaaatttcttccaccagacaccacctttaatcatctctctgaagttaaaagttctgcagatctctaacgaaggggcaaactgctactagttctcaacaagttctacatctccaactgacaccgtgtcagcctggactttattgtccatatcactatcagcattttggtcaaagccattcaacaagtctctaggaagttcctaactttcccacatcttcctgtcttttgagcactacaagtctctaggaagtttcaaacattcccacatttttctatcttctcatgagccctcaaaactgttccagcctctgcctgttacccaattccaaagttgcttccatatttttgggtatctttgcagcagcccccccactctaccagtaccaatttactgtacaagtctgtttttacactgttgaggaagccgtacccaagtctaggtactttataaaggaaagaggtttaattgactcacagttccacatggctggggaggcctcaaaattatgacagatgacaaggaagagcaaattacattttacatagcagagggaagagagaaagagaaccaagtgaaagggcatttcccttataaaatcatcagatcttgtgtgttattcactatcacaagaaaagtatagaggaaaccaccctcatgattgaattatctcccaccagatgggaattatgggagatacaattcaagatgagatttgggtggggacatatcccaaccatatcacccagtgtacttttttgtcacctttgttgaaaatcagttggctggaaatatgtaaatttactactggattctctattctgatgccttggttggtttttatcccagtaccatgctttaatggatactatagctttgtagcctatttgaagttaagtagtttgatgcccccagctttggtctttttttgcccaggattgcattggctacttggagttttttgttattccatacacattttaggatttttattttctatttttgtaaagtatggcattgataatttaataagattgcattgggtagtatggtaagtttaacaatattaatttttcccattcataaacatggtatgtgtgtccattttttgtgtattaaaataatgtgataaatccaacttgctcttagtgaatgagctttttaatatgttgctgcattcagtttgcctggtttttgttttgttttggtttggtttttttagatttttgtgtctgtgttcattagggactttggcctatacccttcttttttgttgtgtcctcatctggtttcagtgtcatggtaattctggccttgtaaaagaagtttggaagaattctctcctcttcaattttttttttttttttttttttttttttgcaataaatagagaactggtgttagttcattaaaagtttgataaaattcagcagtgaaatctttgggttttaggttttcctttgttatgataatttttattactgattgaatctcattacttgtcattggcctgttcatgttttatatttcttcttggttcaatcttggtaggtaatatgtgtctaggaacgtatccatttcctctgggttttccatgatcctttgtatttctgtgtatcaattgtcatgtatttttttttagttcgttattttatttatttgaaccttctcttttttttgtcagtctagctaactactaacactttgtcaattttatcattttttaaaaaaaactttgtttcattgttctgttgtattttttagtctctattttatttctgctgtcatctttattgtttcttgctttctactaatttggagcttggtttgttcttgcttttctagtttcttgaggtgtttgttaggttgtttatttgaaaattttctttttttgatgtagatatttattgttacaaactttcctcttagtatggcttttgctgctgtctcataggttttgatatattgttattctattttcatttgtttcaaaaactttttaaattttctttttatttctttttctttggggtctgttgctggaaaattttgcaggtgtcatgttttcttgcttctttatttatctcatgtccctatcttgatatctgcacatcgggtggaacagtcacctcttccaattttacggaatagcttttgtaggaaaagactttttcttgtagatatgacatggttaggcttcgtatctctacccaaatctcatcttgaattgtaatccctataatccccatgtgtcaagggagagaccaggtggaggtcattaaatcatgggggcagttttttccatgctgttctcctgatagtaagtgagttctcagaagatctaaaatggttttataagggcttcctcttctctttttgctcggcacttcttcctgccactttgtgaagaaggtgccttgcttcccctttgccttctgacatgattgcacgtttgctgaggcctccccggccatgctgaactgtgagtcagttaaacctctttcttttataaattacccagacttgagcagttttctatagcagtatgaaaatggactaatacaagatgtgacttgtgatgttgcttgagtagagtgctttggcttttgtttctgtgtaagagcagtaatgtagtctttgtataatatttctggtgtaatcaacatcagcaatgtctttgagtacctctgtgccttaaattgcaggcttttgtggaggcaatggcacagctttgctggaggtgggttcaccagcagcagtaggcaccaaatgtgcctgtcctcaaggcttgggggagatatgcacaactcttagtaatcaccagtcaggagaatgaggtcactgtcaactggcactaggtagctggctctgaggccctgaggtacactcatgtaaactcctctgaacattgggcatctctagtcagccatcatgatgatatccacattttttaaaactcaaatgacatctttgactctcaaattttcatatgtgaaaaatattgtcttttttttaatagagcatgtgaattcaaatcactagaattataaataaccactgccattccaaagcaggacaaaataagcattaatgatgcctttaaaagtagccatgaaaatatactatgcctatgttggttgatttttatacctgtttttactcaatcagtcattctaagctctagtgattgtttctatggtaccattcactgaataatagctataacatctttaaatgaagatcacttagtctttgcttattttttgatctcctattcttataattttgtcattctaacttttactgtaagtggtgaaaacaaaataaaaagttctcatatgatcttgttttattttgttactatttatggtaaattaccatgggctaattaaggaaaattcaaaaaaatagaaacaccaaaaccaaaaaatcacctatatttatttcaagcagtggcaacatgctaagcaataacacttctttgttttactctacgtagctgtgtgtgtgtgtgtgaacgcggtagtaaattattctgtatctgaaattatattcaaggattttccatcattgttattaaatgttactcattgctttcatagacaaccttaatacaatttagataaatttatttccctgaatttttttttttaaataagtataccactatacctagagtataagggtatttcatttttccaggtaggtaacatcatttttatatgtgcttagatgttcatcattattctcctttaggtaaccatactatagtcaacaacaatatttgtcattgtattagtaatcaatcttcttttttcctttgaaaatgacttttatgaatcaatcgccattctaaacatatttattcattccacatttatttattaatatttgtgaattgacccttatatgctaagaaacacctaaacagtgcagttttgtttcaattggaggggggacaagaaaaatgtacctctccaaacagggaatctattaattgcacattaaaacaatttaccttgattattaatcagtctcaactgtggatgccaattctttgatctacagcacctggtcaaaaatacgtcagacccacttagagttcttgcagattttggtcattattatttattggcctgaaaaaaccaggagaggctgggcgcggtggctcacgcctgtgatcccagcactttgggaggctgaggcgggcggatcacgaggtcagaaaatcgagaccatcctgtctctactaaaaatacaagaaaaattagccgggcatagtggcggccacctgtagtcccagctactcaggaggctgaggcaggagaatggcatgaatggggcggggttgcggggtgtgggcggcggagcttgcagtgagccaagatcgtgccactgcactccagcctgggcgacagagcgagactccatctcaaaaaaaaaaaaaaaaaaaaaaaagtatatatattatatatatatatatatattatatatatgtttatgtcgcaatttgaaggataacaaaatagtcatccaattttgtttatgtttatgtagcaacttgaaggataacaaaaaaaaaaaaaaaaaaagaccaggagaaagcacaagtgttataaactaaatagccacatctccaaacgtttgagaaagattctttccctcttcagtaaaaaccttaattcaaaatcacctgaatcaaaatgaaaaagtttcaaattttactaatgaaatgaaaatttctctaagcaaagtagacataaaggtcataattaggatatctttaaggagatcattttttaatctgaataatatttctcattttaaaaatatatgtttaaaaatgtatttaattatattaaatcagtacaagtcattaaaagatattattttataatactatagaaacatttctctgggggatttgagaatgttattttgaaaatttaattgtttcaacagggaaaatattgcttttttactatggttactgcataaacaatatcatccttattgaatttatctttaaaaccatcacaaataatttatcatgttagttgtttcctcctagtcatataatcagatctaatacttctgtcttaatttatgatggaaatattgtacaataaagaaaatgtcaaccataatgatgctgtttgtcatgataaaaaaactatggatccaaattctgagaagagaaaattatgtttaacgcatcaaatcatgatatttcagagaggttataacatttacatttattctgtactttgatatgggggttagtcaactgaagcatggaaaggactcaagcctatgcaactatgaggaaataaatgaataatcataatcatagctgaaaaaatatatatggtaatagtttaatatgttataagtcatttccaagttgccatttcagaaattcagtaatttctgtgggttgtaattgtgattagggaagaaagggacattttagcccaacatttatttccacaggttttattttgtatagtttatatcaacccactttaaatttcacaaatttcttcctcaggcatgacaagcccctcaaagtaattcttcaatttagatatcatggtttgttgttgttttaaatttcagggatttttgtttgattcattttaatagatttcatctttttgttgaaatctctgtcttttcatttatgttcttaacctttaccactatatcatttaacatatatattttttttgttattatactttaagtttcagggtatatgtgcacaatgtgcaggttagttacatacgtatacatgtgccatgttggtgtgctgcacccattaactcatcatttaacattaggtatatctcctaatgctatccttccccacttcccccaccccacaacaggccccggtgtgtgatgttccccttcctgtgtccatgtgttcacattgttcaattcccacctatgagtgagaacatgtggtgtttggttttttgtccttgtgatagtttgttgagaatgatggtttccagcttcatccatgtccctacaaaggacatgaactcatcattttttatggctgcatagtattccgtggtgtatatgggccacattttcttaatccagtctatcattgctggacatttgggctggttccaagtctttgctgttgtgaatagtgccacaataaacatttgtgtgcatgtgtctttatagcagcatgttttataatcctttgggtatatacccagtaatgggatggctgggtcaaatggtatttctagttctagatccctgaggaatcaccacaccaacttccacaatggttgaactagtttacagtcccaccaacagtgtaaaggtgttcctatttctccacatcctttccagcacctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatattcttcacccacttcttgatggggttgtttttttcttgtaaatttgtttgagttcattgtagattctggatgttagccctttgtcagatgagtagattgaaaaaattttctcccattctgtaggttgcctgttcactctgatggtagtttcttttgctgtgcagaagctctttagtttaattagatcccatttgtcaattttggcttttgttgccattgctttaggtgttttagacatgaagtccttgcccatgcctatgtcctgaatggtaatgcctaggttttcttctagggtttttatggttttaggtctaacatgtaagtctttaatccatcttgaattaatttttgtataaggtgtaaggaagggatccagtttgagctttctacatatggctagccagttttcccagcaccatttattaaatagggaatcctttccccatttattgtttttgtcaggtttgtcaaagatcagatagtagtagatatgcaaatcatagtttttgtaaatcccctgactgatagttttaacatctgactaacagctcaaactccttctattgattgttttagctctggaaaatggcttgtttgtttcttgctattttgtttgtcttataatttttgagtgatgttaaacattgtgaattcaagaacaataaagactgaggtgaagaacattcatagccagaaatgtatacaactcttcctctcttagggtggtagtaaataattgagttgtgtttgggctttgtttttgatatattcaccctcattgccagccagtcttctaattttttcagtgtgggctggttgaaccacatgattgagtgaggactgtggtgttggaggcttctatcagtttttgtgctccctccctttcagaatccattgcactactgtgtcaaatagagggtctctatatccatactccttcctctctaagtagactgctgttgctttttattcaatcctaaactcattacggaggcaggaagcaaacttgcggttcttcaggtgcaggttcagtcttagacaacatctatgtgcctgagtatcaggaatagggttttattattattcttgtctctctcctccccaagagaactatattcagacttgtatctctgaaggatctgaaacaggagagatacttttttcccctctttgcctccagcaagagtacacctctgctttatatcatcatagtatcctgacccataaaagttttcataaggtaagacaattttgattcattccctctccccaaaacagtgatctttgcttgatgtcagaaagaaaggttcactaacacttctccagaagttgatgagttttgctttgatccacagagcactggatctttgcctgggacctggggataagacagtttgttgcttctccctaatcagcttaaagcttttttctacctacagtgaagggtgcaggaaagtggactatagtttgaagctattctacccccatcatacctttagcatttagcgatcctccctggtcctcattctttcccatgaactcctgtgaagatctatagactagtttataattgaatgaaaatgtcctgtgtttgtgttcccaggtgttttaatttttttgtaatccacattaagcttttaggaattcattaaaatttgggttgtttttttcttatgtgcttctacagcagccccttctgtgctctgataaaatgaaacaattttaatgtcctgtctcacatccaaggtgccttctacttcttggaactcagtttactttgttgtctcattacatcagctgtctgatgggtttaagaaaaataatatttttatatatcatccagtattttctcactgttagaatcacaacaatgtttttaaatttttatatcctaatcataagcaaaaatctataaagcattttaaaatgaaaacatgtttattgcttagtgatagatctttcttccatcacagaagttcaaaatggagattagaaatttctattacagcacaaaccagaatttctctccagatatgatattccagcatacagatttgtgatctggctaatagaaatatcaaaaaacagaagagaaatcaacaacaacaacaaaaataataattttacttttggaatttagaaaatgcgttgcaacagtgtaacaaagagtgttcagtatgtattataaaaagggaaattgagggctaaaaacatttgggatatactaggattaatacaggttaatgatttgtttcctagtagacttctcttgacttttaatatattaatttgcactgcagatctgtaagagaagaaaatatctatttagcactttacaatcttatgtgaccacgaagcctcctttatttttttttatttttcccatgaacagtattccatagagctcaatgtgggaaatgctagtttagatattttttaaacacactggcatttaaaaatgtttaaatattgtcttattttcacaattttgattttgttgtgtctaattatagttaaactctcttgatgaaataaaaaatgtgaaaaagcagcaaagtttagaaaaaggagagcaaacaaaatgttgatagtgtaattttatattaacaaacttcaggtaaattctgtgaaatctaaccctaaatttagtgtccaaccacccccaactcagcattctctttagtcacataaaccatactacaaatagttcaagttaaatttgggcagagattcatattttggcttctattgctgagataatttttattgacatattccaaagaaccctttgaaaatatcttccatctgttctagaccaaatgaataaccactatttgtgttgtaaactatgggactgataaataggcaaaataatcttatgaacagaaaactttgatacctcagttatctgtttattttggaattaagatgattttgtattatgccgcatgggtaatattccacaatatttaaaaatttttattttatccttttcttcactccttaattcattcatctattcataatctgttaaatgcttaaattcaccaccaatttgcagaaccaatgaggaataaggaatctattgtatttaattctaaataaattatgtagctatccactaagaaatgaaatgttttctatgactcctttaaaatcttcaaagtcaatatatatatattatacatatgtatataaatcaagcttttgtttctctatttacactttcttcatgacttgtgctactataaaatacaatatattttataccaaaatgtacagtttatctgtggcatattccataagtatactctatacggagccacttatgtgtctagacaagtatgttacaaaaaatgttgtaaataaaagttaattatgagaaaataaaatttgatttttttaggatttaaaatgctaatgtacactatagttgacataatacaattgtttttggcttttgatatactcagacatttgcctcaactaatatgccacatgaaaaagatcagtgaaataattgacagaaaatttctttcccatggcaaagtgtaatttcttatttcaagatatataagatatgtattctttaaaaagcaaatagttatattaactcatttttgaaactttaatatttataccagaaatttgaatcacaaaataatgtctcagttttctaaccatcctttaactcaggagtgagtggcatattattaaagatcgttctattggtctttaattcctaagcaagtgatcaaactagagaaaatatgaataaaacagatatttattggagccttctaatagaaacctattacttctatgtgaaaggtttaggagaaccagaagaaataaaacttcagaaattcaagttaacaaaaaaaaccttaaaatataaagtttgcttcattatagctatttgattagtatgagttaataatatccttgtaaactgttaaaagtagagacattcaaaaagtaagctgattaaatctacatcaagcatggctgccatcttgtggggacaggatataatgtattgaggggccaatctcaataatgtgccccttttgggttaaagtcatcatttgttctccatcaatcagttgtttgatgcttatcaacatttctcttgaaatgccacatcaacatttggacagaaaagataaggtaactaaaaggactattaatgaatccctgtttctaaaagttcagtatcattgccaatgtatagacagtaagaaaactttaaaactagaagtttttcacttgaatcaaccttaaaaacagataagtttggtaaagcattcatatttattaatcatttaaattgcaaaattatattagaatttatatctaattgagttagaagataatatggcattgtctgatagggcatatagatttacagtttcatagatttacagaaagctttgaaaagaagaaagagattatgagtttattttagaagggagggaagagggaaggaaaaggaaaggaagggaagggaagaagaaagggagagatgaagagaggaaggaaggaaggaaagaaggaaggaagggaggggaggggagggaaggcgaaggaagggaagggagagatataagctattactgaggataagattttcactagtgtcacagacaaaatagtttgacagagcggtaagtggtaagtcagtgtgaagttgacctgaaaaaaatgaggtcaagataaggccagcgtaaatatgttatacaggaatatgtaatttaagtattttttcaaagcttatttaaaagtcaaaacatgtgctttctaagtttaagccttccaacaaatattagtacaacttctggaactcaattttcccatcattgtctagaaaaccaagacactgaatgagaaagcccctgaagcctcaatgagctctgaacttctttgatgtgctgagtacaaaagttactctttcagtccctcaaccaaagggaatttatgtttttcacatctgcaaataaatatcccaattacaattttacagccatttatcacaactacttgcatctatagatgatcagtctttgccttttaacagttttcctttcatgctcatattaaggttgaaatgtacttggaatcttttgtgtgactagccatatttgtaatatgaataatataatcataaataattagaaataatgatcagaatttattgtgtcccattttgatgatattattttaaaaaccaactcttttaagtttcaaataagttgactcataaattcatagatctttatactaaaacaaaataaaactcatgagtcattaaaatataattgaacagttcgttaaaattgaccaatgtaagttgatttactgctgttataacaatgagcagctgatttttaaaatttaagcattggtattcttagcagttttaacagtgaaaatgaaataattatatgttccaagaatttctattctattaccttgctttctttccacaattgtgcatgattgaagcagtcagcatttgtagtttcccctccaatgcaaatcagtttttctcaaaaattctgcttttcaaagaaaaataggcatattagtttaaatcttggggtagttcagataatctatcatttcttcaaataattgatgttcaaatcatgatcgatgcctgaatgaagtaacagtctccaccttggaagaataaactcaacaaacatgatttacttacattttattttaaatagttaatcatttgttataaaactttagttaatgagggtattttcctgccaatacatgccagaatttcacaaggtttgaatttaagtacagtgggccaggtacatcacttatttccatataataaggcttgaattaaagttaagcagccttaatgagaccaacagatagctgtcattaaaacatttaatatgcacagctagtgaattcatattttttcttctggaatttaacatctaactcacacattataaatatttgtatccagctaactacatattacattatgacagacaattttctaaagtagtagaaaatatagttaatatatatttattatatatttattaattaggaatcattgaatgtagaaattatttcaacagtaaaaagactgattgttattcttgaaaaatcaaacagccaatgttaaatttatactaactttcttgtgtaacttttggaaagccaaaacttgttgttctactgtttcttctgattggcaggagtggtcattataccttaagggctttttttgatgtgtcacccagactcatttaaatgtctgagtattagaacagtgattctgaactatggctgcatagcagagccctgtatagaggcttttagaatatattacaggctgtgtcccaaactccagagattctgattaaattagccttaagtgaccattttaaaaagcttctcagattatttcaaagtgaatctacatttgaaaactactaaactggaggatttgggaataatgaaaatgctttgctcacagtacactaaaacatttccaagaggggaaatagtatgaatatgactatacaatatttgactttctccaggacagatactcattagccaggactggactagttaatgctctgaagttcttcctagttatcttattctaagatatcatggtgttctttccatgttaaatggttataatttttcttgatagaatacataatgacttaccaatttttagaatgtcactgtaaataatatttgaaggaagctatggggagtgcatctcttctttcaattcattatctgaataagcaaagtataatctatggaattgcatcaaaacactttataaagtaaaatgacattaacaccaacattaatataatcaatattgagtcaatgtctactaatggaaacaaaagataagagaatgatcaaaattgagagtaattaatcagtgaatgcttcttggaagcactggtttgttccagattcagaaggaagtgatgaaattcaagtcaacaaaggggttctctgtaaaatgctgtgttgaataaaatgtgaatgagctttggttttcactctcaaggcatttatgatctaacttagtagtagttctgtctaactctaatacaaaatagggtgtgttacgacagcatagaagatagatggatttattccacattaaaggactggacactacttcatgggcaaaaggaatttgaactagcccttgagatggtgaaggagagtggttgggaggacaaatacgtgctttccaagcagaaatattaacataagtaaaaatatggcagcaaaacattttctggaatgttcaggaaaaagtgtacaagatgaatgaaaacagccagaagtgagaatgtacaactgtgtctggaaaaatagtaacccaattcagaaggctagagagaagggctcaagtgagggaacgggaggaaaagaggtttgccaaacttggaggtaaggctttgaaaggttgtgtaatgagcttgacatccacacatccaacattcctaaagaattccaattataactgagacaatattatgacattaatacctgacctcgactagtcactcgattgtgttaacaaatcttcagtttgcaatgaggccagattgacataagtcaatcattataagaaaagaagtcacaatgatcaggattttatcttaaggaataagcttgcagaaaatcctttcactggagactgagaggctgtcattcaggacttcctcagctttttccatggaagagagtacccaacttcctcattcggaatttatctacataggttattaagctactcaatgaaatattttgaccaaatgtttatgaaaaatttttctgttttatttaattattctgcttttttattttaatttcaagatcttttctatcctgatagagaagaatttctatcaatagaaaggatttcaggaacctttctctatcctgattgcctaaaaaatacactggagacagaaaaaaaaaatcattgtataaaaggtaattagcacgttctctcctttttataactttataattgaaatctcattaaaagctttctaggtctgtatttccctaagtgaccaggtgtccctaatttgttttcaaccaatgtgactaattccaggcaaagactagaaaaagtctgatacctgttagagaatagcaaggttaaataagtggggtggcttttttaggttgcatttaacctcgtaaaataaagaaaggaaaaaaaaagcttcaatgtctttttacagtcctgcctttttctcagtcccggttgaagattccatgggaaatgagagcactattttgtttctcccttgtattgcagatagggggaggaggtggttattagagagaagctcttcctctcttggtttccccctctctccgcctgacagcaccgctctctcgcaggctcgctccttctcctaggtgatccatttctaggcaacgtggggctggtgctgaagctgccaggctcgctccttgcttcctgcatcccgccaggcgaaacgctccaaaagcatcctgcagcctgcggcggcttccctcctctggcccggccccgctgctcgcgcccggcgcaacccccccgccaccgcgccccagcaaaccggctccccgggcccgcctcgccaagctgcgttccgcgcctcacgcagaaagggaattttctctgcattactatctgcattaccttgaagttcactttttctacccctcttggagagggcttttttcccccctccctggtggaatctggctgctccgtttggaatctcctaatctttcctttccacttagattctggcagcgaagaccagtgattctctgcgggctgtaggggcgggggcgggggtcttttttggtccgagagggtgcggggaagggggcacatccggcgtgaggggggtgttggaagttgcagcggagctgggaccggagacccgcggcccccgcgcagcgatgggtctgatctgagccccagcctctccccctgcccaagagcagtagaggctggatatatttttcaaaagccaaactgcaaacaactctggcgatgccaaaattcccctccaagtgacacggctttgcgaaggaggtttcctcaggctgggctctttctgtcattcccttctgcctttctcggcgacgataaaaggctttgctctggcaataggaatttagaaaaaaagaaaaagctgcgctaaactccaccgtgacctcaaactctttggactgtttgaaaaaaaaaaaattggaagaaaatccatcctccaagagaatcggcataggaggagatggaagttttcccctttctcttggttttgtccgtctggtggtctcgaacctgggactcggcgaatgcggattcgatcattcacatcggtaagaaagtgttggtgcagctcgtggttacttttaccgtttcagttctcaaatgtttccccttcgctttccccctctccggtctctgtgtgtcttgttggaggtggcttcagttcattgccccttcccgctacccttccctcacacttgctcagttttctgaaaggatgtggatgctcgaacctcgactgacttgtgctgttgttttgcagtgattcgtggaatgtggctggatgcgtgggggtctcgagttgacctgagtgtgagtgtgtgctgggaactgcagggggattctaagtgtgtggggaaagggagtttaattgactcttatcttccatattttttttcccggatgtacatttgctccatttaaaaatttatctttgggggagcagagaagctgtcacctgtgagatgaaaagaactgggctggggggtagggggagctcccttcggatcgaacaggtggttttgcaacgtgagccggctgagttcgccgcagcttagtgcgatggtgacgggggtgccggatgcgcccccagccaccctctcttctcacatcttcttggctttatgatccttgcgtgtagtctttgagacggtggcaggaggggctggcggcagtgtcgccaaggactgattgtcgcgtgcctcgcctcctcggacacgctcccggggcctggcgcggcggcgaaactgaccccggggcgcttgggaaacgcggggaagcgaatgcgcgcaggctgctcccgaggtctgcttagcagatatccgccttgcctcgcctcgcctcgcctcgcagtcaactccgagtagccgcgcaaggcagacagcgaaggcgccgggactactgcgggccgcgactctgagaaggactgccgagcgggctccgagatgctggtggccccacctattggcaaccagacgggccgggactggccgcggcgagcaggggcgggcggggggctgcgcgtcattatcatgcacagcgctcgcagcttcaggctccaactctactcacttgctaatccgtgagagctgagcgggagacaggctcttgcagccttttctgcgttaatgcgacgatttctttttcggaaattcgcttaccgagccagcaaggtttctttgctgggctgcagagaggtccctttgggggaatttttctgggcacaggacttttatctgtacgcatggcttggtgttctgcaaattgaggcgacagatgggtcacagcttctcccctttctgtacccctgcttctccaccgcacaacacgcatacacatacacacacgcacgtacacatactcctggtaggggaatctgctgcaggtggcgattgtgcccgcccaagcgagggatttctgtctagcgtgcgcgcccacagtggccagcccctccgctccagggggctccctctcttggtctcagaggctgtctttgtaaacatgtctgccattctctatcatttatatcagtagaactgtctgtctctgtgcaaggggtaatgaggtcaggattcagaaaacctagcgtttgtgcattaagtaagtcaagcactaatagcttgcctgctggatcccgttttgcctgggggctaacagtgcctacagattcagaacttttcagcaagaaattatggtctcattgagtggttcagcaatgttctgatagagttcagaaatgaactatgctccttttagagaaatggcatacatttatatctagttgtaaatgattggagcaggaatgcagatatataatcataatacctttatattcattgtatgattagggatttctgatgtaggctcctcatctctcaggagggaaagcctgtggaagaatgctttttttaaatcgcttattctgtggtctgcatgataaatacattatttacaaatacctacagcttttgctatcccttactagttaaatattattttgcaatgcagtctggacatctgtttcaaaatagaacaaaactgttgtattttttagtttgtatactgttgtctgtcagagtggctataatcacatttaaaaattaactgtgtacaaattacagatttctttagaaagttggttgtatacattaactgtgtatatcctactaacagatatagttacttctgagacaattaatttgacttgaatataattagtacattagatgagataattagctgttttatagactacctaatattgtcatgaggctagcaaattgtttcaaaaactttatcttttataatatatcgaaaaacattaactcctaaattaaaaaaataaaaaatgatgacgggtagtatgtgtgtaattcagtgcctccacccctactctcagcaaaagtatagtaaattcaaaaccgaatgtccatattaaaattgtaaagcaccagttaacatgaattggattagtttccttacttgtttgaataggaaaagaattaattttctttaggaggtgttgccttcatttaaatatttaatgtgagaaatatgtttctggggaaatatattagttcaggactgaaggaatgaatgtgatgaaactggagggaaagggaatatttcacctctagcgatggaaggagatatgcagaaatgaaaggttttcccagcctcatgtgatgtgttcaagcagaaagtagctgcaatatgtagttcaggcaaactggaaagatgaaaagacactgctctaagaggctttttatatattgaattattttggtattgaaccaacttatatatacatgaaaatcatctccttctttctctctttctcttcagtttttacctcatgccggtagtttaataaggtcaattacacattttaaactctaatatgttttgttaaacatattgattcactacagtgatgaaacataatggttaaaccataatgattgaaatgaaaatgtatttattttagtcaaaaatgcacaattttatgattactttgagtttcaaatatttaaaaatatttaatcattacgtatatttttaatacacatccacacacagatacacaaccatatagtatttaaaaatgaatcacttccattgtgatcttctttgccccaattaaagaaaggtcttttgacatataaaaactatgcaattttgaattatgcttctactttgagcctatgcattgattgagtaatttcatcagacccacattacttgattgcttagaagtttcctaatgatctgcatgctgtaggaagaaccaaaaagtcgtgagtggaatggcaatgatactgtgttttatgaggctattcagaagtcgctctgatttatgtagctagaaagctccaaagtctttgagattagccacgctgactgctattttcttcatacatcagtcgtcccacactctttactccctaaacacaacaggagtttagagcactgctttaattcagcagggattaggtggcatttccagtcaactgcacagtttgtgttttgcttcatatcaactatggaagatctcatgttttaacagtttaatatatgctcctttctttatctggttcctgtgctcacagaactgattgtaaattagctgtcctcagttatacatctctacaagggaacactcaaacagtgtacttattcatatattatacaaatcactagcatatttttgttgttttcagtcatagtaaaataccttatgtcaacatggagtagaaaagatgcatttattcatgtttttctcacaaacagatgatactttatcctctgaaatcataatcagctgtgatattatatttgagaaacctaagataatccacagaatattttcactatgagaatgttcaaattaaagtacaaaatcgggtaaataaaaggtgtcaacacattaaaaacaataatagattgtaaatgtaaaataccagttattcttacttctgcactaaggattattttgacaattacagcatataaaagcattcccagaagatgtgctgttcttttaccatttttttttttcagttgactacatgatttgcattggttaatgataacccccaggactcctcaaggattttttggattgtgtaagatgtctcaatgatattttatcctttttctacttatagtagttgtttgttcctgaagttcttgataactgtgtaaacgtctagaatgtactaagggacttggctttactattcttctctgtatcattaatacagttatttgaagcacaattcaagtgtgtattaagttagacaatgttgttattaatcaaagataccaactatgacatgactaataagccattacactaagggcctttgctttctacgccaggtgaaatgtacatccactaaatatctgttataaattttaagccaaataggaataaaaatccaggtgattaacttttgatttattaaaaaataaaagccaattgaaattgttaggagtgatggaagatacattttattccattctgatatctcaggctaattttatcatatggtaattttatcttaaagggccattgcaatttcaaaagcacactttttaatccagaagttttttttcttcacctacacctacgtatatgactttattttaaaaagtaagatattcacatttctattggatcatcatgatattttagattacagacagcatattggtgagtagcaatacttagaatgtattactatagtataatgtttattagaaaatacatttatggcctataaagatatctttgccattaggtgtcactgcattctgagctgtatttttttttttagtactacttgaaaaccacatgaaatatttttaaaaatctcagaaaaaaatgtcattttaatgaggtttgtgatgctgtaagaaaataggtagtttttattttcaaactagaaaaataaatatgatccctgtctcttattcttgtaagaatttaatgctaggacatatcaacacacctgataccctctaaacaaattagattgctagacctagtgatacaattttttttcttatatttaaaataggagagaaatatcttcttaaactaatacttattctctatgaataaaatctaagacacctggaaggatgcaagtgtgtttaatactgctggagtaaacacacattagtgaataaagtagtttgttaagcagcttctaacggtggtagctctgcttacctatgggatacttgaggtcccaaactgattgttgtttttgagacaaaacatatgaaaatagagttgtggggaaaaaaaaacacatggacacaaatacatctaaaaataatgtcaaccattgagttttatgaatgaccatatatgttttcagataatttttgcctggttaattgtatgcattgtatcgattccttgcatagttgcacctccaccactactatcactacaagtaccacaattatagggtttatttgttcatgtaaaactcataactattctcacatagtaatttatttgttttgtaaaaaggcactatcttccttctagcatatttcattataagaataatggaggatgaaatttagggcaacttttaatctgataatttagttttaacattggcaaactcacattattagagaatgcaacactagtttaactgaatgaatggtttgtcttatgttagattttgccctatgccaaagttcattaattattggaaaattaaatgattagacagatgtctaaaagataagaaaaaatactaaacagttctggaattgattattagaacatctatggattcatgtcattaaattggcaaattttagcatattgatgtggacacacatttcagagaatttgacaaacatatgggcaatgttaaggtataataaaaaaaagtattctggattagaatttagaaggtattggactaaatctcaatttataaatagctaattgaatacattggaaagttatttaatttttagtcttcatttttatcaaccctaaaataagatttagactaatgttcatttaatctctaagattatatgaactaaatggagaacaattgctatatttaaggaggaacagaaaggaattgggagaagagatacagtcaagtgtggctatatttaatagctgccttagagtgaccttcaaaaaaggaaatacaaggggaaataaggaacatgaaatcttaattacacaagttaagaactctttaaattgaagatgtctttgttgcaaacaagaattatgtacatttcttcatcaggtattctggataactagtatctgattgagagagctggatttgttttttgttttcgattttgttttcgttttgtctattattagtaccaaggtgttacctacagcatcactcctatagaacactgcaaaattagtgtttaacactaattggagggatgaatagtcttatgtatcaactatcattgtgtatgtacacttgcctttagaatttgcaaactgggagtgcatcaggaatattaacatatgctttatatcactacaaacaaaagtagagtataaagaaagcaaccaattcaaagttcttcactatcctggactcctgcttcaggtttttatgcttttatcctactgttgttcaccaagtagtcatcaatgtgaagctgaggctgagttgaccccgaaagcttcttgagtagatacagggaagccaagtgaacaccagaagctaagcaccaaaggcctacttatggtcttaaatattcttaaatcactctgtagtcaagttccttattaacagatttttaaaatgaaaaacattaggtagtaaattatattacaatagcaatttgcatatgtttttctttaaactaaaataattaaaagtactattttaaaaaataatctcattttattgagcagagtacctgatttttttcataagtaagcttaaataagatatttgcttcattaataaagtcattataattctagaagttaatattcctgaaagtatatggtaatataagcattactaccaacatgtagtatgtgtgctaattgggagaatattcttttattcagcaaacattttattctgaatttactctgtatgaagcattgcttttagtctctaaaattaaaatgttgaaccaacaagctatgtttttgtatttaaggaacttacattctcatggaagaggcaaccagataagaaaatatatgatgtaatgtcaaatattgataaatgctatgaagcaaaatgagggaatgaagggtgacaaagtatgttttcattggaacagagacttgatccaaagaaaggatgtgaaccatgtggatatctgatgaagaataattcagtcagaggatatagcaagaatgacggccatgagataagacactaagaaaatctgcttagtttacttaagaaatatattcaaaggcaattggagtatagttcagtgagaaaagcaggaagtggaagtaaatggggtctgagagggcactgaggaagattctgtagggacttacaggccatggtaaggtatttaaatcttctaggtatatttgggttaagataaaatgtgtgatatgaaatagtttgtattttagaaagataacattctttgcttaagtgcactggatagagtagaagtataaattgacaatagcaaattggatcaaggtggtagcttagctaaatgtacagttatcagattgtggacataatgtgaagatcggaaaaacaggattttctgatagatgagccaggtgggagagatccagagaaagtaaagaggcttccaaggtattttacccaaatacatggagtaaatgtgttactgttgactaatattcggaatatgggggcatgagcaagtttagggtacaaatcaaaatgtgcatttattaaattttgtattagacatcaaacttgagagtttaaattggaagtttattatatgatcctgaaattaagaggtgagtttgggatttgagctgtacatttggggaatatatcattgtaaatatagactcctgtaagaatagtcataatcaaagaatcaaaaaacagtagatgttggcatggatgtggcagtcagggaacacttctacactgctggtgggaatgtaagctagtatagcaactatggaaaacagtgtggagatttcttaaagaactaaaagtagaactatcatttgatgcagcagcaaccccactactggatatctacccagaggaaaagaagtcattattcaaaaaagatacttgaacatgcatgtttatagcagcacaattcacaatagcaaaatcatggaaccaactcaaatgcctgtcaaagaatgagtggataaagaaactctgatatgtgtgtgtgtgtgtgtgtgtgtgtgtgtgtgtgtgtgtgtatatgagatggaatactactcagccataaaaaagaacgaattaacagcatttgcaatgacttggatgagattagagactattattctaagtgaagtaattcaggaatggaaaactaaacattgtatgttctcactgatatgtgggagctaagctatgaggacacaaaggcataataataatacagtggactttggggacttgcgaagaagggttggtggggataaaagacaacaaatatggtgcagtgtgtactgctttggtgatgagtgcaccaggttctcacgaatctcccctaaagaaacttacttatgtaaccaaataccacctgtaccccaataacttagggaaaagtaaaattaaaagaaagaaaataataataaaataaataaaaataaaggaatggaggggaagacgtgcagagagagaagagttccaagactaggtcatttagcattccaaaagtttgagtccaaggagagcagcggatgcaggaaaagagaaatattagtagcctgggagacaggaggaaaaccaggagtacatggtattctggaagccatgtgagaaaagtaattctagaaggagaagtgagaaaccctgttgaattgtatgtatgcaaatggagatttgattgctgggcttgaaaatgttgaggacaaagatgactttaaagaaagtgctcttagtggactacaagtgacaaaatactgattgtagagaacccgaagatttaatagaatatgaggaattctatgagttttgtcataagaaagtggtaaggaaggggatattaggttaagggaaggatttccttttacagctgggcattggtatatatatgtaattttctgaatattcagtcctaagagaattatcagtaaaatgatttaaaattgatacacctttttctttcaacttatataattcctgagtttggatagaaaacgttcaaatagaaaggaaatctgtttttttttctttttctttttcttttataaattggatcaagtgacaccaggccaaacacactgaaattaacctgagagacaagtttagagtttagatttcatttagtttcccagattgccattcaaatttcatagaaattttttatctgaacttaagagcagattacattttacatagtattgctataacattacaaatgtcataaatatttagtcatttggtaatgtactaattccaggaacacacaatatttctattctgttagtggtattaaaatgcataaaattcttgttataatagacaaatttaaatccattgtaaatttcctctgagtgcattctgttatgaatttgatttgcttcaaacatcactttggaaacatttttttaaaaagtttttaatgtgtagagggacaaaaaggatatatgtgttgaggatacctaatccagaaatctaaaatccaaatgccccaacatttgacacttttcaacactgacatcataacacaaatagaaaattccacacctgacctcatgtggtggatgcacaaaattatagaaaaaagttgtatgaaattatcttaccttctggctatgtgtgtaaggtatatatgaagcataaatgaacttaatgtttacatttagtactatccccaagatatctcattgtttatacgcaactattccaaaatctgaaaaaattctgaaaaccaaaacacttcaagtcccaagcatttcaggtaaaggatactcaacgtgtagtaattacagggcaaagtttatcattgcagcatagaaattaaatagatacaataaattcatttggcatatcatattcatatgatttctgtgacacatttaaatatttccttttatggatcttttacttatttgtgctaaacaatggatgatagattttcagtcataggtggacatgaggaaaggaaatgttctaaatttagtaacctcagaattcagccttttgaatatgaatcttagttctttcattagtattaatataaccataagttgtgtattttgattttgcacctaaaataataatatctgtactaaaataagcatgctaatagcaggtgaattatattttttgtgttctttgttgttgtaagtgttatgtcctctataaaaacatttcatcatatggaaacaatgtgatatggatgtcagatggttgtttctgctctgatacatctgttaattgatatgtaaatatggaatatttgaacaatgagagggtaggagtcttatagtttgagaatagcaatgactcacaaaaaaagcaaattgtgttctggctggagcctaggaacttaattgatgaaatacagaacattgaaagatattttctatttactagttcatagcttcttggggtggtgaaatatcatttgaaggaaatgctgcgtggacttaaatccaaacttaagttggaatgaacccctaaaactggtgaagtgtttactatatataacttcaacatcattaaaatgtcatgtcattgattgacttagtatcttaaaatccaaagaccaggtaataccttagtagctttggtgagacaagagaacttagtcctggccatgcacggtggctcacgcctgtaatcccaacacttcgggaggctgaggcgggtggatcacctgaggtcaggagttcaagatcagcctgaccaacatggtgaaaccccgtctctactaaaaatacaaaaattaactgggcatggtggtgtgcgcctgtaatcccagctactcaggggctgaggcaggagaattgcttgaacccaggaagtggaggttgcagtgagctgagatcgcaccattgcactccagcctgggcaacaagagtgaaactccaactcaaaaaaaaacaaaaacaaaaagcaaaaaaaaaaaaaaaaaaaaagaaaagagaacccgttctgttgttctgttgtatgacatttaaagcgaattaaaatccagaagactgattcctgcttctaataatctctgcaatctgacaaccaacaaaattgggttagtggtttagtggcagttgctgtcttgctactcagaatccagatattctttgctgcttctgtgaatggaaataacagaaaccattgaattttctttttagatataccaacaactctcagcatagcccagtagaagcatggcctatataagaaccattatacatttcttcttaaatggtttttcaatttttaacaccttattaatgtgggtgatgcttcatccacagatgtaagagggactgctcttctgttctcttgtggtgtagtcatggtgagttttggacattttctataatccattaatttcaagctgagaaattatgactcaaatctcatattccatttgcagaacatatcaatttagggttacatgaaaccataacgtgacatttttgggtgtgtcaccagattttttttacacctattgtgtggttataagaatacagatcattgaaacaagacacgtttcatatccttagaactttcaggagtatctgccttctaagaaaatattataacattaggaagctgaaggtagaacaattcagaactcccagctgaacgactgtggtctactatggcactggagattgtgataattcaataaatgccatttttatagtagcctaaaggtgccataaaaacatatatttcagaaaaagacatagaaatgggatcaggaggttatcacatacaaatggtctttatagtagaaatctcatttctcagctttctgatggttcaccatattgtagctataggctacaaagtaaatacaatcatgccaatttcagatctaaggaagaattttttattattttaattcttttattttttaaaaatagatgtcagtaattctcatgcaagcttaagtaatgaaggaggaggcgttaagatgtggttatttggtaattaattaagctaatgagatcttttctaaatttaatactgtatatcagatattgcattaagcatgatttcttgggtatagaaaaataaaattgccttttttactctcacttctgaagttaatagtacactgttctttcatattactaatctatcctcactgctgtatgtataaaacatcagtgaaaatgacagttttatgacatttgacatttatgacatttgacatttatgacttttgaccatgacagaataatctacctcatggcagaagtaaaataaagtttctttacaagtggcataactattattaggaaaacatatttatatagacttttaattatataggtgtaattgaaaacagggaaaacattgaaaactgaacataacagattgttcgcaaactaactgtccagtgcttctatttttctccacaagagttcatgctgtggttaataaacagttaataaatagcaaaactggctgctttgattttttctttttatttttcctgtctacccttcagtggcaatactaatgagcagtgaaatggccaaaagcaagaaaaaaggagcaaagggttttagataatctataaaccagaaaatcagtccctgactgctcgtatgcacaggcttgctgagaagaaatagttttattttctcaaaatatcacccagattctgaagatagaacttgctcttggctgctgagttagtgagacaagtgaagcttttgggccaccaaagaagaataagctgaatgacactgactgggagcaaagtgaagaatattatcactgaaaaaaactgccctccaggggtaatgctgctgacaaccagggccccagtgattggctcagttgcttgcatcatatttatggtgatttttaaaaataaaatgcaatataaattgcagctatactacttaaaaactttagataattatgtataaactgggttgtattgatattcctgtcaatacacattgagtcttgagcatctacattgtatataccctgttgacctcctgttgatggtatattatagaccatgaagaggaatttgaatattgcactcttaaaaaggaactgtgaagcacatgacaatgataaatgcaaaaatctgactagcaattaatagagggaaaagggaaggtgatgtgatggagaggtacatagtttcaacattattgatggtgttttatttattaagttgggtggttgtttcacaagtgttggatatatatgtgtgtatatatatatatatatatttttttttttttttttggtaagcaatattatatctgttgttactctgctcacagagaaatcgactggttcagttcacttccactttagttagggaataagttgttttcttttaggcccctccatcaggtaggttggctaagtttacaaccctctttggagggaaagagagtgcatactatatgcctatatgccaggactttttttttttttttttttttttttgagacagagtctcactctgtcacccaggctggagtgcagtggcacgctcatggcttactgcagtcttgatctcctgagctcaggcgatgctcccacctcagcctccctaatgtttgtattttttgcagagggaattttctcatgttgcccaagctggtctcaaactcctgagctcaaatgatctgcccacctcagcctcccaaagtgctgggattacaagcgtgagcaccatgcccagccagcaggactattaaatagcaagtcagagaagaattcaggagtctgtcttcaagcacagtgatccctgtggtggattcaacaatccagttgcctttcgctaccatttagaacagcatctttgaatctttgtttcttatttggtgtaggcagggagctcccttaaatgttcaaatcaaagagaagagaggaaggaatgtacagagggaacaactggtttgatgctatgagaggtggtttggcatatttcgtgttttgaatatttcataatgcgtattttaaatgagaatgtataatatttttgttagtgatattacactacaattattaccttctatctcactcttggataagaaaatatgaacaattattttataatgtatccttagagatacttactcctaagaagtgaatttttcctttatcttatatgcatgttattcttggtttgattaatcaagaataattgataatgagtctaatctacctaaatgatttcttgatattttaatattatgtgtcattcactcccaattcaaagtaagatgtactgtaatgatgaaagaaaaaataccttcttgcagccaattgagcttcatgatgtggcccttgattgaatttccaatggaatagttcattttaatctgtacaaattggaagcaatgagaggaagaaaagtttccatgaaacatccttagaggcagcaaagaggttcttttagaatgtcaggtcattcaggcctttggcctgaggattagcaggggagatgcctagggaagctaataggttctcaacgctgccagaatctgcctcttggaaaatagttatctttaatttttggtgccatttaacaaaatgttgtatcttttgtgcttcctgtctggacaaagcagagaagaaataatactgtcatataagaaggggacctatgtttgggaagtcagagacaatattttacatccctgaatttcaaggactaattcagtgtctggcagaatacatacagttatgaaattttacattgtttgtcacatgtccatatttgctttcaaatcttagtttttcagttttaatcaggaataataacaatagctcccaccttggctgggtcatttttaggataaaaagtcattatgtctgtaaatatgcttattgaactctcaaatatgctgtaaatataagagaagaaatattggaatactgcatttgtggtggaaggtgttgcttaggagagaggtgagagaggttgcagccagtgtactgatcattcttttgaagtgggagtaagtacagaaaattcaatacaggaaaccaagaaagagaaaccatttcgggagagaaatggagttcagttttgaactcaaaatgattttggcataactgtgaagtgtatatctcagacagtggtttcacaatgatcccctttcctgcctcagatggagaaaataaagattatttttcatagtggtcaattctattttgacctaaaaaaggaaacagtgtttttctagtcatctttttctagcttttcctcaaattcaacgttaatagtgtcatttcctatttaaaatgtgaaccatttaaagtatattcagggtacttatgttcagaaaatactaattctacaccaggaggcttatgatctttagttcctgtgtctacttatgtctcagtttagaattaatttcgaataatattacctacttttttttctcttttttttgagacagagtctcactctgttgcccagactggagtgtagtgtcgtgatctctgctaactgcaacctctgcctcccaggttccagtgattctcttgcctcagcctcccaagtaacagggattacaggcacacgccaccaacatgcctagctaatttttgtattattagtagaaagagagtttcaccatgttggccaggctggttttgaactcctgacctcaagcgatccacctgcctcggcctcccaaagtgctgggattacaggcatgagccaccacccccagctgatattacctacttttgaaaatatttcttttttcttagtatttctgttttttactataagtgtacattttaaaatcaaagtctggtcctaatttaagagaatggcaccattaatttatttgctgttgatttccagtcaaaagagttttaaaacagaatgatctttgatggaatcttaggttgtcaaatataaaataaaaagataatttttatttcttgttcataatttcttttatagtttcatattgaatgtataattctcttacataaattaatagaattacatagaaggatcgaaatatgttttatagaattttgtgttctttagttacattttctctgaaaacataattagctagaggaaaggaaacttgtgctccaaggatggcagaagtaaagcctgaagtgggacagagatcccatttagaaccaaactaaaggaatcttgttgggacttcgggcctcttttttccacctcccctagaagactccaccttcattgttaaggacctgtgttttctgataagaaaagacatttgcaaatactgatctgcagatggaagaacgtgaaagcagaggcagtgtgcttgtgtgtgcgcaaaaacactgttcaaactgagaagtgggatagagtggatccacgtaagccaagtgttctttctgtctctttgcatctttgtttagagtctagcttttcagcatgttttttctaatatgtaaagtcagtgataacttcaataaaaacaatttaggtatgaaattattggaacttaatttgaccatctcattcttttttgctcttaataagtcggtccattgtaaaagagccaagagtggaaaattgagtgctccaatgggaaggaagggtctcagcatctttttcttgctcccaggcagtctaatgaatatcaaggtagattaaatataagaaatttagaatcaatggagcataacttgaatgagttgacccagtcaaaaattgtgatgattggtcatttttataaacagtcagagtaggatagagtaggaaaatataagcgttgtatttgatgtcaggcttatatgttcaaatcttgccttggtctttttctacttcctggctgtgaagtccttggatgagtgatggaattttcaaagtctcaaatttacctgctccacctcatctgttatatggatacattgcaataaaatttaaaatatggacttatggactattgcaaataaggttcatatttcaggaaattgaacttgcaacttacatgtactgctaatcagggtcctagattaggcattagaaagtgacatgagaaacatgagatcaaatagggttccctgtttatccctgttcctgaaagatttagatttataactatggcttttctacaacatataaatcaaagttgaaagcctttctggtaagtatgtggatttaaggttaactgttctttcaaagatgatatctcattataaatttacatgaagtagatggctaaaatgtttgctagggctgattctgatgtttagctctgtcttggtggcgacactcttttcttagctttggtctaatataggatgatctcctaaatgtattgtccagtttattgtccaaaccaggactcctttcggaataaaaaggataatatactattaagatagctcttggcaaaggaaaaatgcttgaggtgatagatatcccatttaccctgatgtgattactacacattgcatgtgtgtatcaaagtatctcatgtaacctatacatatgtatacctactatatacccacaaaaattaaaaagtgttgctgttggggtgaaaaagacacatttggactgattggaggcaaactggggcaaataagcaccctagtattagaatactgcctatgggcctgtgatcagcttgaagtttggctcagcctcaatgttcccctaggtatattctctttcaatcgccaataattctgtcttagcagcaggttattctttccttttatgctgattaaagaaacaaattatattttgttttggctatgttttatttttaattacttagaggacttttactttttccttcacaggcagcagaaaaaaggacaaatagctaagtataagttgtcttccttcatataaacatatttaactgatttttaaaaatcagaatctagtgcctgtaattgctccctttattattatttttttgtcctttctccctatctgctaattgagtgcaacttctagcagaactgattggacattggcaattgcatgaattcatacccaacctcaaatgcttttacaagtattctcacatggagtgtactgttttttaaaaatgtaaagatagtttaccaaaaagattaaaatttgctttaccttgagtcccaagaggagaaatcatcaagtaaccaacagttttgatcatttttattttttacagaactctattataaagtaacaatgacttcaaataagatgttagccttaacggttaaggtttcataagtgtatatacatttttaaaaggctatttgttatagataataactataagatattgtcttgcatttttgaattaattcttctctagataccatgttatctaatttattcaacctctacaaacttttgtctcaggtgtgccctttctgtttcatgtagaagtcattagattctcctaaaagttttttttcctatctctgttccaaagtccagttttacctgaagaaatgattgtgtggtagcctgcattggtctcttcccctcattctcttgctctttcattgctggcctactttatgtaaaccttactccttgttttacttctggcatcccaggttttttgtggtcttatcactttctatgttttccacatgaaactggctttgagagcatcattctcacactgtgctctgaagcttgccaccttcctcctttcttcttctctggtgattttggcctgatccttaagtcactttcctttagaaattacatgatcataggctcattcatggaaagactgttagagattgtccagagcctaggaccctcttttgctcatgagcacattgagaggttaagtggctcaaatgcttcacaggtaggaattttttgaatactctatgaatttttactaaaaataggaattatattcatatcatcaaagtaatattaatgtggcctattaatgtgggctatctaggagatagaaatagcccgattatgtagaatttgttaattgttttcattacatgggatccatttttacctgtgctctactatattgtattagagtacaataattaattcctttgaagcctattgaatataatgtaagaggtaactaacccagtgtttggagaactattcctacaacctgctaggtgcagtgaatatatcatcctctaggtttctcacagaatttagaacccagcagagtttactccagttccaaatcctatttcttttcatgcagatccaaacccttttccacagcttgcactctccactcttctttcctactgtctctcctgcccatcctttctctctgtccccaggctcagattggaactcttttcttcccagattaactaaaattaattcagtgtctatcagaaacatgtcactatgtatacatgtatttgcttgggaatattttaaattggtgctaaatgataattttgtgttgtaatcctcttatttgcaaaggctacataaaatattcttgattatattcttgcatagcctataacatgttcttaggtttcctatgctatgtttatcctcaataataaacttttatatacacatacatacatacagacacacacacacacacacacacacactgactttgcacagcatcttctgtatcactgtaggaagccttaaagtaatactaaattaacaaaaagatgtgtatattgcaaatgcaaataacatctctatgatttattcaaattatagtgaaaatctatatatgctgatatggatatgcatttgtcaccaggactggtttgttgaaggttttaatagtcaaacatagtttgtaattatgttaaaaagacatgagataatttttcatagttttcacatatcatttattgaacaaataccattgtaataatattagtggaaatcagagttcaaaattatcacactatgtaagaaaaatctcttccaaaaatccaactatacaaaaaataaatcagctttgcttttacatatttccttctgatttcagtctttgtgcatgcacaactgagcatgctgtaatatatatacagtatatgattatatgttatatttaggcacccatctctatcattatttcagtagatgttactaatcttggagctttaattgttaattcattgaactaaaagtcatggagcttgtcacatgtgtctcagctcaaatgccattttacccaaattttagcacttatggacaattaattttaaccttctttaccgtagtgtttttatatgtaaaatgtagatatgaccacctagcttgaagggtcaaatgaaaaatacattaagtaaatgaaacagattttgaaagaatgaaagtgactggcccacaatgaattttcagtcagtattagctttccttcccctttcttctgtgccttccctcaaaacttcataaatataataaatgtaatagactttatttaaataattgtacattttacttcagtctgttttgtgcacatttgccaaatatcttgaggctagagttaattgatttttgtaattatgtcaagtgaagaaaactgcctatgaatatatgagttatttatattcccattttcaaactcaaacaaagagatttgctattagtttaacatgacagaaaacacctagtacaaatttttgttattttttttattctttctccttttggcttcagaactttcataaaataggaatctttccagttactgataaacccataatctttttactgcttggactcattttaagatataactcttctttcatgaccatttaactttatacttttatatctttaaagtcataatctcttcaatctatattgttttctgatttttaatgttcatgtttcagcaatcaattcttaatttcttaatttcttttaactttatttaaacaattatccacattcccgggtctactctttttctaaaacttctaatatatactgtactgaaaagtttgttttctcccatgtttatgtaagataattctacacatgaaaagtatgcttacatgaaaaaaaatagagggagatagaagttacagggatttaggtaagcatttaattctcctggcagttttacatactggaactgatttaccaactgttcttttataaaattaaactagacttgtctttcagaattgagctatcactgcaattttaatcaacaaaactagttcctagatttataactgattaaaggtcagtaacttattgagacatttggaggcaaatcagaacaatgagcataagtacactgaacataagtccacaatactaatttaaaggcattttaatgaaaaatgacttttattgtattgtagatttagaattattattactaaaatacagctaaagtatttctatggtgtataaaggattactgaactagtttgcccacctttggtgccactatcatgaatgtaataaataaatacagtctccttaaccctactttatctgttagtaaaaatacccagtgggattctatagaagtatagaatatatagaaaggataaagtgaaaatgactacatccataatctgtaatgaaaatgatttattacttgttattcatggtcacctataaaaaccaaataatcagagtaacatttattaagtactcacaatatgccaatcattgttgcaagcactttctaggcattatctcattaacgtgtagcaataatcttaataatgctggtgttatacccattttgcagaggagataaaggaagttaaacaatgctatataatttgcataacttctctgaggcacagaagataaataatactgtccgatatctgtgcttatttgtccccttattaactgtgtcaagaacagttttcactgggtttgtatcctttccatgcatcctctgcacttcttttttcctcaggtagtccccttgccaacaagaagccacattctttcctagagccctctctgattttctgatcactgtgatccaggttactccacacatttctactacattgccacattgtagtgtttggcacctctttgctgccagccgtaaaaaatttaaaaaaggcaaaatatttcttctactgagtggtcattaaaatatcctagtttttgtttcttttttggtgctttacaaatagctataattttaaggtagcttttgctgcatcacacaatgtcagtgattactctgaaatcactaataggctcagtgtctacccctttaagtatctgttcacttctctccagtttgtcagtatcaagtagttgaagctagcatgcactttatttcacattattcctagataattaaatatcagtttttaacaacattcctgcctgtaatcctagattttgtgtgtgtgtgtgtgtgtgccttctcaatctctagtcccaagttaaacaatttcactcagatccccattttagagtgtaccacatggtagggagtaactacacatatgtcacatgtattctatgttttatctttctttctaactgagagataagagtgcttagttagccatgattccttggcctagtgttatggaaatttgccagatctttatagtaaactagcccagtcctacataaaacatttaaccaatattcttcccttattatgaaaaaaagattaaatttaattatttcacagaaatatttcaactgttatagtttcacatttttaaaaaataaaatttttagaacatatgtttcaatgtgtttcttcctgaaattttgttgtcctctaatccgcaagacatttcaacattgtttctgaacacgtattctttggctgttcccctcacgtagagaatagaaagaaactaaaaaagaaattaacaatgattaaaataatacatgaaataggaagttaagactatagtgcattatttacagtaagtcatttttatttggtaagatgatgcgctgtgttaaggtcatcaggaaaggaaaaaaaggaaaacataaaagattatttttaccattatattttcagtttgcttctaatatatgttaatgtataaagtgataaatgctcattcatttgaaaaggggctatataagatagagacagggagaaatgtcaaatgtcaaataatagcaaaaacaaataatacacacattcaagagggagaatgacctttagaatgtctaacagctgcatgtggtctaggtctctgctggaacaggataaggactgcatcttatgccatgttaaatgttcttctctgcaggagtaccagagcaggggaaaggtgcaagagagtgacaggtcatttcagctaatgtcagccagatatgtggactttatcactaaagataccagagatttatggaatggaacactttgaagttcagccagagtggttgaaaataaacattcagaagtaatcacagcataacggacttgcgttcattaggaaaatgatgacaacttgtttctgttatatgtggttatactcctaccatatttgcattaacctctgctagcttctcaagtaatcatgccaaggacactggtatctctttcactagagacgatagattggattctaaatttactatagcattaaacttgtatttttccctggattgttcttgaattttcttgttttgaaaggtaattttatgcccgtgatcacaaacagcataataaaatgtaacctgagaaaaacctttgttagcttaaggaactaaaaacaacattattttgtttttgtttctgttgggtgttcggaataaatttaaaaagcagaagtacctgtaagaaatgaatcttttaggagtgtgcttttctaactgctacagctaaggattagttaatacctactgggaagtgttttctcaatattaatttctgttttcatgtttcctctttatgtccttgtaaattatttgttcatttttatttttagcagaaaagagaagattggacttgaagctggaataaattattatttcacattatttttaaataatttactctctggatgtccctagtctcctgggtagagtttgctctgtgtgcacgtgtatatatatgtgtgtgcacacgtgcatgctaattttacttcataatagtcattttttccatgtctagctttcactattcaagattattaaccctaaattgttaatattccaagaataataattccaaatggttaagcatcacaagtggaatagtaccaaaattcttaaactttttttttctgaggttctgatcctctaggaagctgatagtacagaactgtgcttgctggcttctttttaagccctctctatttaaactttggagtttattataaaaggaaagaaaaccaaagatgacatctacatactttatttccctattttagcttccccagagtcatgctgaattgcatgaactcaattcaatcatattgatgtttctccctgcttgctcacttttaatactcatttacttagtgtctgtcctgttggtcatttgtaagataaaattggcagaaaattttatgtaattattatttcattgcatttaaatctcatcctgtctactttatagagttgttaggaggcccaaatgaaaaattgcaaagcacaatgatatatattgattattttgatatttagcacattttgtagaatatctacatatgccctgggtaaacaatgataaacaaaatagaaaaaacactcaaaaatcttgtcttcctgcagcttacctctaaaatggaagacaggcaataaaggaatgatgacatatggaggtctatgaagaaaaaacaggagcaaaatggggtagagagtgatagaggatatgaatttagattagggggccaatgacattgtgtctgaggaaatgacatacaacagagactaaaactaagtgattattcaggaatagattattctagtgggaagaaagagtaagggaaaggagagaagagagagagggaagagaaaggagaaaaaggaagaggagtatgggaggaaagagagagagagagagagagagagagagagagaaacatgctagacattttgaagaaccagcaagaatgttagtgtagccaacagtgaggcaggcaaaggtgagtaaggtagattagttcagggaagaaaacataacattatttaatccattgtgggccacattgcactatgataacactatcatgtcatagagtctcaccattgtttaagatgtttaaattttttaatacgaatatattctcacaccctccgttttttagtcaaaaacctctccctgaatatcctgacaacatgacagaggatctgctgttcctcttcagagttagtttccttgcttggaaggctccttgacagcagtaaccagaatcttgcagtggtttggatggctggttttagtagtagtgacctctgtacaagcgtgtctcactttcaatggaatgtccacaaggcacagattacagattacctctacatgttaattggatctatcatactacttgggcaatatttataaatagagttggtaagatttcaagaattcctcccctcaagaaagaagaatgcttagataaatttttattcatagagacaataattggaaacgtcttattcattattccaaaaagaatcttcttgtggtttctataaacaaagtagctaatataatataaacttaagtttaaacttgactttatattatttcttttgtgaaaaaccattttatatatatacatgtcattataaaatatatatataatcatatagcctgtgaattacagtggaaattctaagttcttgaaacaaatttctagctagtaactaaagagaaattagaatgtgaaaaagttctgaatttttttcaaactcatcttctcaaatgtatatgaaaatgatctcaaattaggatatttacatttctaggaaaatgtggtgtcctttaaaagtatgcactggaatttcacttatcaaaattcatttaaaaactctttattgagcaattactactctgttcaaggccatgtgttattcactgtggaggtactatattaaataaaattgtagagtttgtcctacttgtagttcataggagattgagatgtataaagaattgttgcaaaacacagatcatgcagtttgaatcattattgccaaataatgtgtcagactgaccttgatttactttttgaataaagttttaaatggttaaaatatattttaatttctattaaagttagcacaaactctatatattatttttaagtagaaaggcaagagaaactatgtgctaaccacaaaaagtgccagtggataagcagtctgaaatttagacattagaggtgaaattcaggttacggcacttagcccgatctgtcttactttagttagctgagcattgatctgtcttctagtatttgtgttaccccagaaggaaaagaatttgccttacatattttgctgctcccatgaggaatggcgctttgcttttcttttattgagggtaagcaaatacttgtgaaataatagaaagataggaaaggaggaaggaagaaagggaatacatgcagacacacagtatctactagtttttcatttgttatttcttctaaattcagaaaactggaatgactcaatagctgacacaatttatataaaaaacagtcaaattgctactgtttagagagcagaccctattgagccagacaatttttttaaaatcctggtttacataacactgtaatcttctacattttaatttatacagtagagttaattcctatttcattggacttttaggcttactttgaataagatgaggtatttacaaatctaacacacaatagaggcaggaacacctgctgcatgatttcctagcattattttcccctacctctttccagtatgtcctgatttcactgtggatatctacagatattgctgcactaggagtacagcatgtgacccagccttcattaaaccattgcatgtgattctcttgtcagtggtagttggtaagggggtcacacatgtcctaaactggcagagtttcagagagtctcagaaattatgcttgaagcttagaaacttgaacacacgtttacccattttcagtgatagtacttttctcagtccctttctgctgctataggataatatcacagactgggtagtttataaggaaaaaaaaatttacttggatcatggttttggtggctgagaggtccacgattgaggggctgcatcttgtgagggtcttcttgcagcatcatctaatggcacaaggcagaagggaaacagggcattcgtgagagaacaacagattgaactcacagcctcaagccccctcataatcagcattagatcattcatgaaggtggagccctcatgacttaaacacttcctgttagaccccagctcccaccactattgcactggggaataagtttccaacacatgctttctggggaacacattcaaaccacggcgttccacccctggtcccccaaattcacatccttctcaaattgaaaaatatattcatttcatcctatagtcccccaaatcttaacccattctaatatcaccttaaaaatacaaagtttaaagtttcatctaaatcaaatatgagtgagacttaaagcatgatttattctgaggcaaattattttccatctgtgaaattaacaagttatgtgcttccaaaatacaatggtgggataggcatagggtagacatttccatttcaaaggggagaagcaggcaagaagaaaagaataacaattcccatgtgagtccaaaacccaacaacgaaaacaaaattcttaaagctgtggaataatctcctttgattccatgttgctcatcctgggaaaactggggtggggttggcccttaaggcctcaggcagtcctgtttctattgctgtcctgggctcagtccactcagcagctctcacagatgggagttttgttcctgcaagtctacttggctggaattgtactctgggggctgtatagttctggggtcttgaaggcagccctgcctcccatggctccactaagcattaccctagtggagactctctgttgtggctctattcctgtaacaagtctctgcctggtctcccaggctgtctgagacatcctttgaaatctggatgaaggccagaatggccccacagatattgcattctgctcatctgcagagtcagcaccatgtgttgcttgtgtgtacgtggtgacacaagctgcagctgagcccactggagccacgattaggggtcagttgagccaatgttctggtggccaaggaacactgcactggaatgtagtgggcagagtaccaagctggccatgggcagtgaatgctgaggccccacaggtgcctttctggaaactttgtcctcaagatcttagtttgcctctaagatctcagaaatgcctttagggtcattctcccattatgttgaatagcacctgactgccttctatttgtactaatctttttagcagatggttgcttggacactcttggtttgctctcctaaataagcctttttcatctttacatggccaggctatgaattttctaaatttttcccttctgcttcccttttatttataaattatatctttaaataatttttctccatttgcatcttactatacatggttaaaactagacaaacaacttcttccgtattttgtttagaagtttatcccaccagataccctttttaaaaacatttcatttatttagttagatatggggtcttggtttgttactcaggctgaagtgcagtggcatgatcattgattagcatcaaattcctggtttcaagtgatcctcctgcctcagcctcctaagtatcttggactacatgcatgtgccaccacatgcaactaattttcttttcattttttagagatgaggtctcactatgttacccaggttggtctcaatcttctgggcccttgcaattctcccatctcagtctcctgagtagctgggattataggcacaagctacctagactggctcccaccaggtatcctggttcactgctcttaaattctgccttgcataaaatcctagggcctggacacaattcctccacattctttgctactttataacaaggatggcctttactccgttttgcaataacttgttcctcatttctgtcttagacctcattggaactgcctttgccatccatatttccaccaacattctgattatgaccacttaagtaatccctaagaagatttaggctcttgttacagctcttgttttcttcttagcccttgctggaattgcccttaatgttccatttatagcaatctgtgcttttgttagcctactccttcaaattcttcctgcctctatccattatctagttccaaagtcacttccacattttcaggtatttgttattgcaagaacagagatttatttcttatagttcttcaagttgggatgctcaagagcatggtggtggtatttggtgaggacttctgtactgcatcatcccacggcagaaggcagaagggcaagagcacatgagaggaagagagcaagaggagtctcaactcgtttttttttttaacaagcccactctggcaataatgaacccactctctttataatgacattaatgcccacaaggtagagctctcgtgatgtaatcagctcttaaaggtcccaccactcaacactactacaatggggactaagattccaacacataaattttgggggacacattcaaatcataacagtactgtatgtggatgaaaaacctacacttgctctctctatcttggctttcagcctgacaacaaagccagcatgcagaacagagctgagccaagaaaatcacagaggaacagagccaagttttgatagtactgtgaacctctggatcaaattgtgcctggagcctgccctccctctagagttttcattatacgagccaataattttctgttcaaagttgatttagttttcttttttattctacattaagaatttgaactgatacaataggtagtcaataaatctcagcttcatgacctcttcagcagttgactactatattggaaagggtcacattccttgtggctttttatcttgttgtttgaaagaactgtggtctaagaaaaattatgtttaaagttttaacttcagagttagcatcaagctacaccctttgcagaataagagtggtatattacaaagtttggcatgaagttactctcagcctgagtgggttggaatcccaatccttttagacacttgctgtgtgacctacagtgatttactcaacatatcagaacttgttttctcatcacataaaagatcttggtattcttttctcacagatttattgtcaaataagagaattgctgcaaagcactgagagatttgcccagcatgtaatgaactctcagtaatcattaatcattattatgatttatttttctttcagtctgactttggggaaaagttatgttaggaagctgctgaatctcaattatgattttcagtattaagcaaagaaatcacaggtatcttgtgttatgagtaagtcaatgcatttcccaattgatctgaagcactttttcttacttatgcaattaaaggaagtctaaagtatacaataaaaagttatttgtattttaaagggtataccattactggggaatattttctgccaaataaaaaataatgagttactcagagagatggttgaatgactagacttgaatggtaataaaaagccaaatgccaaatttgcacataaaaatcatcttagaagtgtaccctgagtgattgattccaagcattggtttatctgatgcttgagaagtcaataattgaatagtttttaaagagctatgtggtggtccatggaaggaaagtcactgttttttactttattttatgaggacaaaatttatgtgtatacactgacaaacttacaaatgcaaaaaaattaaattgctgcataattttattatttagggataagaatggctaacattataatgtatggccttgattttcattacatacacacaaatatttgcggtaatgtctatgttatacaagtacatatgtgcatgtgtgtacacatttatttgtaagtaatttagtgttctggcttcatgtatgcttagtaattcttagatgtcataaggacaccataatcttcatatatttagaactgatatccttttctaacccctttttcactcaaagcttcattatgatgtctgtttcagtgacaggcaacaacatctagcagttgggaaagccagatccctataaaaatgcttgaagcctcctttattctccaacctcctaaccaattaaacatgagtcccattgtttctgcttcctaaatatctcaaatctgtccattcctccacatttctacacttgatcttagccaaaaggttaagaagcaatcgttcctccacatttctgtactattccatagccagagttcccatcatctctgactttggctgctgcagtaacctcaaaacttgcatattggtgtccactacccctactcacctattctcctcagagtaatttgagtaatattttaaaaattaaaaataacatcatgtccctactgtgcttaaaatctgtatcttactatttggcctccatgggtcttaagataaaacagtaaacgttttacatgacttataagtctctagatttttagatctctacctcctcaccaaccattgctactcttatcttttgcttttttagtttctcaaaggtgtcatgctgcttcttcttcaggaccattgatttttttgcttcctatatctagatgactcttgaaacatcacacccatcatgccccacgattctaatcaaatgttatttcctcactggagtctttttggctttacggaccaagtcaggtctttcgttgttgtttttttttttttttttttttcatgaattttgcttatacttcacagcatttacctcagtagaaattaaaatgtgggggttctttgaaactttatataatatgtctctcatgctactatatacttcacaaggtcagggactgtatcttaacttgtcagagccatatctccattatttagcatagactttgctcgtaagactgcacataatcttttgtccttttattgtttcataaactctgtcttatcttttctaaaataatgtttttaattttggattgttgtttcactgttaagatagaaaacggtttatttaaccaagccccctgttattggacttttaaattatttttgtctacttattataaataatattgcgatgagttcaggaattcattgaattaaaggcattgtagcttaagttctctacaagcagagcctgagttggagattcttgggtaagcaatttattgaggaatgtgcccagaagaaaagtgaactgagtgaggaaagcagaatagggcagaggtagaagctaagtgtattagtctgttctgacactgctatgaagaaatggctgagactgggtcacctcagaaaactcaacaatcatggccgaaggcacttcttcacaaggctgctggagagagaagtgagcaagagaggagctaccaaacacttatgaaaccatcagatcttgtaagaactcactcactatcagaagaactgcttgggagcaaccactcccgtgatccagtcacctcccaccaggtctctcccttgatacctagggattaaattgcccaaggagatttgggtggggacacaaagcctaaccttatcactaggcaaataaatggttccagaagaagtctttcctgagccagattccaacgaggtatctggagtgaaaatagcaccacagtagttatcactcttagaaactaagcatctaggctgttacatccattattctttggccatgaactgcctgcgtgtgtgcatatgtgtgtgtctgtgtataagtgcacaggtgtaaacttacagtggcttgcctgtacatgggatctagaagaagcaccaacagtatctggtacaaaaaagaactagggatgctgcatggaagagatttttcttaagtattaagccttgggacatggtaggattttgatatatacttcagagggaaaatatgttctgaagagaaaaaacaaaagcacaataaggaaagtgctgagcatgttttagagaaattgaatagtttgttataaataaaatagaggtaaagtgaggtgtgagtatttggagacaaaaattataaagacggattgtacctataccataaaataacttaaattttaaactttatagaatatacattgtgaacagaaaagtttttcaatgaagagtattcacagatacattgcattcgtataattttgggttacttttaaaggtctaaatattgtctactgacacatagtttcttacagtattaattgagaaattatgatagtttaagtaagcacaaaattatataacattgttcctggtgttgagactcttacaatataggaacatacacaaaaacatacacacatatttgcatatatatagtatctctcagttttatgtgtattaaattcatgatacaaaaaagaattgttctgaaacatagctatctatctaaaacattgtatggtaaaaattcataaaacttacgtctatgttcctaaatgtcataaaaacaattgaaaattcatttttaaaggaaatgacatgcaaaatagtgtaaagaaaagcatattttgtgtacacgtagaaaatcttgtgttcataaacattatttaaaatcttaaattataatcttgactcctaaaacataaatctaatatttagttattctcaatttaatttttctcatttgtaaaatgctgttggacactctttattttacaggaggtgtggcaattgaagttaatgagttaatgtttatagatgctttttgaggcctttagatgaaaggtacaatataaatccaaaatattaatctttaggtgtgaaatactctaattacttcccattgccatagggacattattggagatttataccttcctctaaaatacctggaacaattgttatatgagaaagcataattttaggtgaaccattataattctgtagtcattaccatgtatcaaaaaataaagtatatgtgttatatattcagcaccttcttatttcccattattcatttattgatatacaaacattaagatgactcggaaagctgatccattatgctgttctatctatgttgctgctagaatcttttttatatacagaaataaggggaaaatatttttaaaaagaggttgagagagcagctactgtactccatatattggttttaacactagaccaattcaatattcattaactatcctatgatagcaaaggaagaaaattcgtcattgtagtagtattcttatatttaagtaatgaaagtggtaccatttatcgactatatatatttaccaggcatggtgcttatcatatttcatacattattatgatcctcatagtaaccctataaatggagatggaactgtggaatttaaacatgagcaaaggagacaaacaacaggtaattaattagctcaaggtcacagaagatttaaacccaggcaatgtagaatcctgagttttttctttaacccctgaagtatactaatttccccaaatgctaccactttattattctgtttatttcactgttatggatcctactgaatctagactgcacaagataattttaataacgaaataaaactcgaagaagttctcaccagaagcagaggtttcccttgccaagttattctacatgagctgcttatctggtttcttgccaaaccaatatgcataaacactgaaattgcagaaagaagaatgcaaatcacaaagctcgtttttattaggctcatgttgaaaacacataactgagcttagcacgtgtaaactgagtttaagaatggttgtggcattttcttgaaaactgggaaaaaatattgtatatttatactccacaaagtaaaccaaaaatatccctttgaagtatttaaatgaacaataaaaaataatgtattatttaagataattataaaataaagctattacttgtgaaaatttggagaaattatgattctagtttaaaagtggtatctcctttctcctttctttctatttcgctctcccacctcacccccatcatctcccatatacttgtacaatcacaatcaccgttcatgtaaatcaaatttctgaaaccaaaaacgaggtcttattcctgctcagtccaatctatttgccacattttcccgcatgagtgtcccaaagtaaatttgtatgatgttatttacagcatctcagagactccatcaacattcaattctgatcttggtgcacaaagcccttcttgatttggcacttgcttaatttccagttcactcctgccactctcagatgtgcttcctgatctttgactttccctgtagaaatgctacctgcttgttcatggcttggtgcctttcaccatgttgttctctctaactggaattctacatgatgaacacctactcattgctcaaaattcaatgtaaataaatagttctctgagaagtgtttctgaccttctccaaacagaaggatgatcacccctgtctagacgcttgcatagcactctgcatttactatattgaattataatttttattcagcatattgcattgcaattacttattcactaccatatttattatcagcctattaaaacctgtgcctgtggcttattggtcttgtttaccatgactggtacagtgcagagtaatgtctagacagttaaaatgggaacttctctgtctctgagtttttttctgagaccacaaagcagacaacagtatgggtcaagtatttttacattttagactgtctatatgagcttgtaaagggggttcttaaaccattcctgcagttttgtgataagcaaatattataaataagttaagttctaatacaatatcacctcagtattatatacaaaagggcagtatctagtatataaaatataaaatgtgtatactatacagtatatggtatacagtagatagtatatataaaagcgcagtaagctgctgcccttttttatttaatatatgtggcttatacatttgatggtgttaatttttcaaatcaggttagaaaatcttatcagtctgctagcacacttcagttttgcacctttattacttctgtcactgccatgttatgttactattgaaaataagccctgtatggtccaatgtgtcctacctaatgtggatcacttgctagtttagattcctacagcaagagatggcagttctccactgactttctaaggcttcagagatttttttcagtttatattcatatgctcagctatttcactgaaaaatgatgccactaaagtctagagctgcttctacccccatccacagcctacattgcaatccagcttccccaaggccactcaataataaatgtgatgataaatctgttacaagcagataaacacttgagaatcaaggttcatctattggacacctatggataaatgagtatttggggtatttaaaaaatttatgtggcccagcgtggtggctcacgtctgtaatcccagcactttgggaggccgaggcgggcggatcacgagattgagaccatcctggctaacgcacggtgaaaccccatctctactaaaaatacaaaaaaattagccaggcgtggtggcgggcgcctgtagtcccagcttcttcggaggctgaggcgggagaatggcatgaactcgggaggcagagcttgcagtgagctgagatcgcgccattgcactccagcctgggcgacagcgagactccatctcaaaaaaaaaaaaaaaaatgtttatgtagcaacttgaggataccaagatggtcatccattgtaccttgctggataatttttaaattgaggaataacaaacttatttaacattttattcattaattaaaaaatatttattattgtactactgcgctgggcactgagaattcaggaatgaacaaaatattccaagttgctatgctcagggaacttacaatctatttggggagacaaaaaatgcactaaaatgtaaatatgtatgtgtgtgtatatatatacacccataaatatttatacacatatgtatgtatatgtcaatatcatcaggagacttaacatccagttggagaaaataagttatatgttaaataaaattcaacagttaaataatgcatagaaatataaaataataattaaaagtcccaagagagaatggattttggtgtatttgtttaaatagtgaaactatgaattaagaggatgtgatcactctagcttgaaagggttattgaaggaaaggagacttgagcctgaagaagccatataattagagaagtcagtgatctcatcaatggctcattttagttaaagcatttagaagcaacagtcttacattagaactctagaatgtttaggaagatttactcataacctatacatatcaatagaaaggtgttcttggaaggaaattcattaaacaaaatctgatacatcaactaagactcaattctgagtgttccttcatagatttctgcctaaacaattttggtggagggaattttcagtaacaccataaagtgagtatattgattgtcactgtgaagaaaagcatacagattttcaggcaatctgttcattgatagatgtcttaataaacttcaaaactggcagctgcttcccaatatcctaatattactaattgtgctatattctcttcgtcacaaactatatcctgggaatgagttgacaacctatagaaagataaggatctcggtcccgtgtgttcactgtgtacaccacgaatgaatgggcaattgtggcatagtgtaataggcattcagtgaatatatttgttaagtgaatgaaatatataatatgaactgaaagatataaactgagtattccctatagtcctatggggaaatttgacatatttcgctataatgcaaaaataaatttaatttatcatttcttatttaagcttattatattctcaatatttctctcctgcttatctattggagttcctctgtaaatttaacttttttgtaaaacttcgattttcttctctgtgtgtttttttgcatggtgggtgatgttaccaactgcaaaaaaaaaagctcaaatcaaatcaacatatatatgtttgtaattatacacatgcttagtactattattatatatgtaatatttacatactatacataaacatacactatacacattataaatgtacactctctgtatttacaattaacccttgaacaatgtggagattgtggtactgaccccctgtacagtcaaaaatactcatataactttttacttcctagaaacttaactactcatagcctactgtagactggaagcctaactaatagcataaacagtatatataatgtgttatatataaaaatatgtgtttttaaatatatgtgtttatattatatatatatttggagatggagttttgctcttgtagcccaggctggagtgcaatggtgtgatctcggctcactggaacctctgcctccgaggttcaagcaattctcctgcctcatcctcccgagtagttgggattataggcacccgccaccatgcctggctaaattttgtatttttagtagagacagggtttcaccatgttggccagtctggtcttgaactcctgaccttgggtgatccaccagtcttggcctcccaaagtgctggaattataggcgtgagccagtgctcccagctatatatgtattatatactgtttccttacaaaaagtaagccaaagaaatcataaggaagaaaaagtatattttatgttaagcagaagtggatcatcataaaggtcttcctccttgtcttcacattaaataggtagaggaaaaacaggaagaggaggagctggtcttgctgtctcagaggtggcagaggtataagaaaatctgcatataagtggatctgtgcagttcaaacctgtgttactcaagggtcaacttataatttaataattataatacaatatacaatttttttaatgctaagatgaagccaggcgactgagctgatctgagactacattttctgtaggcatgccatctgggtttctttaagcacacctattccccttcctcaattttcaatagaaatgtgttatttgcccattatttgtaaataaaagtatttagagtataaaattaattgaggaccactgtgaaagggcttagaaattcttaactaaccactttcttccctatgagttttacatgtattgcatcattatatttccctttattacctaacatttttaagattcttggtttctattcaagttatcttttgctgcaaaatatctttttccttacaaacttagtggctcaaaacaagaagatttattttgctgaggaatctgtgatttgggcagtgctcgacagggacaactattcctttcttcactcggattcgagtggtgtagctcaaaggctacaggctagaattttctgccagcttgctcattggtggtgaatgctcagatcagttggaacctcatcagggatggggctagaatacctacctgtggcttttctgtaattccacatagtgtattgtctgaggtctcaggtgaatgtcccaaagagatagagggaagctttattgcccctgaagtcacatagccttccttctgccatcttctgtttattagaagcaagtcactaaggctggccttttttgaaatgtagggagttagataccacctttaaaaaaaattatctcaatagttttgtgggtccaggtagtttttgtttacatggataagttctttagcagtgatttctgagagactttagtccacctgtcacccaagtagtgtacactgtacccaatatgtagttgtttatccctcaccctcctttcagctttctcccctgagtcccaaagtccattatattattcttatacatttacaactttatagcttagctccctcttataagagagaacatgtgatgtttggttttccatacccgagctacttcacttagaataatagcttccagctcttataagagagaacatgtgatgtttggttttccatacccgagctacttcacttagaataatagcttccagctccatccaagttgctacaaaagaaattatttcattccatttatggctgagtagtattccatagtgtgtctataccatgttttctttatccactttttggtcgatgggcacttagattagttccatatctttgcaattgcaaattgtgctgctataaacgtgtgtgcatctgtctttttcatatagtgacttcttttcctttgggtagatacccagtagtgggatagctggatggactgatagttctacttggaaacttcgtactgttttccatagtggttgttctgatttacatttctaccaggagtgtaaaagtgtagacaccacctttaatggttaaatattgcagaaaatcatctcagctttctaagtcataaatgatattatggtaaagacaattttgaaatttcacagagaattttttaaaaattatctataacgatttcctgctattgccagtttctggatatcttctgcttatttaaagatgaaaaaagcccccaatacttttttgaccatcacacaaactatcttgaggtctcttgtaaattaaaacacaaaagttcttgaaagtaagcatcgttagccttctccttttggtttcttaattaaccccataatcagcatattcaatcatcaatctttttagtatacaaatgatacaaagtgacttatcaaaagtgttgttaataatttacaggtaatagagtaaatttatatgtttatgtacctcactttacttcttgggaaagacatttcgtgtcaaaaagcataatctgaacaaacaagaagcaccactactgattgggaaactacttactttagtgctaccttatcagctcttacctataagccatgtcagctcctcactggttttcatccctaagtgacatcagcagcagcaacagctattgtgttattgatttaaatccttctgagatcaattcaaaggaggagaggtctcatttccattggtttgtcctgtttatcttgtgtagggacacaagtctgagaaatcaaaattttattctcttgtttctaacaagccttacaacattatatttcattcatggtataatttgactcatattttattttctgaactttttttgttttgttttgtttgcgacagggtcttgctctgttgcccaggctagagtgcagtggtgcagtctcggctcactgcagccttgacctgccaggctcaactgctcttcccacctcagcccccacaagtagctggaactgcaagcaagcaccaccatgcctggccaatttttgtgtttttctgtggaaatggagcctcactgtgttgcccaggctggtctggtacttgaactcaagtaatccacctgccttggcctctgggattacaggcatgagccaccgtgcccagcctatttcctgaactttaaatacaatatcagggagaaaatcaacaatattttgcagtaaaagttcgaatattcatgtaaacatttgtactcttttcccattccattggaatagttaataaaatcagaatataaaaatttcatatgcaattaaaaaattcatgataagttaaaggagtttccatcttttagtttaatgatttaaagattttacttctaattattttagttgcaagtgatatgtatttatgcatatatctatctctcattatgcatctgtctctctatctatctcatcatcttttgatacttctcctaggctgaatgtttcacattttttctcttagtccagaaaatatgttctgctttcctgcttatatggggaaaatgaccactgccaatagcttcaagtttatttctctcttattccagaaggctggcagattgagattagaatctctcatccaattttagtttctgaggagcaactgatttgccaagctggtgtcagctttttagccctgaaccaaaaaattgtggccaaagaatgatgagttcattttaaataaatatatgactagaaatagcattcaatattaggatagttcagtgtggaatagagataattattccctgaaattataaagtgtgtgtgaggctatgcacatgcaatatgtgtgtgtgtagatatgcctccatattgtggtatggcagtggtggcttatttgctagtgagataaacaatatgtgtccactttgggatgttacatatatgcctaatcaatattttgaggatgagcctatttacttctctggttgatttaagtacagaaaagtgtaatgaataatacttggcttgaagatctagctatacttagaataggttgacagaaccattaatttcaaatgaatatggacctttattttgggtagaggattctattatatatttgccaacaatgcagaatgttgtttcttaataatagtattgagatctaaaaacatttacactgtactgtgtgctcagaaattacataagatgaaacattggtataacctataggaaggcgagattgagggatagttgttataaataagaggcttagcttgttaagaacaaagaacagagtttttctgttctttgagatgatttatgaaaagagacacctttcatacattagtgcattaatatatgaatataatattatattgtaatattacgtaattgtaatattacgttttatgaaataagctaatcatctctgaaaacagcagcagctttataaaataagtaatagtagcagactttaactgttttgttgagaccgattatttgccctattgccaaggcaggagtacagtggcatagtcatagttcactgcaacctctaattcttgggctcaactgatactccttcctcagcctcccaaatagctgggaccacagtcatgtgccaccatgcctggctacttgttttactttttaaaatttttagtggagatgaggtctcactatgttgctcatgttggtctcaaactgctgggctcaagtgatcctccctccctggtctcccaaagtgtagggattagtcatgagccaccatgcctgaccagactttaatattttaggcgaatccttctagttcttaacgtttcaaccttatagattttatatttccaagcattttacataaaccattttcagtgaaagagattttcaaattatttccttgacagggatgtagaattagtattcatttcacagaaagaacaatgatatgataacagaagtattcactgttagggaaaaaagttggaactcagagttcctgaggcatgtttgaatttattcagttaaattatgtttatttcagaaagactgaagagctaaaagagctagtttcagctttcttataattaaatcagtgctttatacctgttaggctaggtgtaaatgaaagaaataggggtgtagaaatacaaggtatgttaattacagttcattcataatgcattgcaaaggatctttcctaattgcagaagcatattttaagaaagtttcaggtattaagacatagtttatgagatcttgcacccaaacacataacgtctccaggccctaagcaaggtaaagataacaaccaaaagttgtccagtttaaattaagtaaacaaactctgtggaattatagtagaaagaaatttaatagcagagggtagataacaaagagattgaagataactaattacaatattaattagtacctttgttggccttaaattggtggacctaagagagtactctgaaaatgcaacatgtattaattgaacatgtgggaaactaccaatactagagtgcttttttttttgagtgcctatgattaattgtaatgggaagatggagaggttttattaatgaccaccactggctagctggctagtaagattcttgataaagaaatgttattattcttggctttttaaactacacaccaagctttaatctgaagtatatttcaaaaagttaatgttaaacaatttgaaaatgtgaaacatggaaaataacacaattatatgtttataagagatagggtagttttaatgacttcctaagcagaatggactaaaaatgactaaaagtttgtctaactctatactatcacaaaataattgacttgtccgtttttaatgagtatgcacgtgatcaattgtcaagttaataatgccaattattatctcagagatgtcagtctattattaacctgtgacagatattaactatacatattggtaaataataaagtgtgcaaggggaaattaattaaactaatatataaatgtgagtaaaggggagatgattgatatttttgtatatcaagattttacttttatttaaaacatattttatttttaaaataaaatgaaatttaaaatattttataataagcaactcaaataaatatatgaagaatacattttagcgcattattttgagaaatttatcatctgttattaaagattttaattagggaaatatttttaaaaatagatggtattttaatattttgtattcctataaaaatacaattgaggatgtttggaataatctgcaggggaaaacatttttaatcttttattataaagtaaaacacagataatgaaaaggaaacatgaaaaatgaaatagtttaaaaatttattgtaagccaaacactttcataaccacatcaaggtaaataaatggaattttaccagtaacccttaagttcttccacctgcttctatcccaatcacaaatttctctctgaaaaagtagcattctccctcttttttatggttctactatatgcattttgggaaggcatataaccattacatattacaatccattctaattttcattttcctttagttctataagtgaccgtaggtcagtgctcacaaccttttcatttttctgtgtcttgctactcattttgattgtctgaatgtcagttgttgaagtcattttttttagtatcatgcatgtattacctcattttttcatggcataaagcattggtgctgaaaagtctactcataatctgctattctttcccttataactatattgctgtttcctccaacaaatgcccaaaggatgtattgttattctttaatatccactactctctctctttctttataaaagaatttaacttgatatcagtctttctggatacttatttcagatagatagtgtgctcttcaatgtacaatttcacatttttaaaatcacttcagaaaagttttcttgaattataattttaaacatttgttctgtctccttactttcattttagtctccagggtaacataatatatgtatattgaatcttgcttgcctatcttcaatatttatctattttgaatctgttactttttatttgtttgttgacgtttaaaatttccttccttcttcccttctatctttcttaaagcataatatgttgtgataaaaattacattttcttaacagctttattgagatataatttacataccatgtaattcacccatttaaaatgtatactgcaatggtttttagtatatacatagagttgtgtaaccattacttacaattttagactatgtattcactccaaaaggaagtctatacttaatagtggtcactccaattttccccaaatgccccaagccctaggaaaccactaatcgactttctgtctcaataaattgcctgttctggatgtttcatataaatggaatcatataatacgtggtcttttttgactggcttcttttacttagcatattattttcaaagttcatccgttatgtagcatgtatcagtacttcatacttttttatggccaaataataatttatcatatggatataccacatattgttatccattcatcagttgatgaaaatttgggttgtttccactttttggctatcatgattaatgttgctattaatatttgtatacaagattttgtgtggacatatgttttaatttctcttaggtatataccaaggagtagaatttctggttcatatggtaactctatttttaacattttgaggaagtgccaaactcttttccaaaacagctgcattattttatatttctacaagcaatgtatgaatgcttcaatttctccagattctcaaaaaaacttgatattacagtcctttaaaagctttatttaatttgaattgacatgtaataattgcacatattaatggggtagaggttgatattttgatacatgtatgcaatgtataatgatcagatccaggtaattagcataaccatcacctcaaatatttatcatttgtttgtgttgggatctttcaacatcctctcttctagctacttgaaaatatataataaattattcttaactatagacaccctacagtgctatgaaacactagaactttttcctcctatttagctgtaagtttgtagccataaaccaacctctcccttctcttccctcccatttactatttccaccctctaataatcacagttctgttccctacttctgtgtcctcaagtattttggcctccacatatgagtaagatcatgcattatttatctttcagtgcctgatatatttcattaacataatgtcctccaggctcatctttgttgctgcagatgacaggatttcctcttgtaatgactcagtagtattctaatgtgtatatataccacattttcttatccattcatttgttcaaggacacttaggttgattccatctcttgactgttgtaaacagtgctacaataaatatggggggcagatatcatttcgatgtacttatttcctttccttcaggtaaataacaagtagtgggattgccggatcatatggtagtttatttttagatctatgaggaacctccacactgttttccacactgggtgtactaattcccatcaacagtgtattagatttcccttttctccacatcctcggcagcatttattttttgtcttttgataatagccattctaactggggtgagatgatatggcattgtggttttgatttacattactcttatgattagtggtgactatttttttcatttacctgttggctatttctatgtcttcttttagaaatgtctattcagatcccttgccaaatgttaaattggattattttattattattattattattattattatattttttgctatttagttgtttgagctccttgtatcttctggatattaatcccttgtcaggtgaatagtttgcaaatatttttcccattctgcaggtggtcctttcacttcgttgattgttacgttttctaggcagaggatttttagttttatctaatcccatcagtcaatttttgctttcattgccaacacaagttattttctgctttttgtgtttgttgtttcattatactaatccacttaggtgtgaagtggcatttcaagtggatttaatttgcatttccctaataactaatgatgctgaacatccattcatgtgcttattggtcatttgtaggtttattaggataaatgcctatctaagtcttttgcctatactttaattgggttgtttaaatttgttgttgttgagtagcaggtgttctttgtctgttctggatggtaaacacttttgcttttaacagattgattattaagtgtcttggtttggatctcttcaaatttgttctagtaggagtttttttcagatttctagatgcttttgtgtcttccatcaagtttgagttttggctaaaggtttttgttattatttctttaaatattatatctttctctttctcttcttctgatactcccagtaatctgtatgtttgtcctacagtttccttaagcttttagtttactttttctttctgctcctcaggcatgatagttcatattaacttaccttcaagttcactaactcttttgcctactcaattctgcttttgaactctttcatctccagaatttctttttggttattttttataatttttatctctttacttttagttttgttttgttcatacatagttttcctgattctctttattgctttatcaattttttttttcatttttcaacttaattaaagacagttgttttaaagtctttgtctagtttttccagtgtttgggcttcattagtatggtttctgtctatttactttcttcctttgaatggctgcactttcctgtttttatacactatgaggttatttttgttgaaaaattgacttttaaatattaaaatgtggtaactgtggagattaaattctcctccttcctcagggtttgttgttatttttgtttttggagtctctaatcatttgtctagtgacttttccaaactatttttgcagagaccatatttctcgtcttgtgtgcctccttgaagtctctgttccttagcttgtgtttaaacagaagttttcttgaacaccagtaattaaaatctaaaacaaataaacacacaaatagccatctttaccagcctttccagattggctgtgtgtggggcccctccttcaacgcttaaccagacttgcactgaacatatggatcagcccaagttaaaagcttaacatcttgttttgtcatttctcaacatgtgtcatgccctggtcacgcacatgacttcctaattgccctttccataacctccatatcgattgccctaatttcccaagaaaattccctctcagattttctgccaaagccttaagctgtctattatatttctcaaccataaacttttgcctcaggcatccgcagaatgttttgcagccttgcaatgttttcaagaaatgccgaaacttttccaatgtgagttccgatttaggcaaaaagagagacaaatgccatgtgctggctcttcaggtagctcccagacaggttagaacatatctacacaataatttgtgaaaaagctctgctctgctgcctccagaaccagggaccagcgttcctcactgggaacatgggctaatatcttcaagactgctacccaaccatcaatgagtggggcgaggacagataaatatgccatagagcttccctactgtttttaagttgactttttctggtttcagcatttacttggttgctgtgaacctttgactgtcttatagagttctgacaaatttggttttgatagtttctgctggtttttttatgtttctgtggggtacatgagcttgtagctgcctactctgtaattttgctgatatcactgaagtcttcatttctgaaatggtatcttatttttttcctgagtattattacattgtttctgtttttgcagtcagaatttctggtattctttcatgccttttactttttcttaatgttttagctaattttaaaagaatatattactcttctctgggtattattttgtttttcagtagtaaatatgaattagttttgttggagacatagattttatacattatacagattgtgtcagcaagtcaatcagaatttattatatgccaactgtatgtcaattatatagcatagaaagtaaaacaaacttggttcaattatttatgattaatgttgccctagacctgtctagacagttagaattagcagatactgctgtgatgattgcctaacataatacagacaaaatggagatgagaaatcttaaggggacttataggtcaatgaaacttttcttctgaacttaccacctcccacctttattacgctatcatttagaaaattgcttatgaagttcttctgcgcaaagtttatttctgaaaattgtgccctgcttgaaatccttgttttaagatctttacatgctgccttattcttgtcactcaataatcaattcagatgtcactcactcatggcgactcctcctcattatcctagctcaagctgccttttctaatcatcaatatatgatgctgttttttgaaatgtatttgttttcatgcttatcatctgtattttctctctagaatgtaagctcctttaagttggagatgttttcagccatggccacattacgtatgtagtttctaaaaagatacatagctcagaatggctgtagatttttctcttctttgaaatggatttttttttacctcattatttccttggactaattgataattttacataggcactgtctacataggcatgcaaaattttactacttaagtagtaagctagagttatattgtgtgcttgagcaattattagcatttagactatagatttttatgaagtaaatatttaaaatgttactacaactataattaaataattgaattttaaatttcttttagggtgactttcatactatgaagaaaaaaaggtcataagggtaatgtgtgctaacagagctgacttactctcatacactatttaactttacgttatgacatataagccaaaactctaccctttttcaagctgctttcctaacagagtgtttttcaaaacaaacaacaaaaatatttggaacaaattaattctcagtttcaatatttataattattccccaaatatagagaagttttaagatacgtaaaatagagataaaaactatgaagggtttgcctgttctctggaatttattgaggtcatttgtacttataggatatcaggtatgtgacacagatcaattctcttatatgtatttcaacttgttttcacaaacttctcattcagccctatagccatgccagacagtaaaatttttgttaactatatgcaaaagttgatctccatgtgcagattgttgaaggagaaaaaaacactggttataattttcaaaaactaaaatgctaaataaaatggcatttcattcatccattcattcattcataatattttgaaatctagatcttatatttatacttggtcataacattttatttcttttattgaggatatttctttgtattaagttggggaaatttatttgctaactttcatattttaaaaaaatgtgtcttcaaataaaattttatataaaatgacagagtaaagaaatttcctccaaatttattggggttttttggttcttctgaaacaatagttttattgtatttgatgcaaaatttaaaattctgctttgtatatatattttctggttttcttatgttagagttcactattttaagtgcaaaacaaactgttctttgcctttagctatatatttatatattttttaaaaattagaggtttaggaaaacgttctattttaatgatctcttttactaacttatgcattccttatatattaaaaacatacatgcccactgatttatgagattctcagccataaaaaatttatatgcatattacatatatgctacatatatgtattaaccatatttatatgtagataaatactctgtacttgtgtgtatgtgcagtaaacacactcaagcacataccgcatgtatctatatatgtatagatgtttatgcatgtatatatatcatatagccagacacacatacacctatatgcatatttaaatatattgtctactgtgttttgctgtgtctactatgcttttcatatttcagtgacattgtttctatagtaactaatgcactgaaaaaatcaatgcaaaaaggattgaaattttacaaaaagccaacccagaaacatgcttaaaaattgatgtgcagggggaggtatttgtcttgggtcatacattttggaagtgaataaagcaaaatgaaatcattactctgtaacaaactatgatctagcaaggttggaataccatattcttttctttaaccagcaaattaccaaattattatggtttctaagagcaacatgcacggatccacaaaacctataggcagtgtgaatctgtctatattagacacagtgtaaagaggattagggtaatggtgccaggctgagacactatttccaaactttggatcaagtgtctgtttaaaaatacttctatttggaaaaaaaaatgcctttctgctaaattttaaatgaattatacctaacgtaaatggtaagtgcctgggaagaaggtcaatttgcagttatttgctgcaattttaattctagacatttaaatcattaggaaaaactagaacattaatatttcatattttgttaaaaccatattcaagctagagtttaagtatactaatagccaaaatgtttatgataataaaacagatctgagttaaacaaacagaaacacaaaataatatttaaaatttgaaaataattcaaaatctgctctcttagctttcccaggtaggttacctgtatttcaaagtactttcactctgttggtaaggaaaaggatatacagttgcttttgtaatagccattcatacatataatttgatcatttagtatcaatgatcatttagtatgttacacttgcctgttatataattttcacattattagttaaataaatacataatacaagctttttctgtatgatgacatgaacagttagaattattttctataataaaaagattaattaaaggcttatttataatataaatacattgagtagttgactgttctttctcttgttagttctttgagtcacagtattttaaaatatgatattttaaatacagttttaaaatacatatttatttgacaaatctatattgaacaagtcattaaaacagagctccttctggacctctattaagacagggctgatcacaaataacatgatcacaaatagttataagacatatttgacaagtttcattacacagttatagacaaagtattagatgaaggaaaatctgatgtgattagaaatatttcagtgtatttcatggtgtaagtaacattccagcttacttcatggtataactggcatttcagacaggacttaaagtgtgagaagggatttaatgaggagaaaagaagaaaataacagaaggaccagcacaagtcaaaacagagaggcatgatgggttccaggaaggctaagcagtctgtctgggatgcctagagcatagaaggcatatcagataaaggcaagaatgtgcaaagcactgagagcggtaatgagctttcatgttgttcactggagaggaattacatggttgcatctgtattgtacatatctgatcggacatactatatataacatattgtggagagttagttggtagaagaagagattgaatatatagaaatttgggaagagttaataaaagcttagctatatgagtatctcttgcagtcctggcagtggatgaactcacttgggaaaagaataaaaagaacacagaaacacttggggaacaatattttagaaattcttcaaggaagaggaattagggaagtagaaatgggaagaaagtttagagataacattgggaacttaagggaaatatcagtggtacttcattaatactataacctaaataaaattataatatggttattgtgaattatatcaaaagggataactttgtgccaattgctagatttttatgcagatttcattagtctactactaacttattaccaatgaatttgtgttccttcaaacagaaatgtggtaaatgtaatgatgggaaaaggcttttctatttcatttgatgataagaaaaatcatgaatgttagaatatatattctaatatacatattagaatgtaaggcatatatgtgccattctcattagtatagaagtcatatatgtatgctgtattctaatatgcatacttttttgcattatgtacttgcatgtatcaactaattgcaatttcatgttttgaacaatagtaacatacgtctaaatacacagaaagccttacataggcaacatttttctgtatggaaaacaatgaataagtcccttaaaatgtgtagacaaatattgtagttaaattttttagtagaggaaagctgatatcctgtttggttggccttaactaactaccaaatttttaagtagtgaagtttttgttctttgttcttctttcacgattttatggtccctcttccttcagtactcaccaacatgtagtgttctcatgtgacttctattctttctcttaccaaagcatgcttccttccatctaatgatcagttggaaagcttaggaccactgtgatcaaaaagattgaaaaaataactttataaagtaatagcatgaaactagttttgagtcatacagtcctaaagttaaattctagctccatactgaaatgattgcatgaatgttggcaagttacttatctgacctataactttttcatctgttaatcagataattagatataatttatagggctgagtttaaggatgtaattcacaggaaaagcccagcacaatgcacaggaaaagcccagcacaatgcctggcagtttgcatttactaaacatgtgttatgcttactctttctccccttcttacagaggtttgtgcatttcaatagagcatagcccctcaacactagggaatgcatctctgctccagaaacatcaggcgctactgagaggcaggttagacgggtgtttaggaattggaagcctttctaccatctctgaagtggcacacctgctctgcttgcttgggaggccagcatggtctgtctagttgccaactcaatgaaaggctttaaaagcttgccaaaacattttttcctaggcaatttcccttaggcttctaattgcaagtgaattttaaaatatgtgacctatgatattgactatttctgaaaaaaaatctttatagttgggtaccagaggcagcagtcctgtgattctaaatcccttactgagcagagaattctcatctatctgaattgtatttctttgtaaactacctttaatggtttggtttgggcagcctaatctccctctggagataagaaagaaattctatgaatacagcaagtatttgaagacaggaagggagaaaaggagaaatatttaattaagcagagagctttacctagttttcccttactgttatttataagcaatacattggctctagatttatacctatgcagttccacaatctttattctggctcaagcttctctttttaatctcatactattccaagacaacttgttggaggtaactgtgccctacctctctcttttctgcatctttatccttcagctgggatacacccccaccactccttgtcctcttcataaaattgttttgattcttctaggattagcctgtgtgctgctgcctctgcctgtttatgcattcatgagttcgaataaaaacacaggcagataaacaaaaccaaaccattactgagtgccatatgccagattctagacatagaataataaaaaaaaatgcggttcttttcctaaaaaaattcatagtctgatgggaacacctgcatgcatatcaacaaatttaaagcaatgagagacaagtgaaagtagagtcacattccacagccacccagcattgttcaacggtatcatggaggcttcataagattagtgatgtttgaatggagtcttgaaagataagaaggaatatactaggtagagagtggaagggattggggcagaagaagcagaggtatggaagaccatattgagtctagggaatcatcaggtctttcagagcccatatctcttaaaaaatcacattggcaatcctgattcaaagtgatctccacaggaaacttttgtggggttttcccccttttatatcaactgtaagtcttcatttttatagataagatatagatatttttctaggttaaatatttgtgttctattttaaattgcttggtgactgataagttgcttgagggtaaggactaggtctcttctacttttttattctttaacacacccataactgagttttgtaattatttttatttattgtttactctgtaccaaggactcttaagaaatgtggttttatatttctttaactccaactaaaactccattaggttaggtactattattaccctcaatcacagttaaataaggcaatgcttagtgagatcaaatgacctttctaggaggcaaattgaattaaaagatctgatatcagagccataacttaacaaatactttatttaaccttcgcaggtaagtcattctacatgttcctactaaactctaaatggacaaagcaattctgaaattaaaaataatagttcaattaaataactctacgtgaagacagtgtatcagtatatggaaatattcaatgtaaattgtatattagaaaaaaaattgtgtatgtaaattgtatatcagaacaaaagttctggaaagcctttatataattgaaacagtaaaaatctcaaggatgattttcacaaccttgtattgctgtatctagtacatatttttaggatccaggtgttcatactctgaaggtgccatctggcatggtcatttctagaaaacagggctgctgtagctaactctacctggacaatctcagaggaagtaggttgtgatgggggaaggttggaaaggtagttgcgagggtcagtggatataaaaaagtttgcccatctgttgtaaatttttttaagtctccaaattcctttgttgccagtgtcctggttatagtggaagggcctcaagtacgcatgattcttgtaatctgggcttctggcttccataaatgccagagaatttgcaacagtaatgtggtatactgagcatctgccttttaatgcagcttcctctttccattctaggatcatcaactcagttaattagaggagtggcaggggttacaatgctagcaaattctgcagtattatgttatttgtagagagtgccctggaaatataatgagaagagaaaaatccaagtatttctgtttctcattcaaacccagatggaaaaatatgaggtgagacacttagaaaatcagagtaattgaacaacatactcagactggtttattggcatgaatgatgtccccttcacagtagttatcataggagccaaacaatacaataatgtcaccattgctcatgctgtttgggctcttgtgttggtgttatctttggattctgtgggctgtactatgaataattctcaacagtagcaaatcttcaaacagaaagagtctgttctgtttttgctattagcagaagttagaatgtgccaaatttggtgaataaagtgggtgatcaaagtgggaagtatgattttttttgccaaaaacaaagtagattgcaaaataatgaaacatttttgtcttaatgtggcttaaaacaagctctgtttattccaaaaatttttctaaaattattttgaaatactgcagaatgtctgtagcatgtattttccaattatttaattaaattaaatccacagattctcataaatatatataaatttcagttttctttgtaaatgtatagttacacctattattttacatttttgttgttgaacagcattacaaatattttaaatcttctcatttaaacaatcttaaactaaccaaaacaaacctatttcaaactaagttgaaatattttcagaagttaaaaaggatattttttgagacctaagaagttttaaatcaaaacaagaaaagattcagaaaccaaacacattgtactcatttaggataaaataatttgaggtaattatgaagtgaggagtcagattcgtattttctgaatttaattgtgtcattgtatatattattttttacgtcgtatcacagccctgtgtagtagatattattttaacatttggtcgattatccaagtttacagtcaatattcaaagttttgtctgactccacagcttttatccagctctaatacaagacttcatatattcccttcttcagaagagagaggagaaaaaaaactttgagtgacaattatttttaatttttacactgttaagtgaatatacctgagagggcattgctttcaaaatcttactactcagagtatggccagcagacaacactctgtgtggcagcatcagtgtctcctggtagctgactagtgaagtagagtattagatgccacaccagatgtaccaaatcagaagctatattttaacaagtccccccatgtgaattgctttagagcagtgatcttaagcatatctttggaagtcttttaaacaatattctagtgtcttctgcattttttacaggctctcaaacaggacaaaatttttcagctatgaggtgtgtctaaaagtatgaactcattttgacttcagaacaataagaactcttgaaggtcacctttagcgttttagttaaataacatgaaacttactattaaggaggacatgtttgataagagaaaaaaaccactactgcctaagtagtcatacactcttcaaaattgatacacaatgactgaaaggattattaaactatggtcaattactgatgatttataacacacaatttacggtgattcattttttttctggatacctatctttgaatatgctatttttaaaaattattttgtcatttagacttctattttatactgaattgaaataacatactatgttcctaaaatatcatatggaaaagggtttagcttagtgttcattggttgtgatattttttaacaaaattttcaaaataacacatttttaaagtgaattttattaattactgtgtctagaattaagtttacttttttttttttttttttctgacagaatctccctttatcacccaggctggagtgcagtggcatgatctcatctcactgcagcctccacctcctgggttgaagcaattcttgtgtctcaactccccaggtagctaggattacaggcacccgccactatgcccagctaagttttgtatttttagtagagatggggatttcaccatgttgcccaggctggtctcgaactcctagcctcaagttatccacccacctctgcctcccaaagtgcagtataatgtgtctaaatatcaaattataaaaaagtaaaaagattatcatcaaactacatttctacactcatggtaagatttttcataatttttcttatgaacatgcttaagcattttaaacactgcttgtagcctctgcaaaagttagcatgctaaatgtatgtttaaaagaactaagaaaggaagggaggaagaaataaacaggtttctgttatgcaaagttgagtgagttcaagatgtttatgttcatcaccagaacacgtgtaaaaatagctgtaattcattcataaagtcaattcttacctctgttaactttcttaaagcatagttgttttgatatagattatttcccttcaaatttatttatgtggaataattatatccaatacagaatagtattattcaataacaaaaaatgaatgttgcaataagtcattaagggtagagattattattagctaaaatcaaaagatttttttttcattgaggagaggtctagtatagactttaaagggtgaatcactgttggctatgtctctgtggttaaagagacttactgatgataccacctgtgttcagcagaagtagagagtagttttttgtggtagtaacagagggaagtgcagagctccaaaaacaaagggaaaatatttacttatttcgtctggatttctgccataggctatgattacttacctgtcaagattttctatcctgtcctaaatatgcatcaactctctgagtgagactccccctgtaatcccggttcaaagtactgatacacagaatatattttaaaactgatacattcaagtctgtatctaaactggctgttgacccactgccctgtttcctactacattccttcatcaatttttaagagtagtggtttcccagcaaaaaataagcagcataaataatgtggagagaatggaaatctactacattgttggtgggaaagtaaattagtatggcaattatggaaaatggaggttcctcaaaaaactgaaaactgaactaccatataatccagcaaatccatctcttggaattccataccaaatcagtatgttgaaggaatatcttcactcccatgttcattatagcattattcataatggccaagatatgaaatcaacctaagtgtctgtcagcaggtgaaaggataaagaaaatatggtacatatacatagtgaaatatcatgtagctttagaaatgggtgaaattattttatttgggatggcatggatgaatctagagaacattatgctaagtgaaataagtcaggcactgagagacaaataccatatgatctcatttatgtgtggaatttaaaaaacattgatttcataagaagtagagagtagaatgagagttaacagagactgggtggtgctggtggtggtggtggtggtggtggtgagggaatggaaagttcctggtctaaggtaatatgtctcagctagacaagaagaataaaatttgaaatctattccacaacaatagaatcaataatattgtattatatatttcaaagaaactaagaagaaagtaaatttcaaacgtcttaccacagaaactgagtgatgcatgttaatttgcttgatttaatcattccacattgtatacatacatcaaaagatcacactgtattccataatgtaatacaattatgacttgtttataaaataatattaaccaaaaataaataatcagcatataatagtgcttaagatgggtgattctggtgtcagctggatcagagttgtaatcacttctctgccactcactggtattgctacctttattcaacctcatttacaagagctgtttcctcatctgagaaatgagaataataaaaagatgtatttcaaagaattgctgtaaagattaaatatgaaacacttcatctatattaagttcataacaaatgttggctactgttatgtattattactatgtacttcccttgtactttgctcttatagacactatgtcttttttatattaccttattttaaaacttgcttatcatatcaataaaatagcataatactttcttttttgtagatgaagaaacaggctcagaaatgttaaatttatatccccactatcaagaagccagctaagtgccaatcttgcacatttaaatcctccatgtttcttagtttcccatattacattccttatctcaactccttggaatcagatagaatggtgtaagatctctaatttccttagttcccttgagagctagaaaacatttgacaaactaaaaacaaaattatctaaacctattttgtgctcttcaaaaataggcataatagtatacatttaacagggttgtgaggaataaatgaggtaatccatacaaccagcttagcaaagtgcctgccatatattacgtatggcaggcactcaaggaaaactgactactattagtatctaccaccttgggaattagtagttcccgaaaatgttgctgttgtcccaaaatgttttggcattattattatctagaattacatcaaaatttactttataagctacataagaaatcaaatcaccacatagaaaaatcaactcagaaatggataaaagacctaaaggtaagacctgaaactataaaactgtgagaagaacatatgagagaaaagctcctggacattggccttggcaatgatttttgatattgtaacaaaatctcaggctacgataacagcaatgataaataaatgggggcatatcaaactaaacatctctgcacagcaaaagaaacaataaaataagacagcagcctgtgtgctggaaaaaaaatatttgcaaaccacatacctaaaaatgtcttttatagaaaagtaaataaaagatcatggggattcattttgttgtcatacctctatagtccttcaatttcgaatatttcttgaattctttttgtggctcctaccattgacattctgccattaattttgtagaatgtcccttaatttgagtttgtctgttatttccttcctcatgattagattcaaattatgcactgttggcactgtgtgattacctattactcttcagacttttatccattagttttaacctccatggatgatttctacctgaattggttgatagttggcaaatggtgatcttctaatcctataagccttgctacacatgttagttgagacttaatttataatgggaaagagaacaatgataaaataatgtgcatgtacatcaataaaattgcaaaattttcagtgtcaggaaaaatcaatggatggatgttgagcatggtttgggggtggtctgattctgagagtagtaggaaaagtggtttgatatttcagctgagagttttaagaatcagaaggagcttgccatggaaagaatgagaggaggaatgagaggaagggcaaacaaagggaaagagaattgctttaggtaagaaagatctacatacaggggtgactaaaacaccagtctggcagcatatagtgggcattgggcagaaagggcaagtttccgttaaagggagatgtgtagctgtgatcacttaggatacataagctatggtattttcatctaagtgaagttggaagtcatttaaagatttaagcagagaaatggcatgataagatttttaaaatgtgtctctttgtagagaataggccagaagggggcaggtgaaaaatctctgtttgatctgtgttaactactagcatcattacttcagctactctgatctctcattggactgcacatatataacttgtcttcttagacagttctgtaaattccaaatgatctcttgaaaatgaaaattgtagcaccctggaccccactgaccaggagtgctagttgacagcaagaggagaggaagagtgtaatataatcacatgttgtgagctcaaagagaaagaagcgatagtagcctggaatcagcaatgagaaataagtaagactcagaagtgaaatgggctagaacatgagaaagtggggtcttgggtaactttaggcccaagtatgggtgcgggtctcagagtatgggtaataccagatgctgagggacacatgccttttggttgtcatgaagtagagaatgaagagataagctgtaatagtctcttttaagaggctaaccagcagtctagagctgtattcctaaatgctattctctaaggctcaggacctagagttgtccttgagaagcattaagaggtagggagtgaaacaggtgaggcattggaaagttttatgcctgagactttccaaatatgatgggcctttatttttaataaataaaaaggatttttattggagactccttgcgctgtctcatgctgtaatattgacaattaatggctcaacgacacaataacaatatatttaaagttttaataaatgcactgtgatgtgaatcattcacttttattttatttattacttgcttacagcttagttttatactcactttggatttttttaaattctgtggtttataggaaacctaagctcatgaagagtttataatctaagtataatcctatgaagggcattatgtgagagattattgtgttttgttggaggttgtattagatgacttctaaggtctcatcctactcggagtctatgatttaatgtttctagcatgactttgtatcaaagaatgagccagaaaattgaagggtgtttaatatgacctgaaggaaaaatcaagaattctaataaagtcaagacacgtataatgtgaacaattcctaggcttttgatcattcagtggaactgacacttatgtagctacagatttatgctggttttaaaggcatgtttcaattgaatgagcaaattgtgaaaaaaaaaaaaaaaagtattaggtaacaggatttcaaaagaccgtgtgagatcttagtccatccaattattttactcttgctgattaaataaatctgatataatcgccctaaaaatttgatcagattactagctggtaaaaaccagcttttgctcattgaaataatgagccagtaatatacttcacaaaaatatagctaatgataataaatatatgaaatatattattttttcctaggtgccaagttacatcttttgactcaatgacctaataatagactttctatcattttaaagaaagaatttcccctcatacatgtccccttcacagagattcccctaatgttagactaatggtcctaactttaataaagtgttagtctgagtctgtggaaaaagacatagaaaggtgacttatctgagatcataaccaattcaattgttaaatattgtaatcaagcaaatacaaaccacctactccttaaatatttgtaatttttcaaacacttttaatcagatgctctgggccaaaggacagatgcttgtttacaaggctgatttagttactttaaatgctgctgactgaactatgtacctgtaacatgcttcagctacaggccatgttcagaaaaatccttgcatatcactaccaacacacttcagtatccagctagctaatatattgcaaaaactaatttattcaaagcatatggtctagcaaatgttgactgcattttcagatgatgttgtacatttaggatcttggaaagttgtagattcttacatagaaccacatagaattgaggcactttggggaaaaaggccaaaaatcttatttcacaaatatgggaaatatttttactataagaggtaggaaataactaaacaaaatatttaccagttaaaaaacctcaatcagaaatagtaaattgaaacatttgttcataggttctttttagatatctaatatgaatatatatttatgtagcaaacactggggctttaaaaataaatacaggcatatcttgttttattacacttcactttattgcactttacagttattgtgtttttttcaaattgaaagtttgtggcaaccatatatcgagcaagtctattggcataattttaccaacaacatgtgctcacttcatgtctctgtgtcacacacattttggtaattttctcaatatttcaaacttttttaattatcattatatctgttatggtgatctgtgatcagtgatctgtgatgttatcattgtaatttatttagggagccatgaatttcacccatgtaagatgataaacttaataaatgttgtgagtattctgactgctccacattccagacattcccatctctctccctcttctcagttctccttagtccttgagagaaaacaattttgaaattagaccaattggccgggcacagtggctcaagcctgtaatcccaacactttgggaggctgaggcgggcggatcacgaggtcaggagttcaagaccagcctggtcaacagagcaaaaccccatctctactaaaaatacaaaaactagccaggcgtggtggtgggtgcctgtagacccagctactcagggaggctgaggcagaagaattgcttgtgagactccatctcaacaaaaagaaagaaaagaaaaagacattagaccaattaatactgcaatggcctctaagtgttcaagtgaaaggatgagtcgcacatctttcattttcaatcaaaagctaaaagagagtaagcttagtgaggaaggcatatcaaagctgagatagtctgaaatacattttgagttgatttttgtatgtggtgaaagataaggagttataaaagtagacttcatgaaggtagaaagtagagtgatggttaccaaagggtgggcctggtagtgagttagcaaagttgtaaatgcaaatgaaaagttctagaaagttctagaaaacggaacgttctagaaagtgcttcttttaagaacacctgaatgataagaacacaaaacagccttactgctgatatgaggaaagttttagtggtctggatagaaaataaaaccagccacaacattcccttacaccacaatttaatccaaataaaagacctaaatctctttaattctctgaagtctgagagagataaggaagctgtagaagaaaacttagaagctagcagaggttgcttcatgaagattaaaatgaaagctgtaaccataacaaaaagtacaaggtaaagcctcaagaactgatgtagaagctgcagcaggttatccagaagacatagctaaaataatttatgaaggaggctacactaaacaagagactttccatgtaaagcaaacatcttcctattggaagaagatgccatgtggtacttccattgctagagagaagtcacttcctagcttccaagctttaagggacaggctgactctcatgttaggggcaaaggtagctggtaactttgagtggaagtcaatgctcattcaccattctgaaaatcctaggggtcttaagaattatggtaaaatctactctgtctgtgctctataaatggaacaacaaaacctggaagacaatgtatgtgtttctagccaggtttactgaatttttaagctcactgttgaaacctactgctcagaagaaaagattcctttcaacatatcactgctcactggtaatggacctcatgacttgacggctctgatggagatgtacaaggaggttaatattgtttttatgcctgctattacaacatttattttgcagcccatagatgaaggagtaattttagtttcaagccttattatttaataaaaacatttcataagactatagctgtcatagataatgattctcataatagacctgggcaaagaaagttgaaaaccttctggaaaggatttaccattcaagatgccactgagaacattcattattcatgggagaagatcaaaatatccacattaacagggctttggaagaggttgattctaacccttatggaagcatttgaagaggtcaagacttcagtggaggcactcactacaaatgtggtagaatcagcaaaagaactataattgaaagtggagcctaaagatgtgaatgaatcgctgcaatctcatgacaaaacttgaatagatgaggagttacgcatagataagcaaaaaaatgtcgtttctttggatgagatctactcctggtgaagatgctgtgagcattgttgaaatgataatagatttagagtatttaattaacctaattgataaagctagcatggtttagagcatggactccaattttaaaagaagttctaccgtgagtgaaatgctatcaaatagtattgcatgctacagagaaaacttttgtgaaaggaagtatcaattgatgtggcaaacttcattgttatcttgttttaagaaattgccacaaccactccaaccttcagcaacgggcaccctgatcaatcagcaaccattaacattaaggcctgaccctgccccaacaaaagattctgactcacagaaggttcagatggttgtctgaaattttaaaattaaggtatttaaattattgttttagacataatgctattgttcatgcaatagaatatagtttagtgtaaacgtgactcttgcatgtactggaaaacctaaaactttgtgtgactgactttattgtgatatttgttctgttgtggtggtctggaaccaaacctgcaattcctccagtttctccaaggtatgcctgttctgttgttttaagtcacttaacaaatacacatactttttttccccctatttttatatgatagttactatgcccatttgtacaagagaaattcagaggaatttatgatttagaaattaattgactctgatgctgtataagttatactccagaaaattttaaattattaataagaacatctgattccgaaaattattattcttaatgaaaaaatgccaaaatgcatgacactgctctcctgccgatgactaccagaaactcatctttattcaaacaagttggttttattggcacattgcaacaaaggaaactaacacaaatgaagaataggtgcttcagccagagagtgttagaaaggacgtattataggatacaggttcatgctaggtaatttgggggcatattcaaagcagtggtgctttgtctgcattggataatgtcaggaagcaggggtaattctttgtttgtgaatctaaacaattccttttaaagcagaaattctgattggtaaagaatcagcactcattggtgatagccaagataggggaagtgtggtcattttcgtagtttgcacaatattcttgttttgtctgtgctcaaacatttttatgtagtggtctgatgttgtccagatccatcatagcaaggagtggctttgtctgatgatggtgttctatgaaattatctgtgtgcagtaagagaataccatggcccagctgtgtcagcccaacttctaacaatgttgtagcctggctgatagtgccaggccagcttccagctgtgaggggctttttctctttctcatgtgtaatggcaaatacttctaactacaaatgtcacgacaaaataatttcatgccggatatgaatattttctagctcaacatcttgctttcaaagttctttaatatcaatcctcatcactggattgtaaactccacaaaggcagagaccatgaccttttttcaagagctaaatacatcctaattattagtactactcatacaaattgaattataactaatatttatcaaacttttacttatatgtcagttatacttttgtgggttttactttgcttgtcaccctaatatgcacagaaactctctaggatgagtacatactattaatatctccattttataaatgagaaaatgaaggaatagggaaattaggtgacatacaaaggtcatacagctagtaaggagcaagtacaggattctaactcaggaagtctggctgtagattccctatttttcatcactgtaatgggtttgatacatatgtgttgaatgcatgtgtaaaccaaaaataaaattcaaagcccccccgccctgccaccccaaccgtctaaatggacctcctcctcagcaagggctcttttacaatttaatctgagagactgtttctttcaggccatgatgggaagtgggggttgaaaatgcctcattatgcttcccaagcattaatatcaacacagactttaagtctgataagaaacattttacaacttattctctttaaagcctagtacctaaaggctttccctgcaaagaagaacttgggtctccataatcctttatcttaacccaggcattcatttctattaatcccaggtctttagataaacttaaccaactgtcaaccagaaaaaattttaaatctacttgtaagctggaagcccccactttgagttgtcctgcctttctggaccaagccagtgcatttcttaaatgggttttattgaagtctcatgtctccctaaaatgtataaaaccaaggtgcaccctgaccaccttgggcatatgttctcaggacctcctgagggctgtgtcatgggccgtggtcactatatgtggctcagaataaatctcttcaaataagtttcttccaattgtttacagagtttgactcttttcatcaacacattatgaatagatgaggaataatttgatgattttgaaaattttgggtaaaacaggtaacttttgagattgggtattaacctgggataagagtagcgcaaatcttaacttggagttattctacaagcacatttttaataggaattcttgaaggggatagagtcaagtgtagggaatagacctgaatctggatctccataaataaaaggttaaatataaagtagaaataaggatgaaacgtggtaggttcagatctgtggttatcaatctgaatatgtggatataatgaaaagtgtaaacataccatacctgagacagacttatgtaaaatgaatagccaccttacaagagaataaaccagacagcaagaggggtatatgtgagtactgcaatctttgaccctaaaataggcagccatgacagtgtagagtgcatccttagagttttaaatgtgtatcaggaaaatgaacctaaagcaagttttcctttaatattttaatcaaatcatgggactgtggaccagaaaggatgttgtttaagtataacttaaaattgatataatttataaacttaaatttataccatttagttttctatgttctgctcagaatctataagaaagacatagaatcatgttcatgaaaccatagaatttttgcacaaacgtttgtacaaatttgcaggtgctaaaagaagtgtgcttaacatctttttagcccttgtaatttgtttgttgctattattcattgcatcttgtgactaggtatgtcttggtgaatttagtgtgtaaagctttgaaaattatagtatcctctacaaaaacaaggttctactattatcagtattcattttgttaagagaaaaagagaggttactgattaatgccattccatgcgtgggatctcttttcatttattctcatcttaactatctgcataaataagaaagtgagagaaaaggagaaactgtttaatgccagtaaaggtatcatgttgaacacattttttttgtgctcctcatttagctacattggagatgttggaaatatcacaaattaataaatattcaatcttctcttcttcctgtaatcccattattcacacactgcatcaactgtgaaataggctggactttgttggaaatccaaaagcatgaggaaatgtgctcaaagttgcatattaggttagaaaaaatgcctgatgaatatgcaatttaataggtaattgtattatgtaagaacatacaaaactaatataagcacattattgtattgaggttgtattttattaaattgcttactgatatttttttgaaacaagaaagtaatgtaaattgagtaattctgaataagcgattcagggcacatatatcatgtttctccataaaagaatttttttcatttaattaattgtaaggaagtattattggattagcccttcatgaaaatactagggcaaaatggggaaaaaattatatatatataaatttcaacacagtgataccctgtatctactaaaaaatacaaaaaattagcccggtgtgttgtcgggcacctgaagtcccagctactcagaagtctgaggcaggagaatggcatgaacccgggaggcagaggttgcagtgagccaaaattgcaccactgcactccagcctgggcaacacagcaagactccatctcaaaaaaataatatattaaaactcgaaaatgacctccttcatatctcacatccaggtcatgctgatccaagagatgggttcctatggtcttaggcagctctgtcccatggctttgcagggtatagcctccatcctggctgatttcatgggctggcattgagtgtctgtggcttttccaggcatatggtgcaagctgtcagtggatctaccattctggggtctggaggaaagtggccctcttctcacagctccactaggcggtgccccattagggactctgtgtgggggctctgaccccacatttcccttccacactgccctagcagaggttcttcatgagaggcctgcccctgcaacaaacttctgcctggatatccaggcatttccatacatcctctgaaatctaggcagaggttcccaaaccccaaatcttgacttttgtgcgcttgcagactcaacaccacatggaagctgccaacgcttggggcttgcaccctctgaagccatgacctgaggtctgaattagcccctttcagccaaggatggagtagctgggacacagggcaccaagtccctaggctacacacagcatggggaccctgggtctggtccacgaaaccactttttcctcctaggcctctgggcctgtgatgggaggggctgctgtgacaacctctgaaaagccctggaaatatttttgccattgtcttggggattaacatttggctgtttgttacttatgcaaatttctgcagcctgcttgaatttctcctcagaaaatggaattttattttctatcacattgtcagcctgcaggttttctgaacttttatgctctgcttctcttataaaactaaatgtccttaacagcacccaagtcacctcttgaatgctttgctgcttagaaatttcttctgccagatacccaaaatcatctctctcaagttcaaagttccacacatctctgggatagggacaaaatgctgccagtctctttgccaaaacataacaagagtcacctttcctccagttcccaacaagttcctcacttccatctgagaccacctcagcccagactttattgtccccattgctatcagcattttgggcaaagccattcaacaagtctctaggaagctccaaacttgcccacattttcctgtcttcttctgagccctccaaactgttccaacctctgcctgttacccagttccaaacttgcttccacattgtcatgtatcttttcagcagcatcccactctactcatagcaatttactgttattagtctgttttcacgctgctgataaagacatacctgagaatgtgaagaaaaagaagtttaatggactcatagttccacatggttggggaggcctcacaattatggtggaaggcaaggaggagcaagtcgtgtcatgtcaagtggatggtggcaggcacagagagagcttgtgcaaggaaaccccaccttataaaaccatcggatctcatgagactactttactattacaagaatagcatgggaaagacctttccctgtgattcagttgcttcccaccaggtcccttccacaacatgtgtgacttcaagatgagatttgagtggggacacagccaaactatatcactacccaatatttcaacgtatgtggttagtagaattttgtaatactgttttgagctcattagtttttttacttagatatctaaagtacagcaaaaattactgtctttttgtatcttagatcatataattttagagctgaaagaggctgtagagatcattaaaaaaaaaacttagatattagaaaaatgatgcctggagagatgttgtatgacttttccaaggtaaagtacttaattaaaaaaactaaaaatttaaggggattttaagtcatcacccccagccctgtagattaacttaaattttatcaaaagattagacatattaaactattaagtattgcttcaaaccactctcagagatttattttaaaatttgtgcactgtatatgtggttgtcatataaaggattgacaacacttttttgtgtatgtaaatgaaaattgtattggtttagtgctggatttacagtttaaggattgtatttaatgaaagcctctcaattggtatgtccttgacataataaaaattttcataatttaggttttaattttcacattatgttgaaaattcaaattatttccaaatatcctgtgtttatatttactatattaattcaatcaaaaatatactagttgaaatttggactattccctatcttgagcacacaacatgcacacaccccacacactttacccattaacatggtgtacacaaagaatcttagatattttattcttttcaaagttgagaaatgcttgttaatttttaatcaagttgagctattattcaaccatttaaatttaccatcaacatattgtggaataggataccttatgcctaattaacaacataagtaagaatcaaaatatttcatttgctacctgttaatgctgtcttatgattttgctcatgtttactaatctcaattataaaatatatttttatgtgcacaaaccagtatattttatttattttgccttcatctaccttaaatgttaaaatttttaaaataaacctttatatatttatttacacataatttaataattaagtttatcaatatttctatttttgtaaaggaaattactccaggacccatttatatgactatttaggctaaaattgtattttccatttttttaaacaaatatttggtaccagaataacaaggtatgcaaaatgacaactaaatttattattcaaatcaaatatttaaacatgtacttgtatgattattggcataattatatataaaatgattatgtacataaagtttaattttttttacctgttgtcttcaattaatttagagtgttctccatttatcttgcgtcttgatgaagggtatgggggatccaagatgatgtcaatagctgtttagatgtttttgttgccatgagtttgggctttgtgtaatttcttggcaaaatatatggagatatggagagtgcattactccctgatagacacttataatgatggaaaagaagcaaaaaagtttatgtactttcagctgttgtacatagatgctaaatattactatttattacaatgataatttttaaaacaaatatcttctgtatacaaattacattccaataattaaacctcatgttaatggagatatatggcggggttgaacagtatattttataatctattattttacaagaagaaaaactagatcagttgcaaaatatattaaatacaggctctgaaaaatgaaagactaaggatgttaggccccaaaaaagatacactggagttaacaaatctttattaatgcatgaggcctcccatgatgctggtttctgttctttaccattgaaaactgatcattgcttctggagaaggttggaaagatggctagagcttattttaatagccttacagatagctaataaagtttcatttattcagtgtcttttaaattatatataggtattaaattgttttttaagccattcctgtggtatagctgtagaggtgccaggctgcacaaataataatcctatacttgttgctttggagaagaaaatatcgtttgttgtaagcaaaattgtccaacaggttaaaaatggtctaattatgtgaaaaaactattttagtttaaagtatacattcgaaagtgctgatctttaatgtggtataatgggcccttgatttgttagcatcagcaaagcaaggctaacaatgaagtttgggaagcatttttactttttttttgtatcacttagccctttgttttagatatggtaggtccttgtgtgtgttgatttttttgtgtaatgatataattgaaagattatatcttttaggagaaagagtacatctatttgaaacataccatttctattccaaatgaaaaaaaaatcctttgcttccttagcatatgtatttttgaagacattgcttactagctcttcaaaaaaaagttatttagctttgttgatcctcaggttgttatctgtgaaatttgtaacacagatcttttgtgaagattaaatgatatcaggtatttataatacaaaatttctttcctcccccaactccacctctacatatttgatttggctccatttttgtctcatttttctatgtattttaagtatattttgttgacttatgttgcatatatattcgttagctgcctcaagtatttctggacaaaaatatgtatacttatagattaatacaaattagttcttcgttgaaatccttttgtttttgttttgtttttcagattaccaaatttgttaaatggattaaagtgtggagtcatatgatgtagttgcttctggctaacagcgttagttcactcttcagggtacaattttgcttctctgaaaattagttggtcttagttgtaaatttgactaattaaattatataaccaaaatggtacatataatactatatctcctctgtaagtgtaaatttgactaattaaattacacaaccaaaatggtacctataatactatatctcctctgtgagccctcaataattactaaataatatactttgcaatatcagaaatataaagtttttaagcaaaaagccccttttccctccaatattattttttccaatattaacctgttagtgtctctaatgtgtcatgcaatcttaagcctctttgaaatatagtagataccatacattattttaagtgttttatatgtgtaatgtactttaatcatcataataacctaataaaattggtaactattattatccccatgtgtagatgagaaaacagaggtacgaatcattaataaactcagctaaggttgccaggtgacggagtgactgaaccaaaatctgaagttggcagtctggccccaaaatcaacattcttaattgaaattctatatcacctcgatcactcgatcacttctaatatgtactttacatgtggggaaaagtaggctgctcgtgtgctttgggtgactttcctagtacttgtaatttcactgaatgatgacaaatttcttcctgatcccttgaagagagactagcaactgagtgattatttgtatgtaaactctatggtaatataaaagaagtgtttttttttttccagcaatgccaataatctaaaagacgctgggaccctactaatgtcacttgctcaattccatctccacatcagttaattcatttgggcagcacactttttcaccacaatgtaaaagtttctcttttctaatgcattctttgcaaagaattaaccatcaccatatggaagtactgtggagtttaatttcaatgtgttaaattttgatggtggaacatcagtgaattgactttgaaatctgaactgaactctggttcatttgtcagctggtgtaaagattcatgttctcttgtgcttgtggtcttacatctaccctgtggttttaattttggcaatgattagttagcatcccacttcatttcatacttagtcatccacaggaaatgataaagacaatgaatctcagatgtctacagactagatattgatttattactattttttcaagtttttcatgatttttccccctaagtggaaataggatttttgaaaatggatttctggctctgtgtaattgctgtatgtcagtgagcattccattagtattaaaaacatagtagatatgtccacatgttagagttttgaatatatttatagttacaccgagattgatattaaagatttgaaatttagtaaaatttttattacattaaatgactgtattgagcccataaaattatgtgttctcttaaggtggtagaaaatactatatttttaaagaggagctgaaaaaaaatatagatatagctatatccatggcaacagcatagcacccatacaaaagaaagccagggtgtgcttgttggatagctgcatagcaacagcagagttcagtatgggaggaggaaagaaagtttagaaccaagactatagtgtgctttctgaatgtattgcattgtgctgtcagtaagcctgattaatgtctttttgttcttgttcgatattttacatattatatttgtgattttaatttcaaagaatagttgaaaaatgtaggtgtatggtgtaaaatcagtaaatttgcacttaagttttgcattaatatgagtatgtgctattggaaattaaagcacattgttaagaaataaagttaatagaatgagttattgattatatttgtgaggaattggaatatgtattctataataaattcactttcaaatttagaaagggatgacccttattttataattatttttgttttcaatatgagtatgctagtgttcaaatatatattttatgtgtagaaaatagccatgctacatacttccagaaagccattccattcagttagtcatatgttttggacactgtacgagatagatctaagcattttgtattagtccattctcacattgctataaagaaatacctgagactgggtaatttataaagaaaagaggtttagttgggtcatggttctgcaggctgtacaggaagcatgatgctgacatctgcttggctcctgggaaggtctcaggaaacttttactcatggaggaagatggaggagtagccagcacttcacatggccagaacatgaggaagagagagaggagttatcacaagatctgattgttttaaaacaatcactatctcactcactatcccaagaacagcaccaaggagactgtgctaaatcattcatgaggattccgctcccatgatccaatcacctcctaccaggccccacctccaacactgagtattacaatttgacatgagatttggtggggacacagctccaaaacataccacattgttagggaggactacagcaaaacttgtctaataaactaaatagacatttctgaaaattaaaattcttagtttctaagtattgtaattcctttgtaaatctaaaccaaatcattaagaatcacatataagctccaaaggcctaagacagaagttgttaatacatacctttcagcccaattctaccttactcctaacgtaagaaacatgccagtacagccttttgtcttccatgtaaaaggctttggaatttatcccaggggtaaggtatagaaagcccccttaaaagataatgggactagttttcccagtattctaaataacatagtatgttttcggatcctttgtgttgtattcatctatgtatttgctctgtgtatgttttctttctctttttcttcctcttcctcttctttcttttcctctacctctccctcctccaatgatgctggatttactacctgaattatttcaagcttcactataaagtgtgtatataatattcaatagtcaacagtcagttggctcccaaataatatttctgcttaaaatcaaaattagcttcatgatatttaattatactttaagtctatacattgttccttgttgctgttaaagtttatgacatttcttatccactctttgctcccaaagatagtaaattcttgtctcttaatggtatttaagatggtaaagtagcctttaagatatttaattgtcaaaacctttcttaatggaaatatcttaagcattaaaaaacaggagaataaggatatattctagtttggctgacaatgtgtgagtgaagtagctatgaagaataaagaaatattctaatttggcagtgtgtgtatatgtgtgtgtatgtgtgggtgtgtgtgtgtctgcgtgtgaagtggctgtcaagttgcaaccagaatgtaactctactaggacttttggtgatttttgtttcttttgtttactgctgtatttccaatgcatggaagggcacttcaaacaaagtagtcgaagttttccctcagccacaagagccctttatgtggggctttatgtggagtacagttttaaaagtatgtgtctacattctgtgaatcagccattgtggataatgtcatatatactaacagaggaaagaagtgtacctgtgtgtgtgtaggaatatatatatatatatatatatatatatatatatatatatatatattatttatatataataaaaatatatattatatataatattatataatataatatataatataatatataatatatattatatataatataatatataaaatatattatattatatataacataatatataatatatgttatatattatatataatatatattatatataatatatagacatattatatacatatattatatatatataatatatatgagacatatggatgtttgggagccatataaatattttacttgctgaattagtaaaacttctgataaataagaagatacttcaagataataagtgttaggtagttttcattctctgaaacaatggaaaaacgcttgaattttcagacggtattgtccgtaaagattcacgacgcattctaggtgttccaggatggccttggaagcagtcaaaaggagaatgtttatggagctgaatcagaaaggatagattgcatcaccaatatacacaatgggcttgtcacatttactgatggttccctatgtactgggaaatgtcaggtgattcacatataatttgtcttttaaaaatataaaaatatatctgctggaaaaattgcaccaggtcaaatgtattttagagtatctagtgttataaaatagatgtgttaagtttcctgctataaatgttgatatttataatttcatttattttcataaacagttaggatgcacctattcaagctatcctttattataatataatttagatataattcaaaatttagctataattccaaattttgctcatttctagacatgactatatgactgaattgatgctgaggagtttctacaaattgtcagtgttttgttgttagtattatttgctattttcaaaaacattttaaaatttagtcaattttgcattagatattttaattgtggcaacacagagtatcaactggaatttattaaaaaaattattaaaaattgactcatgcttatatagtctaaggtaaggaaatcaaaccattttttttttcctacaaccatgttaacgctatgaaaactctcatgtcaagatgtgctatctttagaacaggaatggaattcataaaatagctctttgctacagagtttttcagctgcattttcaaaaccaaataatataatttattttaaatttaaattttaggcattttacagtagaattcatgaattattaggtttctatacatttgtttaaaaaacaaataggttagaatacataaacatttgtgtcctacttttgtacatttgtaatatacctttgtagttctacttttcatgtattgttttcaattatgaaataattaagttatttggatttaaatatagaaaaaatatttaacttttgttgtgaagaaatatatataatatacgtgtgtgtgtgtgtgtgtgtgtgtgtatatatatatatatatatatatatgaaatacacagttcatttgcccttgaaataagtcctccaataggaaaaaaaatatgccctttgtgaaatgtcgtctcctcaccacagataatgaaaggattgctttgtgatttgacaattaaaattcacttttatttgtcagtattttgtatgatattctgttcaatgacaccctccagttaaaactctacaatgtagtaacattgtattctgaatggtaatgcctgcatcttattgttgttatttttaaaaagtttaaagctaattaggagacacatctattattttgctactttatcattattcccttcagacctatgagctagattttatcaggaatgcatactgtatattcactctcagtttattcatgctgagggcatcgctaatttgatcatcaaagtgtatgtaccatgtatatcctacagtagattccttaaaggaaaactagggctgtgctattaattttaaagtcctaatgtatggctgttaaaaattaagctgtcaacattctccatttccagcagtagcacagtaatgacaaagacatattatggaaataaatagtaattaattttaataagtagcattgtacttacagcattgtcaacaggaaaaataaaaaatcttttatggagaaaataaagttgtaacatcaaaaaatatgaaaaagcagaatatatttatgattaaattaaggcaattttagaaattaaaactctcatttagcaatatttgataaagacatctgtattgcttctgaataagatatgtattaaaattattcataagacaatatggattaaaaacaaacttctggcttcatgatacttatttattgagtaatttgcaattaatacaaaatatttttactttctagggacaagagaagaaaaacaggcaatgctatggaggattagaaagctgattaacttgagatacatagcctcatgtttataaatttgacagaaaaaatgattcacattctatatatcagtcattaatttggtactgatgataatgtgcaatgtataatacatatctgtgtttactctgtttcttgattgcatatgtaatgtgctgaacaaaacctaacagaaaagacgtttttggtcaaatatatcaaattaaaagcacactattgatggtccgaagctgtttaaacagttaatagaattatctgttgatttcacctgatttcaattatactaatgtaattcatgtaaaaccttatatactcaaaaagtaaggaatttcccatggttttaagaacatcttaactctagaaacacagaaaaggcagagaaaaaaaaagatttggagttgttatctagaaaaatttcagtggtaaattctgatatttttcttcttccttacatgactgaattatttcacatactttttattgtgtctaagagatgttttgaaaaccaaaataacaaacagcatctatgcataaaataagagccagcaagttgtgtggagaatgtgaggtactctgcaaagtgtatttttataagccctgattttgctttccaatatgctccttaatgaccaacaaagagggatatttcttgaggatgacttcccttgacctttcctatttgtctagagtatttgaccaggatagatgggagactatgctgtgcagtggtaactgtacccaggagcaggaacatgagtaagaatgtacttgatggagacaagggaggaaggaagtgtaagtggctctggaaagctccctctggtggagaatgtcttaataataattcagaagccattactagaacaaggagatgatagattacctatttaaaggactttctcaatgtagaaggggccttcctaaaatttcttgttatctgttttaaagtctgtggtagaaataaaaattccattccctaattcaaaaattcagcattcttccattgccagccaaattagctaaagttcaaacataaaaagaatcaaagatctttgggttccatattttccttattcccttccaagtctagctggatttcagagatacatttattactgtaaaacaaatgctcaataatagaataacagaagacaacaaatcttccaacattttgtttgatttctaaaatttttgttaccgttgttggacataatattttacatttcctaccagcactgcctgctgcttaaaaaggttgtttgctcatcttctgctagagaactctaaaaggggtcaatttttctccgaaatcattctgccaagggcagtcgttgatattgctgtcagaagaaagaaaaagacaatcttatgtaggtggaggggttttaacctttttaggtcattggctgttttaaaaatcagaaaaaagctttggattctctggctcagctatatactcataatattttgcatgcagttgcagtattttcctgaagtcacaatagtattcccaataccacggttacaatagtatccctggctctctctctggtgagctaccacctcatttaccttcccactgcctcctacaccttgccatgactagatcttctgaaggttaatgtaattcctcaccccgaggaaggttgaaagtacagtctacataatcatgccccacaacggctatctttagcattaaacaccctggctctaagactctcatcttttatcacaggaattctgcattgttttccgagactggttcctactaagaaattccaggttatggtactccagtaatgaacactaaatattgagaactccctacttccgtagcattcatttctcacaccgccagttaatcagttcctgaatccttgccttctatgattgtgtttgtgtatatatatgaaatagacttgaccctcagtcctaatatcagagttgaatccctgttacaatttttttgttgataaataatattatctaatcacaatgactactgtaagtatacaattgggaaatgttaacaagtgctatgcaattaaaaaaaggttttgtggtcaatgaaatgtggaaatattatataccgcattctctttgggagtttacaacgcctttcaacatacactttaagtagcatcacagtaatggaaaccggcccttaatactggttaacccaaagtttgtcaaacatatctgcatacataacaatttctataggacagtagttaataacataatgttgatagtttaggaagtttggtgttttaggaagaaactcatagccaagcctttaataagatatatttctgtaaaaataacttccacagtactctttatggccaccagtatctgagatcattatattgaaattatggtttattaaaagtgataatttagttgatcctactgtattcctcatacatagcagagatgtggaaagggacagtatggggtttgaaaatttacaacttcaaaaactattttccttaaataattttctcttgtctgatagaaaatcagtgactctgatatgacatgaatctgattcccttcactaaatattcatgtgaccaccttttctgaaaggaaataatactctaagaagtaaccattaaaacttttattatgttcagctccacagttaaaaggacccattttaatatctaattgagtctacttccattttagtagtttactatgaatgtcatgattgttttctaagtaggtgctacaatctttatcactggaatttccttccatctaagagaacagaaaccgagttaatgtatctgaatttcaataaggcatttacaaaggtctcttttagtgttcctgttggccagatggaaaaatattcactgatgatatggaactgggtaggcttattattggttaaaagtttgtactcagataaccctgtgttatggatttgtattaactgtaaggagatatctagtgatttgtcatatagtttcattcttgcccctatattattctaaaggttcattattaatgtgggtaagaacactggactcaatcttttcaaaattgcaggtgctatgaaactggaagaaatattaaatatgttgaatatgttgaattacaaaatagaaattctgggaaatggagaaattttaagaattaggtagaggttagcaaatcatgtttaacagagccaattttaagtcctcttttaaaaaaatctagcatcaattaaacaaagagcacaattacagatggggataaatttgatttgactacagcatgactgtttagctagattctgaatttaacacggaagacagatagaaacaaacattaattaagtgcatactatatgcacacctggggctagttaccttcatgtactcacttcatttaccttcaacaacaaaccagtgaatagaaatgactataaatagtataatgacaaataaaattaattgaaagaataaccgccccaagatcattcagcaaataagtgtcagatctaacttttattcccaaatttatcaattagaatttgcattgttagtaataaaatatagaaatatagaatttaagaagagtgaaaagggtggctctcccttggtccaaccacatctaaaggctgtgtttagttctggccctgactgcggagggaggttaatagaatggatcaagtccagggaagaacaaacaaaataatttcacattatgtgcatttaaataagtttgaatctatttattttgagtaggaaagttttctggtaggatatgataatgatttaatataattgaaaggctatcgttttaaataaaaattagatactttcccctccactttgctccagagagaaattccaggatcgatgagaggaatctgaagagtttcaggttttactcaacataagaaaaacacttcatattttgctgctttaccttttattcctagctcttattatcttatggtataatatacaattttatcgtatatattttctgtttttctcactaagataaaagttccatgatgtcaaggatttatgtctgcttaatcatggcatttttggcaccaagcctggtacccaggataaaataggtgcctaataaatatttgctgaataaatgaaatcaaaccagagattattggattcaacttggttctagcaaatagtttccttactgacaaacagtattttccttactaatagccaaagaagtattcatataatttgcgaattcataaaattgtacatatttgaaagccaaaggagcgctgaattctcaaaaagtcattttagaaagtggcccagaatgattgattaatctatcaatctctatatgtgagtacactttggaagtttttagtcataatgatgttacaaattgtcatcagactgtttcaaggaggtatgagctctgtagttaaacttccaaggctctttacttgcaagctgtctgatcttgaacaattgatacgacttcatggttactttcagcaccttcctcctgacattattttgaggattaaaagtcataatatatgtaaagtacttactgttaccttgtgcttagtgtgaatataaatattaaataatattaacagtattagtagaaaattatggcattgctcttattatagctacttaccattcatactgtatatcatgaaaatgataaatattgagattgtaaaaaaaaccattcaacatttagaagcactcccagggtctttgcaaaacaaaacaaaaatgcatagttcctctattgtccagaatagataaataaaatgttaaaatatggaataaatagaccactgtgtggattacacgtataggtaaaaatgtcatcctcaaggaatataatgtcactctctactcattttgatcttctcactaacttgatctttttaggtccaacccctcttctgagctttcccttccttctcttgaaggattgaaacataatagcaagttgagtagccacaggcagttttgctatacaagactagctcactctctcccattacagtgttttctttgcttttgtgaaaagactcccacactggtgtctgctgctaaaatcaattctggaaaggtattttaaaaaatgaccctcccttaggacgtgacagatctctgatggtgtctttgtcttccttctgtttttgaaaaaatccacagtattttctccaaaactttattatgttttatgaaaacataccactgacagcttccaataggaatcagaagatttacattgattgacctaggatgcacttcaattatctagcctgagcctatatcatctttttaaaacgtttgcttttaaaaaatgatttatattgccctgatcctttgaaaagtaaatttgacacatgataaccctttaattctacataattcagtgtgcaccccttgagaagcattttcttggctgggcgcggtggcctgtaatcccagcactttgggaggccaaggtcacaaggtcaggagatcaagaccatcctggccatcatggtgaaatcccatctctactgaaaatacaaaaattatctgagtgtggtggtgtgtgcctgtaatctcagctacttgggaggctgaggcaggagaatggcttgaacccgggaggcggagattgcaatgagccgggatggcaccactgcactccagcctggcagcagagtgagactctgtctcaaaatatatatatttatatttccctgattttctgaaagtaaattggacacatgataaccctttaatactgcataattcagtatgtaccccctgtaaagtattttcttattcagttacattactgaagtaattatgaaaattagaaaaataacactgactcaaaattactatttaaactttagacatcattcaaatattattttgtgtcccagtaatatcattcatacctaaagactatactttttgaacatactaatatttttcataaatatttctttatcgccttccttaccctgcgttactgaaaacggtgtgttttggtcatgtttattttgaacatagtgccaaacacattcatcgatattattatattaggttattcttgcattgctataaagaaatatgtgagactggataacttacaagaaaagaggtttaattggctatcagttctacaggctatacaggaagcatggcaacatctgcttctggagagccctcagggagcttttactcatgggggaaggttaagtagaagcgggcacttcacatggtgaaagcaggagcaagaaagagggatagagtggtgagggcgttgccacacactttaaaatgactagatctagtgagaactcactattatataggtaggaccaatccatgagggatccactcctatgattcaaaaacctcccacaagaccctacctccagctttggggattacaactgaatatgagatttgggtggggacaaatattcaagttatatcaattattatctttccatctcctttacatatagatactctatagaatgatgcagtgtaatcttacataatatctctcttcaagtttgaacaatcattttttctaggtatggaacaaattacttttatggaatttttatttcctaaacttccctgcactcaacctacatatactctgaacaaatctgaatatagttggatttagaaatctagaatagtcttatatgtacttatatgtggcatacagttaattatgtaaggaaatatttgccctatataattttgtgcttcattttctgttcactccatgttttattttctttcaccaaccaattttcattgttttatttgactaattcctggctacaaacatgatcaagttgctctttagttttggggaaacttaccagtttgtatgtattggtccagtcaaagggggtaaaatattattagccagaagttttctgaataaacataataaagctaactcgatgttcattttaatggaatttttatgttaaagcctagtgatctgatgaaatgccttcccagttacatatatttctatcatattagtgttggtcattttgaataaaagttgtcactttgctggatagtgtcacagaaatactggtactggtcactggttaccacttttaactgaaaggaacttgagtgtctctgcttcagtgatcatattttcaattattaggaagctaagcaaagggtgatttggtttgtataaggttactcactgagtcggcagaaatgccactgatctcattttatcatatctgctaggttttatgtgacattgaaatgcctcattgtccaactcttgttttttgttacaatgaagatcactaatatattatttgtatttgtagtaatatcaataatcatctgcaattccactttttatattgcattataatttatcaactatttttaatcagtgtcttctacatttgactttagccaaaaagctaagaaataattattttcactgattttatttgaaatggttctttactcatggtgcacagggcaccataattttaataaaactttaccgttcaatacagttttgattaattccaacaactaatatcattcattaatcataaattctagaaaactttttttcacagaagctaaacttcctgatctggctgtggctagttttggagtctgttgttcactggttacaatgcttatatcattctctacttatattttaattagaagaatgtaagtagttgggtcacaggctgaaaaatgacttaaaaattaaaataattatagacaaagcccaattaaacataaatttcaaaactctgcaataaatactttttattctaaaaatttattcagtttctatgaattccaacttgaaagaattattagttttctataattatatgtgctgtcagtaaacatttattttgatgtgaaataattactatttacaagccttaattgaaataaatttgtttatgtagatctgtatacttttttcctacataagttatttttaacagctatactaaaatttagtttcctcttagtgtgtaattttgttattttatatttgtgtaatattatttttagtcttcctaccaaaagttgacttttcagttgttcattcttagagcacagtgataataaaaaggaatctatacttaattctatccataatatgctttggcagaataaacaaagtaactaacacattaaaattaccaagtaattttaagttctaaattaaataaacaatgaacaacacataaatattttctttaaaatattttgtgtagaatatagagtttgtttccacaattattcaaaaattagcttaaatacccacatattttgttgatgtactaataatggggatatttttacaataaaacatagaattaaaaattatgattttggagaattcataataaggtagggatatagtatgatttatgtaccctttgatctcacaattaggtgggaagacaatgaataagtaattcactcgataaaaaatattgttaagaaatgtatatataaaataaaatattatttttacagccttttaaaaaaggttttcaaacatattgactgttgatcttgcgaaacccttcattacttaatatctattaaaatattttcacttatcaggaaatttataattatctgtaatggtttatataagagcaccaaaatgttaagtaagcacaaccaaagctcaaccccaggaattctaacttaaaaatttcattctggtctataacgagctctcttgccccgatatatttattctatgtagctgttggcactatctatctatgtgtctcatagataaaaccacataatatctaaaaaactctagttataatataatagcataggtaacatttattgtatacatatgtgtcatattttaaatatattctttccattccttgcacttagagagttgggtgggattattcctatttcaaagatgagaacactgaagtttagtaactaataaatgagtaattatttttgagctgatgtgcccctaaaggccaatatctttctgcatctttgattatttatacttatagaaaactacattttgtacttagtacttggtaagtagattttgaaatacgtaataacctattagtagatttttcttatgcatacacagctttttaagtaatagaagaatttttatgatacagagaaatagtatgataagacatattatttatttcactttttaaagccaaactgatttaaaataaagtgataccttaaatgacttgacatatggtctgaaatgtttagactgattattggtgaaatattttgggggaaatttgcactgtaaattaaagcattatgtttattcaaggtgacaaagaaatgtacttcaatggcatggtactgttttatttcattactaaaaacaatagaactaaagtgctaaaggtaaaatagagagcttgtagtgcattatattttaagaaaaatgagacccagaatgtcttgcatgttatatttgccaaaatatttgataaattcagcgaaacaaatgtttgccgattgctttttgtaagtacctctgatatgtgcttttatatacatggcctaatgatcttatttatgagaatgacttatcatcatcatacacagtcatcttcaataagcaatttttaagcttataccattggagagacacttcactagaagatgtggcatatacaatgaagattatgtcatacctaggagtgagagcctaattacggagatgaggctagtgcataaaatatagttaacaataaagatagcatgtaaatgccaacaggtgtataaatcgtaattattaaagatggtcaaagcaagacaatatcttttatgaaattattttaatcccttactctttattatcatccaggagaagtcaagatctaaaacatagttcagagaagcagaaaagtttcagcacatcaggtgcttccagtcctggatgaattctaaataagaaattccaatatagtagtgttgacctagcaacaatttaaataaaatgatttcctttttatttgcttctctgaagcatggacaaactgctcattaacagtagaacaaactgctgtccacttttatagttatttgaaatataaaaatcaattattagtcatgagaatgaatcacgttttaaaacaagggttgagaagtaaagtattttagttttttttcaaggcaagtattctaaaatgccagcattaggtccatttacaaaaagttgaatcattacattcttgaaattctttaaaataatcatgtaaaactttaaaaatcagaacaatattacaattattatagataatttgagaaggataatttattccacaaatattttatataaattacttagctttgtaagctaaaatatcatgtaggattttttttagtctctctgttattaactatattaaaaggaagaaaaaacagctgagaggaaaattataataaaactctgtgtgtttgtatgtgtgtgtgtgtgtgtgtgtgtgtgtgtgtgtgtgtgtgtgtttctccattcagaagaaataatggaggaggagttaggctgttaaccaagcctagcactgacatcattcaagagtcaaaaaatataatagaaggcatgcctaatacattgtttactattggaaaattgaagatcaagagaaagaaaaaagaaattatttatgtcacccaacatatggaataaactgaaagtgaaaagaaatgctcctattatagcataaaacaactatgttactgttgcagcatagaagtggcatgaaaatacatggggtaataatatcagaagtagtagaggagagtggcctgaaaccatagctcccatcatgaggggaaggggacaaaatgttacaatagcaacccaaaatacagtaatgtctgagaaagtgacagagggtacatggttaatgaagagaacatatcagtaattaataatgaaccatatggaaacgattttatttcttccacacctttgagtaagggttgaatcagaaagaatggtattgattaccatcactatacctactccaagttaatgtggcctggggaaactagaatcacttgcaaatttgtgttcacacaggtgcttcagactgtaggtgatgcttttaaatgtaaataatgctctatattccttttggagaacttaccttacaaatatgctggcacacacacacaaaataatatatgcagagacattcatttgcagcgctatttgacatggcaaattttgactactcctaaaatgttaaatacattgtggcagattaaacaataaaatcatatgcaattaagaagatggaatatctatatataaagatatgaaagtatcgtcaagatatactttaacaggaataaaacaagatgccaaagagcagcatgtatcaaatcaatcatttattattatttcactattattattattattaatttgagacaggaattaatttgaaacctgttgcccagactggagtgcagtggtgtaatcacggctcattgcagccttgatctcctgggctcaagtgatcctcctgcctcggcctccagagtagctgggactacaggggtacaccaccacactgggctagcttttgaatttttggtagacaagtttttgccatgttgcccaagctggtctcaaactcctgggctcaagtgatctacctgcctcggccttgcaaagtgctgggattacaggcatgagccactgctcccaatcacttatttttaaaggtgaggtagaggataaacttcatttgtgtttccttgtacattcataacaattctggaattattcttaaggaactaagagtagtcatcatcgttgaaggaactggaagtaagaattgggcagatgaaggaaaaaaatgaaagaaagactagaaatgcatgattgtacaactatttagtatttgctacattttcagccatattattacaaagtgaaagttaaaaaatgcatataatttaataggcatgttatgagcagtgggactgagtgagctgcctcacactgttaaacgtgataactacatgaatatagtaaaaggatcagatagtctcataaagtccgtaacaactcaaaaaattattatttcttgaattggtaatctattcatttttattttttacatttaaagctagagctacaactggtttagttagagaccaaattactcatccagtttctgtaagccatccacattttactttcatgaaaacacacatggtaagtaaatgtggagatatcaaaaaggaccctcggggtatgtcattgagaactctgtgaatgagctcaggtttctgcatcctaccgtaatacaggccaccgttttataataataaccccgaggacagttgctctttccagaagtgaggtgagtcacatttgtgtttgtgctccattgactgccttttcccttcctccgttgagctcatagtccgagattcctcaagcagttcccgtcttccttcaggcccactcctaattggaacccatctatcccactaacagccgttgagctttaccctgtgaaacattctggttgttgtcttttcaacttgaagtcatatcgaaagatgataattgtaaggctaaattcaatacttggggttagattatactgtattcttattcgctgacaaatattatttttgtgatctcttaatttagttttgaagctttataaagatacacaattaagaccctccaattacatatttcacaatttaactttattggatagaataaaagcagctctctctctctctctctctctctctctctatatatatatatatatatacatacatgtgtgtttgtgtgcatgtgtatttaattatataaaatttttcaggtaggcaaaacatattattttattgtaattagaatttcagagctagaagatattttaaagatatatctcaactattcaatttacagaagtggaaacaaactcaatgaataaatacatagttacagatgtagttactttacgtattgcatgtgtgtataattatataatttttcagttgggcagagcatattatttcattgtgattagaatttcagagctggaaaagattttaaagataagtcttaactatttcatagtagtggaaactgaaactcataatgaataaatacagagtcaaatgtagttactgtaagtattgcagctataacctgtctcattcacattttaaataagagattcattaaggtataattcaaataccatacaattctctcttttaaagtgtatagttcagtcatttttagtatattcacaaaattgtgcaactaccacagctatttaatggtaaaacgtttgtatcactccaaaaaagaaaacctctatccattatcagtcacttcccgttcacctctccctccagttcccagaaaccaccaacatacattcttgtctctatgcatttgcttactctggacatttaacacaaatagaatcatgcaatatgtggccttttgtcacagcatctttcagttagtaaaatgttttcaaggttcattcatgctgtagcatgtattagtactttattcctttttattgtcaaataatatcccattatatggccataccactatttgtttatctactcatcaagtgttgggcatttgagttatttccccttaagggctattacaaataatgctactaagaatatttgtgtgcaagtgtttgtgtggccctatattttcaattaccttaccttacacctgggagtgaaattgctgggttctatgataacttcatgtttaacattttgataaacccccaaattgttttccaaaatgactgcgccattttacattaccaccattaacgcatgaaggttcttatttctctttaccctcacaaacacttattgcatgccttgaaaaaaaattatccttgtgagtgtggtgtccaattgaagttttgatttaccttgccctaaagactcatgatgttgaacttccttcatgtacttacatggccacttgtatatctttcttggaaaaatatctactgaaattctttgcaaatttttaaatttatctttttatcgttaacatgtaagagttatttaaataacctcaatataagttgctaatcaaatatgatttgcaaaaactttctcccattctgtgggctgtcttttgactttcctgatgagatcctttctttcataaaagttttaattttgatgaagtgcaatttatctattttgttgttgttgctgtgcttttgttgttatatataagaaacaatttgcctaatccaaggtcacaaggtcagattcctttattttcctttagaagttcatttacatttttaacatttctttcctcaaagaagtttattatatgcaatttggcaatagtttaaacaataaacaagtaaaggaactagaaagcagatattacatgtttatatagtaatttcaacttcattctttcaattgttatttatcagatacctatagtgaaccaagcataatgttaggagctggttttttaatgtaataatttatttagttttaacaccaattctttgtggcaggaattatgtgcagtcatacatcagagatatcatgggtttagttttagaccactgcaataaagcaaatatcaaaaaagcaaatataataataaagtgagtcacacaaatttttctgtttcccactgcatataaaaattatgtctacactatactgtatgtctacaatatactgtagtatattaagtatgcaatagcattatgtcaaaacataattaacatttaaaaataatttattgataaaaatgctgactatcatctgagcattcattgagtcgttaatatttttgctactgcaggatcttgcctcactgtttatggctgctgattgaacagagtagtggttgctgatggttagggtggctgtgggaatttcttagcataagaaaacaatgaagtttgccacatcagttgacactatcttgcccatatcttttctctgtagtatgcaatgctgcttgaaagcattttacccacagtagaatttctttcaaaattggagtttattctctcactgtgcagctgctttatcaactaagtttatgaaatattctaaatcctttgttgtcatttcaacaatgtttgcagcatcttcactaggaattgtctctatctcaagaaaccactttttttttcctcattcgtaagaagctacttcttatctattcaagttttatagtaagattgcagaactccaggcatatcttaagtctccaattctaattctagttctcttgctatttacaccaaatctgtagctacttccttcaccgaattcttgaatctctcaaagtcattcatcagggttgaaatcaacttctttcacagccctgttgatctgtgtactttgacctcctcccatgaaacacacgtttttattggtatctagagtggagaatcctttcctgaaggttttcaacatatctgcccaaatccatcagaggaaccactacttatggcaggtatcaccttatgaaatgtatttttgaataataagacttgaaagtttgtattactatttgattcatgggctgaagtatggatattgtgttagcaggcatgaaagcaacattaatctccttgtacatgtccatcagagctcttggatgaccagatccactgcaaatgagtactaatatttttaaaggaatcttgttttatgagcaccagatctcagcagttcacttaacatattcagtaaaccatgctataaacaaatgtacattcatccaggctttgttgttccatttatagagcacaggcagaatagatttagcataattcttaaggcccctaggatgttcagaatggtaaatgagcattggcttcctcttaaagtgacctgctgcattagtctctaacaagagagtcagcatatcctttgaagcttcgaaggcagcaattacttccctccacctatgaaagtcctacatggcatcttcttccaataggaagatgttttgtctgcatggaaaatctcttgtttagtgtagcctccttctttaaatgatcttaacctgatcttctgcataacttgccgcagcttctacattagctcttgctgcttcatcttgtagtttttcatatgaagaaggcttctatcttaatgcttatgaaccagcctctactggtttccaacttttcttctgcagtttcttcacttctctcagccttcagagaattgaagagaggtccttgttctgctttagactttggcttaagagaatgtgtggctggttttattttctatccagaccacccaaactttcttcatatcaggaagaagcttttttgctttcttattattgatgttttcacttgagtagtacttttaatttctttctagaacagttttgttgcacaactcaggtgtttggtgcaagaggcttacctttcagcctatctcaacttttgaagttcctctctcagtaagcctaaacatttgtaacatttcattgaaagtgagagacatggccaggcatggtggctcatgcttgtaattccagcactttgggaggctgaagcaggcggattatgaggtcaggagtttgagaccagcctgaccaatatggtggaaccccatctctactaaaaataaattagctgggcgtggtggtgcgcaactgtaatcccagctactcaggaggctgagacaggagaatcgcttgaacccgggaggcagaggttgcagtgagcagagattgcgccactgtactccagcctgggggacagagtgagactccatctcaaaaataaataaataaataaataaataaataaataaataaataaataaataaagtgagagacatgtcactcttcctatcacttgaaaacttcgaggctattgtagggttaactggcctaatttcaatattgctaaaatagataatagggaggttcaaagacagggagagagatagggaatggctggaaagtggagcagtctgaacacgcataatatttatctattaagtttactgtcttatgtgggcatagttcatggctgaccaaagcaatgataataaacatcaaaaataactaatcacagattaacataataatgaaaacatttatgaaataatcaaatattgtgagaattaccaaaacgtgacgcagagacatgaagtgaacacaagctgttggaaaaatggcatcgatagatttgctcaatgaaggattgtcataaaccttcaatttgtagaaaatcaatttctgcaaagagcagtaaagtttaacacaataaatctaggtatgcctatattcatttttttccaaaaagaaattaagagttaggtaacttttctaaagtcattgtatgaaagaatgaagatagagttaagagaaaaacaattctgattctagggaaatgcaaatcaaaccacaatgagataacacctcataccagtcagaatggggattattaaaaagtcaagaaacaacagatgctggcaaggctgtggagaaacaggaatgcttttacaccgttggtgggaatgtaaattagttcaaccattgtggaagacagtgtggcaattcctcaaagacctagaaccagaaataccattagacccagcaatcccattactgattatacccaaaggaatataaaacattctattataaagaaacatgcacatgtatgttcattgcagcactattcacaggagcaaagagaatcaacccaaatgcccatcaatgatagattggataaagaaaatgtggtacatacacaccatggaatactgtgcagccataaaaaggaaacaagatcatgtcctttgcagggacatggatggagctggaagccattattttcagcaaactaacacaggaacagaaaaccaagcaccacatgttctcatttaaaagtggaagctgaacaatgagaatacattgacacacagaggggaacaacacacactggggcctgttgggctggtggggagggagagcatcaggataaatagctaatgcatgagagtcttaatatctaggtgatgggttgataggtgcagcgtaccaccatgggacacacttgcctatgtaacaaagctgcacatcctgcaaatttatcctggaacttaacattagattaaattaaaaataaagttgattctaagcattctgtaaccatatcagatatatggttgtggttgatagctcgaatgtcagagatggagaactgcctgggtttgaagaatggcgttcaaactcccagcaattcgactttggtctagttaattaactgctttgcatttccatccatgcaaagtgcaaataataatatttatataggacagttatgagaattaaacatgttaatgcatttaaaatacttaagcttatgactggcatgttattaatgcacacaaaatgttaaaatgttagttatatttattcataaaatttattataaatctctgctgtctggaactgacattctattagcggggacagacgctgaactaacaaccatgtaaatttttatgtaattaccaattttggtaagtactacatagaaaagaaaaaagtaatataaattataaaagtgattaggtagttcaagatattcaagtatttctttttctgttccttgctgtgggtgttaaaatctttttatatttgttttcttaaattttcatacaataattcatttttatatatgtatatggtgtttccacatagcaatacataagggaaaaaagttgattaggataaaaatatcctgactctcaactgaaaagtaggtaaaagttacattcagtaatacaaaaaaaaaaaaatcagcttatacaactatttcatgaggtcttatttctaatggaaatttagtatcatcacttcaaagtatttttagaaatacggtataaatcatatatgaattagggttctcttagagggacagaactaataggatagatgtatatataaaggggagtttattaagtattaaattacacaatcacaaggtcccacaacaggccgtctgcaagctgaggagaaaggagagccagtctgagtcccaaaactgaagaacttggagtccaatgttcaagggcaggaagtatccagcatggaagagagatgtaggttgggaggctaggcccatctctcctcttcacatttttcttcctgttttgtatttgttggtggctgtttagatggtgcacacctgattaagggtgggtccacattccccagcccactgactcaaatgttaatgtcctttggcaacacccttacagacacaccaaggatcaacattgcattctccaatccaatcaagttgacactccatattaaccatcacaatacaattaataaaactaatacataactttaaaattataaaatctcatttatcccttaaattttaggcctttagtttttgaagcactcaaaagtcaaagttaaaaaagttactatcattataatgttacagtcaaatgcccagtaatgtacattaatgatttcattttagaaaacatgtgcacagttcttactggcctagaacagaaaatgaggacattgtgtgcaaatcaatggggacattgtgtctctggaagtgactagagttttgggtatttttcctttttttaaaaaaatgtcaacttttattatagattaagagatatacatgcaagtttgttacatgggtaaattgtatgacactgaggcttaaggtcccaacaatcctgtcacccaggatgtaagcatagtaaccaacaggtggctcttcagcccatgaaccccttcttttccgctccatctagtgatgcccagtgtttgttattcccaaccttacaattaggcattttcaatgtttagctcctacttataagtaagaacatgtggtatttggttttctgttcttaagttagtttgctgaggataatggccctcagctacatccatgttgctgcaaagggcatgattttgttctttcttacggctgcatgtattaatccgttctcacactgctataaagatactatctgaaactgggtaatttatatataaaaaaggaggtttaattggctcacagttctgcatggttggggaggccaccagaaacttgcaattatagtggaaagcgaaggggaagcaaggcacctcttacatggtggcaggagatagagagagagagagagtgcgtgtcagatactgccactcttaaaccatcatatctcatgagaactctctatcacgagaacagcatgggggaaactgcccccataatccgaacacctcccaccaggtcccttcctcaacacctggggattacagttcaaggtgatatttggatggggagacagagccaaataatatcactacataatattccatgatgtatatgtaccacattttctttatccagtccactgttgatgggcgcataggttgattccatgtccttgctattgtgaatagtgctgcagtgaacatataggtgcgtaggtctttttgatagaatgaattatttttctctgggtatatacctagtagtgggattgctgtgtcacatggtagttattttttaagttctttgggaaatctccaaactgcttttcacagtggttgaattagtttgcattcccaccaaaagtttataagcattgtattttctccccagcctcaccaacatctgttattttttactttctaataattgctattgtgactggtgtgagatggtatctccttgtggttttgatttgcatttctctgatgataagtgatactaagcatattttcatatgtttattggttgcttgtatgttttcttttgagaagtgtttgttcaggtacttttcccatttttaaattggattatgtggttttttgcttgttgatttgtttaagttccttacagattctgggtgttagatctttgtcagctgaataacttacaattattctttcccattctgtaggttgtctgtttactttgttggtaatttctttttctgtgcagaagctcttttgtttagttggatcctacttgtcaatttttgtgtttgttgaagttgcatttgggcttagccataaattccttgccaaagtctacgtagaaaaggatatttcctaggttttcttttaggattgtcatagtttcaagtcttacatttgaatctttaatccatcttgaattaattttcatatatggtgagaggtagggttctagtttcatagacctcattcaatggctgcatatggctagccatttatcccagaaccatttattgaatagggaatccttcccccattgcttatttttattgattttgttaaagatcagatggttttaggtatgtgggtttatttctagattctctattctgttccactggtcgatgtgtctgtttttataccataccatgctgttatggttaatgtagccttacattacagtttgaatttaggcaatgtgatgcctttggctttgtgctttttttgcttacaattatattgcctattcaagctcttttttttttttttttttttttttttttttttgctgttgttgttttaaatgaactttagaatagatttttctaattctgtgaaaatgaccttggtattttgatagggagagtgtttagtctataaattgctttgggcagtatggccattttaactatactgattcttccaatccataagcatggaatatttattattatttttttttgtccctgatttctttcaacagtattttgtagttctctttgtagacatttttcacctccttggttagataaactcctaggtatttcattttgtttgtgactatgataaatgggattgtgttcttgatttggttctcagctagaacgttattggtgtgcaaaaatgctacttttcttttaactgattttgtattatgaaacgttactgtatttgtttatcaagaatgtttaggtggagtctttggggttttgtagatatagaatcatatcattgaaaaagacagattgacttcttcttttcctattttgatgctttttattttattttctctcttgcctgattgttcctgctaggacttccagtgctatgttaaataggagtggtgagagtgagcgtacttgtcttgttccagttctcaaggggaatgcctgaggtttctcccattctgtatgatttggctgtgggtttctcatatatggctcttattattttgaattatgttccttcgatgcctagttggtcgagggtttttaacatgaagggatgttggatgttattgaaagcttttcacgtgtattttggctgtaataccaaaaataagaagtgtgtcataacaacagaggcatgaagagacagccttcttttcccttatttccctcattacagagttaccattttaggtccattaaatgtattttcctactctataaggtgtccagttcaaaaaaatcacacaagggcctagagacctgaagatgaactctagagaatggtataatatgttttgtgtggatagagtatttcatttttaagtatttattactttctgatagattatgtcactcaatcatggtgtctaatatatagtattacttttataggtaaatttataagtcaccatttcagacatatatttctcaaaattaggactatagaacattcaggaacttggatttgtaaagggatcggctgctggtatgaccgaacatacaataataagtaaactaatgttaaaaataaattttaaatacacataataaaatattctataccttcctgggttataaaataaatatagttgatccaataatttttaagtgaatatgaaattcccttctacatatttagtttcaacatccctgcagaaattctgggagagaggaaagagagttacaatgtacttagagtttgttcaacagggtgtggcctgggacagactgtgctggtctttttcttgtggaacctttgctgtatcacctttccctaggatattgcactggcttttctctgtcatctacacttctaataaagagagaaggatgaggctataataaaagttctcccttggagtagtctctctagtttgtgagacttctcagatttaatgaataagaaaatataaatgctatattgaagtttgatgtatctcttcagcctatttcaaggctatgctacttgttagcatatccttcacatgccattaaactttttgggtttcggaggacacccaacatgactttccgggaagcatcttctatctgtccttgaacacgcttcaacttctttgtgtagtggggcaaactgaacttctatatgggcacatgttttcattaggcttcttcccatgacagagatgtttcgtgttacactacatttgttgactgttaaagtaaggcagtacatttaactatcaacacagatagctattcttgctaagaactatattttgaactcagtgtctgagaatatgtacaaaaaacttagttgagagatacaattcatatatccatgaacatttattgcacacgtattttgtatgcagtgaatcctccagataccattctgtgcattggcaagataagattgaacaatttggacaggatctctggcttcacagagctaacattctactagagatacagttttcatacagaagcaacatgcatggtgggctaagagcttgaattctgaagttgtacctgaatttaaatcctacttcaagcacattttagatgtgtgatcttgagcctctcttacatcatttgtaaagtgcacatagcaatacagattaataatcctttatctgaaactcttgggggcagatatttttcagaattcagaaaaaattgtatatttagaaaggtaatgtggtacatatcggtgtaatatttaacaacctaagtaggtctgcaaaagcattttttttttttttttttttgcaaagaaacacatgaatagtcactctcagtggaataagaagagattataaacagtctcacctcagttcaggtcaacagtatttgacaataaaagggttttaatgtcaaacttctgaaaaaaacaaacagcaacaataaaagcagccactggttttcatcatgtttttggatttcaggattatagctaagtgtttatggatatgtagcacttgaagaagacaacttatgtcttgtcagcacagattctggcatgtggtgggttcttacttgttattaatatcagaattggcctggctatttctttagaaagtaaaataattattattgactcaaccataccagcagatatttatgtacgtgaactgctttcatttgacaccttacttctcctcaaattatttttacagaatggacctttagaatttttatgtggaaatattatgaaacggaggcttgtgagactgactatattatttgcttcatatttaccttaatgttatagattatgtgtctttctgtgcaatgactggtagaaatcttacaaaatagagatcaatctccagcaaaatacaaggcttcactgtataaactaaatatgttactttattcttaacgttctttcatttcctacaatatttaaccaccttttcctgatttttaataaattcactttttaaacttttcacctgtattttcatatgctgtctcaagcctctctgtatcaagacataaagaataaatttgtgcattatatatagatatatatgcatgtgtgtgtgtgtgtgtgtgtgtgtgtgtgtatatatatatatatatatatatgaaatatacccacagtgtatttcttttttttgtttttttgtttttgagacggagtctcgctctgtcgcccaggctggagtgcagtggcgcgatctcagctcactgcaagctccgcctcccgggttcacgccattctcctgcctcagcttcccgagtagctgggactacaggcgcccgccaccacgcccggctaattttttgtatttttagtagatacggggtttcactgtgttagccaggatggtctctatctcttgaccttgtgatccgcccgcctcggcctcccaaagtgctgggattacaggccacagagtgtatttcttctttttctatctccttcatattttcagatcctagactaatccaataaccatcatctatttactatacatttttattttcaattttaattgcaattatatatcgtgttttttgtgcctgtgtgtgtgtgtgtgtgtggtgtgtgtgttcaattggctcttgtgagttagcctagaaaagtaatcatggtttatactctgatttctatcaagaagtaagctacatgtttccattacagttccatattgacataaaaactgtttctaaattggaaaccaagctatgtgccaacttatttattgcatatttttaaagaatatttgtgtttcactagtaagtcactttacttctttgcaatacacattgtaaaaatctttgaatattttttttttctgaatcacctattcctagaagtgtggatacaaaggaaagaaaaataagaggacaacatttatatttttctctagaaaacaatgttttctacaatattgatttgtaatttttatatttttccctcttctttaacctctaaggttttcatttatcatgtaaaataattttaaaattagaaacaaatcattttatatgagtttagcacatctcattttttcctactttcacattaattcattacactcaaatttcattcactgagaatttgtaataaaaataactattcatccctgccatactacttagcatttctattagcccatccacataccctgttgcactttacaaggcagaaactctgaattgcttacaggtcaccaagcacaccctggcatttcagacttttatctgtttacacctgtttttcctctgcctgtagcaaatgtcttcttctcctttgttcactagaacacatcctatgtgacctccacatcacaaatcagaggtcattgcttccagaaattttctactgacagtccaagggagcattcctttgtgttacttctagtgttcctctgtatttctctttaccagatacatgtgtgcatatttgtgtttattacattgtactgtactaaatttcagtgagtttcctttttagtatttgtataaatttaagggctacaagtgcagttttattacatggatatattgcatagtagtgaagtctgggctttcagtgtaaccatcacccaaatattacccattaaacaatttttcatccctcatcccctcccatccttagtgagtttcttgataggaggcatgtagctttttcattgctctacccttacccagtcatagcatttcctatattttcattgattgtatacaggcttaaaataaattaggttgaaattaaactatgtatgttagttttttttaaaaatgatccatttcatagaaggacttaaatagtaggccaatacccattggtaatgtgagtgatgaagaaggtggaagaagaatattagcagtttagatttacaccttgagtttgagtgccagttaactatccaagtcagtagtaagattagattgtgggccactggagaaagattacacataaggagaaaatcaaaaggaagaaaggtgtccaaagtgataaacttgcagcaatacctacatcttaagaaattccatcatttaatgagtttacatatggaaagtgtttgggaaggattccaaaaggatgggatgagaaatgctgcaggaaacacgggagaagttgtaattctgtaaaatgaaagggaaagggaatctcaaaaagaaatgactgtttattgtgttaaatatatgcatctgggagacattcttgatgttagtgatagtaatttcactgctgtaatgtgaagaaattttagtattttgaaagataaatggattttaagaaaagagagatgatccctacaaattttgaagaggaacacactagattgtgctagagaaggatatggggttgacagaggatttttttaaatgtaggaacaacttaaagaatattactttagataaatagtttagaatgaggttaacataaaagaacaaaaggaaatattgaaaataacaaaatgggaataatatattgtttggtaagtagaagttgcagctttgcactgacaatggtgatacataataaagtcttggcatcataagtaagtttgtagactggaaatgattagcttgagaatcttgctgcaccttgtatcttactgtctgagacaatagctagtgggaagctaacaatttattagaatggtaaaagttaaaagcatcttctcttacagtgagaagagaaaacatactagagatatatagaaagatgttcagatagccgtgcatcttcaaaaatgaggctggatgcacagaatctgtgggcacacaaatctgcaaaactttcgtgattgtctccagtggccctcagtagactggctatggaaacaaggagaatacatggtgatattaatgcaagtttggagttttcataattaatattacataaacaaaaagagaagcaatagagttaacatttttcagatgatagtcaaagggatggaacactaaattgaatctaaatttgatttaggagagaaagcaaaaaggagtcatttattctggctgatggtgccattgacagtgatgagctatcctagtaaatggtacaaaggcaaacatatggttgtggacagtgagcctagaaagtaacacctccttttaaatactgtgatgttgccagcagtcattttcatcataaattctatagaataacatgtggatgctgcatgaaggtttttttatatttagtttctactgggactatgttagtctaacattaaatttattgtttattatagggttagatccatttatacagcagaagacctcactaagtggtatattttccaataaaaactaaaacctgaatttaaaatcttaggagctgattatattgcagtggaaatttgtctcgcttcattattccatgaaagttttcattcatgttggtatctagatatactagacaagatgttacggtagtcagagcatgcttttcaccctgccttattattattattttgtttttgaaaaagaacaagataaattgtcatcttaaacccataacattaagtatttcataacttcttaaaaataaaaagcaaattttatcttgtaaaattttcatctaatattttattttcatgaataattactgatatatcttaacagaaattgttgataatattagcaataattcatattcttaccataatttaccactgacagattacttttatatgtattatcttctgtagagataattacattaaactctacaacaaatatagatttttaaaattttgtttatttttattattattattttaatagttttgggagaacaggtggtgtttggttgcatggaaaagttctttagtggtggtttctgagattttggtgcactgattacccaagcagtgtacactgtacctgtgtagtcttttattcctcaccctcctcccacagttcctcccaagtacccaaagaccattatatcattctttaggtttagcatcctcataccttagctcttgcttataagtgagaacatatgatgtttggttttccatttctgagttacttcacttagaataatggtctccagctccatccagggtgctgcaaatgtcactatttcattccattttatggctgagtagtattccatggcgtgtgtatgtgtgtgtgcatgcgcatgtatgtgtgtgtgtgtgtgtgtgtgtatgtgtgtatatatatatatatatatatatatatatatatatatatatcacattttctttattcactcattggttgatggtcatagtctggtttcatatctttgcaatcgtgaattgtgctgctgtaaacatgcatgtgcaagtgtctttttcatatagtgacttcttttcctccaggtagatactcagtcgtgggcttgctggatcaaatgatagttctacttttagttctttaaggaatctccatacagttttccatggtggttgtactagtttacattcccaccagcagtttaaaagtgttctcttttcaccacatccacgccaatatctgtttattttttaatttttacttatggccattcttgcaggaaaaagttggtatctcattgcggttttaatttacattttcctgatgattagtgaggaacaatttttttcatatgtttgttggctatttgtatatcttcttttgagaatcatctgctcatgtcattttcccactttttgatgggattatttagtttttcttgctgatttgtttgagtttcttgtagattctggatattcgtcctttgtcggatgcatagtttgcaaatattttctcccactctgtgggttgtctgtttattctgctaattatttcttttgctgtacagaaactttttagttgattaggtcccccgaatttatctttgtttctgctgcgttggcttttggattcttggtcatgagctctttgcctaagccaatgtctagaagagcttttctgatgttatcttctagaatttttaaaatttcaggtcttagatttaagtttgtgatccatattgagtttatttatgtataagttgagaaatgaggatccagctctattctcctacatgtggtttgtcaattatcccagcatcatttgttgaatagggtgtccttttgccacttcatgtttttgtttgctttgttgaaggtcagttggctgtaaatatttggctttatttctgcgttctccattctgttccattggtctaggtgcctatttttataccagtaccatgctgttttggtaactatagcttgtagtatagtttgacgttgggtaatgtgatgcctctggatttgttctttttgcttagtcttgctttagctatgcatggtattttttggctgcatataaattttaggattttttttctagttttctgaggaattattattgtattttaatgggaattacattgaatttgtagtttccttttggcaatatagtcatttttacaatagtgattctacccatccatgagcatgagatgttttcatttgtgtcgtctatgacttctttcatcagtgttttcaaatatatgtaattttaatgctcaaagaaggtgcaaaaataattgtctgcaagtttatattggcaatgtaatagttaataaaaataaatttttgtttttgaaaatgggaaaataatacacaataatcatgcttccataaagaacacatttcagatttgacttttaaagtcctaggtataaatataagtaacggagaatttagaagggctatgaaaataaaatgagagcaaaatactctgaaaagtaatcccaaagacaattgttatggtttgactatgttccccaaaattcatgtgttggaaacttaattctcagtgcaacagtgttgtgagatgaggtcttgaagatgtgattagctcataaggctcataaggattcagatagggaaaatataaagcaattaccccctgaggaactaacgctccagtagagtaattaattgtaacaaaaaggtaaaggcacaatatcatcgctattcaacatttttaaaaagtaccaggtatgtactaagcactatatataatagtgttcagaaattatcatattacatgccattgtggaggttgcagtataatgtgaggaggtggatgttaatcaaatgattaacaaaaaatataaaatcataatagttattgatatggtttggctctgtgtccccacccagatctcaccttgaattgtaataattcccacatgtcatgggacggacccagtaggaagtaattgaatcatgagggcaagcctttcccatgctgttctcgtggtagtgaataagtctcatgcgatctgacggttttataaatgggatttcccctgtgcaggctctgttgcctgccactatgtaagatgtgactttgctcatcctttgccttctgccatgattgtgaggactccccagccatgtggaactatgagtccattaaacctcttttataaattactcagtcgtgtgtatgtttttattagcagtgtgagaagagactaatacagttatacatgaagaaaaggatcaatacatggagctactatgttgtaccatggaagagtctgaggtagatttggtgttcatacatgcttctctgaagaagcagtgactgagttgaaatctgaagaatgagtataaatgagagcaatgagcatgtccccacactctatggctggaatgggtttggtgaatccagtgagctgggagatggccaaaatggctcatggaaagactgaaatggaatacactgcaaaatgaggctgagtggcagataaggagcagaccattgaagaccttagctctgtaaagggaacaaacaccaagcgtcaagacaaggatggggtgggagtggtggaattgtgacctgattgcatttgggattttaaaatgttacactggctgtagtgtagaggaaagattagagagggctaatggtgatagaagtagatgagtgggcaaggacaagataatggtggcatggacagaaagaattggaggcagatcagagatttaaatatgagacaaagtagagatgaattgctaacaaatgagtaaaaagatagaggcgggaaagatgtcaaggacaaaatctaggtttctggctagcttaattaaatgataatgatatcattcatcaagtttgggtctcctccttccacacccccctaaaaaggacattaggttaatgtttgtttagataccataaatgacatgtttagtaggtcctgttagtaagaaatctccatttctctggcctcatatttctatagagaagagcttcaaaaaataataataataacatgttggcctttatttttacttcttactcagtgctctccagtgaagatggaaaaattatctggttaataatttggaggttaatgttgtactcatatctctctccctctctttcctttctctcgtctctttcttttgaaggtttggggtatttctacatatttccagaaagcttaaaagcttaatttgcctctgctatagtgggatagattttgaattatccttcttgcttgttaaaatgtagacaagtttgtcattttcaggtagagtatgttgaaagctcattttggtcacagagataaactgtactctaatcagtctaccagtaataaagcttacacttcagtcttccatttatctttctcctgtgactgtctcttaattggcttttaacttatgagggaaagggaatgtgatttaaacctcctaaaactcttacatgtagctcaggaaatgagtaatctgcctctagaagtaattgaagctgtggatatggatgagactgccttgggatagaatcgagaggtaggtgaatagcctaagactgagcatctaatcacaactgagtgtcagttctggtaaattaagatgacggataaaatacgtcaaataaatttaaacaacatgaacattatatttgtgattttagaaaatggtaagaagccagattgaagtcatatctcgtgtttctggtcttgttaggtgattgggcaggttcaagtgggaaataactttttggaagagatatttctttaactgcttcttaaagttgagtaaaagttagaaaagggaagagaatgagcaaagcttgagaggaaaaagatagcaggaaatttcaaaatcaccttcttccttcctttttaccttaaaaacccatctctaagaactaacacttatttaggtgctgtaacttgaggaaaaaatgattcactagaaaaattctaggacatttatttcagtggttatttatatagtcaatagtaatcatcagaaaatatactctgaaaattggaaaatatacctattttatttacttaaatatttcaaattttacgctgttgttctctgaaaatataaaaatgaaatttcatcaaagtttcttagtcattattataaagtatgatattttcagcatgaattagaacaaatatatagtcttgacatatagcttattattggggattatagagttgtttgcagtgaagggattttagcacttcttttaaaaaattggtttcacaaaatgtatcactggaaaatttatttccctttggagaattctgctgtgactacaaattcactcttgtcaattctttgctatagctttgctagagagcatgtataatactaaactataatataaacttaattggattgatccatttatgtatttattgcatttgtctggaaattattaccataaacttttaaatagtaagttttaacacctaatatggtgttatgatgcacatagaaactatttttaaatttatagaatcaaataacttgattacaattttatgattatcctatctaagctccagcctagtacaggagtctgtttatcactgaagaccatttattagcatattttaaatataataaaagggagagcacatgcttgtgttataagacaaatcatatttttgttgtttacaaggtttgttttcatatttgatttgtcttctcctaatttcaatccctagtctgtccttcacataatacatcaatacaaaaatcaattaccaatttcaaatgataacttttcaaatagatgaagcagacatggacatcacccacactgaaatgttttttgttttgttttgttttgtttgagacagagtgtctctctgtagcccaggctggagtgtagtggtgtgatctcagctcactgcaacatccaccttctgggttcaagtgattcttatgcctcagcatcctgagtagctgggattacaggcacgtgccatcatgcccagctaatttttgtattttcagaagagatagtgttttcacgtgttgtccaggctgatctcaaactcctagcctcaagtgatctgcctgcctcagcttccaaaagttctgggattataggcatgagccaagctgcctggccctcacactgaagttttttttaatgtaaattctctgtcagttactacacaacttaaaaggtaaatgagaacagttctttttgtttttttcagttccatcatttactttttcatatggctagtttccaaatgctgcaccttttacatgatcagctctgagagctttatcttttattaattttatttatatttattaatcatggttatttaaattatttgtttgttgagtgctctgtatgtgttaagatctgtacggactgttttatatttattaatttagtaaatacctgctgagttcattctatatatctggtacttgaattcagtacagtggaacaatggatgtgttataggaattagaccttatacaattgtgggaggagctgaggaaatacagatggaaaaaggagaaagtttgagaaaagatcaccagtcagtcttcccaaagcactgtcacctttggcatgagaatgctgagaacccaagcacatttggttgctgaagtgggactgcaaatgaaagtttgtagaaaagtcagttagaagcttttgaccctgtaagatctatctgctgtaggcccactgctaagagtctggtagtgggtccaaggctgctgttattcaaacaggactaatagatgagaataagaattagacacaaagcagaagagagtaaaaacaagctagagtttgctgggcgctctgtttcagtcactctctgtgtctgatgtaggtttagagagtaatgcccactgcttcactttcctatcccaaatcttgcacaagttccttttctgttcaactctaatccagaactatacaaagaaaagaacactgggtagtatagttaatagcttaactattagagagccaatagttcaaatctgcaagggatgcttgggattcagtggtgaaaagacagaaaaagttcctcgcttcttgcagttacattctagtggtagagtcagaaaataataaatattttatttaatgtcaagcagtggaagttcaggaaaaataattaagcagagaaaggaatggagaatgatgccttggagcagcatgagtggaggatgagatgaggcttccctttttgagtaaggtggatgaggaagactcatctaaggaaatgcaaatgagccttagagacctcagtgatgtaatgtgaatctttcagctacctaaaacagatcagtactggcagagggtaggcagcaggtgggaaaaagcttggtgatttttggaagagccgggtagtgtgtctaaagttgaatgagtgaaatggagagttctaggagcagatttagagacctttccagggattcgttcaaagagaacattataggcatgaaatgagtttggacagtgtatgataggagtccactggagagttttaagcagagatgagacaagtttgaatttacattttattttattttatttttgtgggagaccagagttttattattactcaaatcagtctccccaagcattcaggaatcagagattttaaggacaacttggtggggaaggggaagccagtgagccagcggtgttaattagttaggtaggagatgaaatcacagggaattgaagctgtcctcttgtgttgagtctgttcctgggtgggggccacaagatcagaggagccagttaacccatctgggtggtgccagctaatccatcaagtgcaaggtctgcaaaatatctcaagcactgatctagcaagcagttcagggagggtcagaatcttgtagcctccagctgcattactcctaaaccataatttctaatcttgtggctaatttgttagtcccgcaaaagcagtctagtccccaggcaagaaagagatttgttttgggaaagaactgttaccatctttgttttaaactataaactaagttccccccaaagttagttcagcatacgcccaggaatgaacaaggacagcttggagaacaagatagagcctgttaggttagatctcttttactgtctcagtcataattttgcaaaggcagtttcaatccctccctttgggttttaaaacacctcagtcttatggtgtaggctatgaagatgggacaaatcctgccatctttgtagagagtagattctagcgagccaacgcgagaaaaatggagtctacatgaaaaatgatagctcaaactgggaatctagctgatgtggtagaaagaaatatatcctgaatctaccttgtaggtagagctatatagtaagactagctaatagaccattgttaaaaaagcaaatggagttaaggatcatcctaatttttttagcaaataagtgagttttggcagtatttgcagagatgagtaagaatggaacaccagtgagtttaggagataaattattttctattagaagttagagattttgtgttgattaggcagttacaaagaaaggaattgaggtgaagcgaggagagatggatattgaggtgtacattttgtagttattcaagtccataatgtgtttagggacacgatactagaaaatcagtggggaagatggtatagagtttaaaaagtgaagagaagtgatattcttgtggcaaagattgtgtacaacttaataagagaagtgttgttacattcttatggcatatgcttacctggagggagtaatgcttcttatgcataacctgatttatatcctattttccttcacaacagatttgagctgatgttcaataatacttttggcactccagaataaaatgcaaacagagggtagttgggtgcaagagagaaccagggtagttaaattttgtagccgaaagtaagttagcacaggtgtattaaaaagaaatgatgatgaagatgagctgcagatttttttgcagtgtccaaaacaagaggagcaacacaattagtcaaattgttagaagatttataatattcataaattaaaaaataaaaaagagaaatggaaaaggaagaattgctctgaaaatatttgcgaaggctctgggcttctatgctcttcaagtagtgttaaaccaatttcctttgaattgtctgagatgatattacatagtatggcaagtgatatttggaattcttgtgacattatgttactgaaatgaaattcaataaaaacagtcctacagggacccaagcagttttatacaagttcttaattctctagtagtctgtcttgatccaagataaacttcatttatttcaggtaatcttccacaaaattctctcaactaggagtttgataattattgcaaaggaaagagttattctttcttcaaaggacctgtacttctttctcttcctgttcatatgtgggaaacatatgataccatgtattatatttttctatattccttgggatgttaaacttacaactggacaatactccaagttccctgtgatcgtagttgatatgacaggatgaccaactcctttggataaaataaattggatttttaaattaagttccaaacttttgggagtgagaaatattttggtagtcaagaaatgctcatgatgatgactacagtgataaactggaagtaatattttatgaacaatgacacataagccaccaacatgtggtagttaggaataactataaaacatctataaaagaactaaaatttacaaaaccctcagtgtaatgaatatgagaaataaaaatctcaacatcaataagtgagtcaatttaacaatatttctcactatttctatagggtaataataggcttttgaactgaaaaaaaaaaaccacaaggacaagcttctagtttcttctgatatttcaataaaaattgtctatttacaacagcagtcctaacaacaaaaaatactactttttatactcctctgattaaacaaaaattcaaaagttgcttgtaaccagaggagctaataatcattattaagtatttactaggataaaataatttaatgaatggaaaaaacatagttctcatgactatctaaattatatttcaaatgttaaaattaagtcttgtattgttattaaacatttttaaggcagttaaatttttaattgtgttgaattcagcagaatcttttaggttattataataattataagatgaattttcttgactaccaagccaaaagaattatttcaaatagtttaaatacaattttctgtagaaagagaagtaaggaagatgatttttttccacatgagtatcattattaagtagacgacagcaaatacaaccaagaaaatccatctttgaagtgtgctaaagggtggctcgtttagatatggcaattaatcactgcattatttatagtactttaggaacagctcatactacattaatcagggataacttctgcttaattaacaagactgccaaaaaatgtcaaacacaagcacaaaaacacaatggaataaaaacaagaaaacaagtgttagctagcgactgatcaccacaaagtgaaattttaacttgcatcacaatattttacttgcttgaacttttatactttagctggatatttcatgaaacgatgatttcttctcaaggttgaaaagggtgctgtttaggacacatagtagcaaaataaggtaatccatattatatagtgttttacttctgaccacctcttctgtagtatgtttgtgtagcttattctgtctaggcaactgcctactttcccacatggattgggcaggcattactgaagtgccaaaatagactgtagttagattgcctagtttaaattctggcaccattatgtcccagctgtgtgatttaagataaagtaatcaacttctctgtaccttcatttaataatttatgaaagagatgaaaaatgccaactaacttacaaggtggttatgcaaattaatatatttaaagcattgaccaatctgtaactactcaatatgtattaggtgttattattatttgtattttttaatcaggaaaattatcctctatcttctttagctttctatagctctctcttccttagcctctgaaagataacctaatcccacctactttctttctctttaacatctcacttggacacctgagcaactgctgtatgcatagtacaatgcaatgaatactttatgattcaaacacacagttcaggctttctatggtaacttgtacttcatacatctctggcatgtagttttctcagatatttgatcagtttcatatgtccaaagttatgtcacatttaatgaaactataactaataataagaccttgggtcattctctgaccaccaatactgaaatacctagaataacacaaattcctaggacttcttggtccacggaatatatggtaacatgatatacaaagaactttcatgtgatgagctaaagcaggaaaatggtattcagggtagaaaaggtatatgctttgcttaaggatgtgataaataatgtaacacagttgggaataaccaataattgtagatgtctacctgatctagtctgtccattttaaatgacagcagcaatcagtattaatgctaaaacaaggaattacaaacatagtgcaaccttcagatacacagaaatgatagcttcatctaaatccagaagatactgcttaagtgaggttctgtagatactcaagtatatgaagagcaacagtatgaaatgcttcccctttggaaatacaatcacaaagaacaagagcaaatatctttcctttgatttgttgaaaaactgtttattatatattatgtgaaattatcacatacatttttttcaccttttctttccactgatacaagcatttgttcatggacctgaagggaccttctctctcttttattactatataaaccctagaaatgcaaaaagcataaggtcacctcctagaagaaaccttcctagattatctgacatgaaaatcatatttagtaggtgagccatccaagggctcatgttttaaaatggaggagggtgagcatacctatgtgtgttagtgtcaggacacaggtttttgaccaatggtatcaaaatcactgggttaatgtcatttcccttcaatctcacctactaggaactcagatcacattgaattattaaatagtggacttgaattcaggcttttatgtgtttgttctatttttggcttaatgtcttactaacttcctatactctgatccggctcaaaatatcagaaggatgctccaaataatacatacattttcattcttgtattagttaatcttgtattctttcatattgggtttggctttagtgggttccaattatgggaccttatcagtatttagacgacattcttgatctattatgttccctaaaacgtatgacaaatatattttgatgaatgaatgaatgaataaatgaaggggttgggataaacagccccatgaaaatgaaaaagatagcatacaaacataggtttgttgagttatggactaaattgcaacccacattattgataaaaaactgttttcttgttgttaaatgctgtattttcagtccatctcagatgttatatagaaaaatatactaggaaaagctagtacaatgaatggtccctagaccttctattttgccttattataattgtagatggaaaattcaatttttaagaaaatgtaaataaagagatcatgataaggagatgactttttaaaaggtagcaactagaacattttatcaaaatagcaacaaaatgttaacaaatagagcgaatagaccaagttatcttggtttcagttggttaagtttaattaaatgaatataataagcccaacacagtacaaagttttattgtaaataagttttatagattttcttatcttaatgaatgcaaagtttttgttgtgttttctactctaattgaaaaatagaaaatattcgaaagacttaccaaaaatcaagctattgctagggaaacaatctactctgtgcttctttggagattagaattattttgttttcaatatttgattaatgctaataaaaataatagttttgggccaggcacggtggctcatgcctgtaatcccagcactttgggaggctgaggcgggcggatcatgaggtcaggagatcaagaccatcctggctaacacggtgaaatcccgtctctactaaaaatacaaaaaattagccgggcgtggtgaggggtgcctgtagtcctagttactcaggaggctgaggcaggagaatggcatgaacccgggaggcggagcttgcagtgagctgagatcacgccactgcactccagcctgggcaacagaacgagactcctcacaaagtaataataataataataataatagttttgaaaaacattttgtttggcatttatttttcaagtttctaaagaatttactggaggcattgtaagaaattcatctttaattcttattcttttgttttcttttttctctcttaacttctgatatttccttcggtaatcctgttacagtttctaaattttcagtaaggaaaacaaaagagaatagaactataacaggtttattttttccttgtggacaattggtatattcccgtatattctttccctgtgatattaagaagagatagcatttatcataattttctttttattgaacattttgctttgagtattaagttataactattatgttttttgctaataagaacatgtaagtaaactaacttacattttatttaccatattttagaaattaaacacatggatgtcagagacattttgtgaagctaagacctacatttcctatcttttaatgtttattttattatgccacttccatgatagttaaactagtattttttatttttatgcatgcacagtaggtgtgtacatttttttgaaaacattatgaatttatttatatacatgttccacaaacattttttttaaattatactttaagttctgggatacatgtgcagaacgtgcaggtttgttacttaggtatacatgtgccatggtggtttgctgtacccatcaacccgtcatatacattagctatttcttctaatgctatccctcccttacctccaccccccgacaggccccagtgtgtgatattcctcttcctgtgtccatgttctcattgttcaactcccacttatgaatgagaacatgctgtgtttggttttctgttcttgtgttaatctgctgagaatgaaggtgtatacattgatggggtgcatgagatatttcgatgcaagcctacaatgcataataagcacatcagggtaaatgcagtgtccattatttcattcaaatatccaatatcccagcctcttgtaaatattctattttctgtcttcataagttcaattgttttaagttttagatctcacatgagtgagaacatgtgaactttgtctttctgcgcctggcttatttcacttaatgtaatgtcctttcattccatccatgtcattgcaaatgacaagaacttaattctcttttatgcccgaatagtaccccattctgtatgtgtactgcattttctttgtcctttcatctgttgatgaagagcttaggttgcttccaaatcttggctattgtgaatagtgttacaataaatataagagtgcagatatctctttgatatactaatttcctttcttttggaaaggaatccagcagtgagattgctagatcatatggtagtctatttttagttttatgaggaacctctaaattgctctctatagtggctgtactaatgtaatttagtccccagcagaagtgtacaagcattctgtgttctccacaccctcgccagcattcattattgcctgtcttttggatataagccattttaattggagggagatgatagatcattgtagtgttgatttgcatttccttgatgatcaatgatatggagcaccttttcatgtacctgtttgttgtttgtatatcttcttttgagaaatgtctattcagatcttttgcctagttttttaaatcagattattagattttttcctatagagttgtctgaactccttatatatctggttattaatctcttgtcagattgatagtttgcaaatattttctcccattgtgtgagttgtctcttcacttttttgattgtatccttttctgtgcagatgctttttaacttgatgtgatcaaatttgttcattcttgctttggttgtctgtgcttgtggggtattactcaataaatttttgcacagaccaatgtcgtggaaagtttcccccatgttttcttgtggtaatttcagaggttgaggtcttagatttaatccttcaatccattttggttttatttttgtatgtggtgagagataggggtagtttcatttttctgcatatgaatatctagttttcccagcaccatttattgaagagaatttcttttctccaaagtatatttttggcatctttgttgaaaatgagttcactgtagatgtatggatttgttttggttcttggttctctattctgttctattggtccatgtgtctgtttttatgccagtaccatgctgttccagttacaatagctctgtagtattatttaaagtcaggtgatgtgatttttaaagtttttctctttttgcttaggatagctttagctatcctgtgtcttgtgattctctatacatttcaggattattttttctatttctctgatgaatgtcattggtatattgatagggattgcattgaatatatggattagtttgggtagtatggacttttaaacaatattgatacttctaatccatgaacattgaatatctccgttttttgtgtcttcttcagttacttgcatcaatgttttacagttttccttgtacagatctttcacttctttggttaagtttattctctgttattttattttatttgtagctgttgtaaatgggattactttcttgattcctttttcagattgtttgctgttggtatatacatatgctgctgaattttgtatgttgacttttttgtcttgcaactttactgaatttgtttatcagttctaatagttttcttgtggactcattaggtttttccaaatatgagatcatataagctgaaaacgaggataatttaactaattccttagaatttggatgaccctttatatatttctcttgtctgattgctctagctagcacttccagtacaatgttgaatacaagtggtgaaagtgggcatccttgtcatattccagatcttaaaggaagggctttagatttttctcattcaatttgatactagctgtggatttgtcatatatggcttgtattgtattgcagtatattttatctatccccagttttttgatggtttttgtcatgaagggatgttgaattttatcaaacactttttaggcatctattgaaatgatcatattgattttgcccttcattctgtttatatgatgtatcacatcgatttgcaaatgttgaatcatccttgcatctctgggataaacccatttggtcatgataaatgattttttaatatattgttgaatttactagtattttattgaggatttttgcatcagtgttcaacagggatattggcctgtagttttatttatttattgtttgacgtgtctttttttttttttttaataacagtgtaatatccttcaaacatgaataagaaagactttccagaaaaaaagactttccgtctctatgttatcttgaatttcatttagcttcctcaaaacagccagtttgaattctctgtctcccccagattggtttctgatgccttatttagttcatttggtgaagtcatgttttactcttgatgctcgtggatgttcactgatttctgggcattgaagagttaggtatttattgtagtgttcacagtttatgcttgtttgtacccattcttctggaaaaggctttccaaatagtcaaatagaattgcatgttataatctaagtctttggtcatcactgtaattgtgtctgcattgggggaaccccaagcccagtaatgctgtgactcttgcacacttgtagagataccactttggtggtcttgaatgaaatccaggtgaactgcctggtttaccaggcggggaatcttgttcttttcccttactttcccctcaacaagcagagtctctcttttcatgctgatttgcctggagctaggggaggagtgacacaagcatctttgtggccaccaccactaggactgctctgggtcatacctaaagccaacacagtattgggtctctcctaaggcccatggcgaccactgcctggctactactgatggtcatttaaggcccaagggttctttagttagcaggtggtgaatccatgcaggctggtgtcctttccttcagggtagggagttccagctggcccagggtgggtccagaaatgccgtttggggaccaaggcctgagtcacaaaccttaggaatctacttggtgctttattctgctgcttctgaactgacagccaacctgaaagacaatggctttcccactctttcctctcctttcttcaagcaggaggagtctttcctcatggccaccactactccaggcctgtggggtactacttggctactgctgatgttcactcaaggcccagtgctcttcagtcagcttgtagtaaacactgtcaggcctgagtctctctcttcactgaagtgggctcccctgtggcacagtgcaagtccagaaatgccattcagtagctaaggcctggaatcaggaaccccatgagcctgcttagtactctacacaactgtggctgagctgctactcaagcttcaatataaagtcccctttactcttccctcttctttcctcaaacagaaggagcctttccccatagccaccgcagctgggaatgtgctgggtcacacctgaagccagcagggtactaggtctcccccaaggcctgcaatgagtattgccttcatctgctgatgtttactcaaagcccaagggctctttattcagctggtgatgaatccttccaaaaacggtccttcccttaggagtagcagctttcctttttgttcagggtgtgtctagaagtatcatccaggcgctgggacctgggatgggggcctctggactctgcctggtgtcctattcaaatgtggctgagctggtatccaagttccaagacgaaatcctgtttactctcccctatcctctcttcaagtagaaggaaggagactctcccagagctgcaagctgtactgcatggggttgggggagggtgacacaaggactccctcagtcacccaaggcagtgcctcactatgtcatgtacacctcaagtccactggctctgggcccagcacagcactaagctgtgctcaggaattgcagtccttgcggcctagaccgcctttcaagtttatgtaggttgccagagtgctttagcctgcaatggcggtgcttgccagaacttaggttccgactgctgggatggatgattcccctctggctaggtctcatctaagtgcttcctctgtgggtgccagctgaattttgccctgtgttgctttctgctggaacagacacactgagttccaatgccaagtcccacaatcattgcaagcacacagattctctccccacctgctgctggggagttggggaggggtggcattagcaattcaagactgtctttccacccccttcagtgcctctgtcctcaatataatgttacaaccaggtactgtgattgatcacctgatttttgtatcttatggaggtgctttcttatgtagataggtgttcctgtggggaggatgaatactgaagggttctattcagccatcttgctctacctacctttcctaaaatcatattttaatttatcaaatcagtaattagtttgtcaccttccttaaaagataacatacacatatttaatgaaaattaaaagagagcaagcaagaacagaaataagaataaataaaaaagaagaacctagaatgaggccaataatgcatatcatatactttacacagtgggatcatggatttaactttcagttttctataaacccacgtcaaaattgttacacaattcacgatgtccgtaaatttaaaacaaccagttattctttgagataatacgttgttctcagttttcttcagtagtaatatcagagtagaaattttccaagtggagcggctattccagacactgtgtgacataatacaattattctcagcaacatcctttcaggcgattccacagtggttttcatggactgttttttttgcgtgtagtctctgatggccacacagcaaaagatggtccagccaaagcaattttataagtttgtagagtgtaacagaggcatttcctcactgactggatcaaggagtatgtgtatatttgggatttgaagtagcttttttatttctgaaacaatgttctcttaaatggcgttaaacataacctaacaatgcattcggaattctgctgttttccttgcgcctatggtaaattctaatgtcagttaaagtcagaccacaggacttaaaagataatccaaatgagattataggtgtcatatatttaggtcaaaaatagagagcctagaaaggacaacagcttaatttgaagctatcctgacctcctttggaggtcaattaaatagaatagagatagggtaattttatattatttaattttcacatatatcagttttggtggtttaaataacttctaatatatttgaaaaatgaatagcaaattaaataaagcattttctaataatacaaatttttccaaaagggaaattaatataatatatagatagatagatataatttgataggtctctctgaagtcaactgtatttcctactggatatgtgagaaaatgctcatatgaaaatttagcaccccttaatccctataatgctgtagaaaattcgaatatttaaaaatagaagattacttgctgtcgttgatcacatgggaatggaattcaacaattcaaatgttagtattcttacttttatactatgaaggctaaatagagtaggaaaatgcatatttatatccaagattattatgtctttatgatagcagtatatcttctatgtttcatttacacaggattatgtacctcttcatttttaatatttactgagccctatgtaagtgggcaccccatctgcagttttcctagaggtttctttctgttcctgggccaccaaaccggatttgtgttttcattatcagggttgataagatccttgggacatttcacaaatttccttatagggtatgtaaattatttcaacctgagtgtagctttgtgatcgaaggagtttatgacagaaaatagtaaaatgtaactattcaaaacagaaagggtcaaacttaactggaagcagtatccatggagatgatgggggagatgtgaagaagatagatgtgccttttacagtggaagaatgtgctacaagtgtcatgagtattcatctgtctagaacagagtagataatagttcccttcttcatttatgtcataccctacttgagtctgtctggaatgagaccctgtctggaatacaataaaccagagtgagactatgtgaatcacaacatacgatgactgattgaaggtgctagcatgttgagcctagagaagaaaagcttttcactattttctacaagaactttccgagctttcatataaaatgtactttaggttttccatgccattgcagagaagagtactagggtccatggatgaaagtgtagtgaggaagactaactcattgtgaggaagaactctctgtgattgattctggaattgtctgcctcaagaagtggtttgttctccatcactggaagtatctagacataggatatatttgtcaggaatattgcatagagagattttatcagagtagcttgacagactacgttctttttatccttgcatttcctttggaccttatgatagattttgttgttgtatctgagattgtttggtatagttttagagactggaattggtgtgccatgtgagaagataatagcaggcatatgagacttcacaaggaagttttgttgactaatgggaattaaggattatattccatgtcttcatagtgaaaggaatattactaatggtggatcctacatgctatgaaagtgtaccgcaaaattattctattaaattctcagtttcctttaaattaataattcttggaggataaataatggcaatgtgtacaggtaaccatcattatttaaaacaccttttgtgtgtgggcaacaaacatttaactaggtaaatatgaaaacactaaatgttgaccttaccaaaaattcagagaatcctatatcaatgaattaaaaatttctcaaaatactaaagatgtggcaataaaaaaagtcttgacattttcccattttcaatattaaattataatcaatttgttattatagggctaaagatttcagtacacatttctgggcatctgattttattttatttatgaaatgctactactatttaaattttctcagcttttttttggtttgtttacatttttgaatttgtttaactgacataagtatcattttgtttttctaactgtgaagtgtacagatagtcttgaacaagtgctatctactagaagattattaagaataatacattgcatcataatggttatggaatctctcttaggttgcttgtgtgtgtgaatgtatatatgtagctataaatgtgtgttaaatatgtattagacatattagacttatttctacatacatttaatattgaagacaaaggaaaacaatctcctaaatgcctgatactttcataatttattaaggaatgatttatttatgatataagaataatgtctgttgggccaataagtggcatatttatttaaaattatgtgtataatgtttatcatatgaaataataggtaatgaatgctttatgtactaaatacaatagtataaaatatattagcaagtttgatttagctgtagatttggctataacaatttttaaacaactcaaacaaatgtataaattcttaaaatgtgagtaaattttgaaggacagattctagttaatttataagttatgtgtctataattgactaagatgttcgtatttgaatcatgtgggtcttataccaattaaagagaaattttactttaaattgtaagattctttaaattcaaaataaatattcggtgcactgaacttgggctatgactagcatttcaccgacgaatgattggaaaaaaaatgattcatttatatttctctaggaatgcttatttttagtttttgttttgagacagattctcgccctgtagcccagcctggagtgcagtggcacaattttggctcattgcaacctcccccacccaggttcaagcgattctcatgtcttggcctcccatgaagctgggattacaggcatgcctcaaatagcccagctaatttttgtagacagggttttgccttgttccccaggctggtctcaaactcctggcctcaagtgatctgcctgccttggccttccaaagtgctgggattacaggcgtgagctactgggcccagctgactgcttaaaggactattattaaatgtttgagtggttctggaatcaacgtctttaatatgctgatatttgattattcatatgtccttttctgtttaacctcaaaggtttcactaacaaaatcaatatacagaaggtattactcagacatgaaaacacatttaatacttccttctttctatattacatctacatggcaacttgtggatattgaggctccaataaattggattgcttcggctcaaggtaaaccaccactttaagaattaatacctaaagaaaacaaaattgcttagatgttttgttgcttattaaaatgatttatatctcagtattagtttcagatccatacagtctttctttgaactctttttactagcatttttttcttgagccaagattacatgcattttttaaagttcatttttctgattttattcattggactttagctgggcttagtgtgccacaataaataatctccaagagtatttaaggctgttaagtatttcctaagactatttatgactttccatcgttggtattgtagttattttatacgtacatatgccagaaataacataaaaatgtatgccaataaatttcatgaatatctcacctttttttttcctcttaatatcaggatacaatttatctgctggtttgtgcttctaaacactaaaccaactatgtcacacaaagcttactttaaaaaaagaaagcagagggacagtatgatgtatttgtcattaaaagaaaaataggctgccaggaatctcggagcacatatactcagatgcaatgattgattatcatcttatcgcatatttttttttgtgctcccataatccctgtcctttatcttaatatctaacaccaattttcttgtcattttctttgtttttatttaatagtgtatatgtgatgaggcatctaaagtcaatattggcattatactgtaaggattctattaatttttataaaataatattcatttggcagtttaccttctgtgtgtgtgtgtgtgtgtgtgtgtgtgtgtttctatactagtattttagccatgggcacatgttcgtgctgtttttcccaactcttcgttggctaccatggaatctatttaactagtgtcttcttttaactgaagaatcccagtcgttctaggagaaagttgtatttttgaattctcttctttgatctgatataaccctcaagaagaaaatctgtagatacatgaatgcttattcttttaccaatgtcccctgtgcatctattcatgtaatatcccatgaaacaatatcaacatttggttttctagattattgccagcactgtgagatagttacagtatatcctgccttctctccaacactggtgtcttgcatttcatgcgcgtccctgtgaagagaccaccaaacaggatttgtgtgagcaacatggctgtttatttcacctgggggcaggtgggctgagtccgaaaagagagtcagcgaagggagataagggtggggccgttttacaggatttgggtaggtaaaggaaaattacagtcaaagggggcttgttctctggcgggcaggagtgggggttgcaagttgctcagtgggggtgctttttgagccaggatgagccaggaaaaggactttcacaaggtaatgtcatcacttaaggcaaggaccggccatttacacttcttttgtggtggaatatcatcagttaaggtggggcagggcatattcacttcttttgtgattcttcagttacttcaggccatctgggcgtatatgtgcaagtcacaggggttgcaatggcttggcttgggctcagaggcctgacattcccgccttcttatattaataagaaaaataaaacaaaataatgttaaagtgttggggtggtgaaaatttttagggggtggtatggagagagaatgggcgatgtttctcagggctgcttcaagcgggattaggggcggcgtgggaacctagagtgggagagattaagctgaagggaggtcttgtggtaaggggtgatattgtggggatgtaagaagaaacatttgtcgtatagaatgattggtgatggcctggatacggttttgtgcgaattgaaaaactaaatggaataacagaaggagaaaaacaggcataaaaggtttaagaattgggatgactcaggacatctgatgagagagtgcctaaggagattcagcatagtcctgccagcaaagattatttatttacttcaagagttaagagtggcagtttggggatagcaccaggagatatcagctgtgatggcttggagaaacagtgtaaaccggcagtgtaaacaagagcagggcatgtatgagtagttgagaacggtgaataggagtatgactagacagaagatagtagggatgacaagttttttgggggcacagtctaagttggtctggtgtcaaatgagactggggcctaataaaaaggagcatctgtacaggagcttaaatgggctgtaccctgtagcattccgaggacaggcctgaattctgagaaacgaaagtggtaaaagtattgtccagtcctttttaagttggtggctgagcttggtgaggtgtgtttttaaaagacctttagtccgttctacttttcttgaagacggaggaccttaagggatataaaggtttcactgaatactaagagcctgaaaaactgcttggctgatttgactaataaaggctggtctattatcagactgtattgaggtgggaaggctaaactgaggaattatgtctgacagaagggaagaaatgactgcggtggccttctcagaccctgtaggaaaggcctctacctatccagtgaaagtgtctacctagactaagaggtatttcagttatctgactcagggcatgttgagtaaagctaatttgccagtcctgggtggggcaaatcctcgagcttgatgtgtagggaagggagggggcctgaataatccctgaggagtagtagaatagcagatggaacactgagaagttatttccttgaggatagatttccacgatggaaaggaaatggaggttctgagaggcgggctagtggcttgtactatagcataacctgcctttgctggtgtgtggtgattaggcctggtggaaccgccatcaataaatcaagcgtgatcagggtgaggaacaggaaagaaggaaatttggggaaatggggtgaatgtcaggtggatcagagagatacagttatgggggtcaagtgtggtatcaggaataatgtgggaggctgaagtctgggccaggaacaacggtaattgtgggagactcaataaagagtgagtatagctgaaggagccgggaagcagaaagtatatgaatcaggtatgaggaagaaaatagattttggaagttatgagaactgtagagagtgagttgagcatagtttgtgattttgagggcctctaaaagtattaaagcagcggcagccgctgcatgcagacatgagggctaggctaaaacagtaaggtcaagttgtttggacagaaaggctacagggtgcggtcctggctcttgtgtaagaattctgaccgcactaaccatgcctaggaaggaaaggagttgttgttttatagaaggtgtttgggtttgagagatcggtcggacaagattggcagggagagcacgtgtgtttttatgagaattatgccgagataggtaacagatgaggaagaaatttgggcttgattgaagtaatgggggctgtctgtgaagctttgcagcagtacagcctaggtaatttgtggagcttgatgggtgtcagggtcagtccaagtgaaagcgaagagaggctgggattaaggggcaaaggaatagtaaagaaagcatgtttgagatatagaacagaataatggatagtagaggcaggtattgaggataggagagtatatgggtttggcaccacggggtggataggcaaaacaattttgttgataaggcgcagatcctgagctaacttgtaaggctcgtctggttttaggacaggtaaaatgggggaattgtaaggagagtttataggctttgaaaggccatgctgtagcaggcgagtgataacaggctttaatctttttaaagcgtgctgagggatgggatattggcattgagtggggtaagggtgattaggttttaatgagatggtaaggggtgcatgatcggtcgccaaggagggagtagaggtatcttatacttgtgggttaaggtggggggatacaagaggaggacgcaaaggaggctttggattgggaagaagggaggcaatgagatacagctgtagtccaggaatagtcagggaagcagataatttagttaaagtgtctcagcctaataagggaactgggcaggtggggataactaaaaaggagtgcttaaaagagtattgtctaagttggcaccagagttggggagttgtaagaggtttagaagcctggccgtcaatacccacaacagttatggaggcaagggaaacaggcccttgaaaagaaggtaatgtggagtgggtgcctccatattgattaagaaggggacgggcttaccttccactgtgagagttacctgaagcttggcgtccgtgatggtctagggggcttccgaggcgatcgggcggtgttagttttcagccgctaagccgagaagatctgggaaggagtcagacagccttgcgccagagttccaggggctctgagagtggctcccaggtgagttgaacagtccgattttcagtggggtcctacacagatgggacacggcttaggaggaattccgggctgcgggcattccttggcccggtggccagatttccggcaagtgtagcaagctccttggggaggaggttctggaggaacgcctggccgctgcggttcaggcgtttggaagttcttgtgtgctggagatgtggctggggtttgtctcacagtggaggcaaggaattgcaacttttttctattattgtacaccttgaaggcgaggttaattaaatcctgttgtggggtttgagggccggaatttaattgttggagttttatttaatgttgggagcagattgggtaataaaatgtatattgagaataagatggccttttgaccttttagggtctagggctgtaaagtgtctcggttgctggcaaacaagtcatgaactgggctggatttttatatttgatgaaaaagagcctaaacgctatctgatttgggataaagaaaaaggagcattaaccttgactatgcctttagctccagccacctttttaagagtaaattgttgggcaggagggggagggctagtcatggaaggaaactgtaagccggaccaggtgtgaggaggggaggtgataaaaagattatagggtggaggagcggaggctgaggaagaattgggacctagctcggcctggcgaggagcagcctggggaggaagggagaggtcagatgggtctgtagaaaaggaagattagaaagactcagcgaggcttggggttggtactgaggggacaggcaggagggaaagaaggaagatttgggacgagttgcactgggcacagagactaggaagggactgatgtgtaaaagaatgcctggacgtcaggcacctcagaccgtttgcctattttatgacaagaattatttagatcttgcaggatggaaaaattcaaagtgccattttctggctatttggaactactgtggagtttgtattggggtcaagtggcattgcagaagaaaataaggcatttaggttttaggtcaggtgtgagttgaattggttttaagtttttgagaacacaggccaagggagtagaaggaggaatggagggtggaaggttgcccatagtgaaggaaggaagcctagagaaaagagagagtagagaaacggagggaaggggtttgggggttcttaccttccagaaaagtgggaaaaggggttggggcacagagataagaggtcgggacgtggaaataagtgattggggcacagagatacgaggttggggtacttgcctctcctctagaaaagcgggacttgccgctaagagtgaaggagaaggggttggagtacttgccctgtgcccggaaaagctgagaaggggtagagacaaggagagaaggggttggggtacttgccccttccccagaaaagcaggacttgccgctaagggtgaaggaccaaggcaggcgtccctgcgtggtatgacacctttgaaacgtgggttgaataatcagagaggcgtccctgcaatgattaaacaccaagggaaggctgcctttccagtctgtgaccggcaccagagttttgggtccacagataaaatgtatctcctttgtctctcccagaaaatggaaggaattgaaattaagagatgggagagattgaagagtggaaaggagaaagtggttgagggacagtgagagagattggagaagagagtcagaagaggccgcttaactgatttaaaattggtgagatgttccttgggctggtcagtctgaggacctgaggtcataggtggatctttctcacggagcaaagaacaggaggacaggggattgatctcccaagggaggtcccccgatccgagtcatggcaccaaaattcatgcgcgtctgtgtgaagagaccaccaaacaggctttgtgtgagcgacacatctgcttatttcacctgggtgcaggcaggctgagtccgtaaagagagtcagtgaagggagataagggtggggccgttttataggatttgggtaggtaaacgaaaattacagtcaaagggggtttgttctctggcgggcaggagtgggggtcacaaggtgctcagtgggggtgcttttggcgccaggatgagccaggaaaaggactttcacaaggtaatgtcatcacttaaggcaaggactggccatttacacttcttttgtggtggaatgtcatcagttaaggtggggcagggcatattcacttcttttgtgattcttcagttactttaggccatctgggagtataggtgcaagtcacaggggttgcaatggcttggcttgggctcagaggcctgacatttcgtactatggatataatgtaaaaagggggcgtttgtcttctctttttaaatatccgtacagaagtctctgctgcaacataataaatgacaaatgccagaatatatcctaaaaatttagcacatgtggacagtgggtttacttagatgtttatttttgcccttacatatttttggaggattgatacatttttggtatcacttttggtatttaaacaaataggtaaatattttctcaaaaagtgaagacttttttttcagacaaatctatgagaaattattggcttaacaaatcacaagttttgtcacgtatgccatatttgtttgtttgtttgtgaaaggattttgggtattaggcaactgtagcagacatcatgtatctggactttagcgagtcatgatcactcatcatctagtaaaaatatttaatatttatataaggcttattatgtgctagatactcttcaaattatttcacatctcttaactcatttgatcttgttaacagtgctacaaagtagatgatttgatttttgcccttgtattgatgagtaaaattagtctagcaagtagcagatgggtaatttgagtcccagactctcttgccctagaattagttttataatcacaatgtcgtgctgctaaacaattgagatgcatcattcctgacaatctttgccttcacccttcaagtaccatatcagcatataaaagtgaaggatgatgccttccagtgaaggttcaaggcttttgcctgaagtttatattatttgtttgaaatctttttcagccatggagatattgaaggagattttattaaactttcatgttgtatacagctgaaagagtgttttaaaaagtgatatgtaaaatgacagttttggtattcaaaaggagcaatggtggaaatccaacaataaatatggcagggataaatgtaaggtgctacccttgaatccaataacccatgaaacaagtagagcataggagagagctgatttaggaacaagccatgggaagaggtctaagggattatgatacagactagccccatcgtggtgtggttccccaaataacaaattctatcttaggtaggctgcatttctatgttgtaatttatttattgaataatcttaccttggttagtgcgtaattctaaactttttccaattaacatttttagctctgctattgttaatcatttcccatgctttaatgtcactgtgaacacatttttaattttttctaatgttttgttactaaaatcagtataaaactcttatctcatattttttgtttgtttgttttgagacagagtctccctctgtagcccaggctggagtgcagtggcactgatttcggctcactgcaacctctgcttcccgggttcaagcgattctcatgcctcaagctctggagtagctgggactacagggttacgtcaccatgccctgtctaatttttgtatttttagtagagacggggtttcactatgttggccaggatgatctcgaactcctgacctcaagtgatcaggccacctcaacttcccaaagtgctgggattacaggcctgagcctccacacctggctttatcccatatttgatttaaattgtatgttcttacctcttcttggtacccaaattgagaccctaacaaattggagtggcaaagaactaccacaaggtctgactctgagataaatgtctcttctttctctttgatatatagttgctccagtatgttaggtcagagaagagagagcagaaagtgttaagtgtatctttattcaacatttactaatactatcatttatttgctttctctgctttgcagacttctgtgtggctctcctatgaggctcattcatggattctttagaggacctattgtaaagttctctgatatgggagattcaatctgaatccaagctagctagcctccattagagtgaaccccaagctgtacacactgttggaacttgtttttgaggtctccttagttactatccagtggctctagctccactacattttgtatatttacttgactcatggagaacttacatagagttacttctaagtctacagcctgttctattgcaacaccttgcatagattggtggaccacttgggtgaaatgcagagaatatcatgcaaagaatatctgctctgcatgaatgattaacagcagaagttctcaagttttacctgataaccttcgaagtaacaccaattccttgatttgctcctgcaccatccctttttggattctgtccaacagatctgctataaagcctgatgattttgtttgtttaaagcacttcagctagtcagcaagggttcagaaacactaaattagattaccttactcagaatcctatgattctatgtatttttatcctctttaaaagtacttttataactgtgatattactttaatattttaaaacaaccataaataagattgcagatagtaatgcattgggtttgcaaaaataactttagataaaatatattccagtttgtatttatgtgataatacattacctcaagacctcaaaaatagatttgctttgtttatatggtttccttctataagtgaaaaaaactagtccaatgaaataaagggttaagaccccttagaggaaaaggaagataaaattatcttcagaaatggctatggtaacacctcccaaggcaaactattggcagaccttctaagggcagattgtgtgcatctatgtaagtgaaaaacagctgaagggtgtcaagtgctctgagtcacactagagtccctttagatttatttcccaaaccaagtagtagttgccttttccaccagcccacacagttctattattttcctatctttgctttatgaatagctggctcttacagtacttaacttcttatcttagtccacttgggctgctagaacaaaatatcataaactcgatagcttataaacaacagaaatttatttttcacagttttggatgctgagaagtccaaaatcacagtgcttgcagattccaaatctggtgagggcttgtcctttggttcacagacagtaccttctagctgtgtctgctcatgttggaagaagcaagctaacattctgagttctcttttataaaaggactaattccagtgatgagggctctgcccttgtgacctaataaccttccaaaggccccacctcctaataccatcaccttatgggttagaatttcaaagcagaaatttggggtggaggaggatcaaaaattcaaatattctgaacccttgctgactagctgaagtgctttaaacaaataaacaaaaacaaacatatcacttatgttgaaaactagtcaaataataaggcatttctaacataagacctcatgatcaagtaaacttacatgaaatgaccagtgcaaagacatgcttgggtaaagcttttctgtagagtagtagtattgatttttattttatgtatgtatgtatgtatgtatgtatgtatgtatgtatgtatgtatgtattttgagacagtctcactctgtcacccaggctgcctaggctggagtgcagtggtaccatctcggctcactgcaacctctacctctcgggttcaagtgattctcctgtctcagcctcctgaatagccgggactataggtacatgccaccatgcccatctaacttttagtagagatggggtttcactatcttggccaggctggtcttgaactcctaacctcaagtgatcctcctacttcggcctcccaaagtgctggaattacaggcatgagccaccatacccagcccgagtagtattgatttttaaagtaaattttttcatcacatccctaccaaattatatacaaattaagtaactagcccagttaggaaaatagtacacaagtactaaatccatattaagatcaacatctaaaaaaataaacatttacataaatggaagagacattttttactacatttatttgattttaataatttaattttatggaatttatgaaaattttatttttaggaattcatgaaaaattccaaaaatttcaattattaaaatcaaataaatgaggtaaaaattatgtaagatatatttgggtaaaaagcataaacacatttaaatattttattaaaacattttaattaacaggaacatgttttaaaggaactaatacataaaaatcaatttcaatctcattattcctcacaatcacttccagtattctggagcctcaggttttcatccttgatatttatttataaagattattatagtcatattgctcatgtaatagataatccctctccacaactaatattttattatgatattttctacattattacctatttctcataaatataactagaaattatcgtgcaatattttattgggtaacatgatttagttagctatttctcccataattatacattatatatggcttactcttgggttttgctcctacatataggactgctttagatctccatgtcactaaggttttaccatatttggattatttccttaggataatttttcagaagtgggattattaaagagactcaacatttttaagtttttgttttgtaatgcaaagttgatttccataacttacagtgctgccagcaagatagggaaacatccagtacacagccttactttttccttgaatttggagctcatcttttatagtttgtataaaatatgatagttgaaaataatatttcatggtcagatccatgtgaaatacaaattattgtattagtggagatgagttgaaaatttttttccatgtgtgggaaatacatttgcctttctcctctaaaatatgtctttttggaaaataggaacttcagtattttgtgatcatttgtatacactcttcatataataataactctgtcataactgcaaaaatattcatatttattcttaattttactaattatactcaagtttttacttgtaatataatcaaatatgtctatcttttcttactgatatatatatatatatatatatatatatatatataacacttaagccaaattcatttatatttcagaacagtcaggaatctctagaagcttcattaactctttcctaccattatatttaatttttaagtcatggctttagagcaccagaggttagtatgagtaatttagtcagtgagaaaagttggctccttctggaaaagcacctttatcaaagcaattccatcaaagctggctttgaatttcagagaaagcaattagattaaaagaaaattaggatcttggctcacagtaagagcatgtaaaacataattcatcttgattcagcgttttaatattctatcatgggtatcaaatatgtcagatatgaaaagtaatttcagctttgttttcaactttgctaagtttggtcactgttccttagaagcaaaagtttagctctgatcatgttggaaaataaagtagttttagtcattaaaaacaaaaattttatcaataatagtgtgatattataataatgtcatattttcatcttctggtgtacctatcttgtgcctgatgtataataggtgcagaatttataatagtagaatgaatagatgaatttcctgaagtagaatgcagtgaggcattaagcatgtcctcataatgcctttaggattgccaaaagtcttgcttaggggttgaaaaagaagtagaaatcaaatgataagacctcgaaggaacagagaaatccaactcaatgaacagtaaaaatcaatgaaggcaaaaaaggtccatttttatctcattcatcttcagagatagaccagtgtaagttcattgatttacagtgctcattgagttgtattctcctgttctttgttgtgctccattctctgttttttcagcttcactttgtgttttattttaaattgtatttgttatgaggtgggctttgatggcatagttttagcacaatgagactattttttttcacttgatttttctactcatatgatatcatcacttttcaatattcttaatggtacttttctgaataacctcctttaaatctctctctttctttatgttgatctgtgtcaatcaagtttttatgtgtaaaagtgtgttaataaatttaaatttaaaaataaattttaatttaatttaatttttaaatatttattttaataaatttaaataaatttaatttttaaataagtttaaataaatattcaaataaaataaaaataaaataatatttaaataaatttaaattaaaataaatttaatttaaatttattatagtgaccatacaaaacaaatagttgtttctattcagttcactcataaagaaatgttatttaacaaatatattcagcacctttcaatgcaatgcacttttgcagttgtcaagcaccataattcacttaggttctgccccaggcctttaattataagttcttatttatgggaattagagagtagaacttgaactgaagagactagcctgaccgtggagctgacaaagaaagaatgtacattggttctgagtacagtgcccacagataattggagaatacgtgtttgaatcagactgatgaattctgggtggaacatgaaagccggtaattctaaatattagtgatattaattaaatcatcataatttgtctagaatcacgctcaatttagaaaggattcatctaagggaatgaagacagaatagctgaagccaatattttgaaagataaaacagagtaagaaaaattatttgaccactaggcatttacatttttttatagtatataaatcacttacaacatgcagatacacgcatacaatagaatttcaatgaggtacaatcacttcccacattttaatgaatgtgctcagggtagaagtaataaattattttaatatatagaatttgataaactcataatagaagtagaagcaaatcctttgagtgctacaaagaaaggaaacccatttcaccaatgatatgcatgagtgcttcattgtggagttcatctttggtttcaggcttaaattatgacacattgacaatttggaacattcagattaagaaaacattgagcaataattcaggaaaattaggcagaagggtatgttcacaaaataatcctgtattgtccaaatatcaaaagagcctaagtattcatctcaaattgagcctagaaaattagactttgggagggtcacaagataagatgtttgtaatatagccagataagcactaaaacaaatccaggattaggctgtcttgtgatttggctttctccactgtaaaccatgtttttctatgaatgtgagactctgctggcattgttgaatcactacatagtcatccattcattcatcatttaatttattatccattcaggattgcaaaaagccaaggatgtataagtgtaaaagacaggtaaagcagtgtcatggcatacatcattgtggaaagctaccattatatacttggctattgaacacagatgccctaacagtgaaagttttaataaaaataatattatgccacataaatgttctttatagtatatatggaaatgttctctattattaatgtcaacattgcctttctgtcatgctttggttagcaaatttagcaagggtaaatctgtttagatttttttttttttttttagacagagtctcacttggtcacacaggctggagtgcagtggcacgatcttggctcactgtaacctctgcctcctaagttcaagcaattctcctgcctcagcctcctgagtagctgggattacaggcatgccactgcaccctgctgatttttgtattcttagtagagatggggtttcaccatgttggccatgactggccaggctggtcttgaactcctgacctcaggtgatccacccactttggcctctcaaattgctgggaatacaggggtgagccaaggtgcccggccctctttaggtttttaatgtaagttttttatgaagttttctgtgctattttaagcatgaaagtgagactaatacatataataacaatttgtgagaacttgtatttggaagtacttaataatagtttgtgaattgttacctgcccgttcatgagtagatagcaaatatatatgatacatgtatatataatatatgtttaccatatatatatatttaccatatatatatatttaccatatatatttttttaccatatatatatatttaccatatatatatatgtatgtttctatatatgatacatagagatagactgacaggtgtgtgtgtgtgtgtgtgtgtgcatacacttatgcatttgttagtctatgtatccatgtaacttatgtatgattttctacttatgaatatgtggcatttgtgtgggtgtgtgtgtgggggtgtatacatgcattaaatcatgtcctctaaagagcaaataccatgtcagaatttatcatgcaagagatttattgggaaaatgcctgtgaaagaagaaggagagggaaataaaggaggcaggaagaaccatcaaacattgaagcagttctgatccctgggaaaggaggggagagaaggaaggagagttggactgacagaatcttggatgaagcatagtttttaaaatattttggccaggccaacagggagtcattgtgccaaagttgcctgtcagaggagtattacatcttttagaaatggacctgtcttgctaatgctatcttgctcagtcattagcagagaatgggttcatacagagtatggcctcacgtatgtatattcacatatgtatatgtattcatatacatatatgcatacataagtatcaaaaaccgatgtatatttattgcaccaaatgatttttaatgtacatgttgaaacatattcgttgtgttactcttatgcatataaagttatttgtaaagacatggatttctttcatttatgttttaaaatttccatgtactatattagaggacataaaaagatgcgtaatattacctaggagtgcacattgttgaagagagttacctagtgtttgtgaaaggcttttatcatccagaaattaaattttacggcttaccttttaattttcctctcaaatattgattgattttttttacaagtagaaaacatttaagctatgtttgagattttttaaatataatgtataacttaataaagctaaattatactgtccttaaaaacttaagaccactgactgtttctttcttactgaaatcaaaatagtgattatggctcaaagacaatattacaaaactgaatatgattgcaaatatgtgtgcactaaaccacagcatgcacactttggccacagccaaaacataattagatttctccaaaaatgcctcttagtgtttaaataaacagtactatgtcataatagtacatgacatatagataatttacttttttagagaaatataaataataatgacacattgttttctctgctattacttacaaaatttgagtgtctaagtcataaatgtgtttttctttcccacattaaaacaatgacaaaataattagatttgtatgttttttccacttattggacacctggcttcaaattctattaattattcattacctgatcagcaaagaatacagagaaaagtacttaactatatgaaaatgagcattatgcataaggataaatttggctagtatcttacaagtttccttatataaattttttcaactttaaaaatcttgtgattctccatataaatacagttttattgatcaaatgaagcataaatataactaaaattaatacatttattaacctctgaaaaatgttaggtgaatgctatgtatatacaaacacagtggttgctatatggcatggaacattcccatcaaatctgcatccctggtggctcacgcctgtaatcccagcactttgggaggccgagatcggcagatcacgaggtcaggagatccagaccatcctggctaacacggtgaaaccccgcctctaccaaaaatacaaaatattagccgggcgtgttggcaggcgcctgtagtcccagctattctggaggctgaggcaggagaatggcgcgaacccaggaggcagagcttgcattgagccgagatcgcaccactgcactccagcctgggggacagagcgagactccgtctcaaaagaaaaaaagaaaaatctgcacccctgcaatgtctctggattactttccgattattcacatattatgttgtcccaaaaactcagataaaaccaaactagagtatttaaaaaaaattatttctaagaggttgattttaaactgttttcctacttggttaagattctactgtatgtctagctgtaaatgttttacaacttcatgattatggaatgaaaattagtgctacttttatatagcaccgctgtaaatttctattcattaaaactactttaaaatagaaaaatcctaatagagcccatatctttgaaaggcactagaatttatgtgaaataaaaaggatacttctaattttatttatttttcatttggagtaatgttttaatgcatctattgagcaagtattttttgaggtttgtggccaaaatactactcagttactaagtgccgggtggacaacagagacatttccgtgttcttgtgaaacttatattccaggattcttatattcagagaaaatcttattttctaatactctgtataccccaaacgacccaccagagtatcaattatgtgaattacaactgggaagaatgtgagaaggagaagtacaccatcaggagaggatataacgtgaacctagtgttgggcctggggagaggtccttgaggaagtggtactggagcagatgtcagaagaatgaggtgtgagcgagagggaaaccgcacaggaagagcgttctggtgagcaggaatagaaacatggaagaatgctctgaaatggagaggagcatgtgctcaaggaaatgagggagaccattgtgtctaggtagggtttggaaagcagtaccggagtggtgggcagtgaggcacgagagaggggaagagtttctaaatgcatcctcatgtaactcaagaatacacctgagatgaattttgttatgcttgtggaggggcagtgcctaataaagtttaggtcacactttgatactagaatgcaatagtaaattgtatgatcttattgctgcctgcgatttgattgattaattacagtgatttttctcttttacaaaagacaaactgctgccacttgttgcattttttaaatgagcagtttgcaaagattgtatcttttatgtaggttgcttatttcatatatttggaaacgggttatatcagttggtggacgatatgtcaaaaatttagaactttctcccatctttccaagttgctaaattatatttcagtgaaaagctttctctctaaagtgctaaaggtatttctcaatggaagcaataaaatgaacttttttggcagctttcccagaaaaaaaaaaatccctctagcatttttggaaatgagtaggggaaaattataaataatgtaaaataaactcacataagaggcttatatgaactattatacaatatatattaggaactaaattttcttccattattcctttaggatcttgtggctctagtagaatgggaaaatgcactcccatgagaaatttgacaataacagccaattctgcacggaaaaaaatattgaatggtttatatataagtttaaaatctattttaaaagtaagacttgatacgtgagagactagtcaagtttggtgattaggaagtctctttttctactaaattcaaacctacagtgttggtgttcactgaatacactaggtagtgtagaggatgcagaactcaggggaaaaggtctcaataccaacctacataatgaaaaagaaaagatatgtgtgaggtgtggctttaaaacaaaagatctaatctaaaaagatctaatctatgtatcacttttgggatctatatgatatgacagttatgccttatgtttggaataataagcaatatgtaaattacagcaatatacaagctactgtatattagtagggaacacaggttccatttctccttacttcttcctggcatgctatgataacaacttaactatgttatgataacaactactagtcatcctgcttcctgtatccctttcttgtgtaccttagacacacgtgcatttttcttcttaaataacaggtatgttatgaaatatttgtgcctaaaattcttaaatatttatctttctctttacacacactctcacacacatttatttatatgtgtatgtgtatatttctgtctccaacttatcttctaggcttattttcgacattccttacaactggcatgagcttcttgttatagtttctagatattctaggttttcttaccttgaggtcacttttttggtcactttattttttctgtttgtaattttttgttctctatttttactatcctctatcacctcagtttttgactgttctttaaaaccaagttcaattggcttaaactctgtgccttttccttacccatatgaaaaatcactgtcttctcatcaaagaattcctgtgatacattagttatgctgtttttatagcacttttcacattttccattgaattatttatgtttatgtgttagattgtaaggaacttgaaggcaaagtttatctctgagtcatttggcttagtaccttgcatagtaattatacagagtaaatatgtatagaatgaatgaataaatatatgagaagaaaaatatatttcttttatgcgcatcgaaagatgtaggcttcatctacatacacaagtcggacttaagtatttagctgacttgattaagggatgtctcatcctgaggaagggtataatttagcaataacttactcattataatttatttaaagttgcattccacaagtaattgtacagcatcacctatgggacaggaacattatatgtgtagcttgtgaattcaagattgataacaatcttcagctgagaccttttttttaaaaatgtggcatttgcctccaagagaaaaggcacgaaagcatcacaagcagagaacaaagagaaagtgtcttcagaatgtaattgtgatgaatctatgcctgtctgtttgcaaggatttgtgtagcactcttgcaccttcccccttaaagaaatttctctactacaaattttcagtgctttgaaatgaaaaataatttctgccattgtaaatttttttgcaaataatttcagcacctagaataagtgaagttatttttcagtaagagtttatgacataaagggaagtgattaaatcagtcatgaattgtgcatttagaatagcatgaaggacttttctttcaacacaactgatacgtttgaactatgctgaaaagttctcctggctgaaaaatggtcatgtcttttttattctaaaataagaatgaaatgttttgtaccttaaattttctttgattttattccaaaaataaatagggaagctaaattttgcaaaaataattagtctctatgataggcacggtgagaacaaaaagagactgtgaatcagatgatcctagttctaggcctgggttcagccacttaattaagtctgtgaccttggcgatttcatataaatatttaagtctgtgacctttgtcatttcatataaatattttcatcctcaggaaccttatctgcacaatttagggattagtctttaatggtaaattttaaactgcttttaggagtcacagtggcacatggagtcccttgagaagcaacctcacaaggggtggcctagggtgccaggctccaccattttttgtgtttgttttgtattctgtttcatttgtttgttaaaattccctttataataggttcgtgacaggaacaaacaacaaatttaaaattctagattaaatcacttctgggtttcatatagcaatcttaatttttacttgtttatggaacatgggtagtagcagataaagataattgtcatttttcttattgctctattcactcacccaacatttattaagaagttgctacatgtaaaaactgctgtgtccagtgttttggaaatttaaaggtgtcagagttcaaaatctattcggaaaatatctaagaaaaaaagtccatgtgataagggttacggcagaaatataaataaaatgtccttaaagaatgtaggtagagacttcattcttccatgctctgagcaggtaatgatcccacaacaggagatgaatgcaagttggtttaagtcctatggtctcaaacttggttttagaactgaagcactttttatttcagtatcattattttttaagcaaatgcctgatgaaaagttatctttgaaacattttgtatttaaaaaattgtcatcatgcatacattacttaatttaatacagtacactatttttaactcatagcaaaagaggtaaaacagtaacttaaaatttataggttgtaagaagtatgaagatcattgtgatgcaagtataaaaatggaaacgtgttttaaataaatcaatattcaaatatgtaagtcatataattgttataaataatttaatatacaaatacatatgccaaagtccacatgatatatccactaagaccttaacatcctgaagtgtattatatactagcgtaacataattaatatagtgaaaaatgtctggcaatatgcaaaccatccataaccactttgtttgcaatctaccttcaatatttagttggacaactttggagtgaaaagtactactgcatgagtaaagaaatacaaacgtcttattatgttgctttccagagtcttaggtttcagttgattacctatgtcaattagtatattctctcctttcctttctattacctttctttaaactttgagttttctgtgcctaaaaatgtgtatacatacatcttgtctacccaaaattttattctgttgtaattgaaatatgtatttacttgtgatggctaatttcatgtatcaagcctggctatgtcaagatacccaagtgtttaataaagcatttctctagatgtttctgtgaaggtatagatgagattagcatttataagtagacttacagtaaagcagatgaccctctatagtatgggtgagtctcatccagtcagttggaggttttagtagaagaaatctgacctccatggaagaagagagaattctgccagcagcctgcctttggattcaaactgtcactctttcctgggtctccagcctgctggcctgccctgcactctggacttccagcctccgcaactgcatgagcccattccttaaaataaatctcactatatatatatatatatatatacacacacaactttttggttctgtttctctggagaactctgactaatatatgcttcagggcccagaaagtgctgaccatcttataataatttgaacaaacaaataaacaaaaatagcccaaaccagaaaagtcactcaatgtatatgtgatgtgatacagtgacacagatattgagaaggcaaatactgtgtgatcgagataatggggtcagcagatattcttccagagacaagaagcactggtgtaaacaagtatgctagttaaatactcattagttaaatttacagagggaattcagtgaaccctacaatgcttcagttcttcagaaagattatccagcctctctttacttctcccttccgaaatttcatgtacacgattctagatatttgaataaatgttccacacagaactttgggtgatgaaataaaacctatccatctgtaatggaagggaactgactcttacaattgttatttctgatactgatagaatttttgtctcaaataatttttacacttactgctgttgttttcctttctgtcttgctcacacttttagtgtaaatatagttataacatatagaactgttagaattgtggcattaggttgtagatttgtgatcttcctatatttttgatgaaggcatttaactcaggactcattttgaaagtctaaactctttgaattggaaatatatctcctgaaagttttttactggatttagtaaaattgagcatttacctcactgtttttctttttcaaaagacatataatatttaaaaacagtagagaataatgtgggggaaaatgcaatctaattaggtttattgttattactattttgacatttttagatctctttagaaaaaaattacataaaagacatttgaagcttcatatatataacgctaacctattttcctcccttcttcctcatatgtatctattttaccacatatttatttttccataaatttctgtctattgttttaatttttaaagttttatataaatagtatataaatcatatatttatataactttctttcttatatgtgttttttaactgagtaatgaaagaataagtgtttaaagtaaaatattttatcaggtatacttatgaaacatcaagtatacccattaaacttgtcaacttttatcgtaggaatgttacatggtaagtccttagttaacatcattgataggttcttggaaactgtgacattaagcaaaaggacatacagcaggtccttgaataacatcattttgctcaacatcattttcttataatgttgagaaaaagcatggtatttttatacgttgttttgcttaagtcacagtttctaagaacctattgacaatgttaactgaggacgtgttgtgtttgccatttttttctagccaaaaactctaagaaacttgaaatgacaaacccttcaatatgctttctcgatatctttctcataagaactcagataatttcagtatagataataatatagctactttctgtataattgtggattttatatgagaattgctaataaaatgcctttttttaataaataaaacctaaacttaccctaattatactttcattttcttcctgatctcttaaatcatcgtggattacagggttttgttgttgttgttgtttaaatctggcatatggttacaaatatagcctgtgtgctaataatcatttcatcttttttaatatattagaagacatttacacagtggttcttttccaaggagagcattttctgctcagttagcaggaaatgcataagtagttttcctaagtgagatcttcatcagcctagaagtgtctactgcaactttctgggcttttaaaatcataccaccaattattcctgagatgttgtattacgtctttgacagctgacatttttttgtgtcacagctatttctatacaaatagaatgcatggagcattacaagatatttaaaattgttatgtattcaaatagtaataggtattgttttgaaatgtacttctttaattcacaatatacttcctttagggcacctggccagggatttaaaaacccaaagcaaacatgtttttgtttctttctagaaagatcaataaatagcattatacaattacaacttactattctcacatcgctaaaatagaagtgtgcttatggctgatgtcaaagactgtagttgcctacgcatcacagtctcccaaggagaaagcttaacctttaattgtatgctactcaagcaggattgctgactatccttatctattgaggggaaataagtaaatagtaggagagaattaactgcctttcattctttgctatcacttaaacatatggtataaacaggatttttttttgtggctgttgatttttttccagtggctctttgctggaagcaaaaatatattttgccttgaaaataaagttagtgttctcaatttgtgataaaggtcactatttaaaaatattttttgttgtttttgttttctgacaactcaagcagaattgattaaggataaaaaaatggcttgctatttatggagatgatttcctatagtttgtaatttaatggactccctaaccaaaacacattcctaaaatagttttatgagttaaaatgttaagtgatcggtttaaaaaaaaagtaaattcctttctataagacacttctgaatcaatatcattgtattactgaaatattaaaaacaagcaagaaaaccaatgagacttgttatacaggtacatgtggctactcaactatattgtgatgtcagagaaagctcccttttctatggagggccatgtgaccagaagaaataggtgctttcttactatgaaagacacaattgtcccttattctaatttgcgtagatatttatttcaatttccacaaaagtcctgtttacataagagacagaaataaatgtataacattataaagtaaaccattgaataatatataaaaacagcttgaagttttatattatgactatcactgtgaaatgctatcattacatgctttttgatggcatgatgcttttaaattgaaggttaaaagtcctaaaatatgtaactagttagtgtaaaatttttatttaaaactgatggagattcagttttttaatttctgtttcagaaattatcatcagtctaggaggtgtaaattatcctctcaaaggaaggattttgctcttatctattgggaattttctttaaggcctcttgcctgtaaaatcacttgtatctaatatgtgccattaattataaaaccactcctcctataggtctaccatcacagagttttgactaacattttttgaaccaccatatttattatgataacaatttaactaaattaggccctgcttttcatcattcagacaacttttgggaaaacatttaaaaaataaactcaaaactccactgtctctgagaagtttaaaaacagtgagcctcaattcttatgtcagtgaagtcaagagtttcagataaatctgtatattcaatcctgaggtatcaaatccagttcactgaaattgtcaacagtgatttacaaaaataaactgaagggcactgtttattcacttctgtactgatgttctatcttcttacggtgttttctcacagcttttttttgtgtagagaatcttgtattaaaaggtcaagaatattgggatttaagcctactgctgctactattttaataggtatttaactcccaattgcctatatttcttgtgtggtagtaagtgggatactgaagttagattcattgatgtctatggactttgctgtcaccattccctatcttgagaatcttatcttcccatctctctgcttccttttttcccttttcttttaaacatttttttttattcatttgctctttttctctacttctcttccattgaaatgactatattttccctcccttttaatatgctaagtcactttcagagactcaatcctaccctattcttctcaaacattcttaaaatacccttttctaaattgtagagcatgtaattttcctctcatttccaatattccttcctattctatcatgtatgttataatctgtgatgagtaaattaagaatcaagtgtgtcacagcaaaaaccaaaagaatgagaaagatagtggaaatagcacagctctggttaaaactgctttcatcttgccctttctcttagtaaaaactcaaccccacagtattctaacaggatttttactaccgttcttttcctgtcctaaccccaattcaaataaagacttcacaccatctcagttcagttaaaagaaatactgttctctttaatgttagaaataaagctctagtcttccataccagaaggattttgagtaggtatattaactttttgctctacccactttagagtagactggaagtattaggccaatatatgttaattattttcttctgatggcaaaataatataacgcctgctaatatttcgagtgagttttaagactttcaaaaatccttaaaaaaaggtaatacatgacttcagttcaactccataaaatagcatatcccagcatttagagaatcaaagacaaaaaagacaagttcattaatctcaagcagcttacagtctattagtggagctagaaatataagcacataaatgttaaaaagaataattaagaaaggatttataaaagatagcaattatacagaaaaatgtctaattctcataagatagtatgagaggtttggctctgtgtccccacccaaatctcgtgttgaattgttattcccgatgttaggggaaggacctggtgggaggtgattggatcacgggggcagatttcccccttggtgttcttgtgacagtgaataagttctcaggagatctggttgtttaaaagtgtgtagcgtttccctcttcactctctctctcttgctctgccatgtgaagatgtgccagcttccccttcgccttccaccataactgaaagtttcctgaggccacccagccatgcttcctgtatagcctgtggaactctgagtcaattaaatctcttcataaattactcagtttcaggtatgtgtttatagcagtgtgagaatagactaatacagatatcaaagcaagtgattcataaaagttgagattcctgggccgagttttaaaagataactaggaatatctcacaggcaaaaaatagagagtgagattaaaaaaaaaaattcaggcagagagaacaagtacagactcaagaaaatgttatgtaattaacattcataattgaattcattagacactatttggaaatgggcttacatatatgacaaaactgaaaaatggcagatttctgatatgaattatttcaccggattgcttaatttgctttttattgatattatggaactcattacaaattatttatatagagctataattcacaattatataccagtagcaataaaaaactagtagaattgtagatgatgttggcactttctttgtagtttgctcaaaattttcattgaagaagaggttacattcctctaattgtatttttccttttaatattgtgcaattaaatgtttatttgcagttcataaagcaacatcatctcatttgtttgaaaatcctgcttgacatgttcttgtatttagtcttgctattaaattaggggccattagaataaatgagattgtgagatgttaatacagaggtcagttcaattttctacccatttccaccaatgtgaaaagcatctaacatgtttgcataaatcctgacttatagatgtggtaataaacaaacaaaattgtaaatttcatttatttacaactactggggagtagaaaacataaagaaaataatgatcatatacaggcagaagctgagagtctcacagccccctttttatatttaataataatatacatattttaaattgacatataataattgcacatatttggggggtacataccaatgtttatatttatagatatgttgagtaggtgcaaaagtaattgcagtttttgcaattacttttaattacactatatataatggacagttaattttactacactatatatatgttacagtaatcagatcaggatgcttagcatatccaacatctcaaacatttataatttacttgtgttgggagcattcaatatacactcactagctatttgaaactatataatatattaatgttcactatagtcatcccacagtggtagattttcactgcctttcagagtttgtacagagagttaaaactatttttctttttctatatttagtctgtacattttttccttttgcaattccttttcagcattctgcttctaatctctacgtccatgacttcaattgttttgatttttagataccacaaaatatgcttatttcacattgtatgcctttatcaaaacatctcatgtaccccatacatacatacacctactatgtactcacaaaagttaaaaataaaaaaattctctatctattcattttttaaaattatttgccattactcatttccttggtttcttttacagtcgtttccctattaaatcagttagcttttgtttagcttttataattcattctccattctctatattgtacttacctatgacacagttatttaggtgattacttttagagtggattggcatatttctgttagaagatgatatcaaaatattgttaggtaaatgaatatatatctacctaaatgatacatacatatatatatatatgtgtgtgtgtgttatatatatatgtaaacataccaccttaatgggatgcatacagggctaatacgataattccttattttatataatgggaaagtagtttttgccttattcctcgaattaacggtgtagagagactcaatttgttttaaaatcttaattatcaatgataattcttcaaataaatactctcatttcattgcaaagttattactattagagaacattttaattattgttatcaaattttacttttttagaaaaacacaaatcctattttaagttgaaaaagcgaatgttaaaaatgttttaggatttacacaatattttatttgaagttttcaatttttcaaatgtgaaaatacctatgaagtatgaatttttttatttatcacgttgattataactttaagttttaaaaatgttgaaaagcaactgggttatgtagaagtgtatatgtgtgtttctaaacaccttatatattatgtattattacaaaatgtttataaacacgttataattttcagaggcttacattctttttaaaatgatacttcgttaataacacttcactaagtttttcattcagaaaattttaatctaaactagactgatgtactactacacactaatatgtaaaaagggaccactaccccttgagtgagactttatattatttaaattttgctccaagtactgtatgcatctggatatattcgaaaaaaatctttccacattctcttatttctgttttcttagatgaagcatgagtgggctggtttgtgcatctagaacaggggtaggggacagggagatatccaaccaagtatggaaaagcatctcttctcttaattttcttcctccaaattaaggtgctgtaacttgaacgaacactcaaattaatgtgtacacatgttatggaaaaaaataatgcagtgatcaatgaaagaatccaggtttaatattgggaattaatacaaagaggggatatagaaaattgaagctaggcttaaaattgaccccaaaaacttatctgaacaaatgaaatcttagaaatcctttaagtatagtatgccttggaaatgagtgatatggaatgatcatagtaaaaccacactaatgtgacatgtaaacttacctatgactacatgaaaacttgggcccaaggaaagctggattatcaatactatgtgtatatgaaagagtttgtcatgaacctagactgtgtcacttttttccatactaagagggatgctatctcatccacccaacatgaatggaaatttaattatattcaattatcttaccaggtttggagatacaaatgaaatactattatttaatatttactgagtgcttattttcaagtggttatcatgttaaaggctttagatcattgactaatacaattccataataaccaccctgactaggtgtttttactagctgaatttttcagataaaattgagacttacagagactgaataacttttccaatattaccctgctagtagaaagtggcagaactgggattggatcccagttcttagaaaatcaccaatctttcttaaccattatgctatttattggttttataaataattacttcaaattacctacttggtggcatccttaatttggagccaagcacttatttaaacaaacacttaatgaaatatttatttatttttaaaaaacttaattaaacacttatttaaacaaagtttaagtaagatacagtttttgttcttgaggaacttacagtataacagagggagaaagccatgtaaacaaaaaaacaaacacctctaagtttgtggctttgtacagagagagtggtctgttccttttggatttttactttctagaagttttatgcaaggctccataaatatattatgtctgagtttcattgtgaaaagttagcaggtattcacttactgaagggaagccattaaaatgttttaggctggattataaccactggacatgaacgaagaagaagatttcagctgagaatagtgagtccatttaaaaggctgttgaagtagtcaaactgaggtcagatggaggcccgaagagaggtagttccagagacaaggcactgtgaagagaagggattttggtgtttgaggagtagcaatcatggaccacacacatttctgagtggaagtaaatcagctcaacctatgtcactgcctgggcatttgacagccatttgttgctttccttgtttttaattacttaatttctattatttttgaagagactacctaacatacttaagaaacttcactttccaaaaatctttggctattattatcccgtcaggaaaactccttatcaaagaaaactttctttttggaattatttttttcttcagtgtcaagtgcttttatattctgttgaagatttgtttttcgttaaaagataacttccacttcctgtattgcaacaatccaatgagaatgaagaaggttagaatatagttgtccctcagtatcagcagatagaactggttctaggaaccaggtggatatcaaaatctgcaaatgctcaagctccttatgtagaatggtatcactgtatttgcatataacctacgcacatcttccatttagataatctctagattagttataatacctaaatcaatgtaaatgctatgtgaatagttgtcataccatgttttctatttgtatatttttattgttgtattgttatttttattatttcttaaaaaatattttcagcctgaggttggttgaatccatggatgtggaatccaagaatacagaaggccgattgtaaccgatatcggatcaaaaagagagtaatagaaagaaaggcataaaaataggaaaagacaaatgaaacaaacaaaaaagccacaacaaaaataacccaacttagttagattcaagtttcataatttttttttcttaaaggtatgattaagagttgatgagagatacttggaagaaaaaacaaaacaaaataaaataaaacaaaaaagctgaggaagtttagtaacagagaagagttaattgcttttagaatattttcacaatagtaaagctgcaaattagtttaataggatacaaaattttaaatgtaattatattaataaggaggtaatgatttcttgtagtctataagttatcctatacagacatgaaatattttttgtattatataacaaaccctactgaaaggatggatgtctcataagtatattaaaatttttctaaaaggcatttataaaaacaggtgtgaaaatttttaacacaggatggactagaagaaaataaataggagactagaaaaagatacattctcattggaaattctacagctccatacttgggatcctaagctataattggatgtggaacactcaatttgagagaattttcacagaatgctaaagttctctcttttttatcatccaaaaaaaatcatcattaaaaacttccaaagggcgtaaaacatataatattggcagagagacacaaacatgtttttttttaatttaattttaaccccctgtgaaaaaagaattccttgagtttggccaaaattcaaaattttaacttagaaaataataccagtctctattcactaaaaatatgcattctttcatttatttctgaaaaaaagaggtagaattttatttctgtaatgtcaaagcaagtcctcatccttctttaatagacactatatttgtcaaaatttttgtaagcataaaaatatggctggagttcttagaaatgtttgccgtaacttaaccaataaataaagtattgcctcaaactaaattgcattagaaacaggaaaaggagctctaagcaagaactgactgcaatcattcagaattatatttgtattttcaataatggccaaagacataaaattacgagtgcccactaggtgaacattatttattgtgtgtcagttatgactcataatacatagtcattatctctttaacacagtaagccagaataatatatatgatttttcccattttacagatttaaaaatgatgctttcaaagtaggcttaactgcttcacaggaatgttgtctaattttgagcaatgtacattataatttttctaatactgtctacatacagtattattggtacaactttaagtaggttgtgtagtatattgtaacacagggtacaaatcctgacagcaagtggtaaatataatggtgaggtcaagccaattccaaggaaatacattttctgggacatatgagaactttgccttttgtatatatgagcatcatgtaagagcgaatggtacagtaaaaaccccaaggaaatggcaacttaaatgtgagtcatttaaacaacattctgaggtattggtataaggttaggatcatgttttaattattgttgatctgcaaaatattctattgggcatccttcaatcctttcaagcatccagcctaaaatactaatactatataatgttacatgactccaaacaagattgaggaccagtgaccttgtacaaccctttcattttataattgaggaagttaaaggcttgagtggttagactgttggtaagtaagtcattacaatagcaaaactagaacccaaatctccaaactcttttttcccattatgttttctcctatatcatactgcctggtataatgataatggtaaagttcttgctttttaactctaactgttaacattttaataataaacataaacaaccaactgaaataataaaaataatttacacatgcattttaaaatatttattgtatgaccagcatatactaacttaaacaaatttaaattgtacactttgataaatactgacatacttaaaaattgtaaacacaaagtagtcatcattccccccaaactcccttgcttctctgtaattcttctcacccacacttcctgactgcaattccatacccaggaaaacgtggtttttttctggtcactgtattagtttgcattttatacaggcttatataaacagaatcatacaatctacattgcatttctggccttgtttctttaacggagcatacttatttggggatttatccatatttctttttttttttttttttttttttttgagacggagtctcgctctgtcgcccaggctggagtgcagtggcgggatctcggctcactgcaagctccgcctcccgggttcacgccattctcctgcctcggcctcccgagtagctgggactacaggcgcccgccactacgcccagctaattttttgtatttttagtagagacggggtttcaccgttttagccgggatggtctcgatctcctgacctcgtgatccgcccgcctcggcctcccaaagtgctgggattacaggcgtgagccaccgcgcccggccgttatccatatttctatgaatgtcaatagttcattgcttgttataaatttatactatttcattggatggctatactatgatttgtttatccactcacacgttgatggacagttgtgttgttttcagctttggctgttacaaatagagctgctatgaacatttacacttaagtctgtataggaacatatgttttgaaattttgggtaaatacctaggaatggaatgatgagttcatttggttggtataagtttaactttttaagaaagtttcaaattgttttaaatgagttgtaacattttactttcccactggtaatgtataagagtttcagttgctccacatcttcatcaatactggtgtggttacacattttaattttagacattattgtaggtgcatagggatgtctcgctgtgggttcaatttgcatctccctaatgacaaagagtgttaagcatcttctcatgtgtttgtcatgcattttccttcattgtttcaatgtctcttcaaagttttgcctgtcttaaaattgggttgtttgtattcttattatcaagctttgaacattatttttctgctctggaaacaatcctgttgtcgactgtatgatttgcatgtattttctcacccatttgtggctgaccttaacagtgtttttcaaagtagaaattcttaattttgatgaagtccatttcattttttatgggcttttattttagcgttgtgtctataaaatttttacctatcctaaatttacaaagattttttctatgcttatttctagacatttcatagttttaagtttaatgtttagctctgtgaatgattttgggttatttttgcatatcttatgagttatagatcaaaattcatttttttgcatacgtatagtcagtaccatttgttgaaaaggctatgctttcttcactgaatccccttcacacctttatcaaaaatcaattgaccatgtaattttgtgtttcacttttagattctccattctactttattgctttatttgactgttttgatgtatgtgatcttttatcctgaaaacttgcaaaacactttttagttccagtggctttttgtagcttctgttggattttcttcttacacatcggtcgtcttataataaggaaagttttattttttcactttttaatggcttacatttatgttttctgacttagtgcactaggcaatacatccaggacaatgataatagaagtgggaatagtggaaattcttgactttttcctgatcttaacaggaaagtattcaatcttcaccattaagcgtaaagttagatgtaggtctttcatagattcccttttcaggttaagtaatttttcttctatttctaggatcctcagaattttatcactcagagtatggtctattttggtaaatattctttatgaatttgaaaagaaatatgtgttcagctgttgttagctatcgcgttctaaaaccatcaatagtgtcaagttggatgatagtgttgttcaagtcttactgagagagacagttgaaatatccttctataatttgtttctttttttgatgatgaaattgtgtttaagtttttcagctttattgatgtatgattgaacataaaaattagtatatttaaggtctacaatgtgattttatatatttatatattgtgaaatgattaccacaatctagctaaaaatcatacccatcacctcaaattgttatcttggttgtgtgtgtgtgtgtgtgtgtgtgtgtgtgtgtgtgtgtgtacgtatgcgatgacaacaactgagaacttaaggtctattctcttagcaaatttcaagtataaaatacattataattaactgtagtcaacatgttaaaaattatgtctccaggacttattcatcttatgaatgaaagtttataccacttgacctcaacatctctcccatttcctaccctcctatctcctggtaccatcattctgctctctgtttatatgaatttggattttttagattgcgcgtataagtgatgtcatgcaatatttttatctttctatgtctggcttatttctcttagcataatgtcctccagtttcatccatgttgtcacaaatggcaagatttacttatatttgatgctgaataacacctgattgtatatatatgacacattttcattatgcatttacccactgatgaacacaaggttgattccacattttaggtattgtgaataaagctgcagtggacatgggagtacaaatatctctttgaaataatgatttcatttcctttgtatttgtacacagaagtgagaatgctggatcataaggtacttctatttttaacttttggaggaatctccatcctgtttttcataatgatggtatcaattacattctcaccaatactgtacagtggttcccttttctccatttcctcaccaacagttatattttttccttatttacaatagtgtgaagtgatatctcattgtagttttggatttgcttttctgtgaggattagtgatgttgagcattttgtcatatacctgttggccatttgtatgtcttctttggagaaatatcaatttaggtttttttctttattttttcctgagttgtttgacttcctaatgtattttggatattaacctcttatcaagtatataatttgcaatttttaaattttacctttcatagtttgtctcttcattcggttgattgttttaatttttttggggggggggtggaggggggagggatagcattaggagatatacctaatgctaaatgatgagttaatgggtgcagcacaccagcatggcacatgtatacatatgcaactaactggcacattgtgcatatgtaccctaaaacttaaagtataataataataataaataataataataataataataataaaaagctttttattttgacttaatcccatttgccttttaaaaaaaaaattgttgcctgtgtttttggagtcatgtccaaaatatcattgccaagatcaatgtcatagaacttttctcctgtgttttcttgtagatgttttatgatttcaggacttacatttaatctttaatccatgttgaattgatttctgtatatgatgtgaagtaaggatataatttcagtcttctgcttgtgggtttccagctttcctagaatcatttattgaagagaatgtcctttccccattgtgtgttgttgacatcttggtcaaaaatcaaatggcagtacatgtgtggattttatttctagtctgtctgcattgttctgttagcacatgtatctgattttaagtcaataccatgttgctttggttactatagctttgtagtattttttgaaatccaggtagagagatgcctccaaatttgttattttgtctaagattgctttggctacttggggtcttttatggttctgtaatgaattttaggattattttttaattttgtgtaaaacatcatgggggcgttcataggcattgcattgaatttttatatcactttgggtattatgaatattttaataatattatttcaaaccaagaatatgtgatatcctttcatttatttgtagcttcaacttcttttgtcaatattatatagttttcggtttacagatcttttacctccttagttaaacatattcctaaatataatattttactttattttattgtagatattgcaaatggaaatgttttcttaatcttctttggatagtttgttgttagtgtatagaaatgctactgatttaagaaattcagtgcttcttttttttttttttttttgtgacggagtctctacctctgtctcccaagctggagtgcagtggcgcaatcttggctcactgcaagctccgcctcccgtgttcacaccattctcctgcctcagcctcctgagtagctgggactacaggcgcctggcaccatgcccggctaactttttgtacttttagtagagaccgggtttcaccgtgttagccaggatggtctcgatctcctgaccttgtgatccgcccgccttggcttcccaaagtgctggaattataggcgtgagcaactgcacccggctgaaattcaattcttctttacattaaacataagataattttctaaaagtttaaaaaatattgtcttatttaaacacgacaacaatctaatgtagtagattctttatctatagaggatgaaactgtggcacacagggtgaggtttatataacttttgtaaacccatacagatattaaaattgaatgatggcattttgagtaaagatgttatatgattagatatccttcactctgtgttgctttacttatccaatcattttacctagttaaaatgattaaaataataaaatgttttaccagtagcaaatgaaaacatatatatctcagaatctacttataaccactaactaaagaaaaaaatttcgtatgtttttctaaataacatagcatttaaagctgtattctaaaaaagattacatatattgcataatgattttacttaattactatcacaacatgtagtcaaatatgaatgcttaaaatgtggtgttgcataatgatggaattttaaaaatatgtcagtgaaattcatttaggaacgaaaatgtgacttttctatctttaatttataaggctaataaaattgaaataatatatactttaccgactggtggagtggtccaaagaacaatgaaatgaagttatttaaaacactgtcattcttaggataaaaatcctttgcaaaaacagatggctaaactatttgatttaacttcatgtgtgtgtgtgtgtgtgtgtgtgtgtgtgtgtgtgtgtgtgtgtgtgtgtgtgtgtgtttgcttagtattgttagactatgaaaatgtacttaaatcttttaagaatggaagaatatttttgtcataatcagcagtgcaggcacttgaaaactctagcacaatatttttttttaactgtaactgttttggtttgctaatgcagcacttacttttccatatgcaaagatatttaaggtctcaatggttaaccttattttagtattactgtggagaaagttgcaatctgaatctaaaataagtcatttagtttagactaaatggacagacacatctttgaagtttatagatacagtttccagtgacccagtttttgacatactactgtcgtggttcactctaggttttccaaacactgtttcagtgattactgagccagagacagtatgcttgattgtgtcagtttatacttgaatacctttaatatgtgaatctatgcatcatactcaccatttatcactctaaccctctagggcatatgagcacaacacataaatctattttggctgctccttaaatgtcataaataccctggctatatttggttttaatatatatatattttaaagagataaatactgtaaatcatatttctgaaggaaacattattttgacaaaatgtccatcaattaaacagggtatatatgtttatatatttatatatcctcttttatatatattaattatattaatatacatataatacattaatataattaaaataatatatattttaatatatataaatatatatattcacacataatcacacacacacatagagatacacaaattgaaaaacaaacatacacataccataaactgtgttattggtactatacaagagttacatcttttacagaacaacataggccctagaaatagtataaactcaagaaatatttgttgactaaatgactgcataagcaaatgaggaaacggcctagaaattgatctaaataacattaaaaaattgactgtatcccatccaatatcatagaataatattttctatattactgcaattaccatatctttgattttctttaccaccaacctcttatttgtgcagttatctttttcctctagtgctctccctctttgtctctcctgcctaagctaaatgtaactaaaataaaaaatgtaagttactttaaagtatagcaccatgaaatcttcttagtctgattgtttggaagtagtcagtggctttacccctacaacttaaattttgtatttcaaacttagtcctgaaaaggcattatttgcttcatctccataaaattgcattttagtagcatgacttgatgtgcttaataaattagttatgcatcttaatgatagaagacagcttaacctgtctttaaaacatcatcataaagctggtcatgcatttttctttagtgtcttccctagcactgtgaagctgtatgctcatatttacatcaaaactctgtcagatgattagattttgcacattttttaatggccattgaaaacaagttctttaggaccttaattgccaaagcaaaagtatgaaatagttttgatcaccatgctgtgatcatacttctatgacattcttaagtaaatggcttaccttggacacacttttaaatatatctgacttctttttttccctttatggttttccatcttgtttctgcagacgttctcttccttctgtacgcctctcccaatatagaatttcaaatttgtcatcaattttctgtccacatctccctatctgaaatgtttgctaataaggtaattctggctaggaacactcacagcaattctttgcgggggtaaaatgctactcttcaaggcccagtgtgacatctccaatgatttctcaggatttatgagtttcctttgtggagctgactttctttatggtgtggctgcatttctgaggatcatcacagtgtcaaaattcgttacagtgagaataagtatctcatatgagccagttgaaaagctaatacaatttagatatttgtggttattgataaagatatatttaacaatgtagtgatttcagaaaaaataataatggtgggaaatattacaccttgtgtataattatgatacattagtggacttacttcaagtttagtttgtgcacgctatggaaataattacatggttttttaaaagttgttaagatacatagtcctccttagtctttgctctgctaaagtggatttagtgtactacaaatggtaaactgttagaatggtccaagtctaattcataataaaattttacctattacaaactgtggttatatggattaaaaaaatgcctaaattttccagagaaagttttacaaaatgtgtttatttggattttttaactatattaatcaacaaatatgtagcattttcaatacctccgtattgttctgtttaaatgagcacttacatattattagatttgatgatgttctttattttacatatgggaaaactgaggcacagatacattcattaagttcacatggaaaagcagaaccagattttgaaaatgaaagagatagttataaagttgctgcttattgaggagtattcttcagacctttcaattttatttggtgaatcaggaaatagattaattgatcaataggaacaaactacgttaaatgattgataagtaatataaattaattccaaaagtggagacttctgtgggcttcagttagctaaaaacatgttattgaggagacaggcttgatctggactttggagaaaatagagaggcaattagggagacataatgttggagtgagtacatagaatattcaaataaatatcaaatgttattaaagcatttcataaattaagttttagcgtaattgatagaatgtgattctttgaaacattgtaattactagcttaaaattgtttattgcataatgagtattattattattgttattttggaacatgttttcccttctgattagttttcttacaatttctgtgtaataatgattacaaataatttttcttgtcaaaaaatacacgtatcttctcagttctactaaaatgaatgttttacatgaatttgttagagtaaaagcataagaaaccatcaggatctagaaaggaaagaaatggaatgagaattaaataacttacttgaattgtcttgctttaagtgaatgtcatttcttatgataatcacaaaaatcattaatcaaattttattttcataagtttgcatgagattacttaatagttttcttgagtcaatatagtgttgaaatataacatttttacatttttctccttagtaggaaagataatctataactatgggtgagcttatcatcaagaactccaggaaaattatgaagtgatttctcttgccacagtgcctgtcttagtttcctgaggctgttgtaccaaattaccacaaatttggtggcttctaacaacagaaatgtattctctcacaggtctcaaggctagaagtccaaaattcaaacttggcagggctgtgatccctgcagggctctggggagaatatgttgtttgtcttttctgcctttctttggctgcactggttttccttgacttgtggtcgctcaaggctctaaccttaattgcatctgcaagtactctttttctaagtaacgtaacattcataggttacagaaattaaggtgtaggcatatcttttgggggtgccatccctcaacctacttcagtcctcttttcctttgagctttcttcaaaatccctatttcatctgctacctgtgattagagctcccttgctcactatgctccccttctacttcattgtagctcttaggaagttgtcaactctcttgttcagcttttaaaagtactcatttgattattcttgctggtgtctagtttcgtgaggtttctatgctctacatgctgacaagggtagtaagtatgatctcaatacagtgaaatcacctctcaatagagttaaatttctgaagtcagcaggataggctgaatgtgtatatgacgtaaacatggtaagccagaattaatatagctgtactgacaagtacacaaaattggaagtttaatttactcaaaggtcttgagaaaattgtttattatctttaatttcatatacctttataggcttctaattttttctgtaatcttatagagtacccttaaagttcctggaagtagagaagtattactcttctattttaagaaattacggaaagaaaaagatagaggtaattactccaggataagtgttcatttaatagaatggtaataaggaatttatgtgaatcacagacactatttaaatgattctctagtatgactagccaattatctcagcaccatttactgaataaggagtcttcctcattgcttgtttttgttgaccttgttgaaaatcaggtggttgaaagtgtgaagctttgtttctgaattttttattctgttccattcgtctatatgtatgtttttgtactagcatcataaaattttcatcagtatagccttgtagtatagattaaagttaggtagtgtgatgcctccagcttcattctttttgcttaggattgctttggctattcaggctcttttttggttccagatgaatttcatgttatttttccaattatttaaagaatgatgttggtagtttcataagaatagcacagaatctgtaaattgccttgggaagcatgaccattttaacaatattgattctttcaatccatgagcttagaaagtatttcaatttatttgtgtcaatcattatgctgaaaagacacatgcatttgtctgttcattactgcactattcattattgcaaagacatggaatctatccatatgcccatcagtggtggactggagaataaaatgtgatatatatatatatatatatatatatatatatatatatatatatatatatataaaataacaatacaagcttatagctgctcagagaattttgatttattcaagatttatatatatctatatttatatatatactatggaatactacacagccataaaaaaacagtgaaatcatgtcctttgtagcaacatggatggagctgaaggcaataatcctaagcaaaataacacaggaatagaaaaccaaatattgcatgtcctcacttatatgtgggtgctaaactttgagaacacatggacataaacttgggaacaatgggagcaatagacactgtggactacttagagggcagagggaggaaggaggacatgggttgaaaaactacttattgggtactatgctcactaccggggtgcaatatacccatgtaacaaaccttcacctgtacccctgcatctaacttaaaagttaaattaaaaaatataaaatgaaataaaaataattattctattcttgcaccttctccttctggttgaattggtcaaaggcaaataagaatataatttgactccatttagttatgttaactgttttagaaaatacaatagttacccaattaaaatctactttttttaagacgagattaatttaagtcagaatatgagcctatttgttaatttggtcttatcaaatcatatcacagggcagattgttgctcaattctggcttgtgattgacttgtctctggctgaaagaatctagagacgcataacttaaaaactctaacggaagaagatgttactaattaattcttcaaactcagtatacatcacttaaacaatgtattattttacaatattaaatgcttatttttattattaacattattctctaaattctatgtctatcattgttttagaaatttatttttaatagcaacatctgtgaactataaatactaataatatgttgcaacataggattgtatccatacatggaatattttgacagaatacactagacacatctagacaaacttgttgttcaactgacatagttggtcaaaagtacaagcttggctgggcgcagtggctcacgcttgtaatctcagcagtttgggaggctgaggtgggcggatcacaaggtcaggagttagaaaccagcctggccaatatggcgaaaacctgtctctagcagaaaatacaaaaattagctggctgtagtgcacatgcctgaagtcccagctactcaggaggctgaggcaagagaatcgcttgaatctgagaggcagaggttgcagtgagccaaggtcgtgccactgcactccagcctgggtgacagagtgagactctgtctcacaataataataatactaataataataaccacaataacaatacaagcttataactgctcagagaattttgatttatacaggatgccagttgaatgttgagttagttttccccttttcaagtgatgtcatgttttatcagtttaatttatcaagacagtcaatatgtatgttgggaaaagcaataaagctctcgttactgaataaatatcactgggacgatcaaagctagagtaaaatcctgggtcaggaacaccaaccacaagattcagggagcaatcagatttcagaatgtgattaccaagctgggtcagatgtctggagaataggatctggatgaagtagatacggaaggtgtaagtaagtttgccaaactaaaatcagaataatgaaagtcatatttagaagtctgagggagccttttcaggctgctacagggatagggaggtaaacaagcaacagaaaaaaattaaaatgcctctttggaatgttaagtagcagaatgcccctgttggtgtttcctgccacacctgacagtgtggcaaattagcttatacatttttgaagaattttaagaaatggaaatattgcatatgagaacgcacagttagttaacctctctgatatggcataggaaagaagattaaactacgtgaatgataaagcaaggtgctctccatgtaaactaacttgtaaaactgaccactcccaaatttgtatgtttttattcacactgtgatagaacaaggtaaatctatggtggaaggatggagggggagaaagaaacattacaaattgatagggaacattttaactgacaatagttgctatacctaatgtttctattcatttatagtaattgtaacctacccaaagtcacaaagatggtatctgacacaactagagttggttattgaaagatcactgctacaggcaaggcaccaagatgcctcatccaagctgcataatgattcagtaattcccttgaagaaagttagtaactataaaaagaaggtaaagataaaatgtcatttctgacttccagaagccccagcagtaatatactttattatatactgtatgtaagcaggaaataaaatattataggaattgtgaatattaattaaccacatcttcatagagtactcagaaaagagtttctggaagatcaatggttccaaacagattctaaatgatgatggtttaggaaggtggagagacacattcaatattttatgcaaagccaacataattttatataatattttatataatacttgttgaataaagaagaatatggcataaaattgaagcagtacatcagaataagttaatggagagattaagattcagactaaaaattctgggtctagttcagtagatattgagatagtaggatgattatgaagagcgtcatatgaagaagtactatacaggtttgacttatgaggtatggagttgtatatatttgatctaaatctcatatctaccactttttagctttgatcttaagctattttacattattatgcattataatttctcatatttaaactcagattaatgaaaatatttccttcatattacatggaaatatgtaatatggaggattacatggaaaacttcatgtagcgatctaatcatggtgcttaccatacatttaagaattatctatttattaaacaaatatttaagtggctgctacaggcaggtcattttgttattgttatttttataattttaatattatcattactcttattttcgatattgctaataacttgaggacgtttatggcaaatatatttaggctggatgaagcatcctaatcctggaggatgacagttggggattgggaaggaatcagtgagaatattcaaatgtttctaattgaataaatttatttgcttatatggcttttatttatgatttatattgtccttatatataataaataaggtgtgtgcatatatatatatatatatatatatatatatatatatatatatatatagtgtgtgtgtgtgtgtgtgtgagtgtatgtgtgtgtatataattcaggaccattataaagagaaaaataggccagtcctggtgactcacacctgtaatcccagcactttgggaggcccaggtgggtggatcacctgaggtcaggagttcaagactagcctgtaaaaccccatttctactaaaaatacaaaaattagccaggcatggtgtcacgtgcctgttgtcccagctacttggtaggatgaggcaggaggattgcttgaacctgtgaggcggaggttgcagtgagctgagattgcaccactgcactccagcctgggcgacagaatgagactctgcctcaaaaaataaataaagaaaaatgagagagagaaaaacaatttgcaaaaatatctgtaataaaaatatttgagaattttaagcttcagactttgcatatgtcagtgtatcatctgctctgcattaattttatgtttgtatgtctgacataaaattttacataaattttacgtggaattttacataaatagctttctaaaaattttctgggcctggaaacaagatttgaaattgtagaaataatgagtatagtgaaaactaatcatgtaaatatacagtagataacaaaaatgatggaacttgtgaaatccaccaagaaaactatgctaatgggttctcattaacactcaaattagattacctgacctctggtttctatttgtaaacttgaatctctaaaacataaagtggccaattcaacattccagccagtatgtaaatcttataatgaaaataaaatataaaaatataaataaaataaaaaaatataaaattagtttttatttttaaccacttaaaaactaaagatagctgaccggtaatcacctttatcatcccattagaagcacatagtaaaaaataagtaattaatgtaatatcatgccctttggtatacagcataaaaaatagaaataaaggggtacatcattcataagcctcatattttatataaattgagcttcttacatttttcctttcatatactccttgtcatatatgtaaatataataaaacttgaaagtttaacataacttttccaatttgacatagaaaaccagattaatatttatgtttgctgaaatttacattctgtcctttcaaaaagtgatgtaaaatagccttataaatctctctctctttcacacacacacacacacacacacacacacacacacacacacacaaacacagataatatagtaggaataagaagggtaagaatcaacagagtaaaaagacaaccaatggaatggaggaaaatacttgcaaatcatatatgtcataagggattaatatccaaaatatataagaaactctacaactgaagcagaaaacataattcaaataaaaatagataaaggatatgaatagacatttctccaagaagagatacaaatggcccacaggtatatgaacagatgcttaacatctctaaaaaatttttaatattaggttttggtgcaatgatacagctcagagatatggatatacagtataacccaaaggaacgtttaattatggcttttcttcattagattttggtgttcatttcatataaattatcaaacatattgatatacatttgtttatgttcttcctcccttagcctcttaatgtctcttttatttctgatatttgtgatttgtacattctcttttttgttatgatctatctggttacaggtatactatttttgctgatctttccaaataactttattttaattcattttcctattgcgtttctgatttatatttcattgatttatttctcatttatttctttcgtttaaacagaaagtttaattcaagactaattttttagacctaaatttatttttccagtttcttaatatagaagcatagatattatattatttcttgtatttaaatttaaacatttaatatgatacattttagagttacttttatgtttaccatctagtgctccttattttttgggtagattccaatttctatctgttattatactcgtgctgaaaaatgaatactactactagaacaggccttctgacattaaaatctctcaagtttttgccagtttcttcattttcttttcatttttgaaagatatttccactagataatagactgtgggatgaagtgattttattttagtattttcaacatatccaataaataactacattgtctttgtcttgcaagaatttctatctttttatctttattcttctatatgctatatcccactcccctgttttccccacccttgctggctttactaattttctcttggtctttcagttccaacaatttatcaatgttttctctaagtgtttgtgtgtttttaaattgttgtgggttttttgtttgtttgtttgtttgtttattttttcctgctacatagtgttgtcttgggttcttggatcggcagttttgtgtgttttgtttttggctttcattgattttatgaaattcttgatcattttctgtcctattgctcttctcctctaagaaaacaatttcatatatgttataacatttgatattgccctatagctgttagatattctgatttatttattctttgtttttcctctttctgattcagtttgtagaacttcttttgattcagattcaggctcagtgcctcaactgtgtcgattctgttgatgaattcactgatggaattttgaaactctgatgtcatgattcttatatgtagctattgcttgaatgctacactttctataaaggtataatgtgacataatctaatactcaattcctgtcaaatgtttggttaaattcttacattcattttggggatataaaaagttaaaagaggacaccggttctgacaaccagtgagaaaaagctgaataatctacaaaattataactattattcaacccatcgaagagctgagatcacaaggcaaacaaataaatcaacttccccagtatgtcactttgaaatagcagagatccagtcacaaggaaacttagcactcattcacaacttatcttcttatgcctccactggatgctttttagaaggatttggggtgctggcatgaaggaggtaactgctgagggatcattgggaagcttgcactacttttctagactctcatatgaagcaaaatctttatgttactgggaaatgggaaacaaactaatctccacaagcaaggcaaaattccactgcttctgaggtcaaaatgtaaccaaaaacccttctgtctctggggtaggcatgctgcccatgggatttaatcaaagaaatgttaatgctgaggaagggtaaaagaacgtacctcttgtgcctgaaggagaagtgagaaatcatctggggctcaggactctgcattctgcaagcacaggtctgataatcctggggaaagaccaggaaactcccatctgtttaagaatgatcaaaaataaaggcaaggtttggcttctttggggaatagacatgctgagaaaactctactcaaggagtctcatgaccctctctgtgcttgtctgaaactgcgactacagtagaacaacagagcctacccaatttataccaccaatttataacacaagcatacctagtgatagtacatttcccatagtattgctgtgatgattatattagacaatagatagaaaacacagtgtataggtgggtaagtcctcagaagacattactacccacaaaaatactccctatgagtaaactaaatatgaaataaatatggttgccccttctactgtaactacaaacagcaataataaatatgcagatttaggaagtttacattgcactctatggttgataacaatataatttttttaatgaagctgttttaacttaaaaactcaacagaaataattatattcattcagatatttttaaaacatccatgtcctaaatgttatttaagaaatcaaaatacatcaaaattatataattagatacatcaaaagcatatttagacacacatctcattgaaatctcgattttgtaacaatattcctcaaaattattgaatgcttttgattggtgcagaggaatatttccatgtaacaacaataataaataaaatcatggtacaagtttaattgtctttgattgaacaatgatgaaatgattcatctaatttgttcattattgaaagtaaataagggccgggcacggtggctcactcctgtaatcccagcactttgggaggccaaggcgggtggatcacctggggtcaggagttcaagaccagcctggctaacatggtgaaacaccgtctctactaaaaatacaaaaactagcaagcggtggtggtgcgcgcctgtaatcccagctactcaggcggctgaggcaggagaatcacatgaacctgggagctggaagttgcagtgagccaagattgtgctactgccctccagcctgggcgatagagcgagactccatttaaaaaaaaaaaaaaaaaagtaaatgatttcacttagagtaaaagatgactgttcttctgtgaaattcatgaaagtttaaaattaaggaagtctttgcatttttggagctacttctttatatgaggatgtgttccaaacaaggaaactaaaaatatgtttccttaaaatcaaaagtacgtttccttaaaattagtcacagggatcactttttaataaaataacttatttaactgtagtgttgttgaggaagaatttcatttggaactacaaattctgttactcatgctttatagtaatagatgatatcattaaaactttttggctctatgttctgtattcagttaaaattaataagatagcaaatatatggaaatataatctgcctgtttgtaacctttatcgtattcaaaattaaaagatgcatttggatggtgtaggtttgtgagaacacagaaatagagttagaagaaaaaattataggtatctttattgatttgtaaaacctggaatgccagttttcttatgtgcttgtaatttttgttcattttatgagcccttatatagcatcctgctctgatcagtttagtgtatttatcattaggctttattaagctgaacagcaaatggacaaatgctttattgaagtgaatagcatattgcagccattatgttcccaagatgatttagactctggatagttattttacgttggtttattgttctcacctccattagacactataactctatcatattgaagaagtagtgtggaataattaccgtggtacattcattaacatgggaaaaaatgaaatgctgattctgaattcccagtatgaaatcccttattgaaacagttccatctcagcatgagctttatgggggatttcataagaggccgtcctctccaaagtccccaaataaagcatctggggatgattctcctcaaattctcctcaaattcaatgttaacctttaagaaaaaccagaagaaacaaatttaaaataccaacaaatgatgcctgttttgcatcattaaccgtaagtgttcacattgagaaatccatacaattgaaacataaaatctagtatctatctaaaaataaaaacaaaaatagaatggaatgaaaaacacatgcaactggagttattaagctagtattgctcttttgtattttatctttctgtttacttataatttctccctattgcacaataagcaatttatagtaaattgtagatcttatatatcactgcattccagccacctggcatttttccctaacatattagcccgataaatatttgctgaatcactatttttgaaaataataaatggctggataagaacatttatttgtaaacctttggaaggagactttttgaatgaaaagtctaccacatgcatatatatgcatcttgcatttgtgacatcttggttaaggggtcttagataatatcagctatgcttccagttccacagtttctaagagctccggtcctgttttgtgctggatattgatgcttttatcttctgctataactgtatactccccaagtctaacataagccttcttgtgtacttttcttattgtcatcaggttagctcagttctttatcacttccaaattgtttaaagtaacaaattaacaactgatatctagctcaaaaacattggtgttttactacattctctttcccttgccatttgaaattaatgatgcaatgacttgtgccatttcttattaaactgattttttttcattgtcatgtttcacatttgtcttgtatatgcctcatggatagatggaatttgttaataaatagctgtttccttattgggtgtgtgtgtgtgtgtgtacatgatgtcaacagaataaagtaattcattttcaatattctatgatttcactatggataaacataaattatgattaattgttctatggtttcttcagtggatgataaaagcattaccatttctaaacatttctcatatcactttatagagtactttttggagatatgcattaatagttggatcaaaattatttaaaccacttcagtaatgccttttccaaactgtgcattgtacatgttcctaaattttgcacaggatacaaaaatgaatgaaaacattttctgtgaggatgggctttccctgacatcagtctattcccagaatccgaatctttagtcattcataagcttgcatttttaaatattattttagttatatctatcctaaaaggctttgtatgctcatcaggacaggtattttaaatgtggaagattattctcctattaaaaagtaaacagagtctttgaatctagaaagggatcttattaaaactgttgttttcctatgagtatattctggaaagaaagactctaccgaactgtcaagagcaattctcttccttcactatttggttattatatatggttagaagattctttcttggtaaaatagtctcaagattttaaccgtccccaatgttgtgcaattagcaaaagtgggacaattttttgacaaaatgatgtttattacatgtgtaaacatttagcattattctgtaatcaggcaattgtatagatacataagagcatgtatcattctgagttagagcaaggattattttgtagtgatcattggttagcatccacatattccattagaacatcctttcagatattcttggatagagaacagaaccacatttttatatctacaaagcctttatgtagtttcagtctatttccatatgatatctgaggcatagatattccatgtttctcagagtaagtggtatctctgtaaacacagaatatgaagctcaaaggctcctaggaaccaacagcttttaaaatgatgcatggcacaataggtattaaggagtcatatctgaaatccaccaaaaaaattttattatcaaaaacgtttaaaaggttgcataataactaagtaaacaatacccagggctaaatggaatacagttttaggccaggcgcagtggctcatgcctctaatcccagcacttttggaggcctaggcgcgcggatcactggaggtcaggagttcaagattaacctggccaacatggtgaaaccccgtctctactaaaaatacaaaaattagccaggtgtggtggcacatgcttgtaattccagctactcattaggctgaggtcggagaattgcttgaaccctggaggcagagtttgcagtgaactgagatcatgccactgcactccagccgggggacagagcaagactccatctcaaaaaaaaaaaaaaaaaaaagaattgaattgaataaagttttaaggattaatgttactatttcgctaagaaaaaagtggtttttatcctagtcactctcctaaaagagggcattataaaactattctattaagtcttcaagaagcacagactcccgactctacaaattccatgaattcagatgtctttcaaaaatattcttatttaactttcttccacctgatacctatgctgggtaatgcatcaccatcagcttagtagctgaagccagccagaaatcatagtggacaagagagacatagcccagcactcataaaattctaaagctacttcattctccacatgaatgaaatctttctgagactaaccttcaattaatgacggagtgtgtcagctgctctaaactcaagtgcagcagcttagaggtgtgtcttgcatccttgtgcatcactcacatttctatcccacacactgctgctaatcaatttctaaaataaaattttaaatctaattatttcacttcctttatttgtctctcattgactcccgttggccttaggataaagcgtgattgccatggctaaacgctcatatttttgaaatctagacttttctagctatctaatttgtttaaattattgctatcattttgaacagtttgaccttttttagccttcagctgtttccaataggagaccactagaaataaccatataaagcaatcagttaaacactttcctcaaaacagaagcatttgttagaaaacatcacatacattgacttaacactgtctttttagtttacgtataagacacaatatgatttgaagaaacaaaaagaaatgcagacaaagacaattagtattagctccttgcacttcagctatttaactattattttttacatttttgttgcagagccaaaaagttactgtgctatattcattatggtatccaaaattatctgaaaccaattacatctgctattgagaaaatttttcataattgctttgcctatattaccaagatttttcttccccataaaactctattatgttgatgtgaacatatatttgtgtctgtggaacttggtttttttgtttattctttggagagagagccattagaaatttataaatttaatggattctcctttttataaattcctagataggaaattactaaattactaaaaaattttcaggaaaattttttagtaatacacttttacatgtataaaggagggaattttattcctatgtatttagataaccaggtcattagtattagaattagcttacattatatagacacagaaacatttagtgtgtttcttattttacatgtcacatgagaaaaataatattgttttgataatattaattacaaaaaacttctgcatgtatctaggctttgttttatctcatttatattcacaaatctgtaaaagagagttgggcaaggttaccaggataacaagtaccagaatcaagtctaattctgctgatataattgctggcacacataaacactgtactaaaatggctctgttgtaaaagatttgccaaatgtgtattttatctttacatttgtagtatgtttatgcatttcattttttcattgtatcagtaatatttctaattttactaaaaaaggggctatgtacacagtagccatttagtacatttttagtttggtgcaaaagtcattgtggtttttgccatttttaataaaatacaaagaaaattattgcttaaaaaataatttcactttacattttcctccattgttagataaaaattatgcagtgaatttctattacattttatattattgggatgaagcacaattaaaattccagaatagagaaaaattaataaaaatattatcaaactttgttcaaatatacagaaagtgaaaagtatttaaaaatcacttttgtagtagtagagaaatgaaagcattcatgtggaatctattataatgtgtttccagtcaagcaaaaccagaattctcctcacgagagagtgtctagatcaaagaaactgcttctttcttcagtttcttaaccataaaattatctggaatacatttcaagctccctgtgttcatataaccttcccagtaggtttattttacctctgagcatctggttattggtcactgagaagaaactatttcctagaatctagggctagtcgctatgggggaatactcaacatacacaatagcaacatagattccctgttatacaatgaagaaataaggtagaggatctcttgtataaacaggtagaatgaaataattttaggtggctaagaggatcacaggcagagatgctgataattttaggttgccatagagacaattagcaggattgacacaattatactgttcaggcataagagtagaatgttggaagttatacagaaattaagggaactaacagaaatgtaggcaagattgaatgagatccgggtacataagcatcatggaggctgaatgaataatcacagcagcttaatgtaccatttaaaggggatattgattgtttagaattataaaaatataatgtaatataaataaaacattacaaaatatatgaccatatttagagttagttctaaattaaaattcaaagtaattgtgtagggtggtcattttctgatctgagaacctcctgataggtgagttgtggagaggaaggaacatcagaacatattcctatgcttctctagtgagatcggaaagattttagatagtattcaactccatgacattggcaactatacccagacatgcaaacttttgatgcaactatgagccatctttatggctaaataagttatagaggctttaaagtaaatatgtatgaactgaatttgtatttcctcaagacagaaaaaaactactattcctttagcaaaaattattctgcactgattattattttcaaataagtaaagcttaccatgtaagcaccatgtcctttaaattaatgttgaatattttgaaaatgatcctttacaaaatgaattgcaaatttttatttattttaaaaaactgatatttatcctaatttcagaatgactgacacacaatttcaatatatgtacacactctcctttaccttgtattccttctttgtggatgtcagaaatcagtttctaaccctccttctagttataccctacctttgaagatttcagtttactggaatctgaaaacaaaacaaaacaaaacagacagccatacttcttagatcttgtataaatgagcagtaaagaaggtctgagtgaagatttagcagaacttgccttttgccaacagaacttcatgtatctgactacaagtaaaagttggaaaatcatcactaaaactgtaacagaaattcaaggactaaattgaaagagaagttgaagtttatttatggtattctttccagagagattttatagagccttttttcagtctttcccaaccatgtttatttatgttaaattaaattattggagtttttttttagaattcttatagaatatatgactaaaatgaaggataataatataatttgacatttaaacagttttattgtgaaaatgaaaatgaatgttgttaatacttatgctaaaacagtaggcatgaaatgacactgtggctaaccagaagggacatatattcacaccacctaaatatgagacatgtttgttaaaagatcctccagatatctttttccagtgaaattaaaaaaaaattacttaatttatacactttcaaatattgtctttttttcacattcagctgctaagttatttgtttctagttccctaaaattggcacagagggaaacaaatagttaaaatcacatttatcccctattttttaccttatatttatataagaaagtcataaatctttctttagtccttagttcaaagattacttttagtcttcttttacaaataaaagcaatagtttggagagtgggaaatgagataggataactttcctctggttaaaaaaaaatctttgagactttgttgttcactttaatgcttcaaaatacttccaaggcgtctttgaaggtttaaaaaaggatttgtgaattttttatggaatgccacttagtaggtgtcaaaacatatttagcaggtggtatctaattttcattttaatgaagctaatcttttcagactaggataacataaggttttaccatctgtgtgtatcctatttagtttatccaggttggagaaatctgaaagaaggtctgtgaaacaagaagctagatgttgttcaacaccagccttaactacctgaaagcattactattttaaaaattaaaaaaatagagaatacaaattttagtatattagcctataattttatctaaattatatctttgtattcagattgaatgatcttttacagcattacttagaaaggctttacatgtaagacatcttaaaatctagctaagaattttctgaggagacacggtacaaatgtgtttcaagagccagagaattaaaaatatgttgcacttcttcacctttttctctcttgcagatcatcactaattatttccctgcacaatctttttttccagctttgcttccagcacatatttgaattttcctattgacttcttttccactgcttgcaagaaccttttcctttatggtcatatataaatttagtacatatttaaaaattttacgtaaaaggatcgtgccatatgtttgtcttttttatttttggaaataaaaaattatcattgcttttcaaaagtgacttcttaaatcttagctgcataagtaataaatacagctgtaaacattcactatgtactaaaatttaaaaagcattcagaatatcatgagctcagtgataatcaaaaacaaaactaaaaaagaaaaatacttcattgctcaaaataaaatgagatatatagaagaagataaggaagacaagaagggagaagtagaaaagaggttataggtaaaaaatggagagaggaggaggaagtcatcccacctttgcataaatgttgtagttgttgttgctttaagtattattataaggtagcacaaggggaataatgtgattggaattcaagagttagcattagtaaattggtcccaagtcagttcacaattggattgcaaaatatagtgaatttcaggaacttatttagaagaaatctaaaatttattagaaatgatgaagaactttgtgcagtaagagcatatatgtgccaagtatgttccagtaaagggcaattaagggtatatctgtcaattaaaggcatttatatttaaataacaaagctaaaaactgattatgcaaaagataaatttgttgaatacacgaaaaggataaggtttttaattttaaaatatcatttgcttttaaaaataattccttgattatttttaaagttttgctcaattggattcaattgatttaaaaaattaactttcttaatgaatggactaggaataaataaataaaacatgacaaaaattaaaagctgcttgaattgtgagtctatcaggtgcaaacttaaaacatctgtgagactattgtataaatttacagggaagcataatcccatcgacattcagttctataaatgcacaaacacatattccttcagaatgtcctccaaaatatatattaatatattatttaccatgcatacataatcattcatatatagtgtaggtagtatgaatcatggaaatttgaatttatgagtatgccaaatcatgtaggaaatgagacaagaacttatttaggtaaaaaaaaaaaaaaaaacaagttagaagaactgtgaccataatattgtccaattttgtgacctgaataaaaagaaaattagatttcttaaaatcaaatctagggacaatcttaatataagtatttaatagttgtcttacttttatacagatgcatagtttgaggaaataagatacattgtagatatgtatactacctgttttctttacatttttccttttttcttatttttatttgatgaagttattgattacatttcagagctttatatttatcatttgttcctttccttatattaataatcaaacatgtatctcctgtaatatttgaaagaaagagagaaagtatatcctgccctaccaaaactttgattctccagcagtttatatttgatctttggcaagatttctttagaatgttgttatttccttattctgctgcccattcctctccatagatttatccaagttcttttaggttgttttctctatttgttcctaagatttattcaaacaatttaatactttccttcaagataattaatagcttttactttatagactggctcttctatatttagaattattattcagcagaaataaaattccaaatggaagaagctcatattgagcattttaaataaatagtgtaggtaggtgatacaatctatgaatgttttgtttatttatttatttattattttgagacagagtcttgctctatagcccaagctggagtgcaatggcgtgatcttggctcactgcaacctctctgccttctgggttcatgcgattctcctgcctcagcctcccaagtagctggaattacagggacgcaccaccatgcccagttaacttttgtatatttagtagacacagggtttcaccatgttggccaggttggtcttgaactcctgatctcaggtgattcacacacctcagcctcccaaagtgctgggattacaggcgtgcgccattgcgcctggcctatgaatgtttttatacatccaaatttctttcttattcctgacaaataattgatattttaaattcaggattataggatttcagtcctgttctttcattaatatttttcccatgcaacttattattgtggttgaaaagttgacaacaattcgttctctgtcattttttggtctaattcatcggtcttgaagtgtgcaaggttttttctttgtaagtctcaggcattttactaggatttgcttacctgtgtttctttttttttaaatcttttatccagtaacttagtgacccctacctagctgtagttgccaatatcagcattgttttcacactttaaaaaattttttctttcataatttctatttttgtgcttcgttttgagatatttcctccacttgatctcccagcgcaatcattaagatgtcattagtgattcttctgttctcagtctatctacaaaagttaaattcttttaaaaaaaaacatatttttattcacattcctttgagaactaaatttttaaaatatcttctgtttaggtggacttaagtgaaatttctctgaattcccttgttgtttattcaggctggcatctgagttctctagcaagtctgtttcatttaaaataaatacaaatacttgtgtttttacttattattcctgtcttttgctgccattattttgcctcaccatacaccagtctgattgttggaatgctttatgttgctaagccctgaaattggtgggctgtctctggctttaaaagaataccaggtggtatgaaatctttgtccgccagaagccaggagtaatcctgcctgatacctgattttctcagttacaaagctagggcatttctagccttaggaatatgggtgaaacaatggtctagaagctcttccggggccataaaaaccactaggtcttttgggtgatggtttcttaagtgagtattgcatttaattaatcagagtctcccagtactattcaggttaccagagctccctttattttctaagattcattcatgttctgttctttgttgcttatctttacagctctggttctcattctttcattagggcccagagttacgtgctatttttctgaataccaatagaaaccttaggcttatttcagatgctctgccaacccctgaagattcttctctcaggaggggtgttggttaattgaatttgattaggagggaaggacaacaggaatgcattcgggaattctcaatgatttgttttcagaagtatactttaattgacagtaattactgtcagttgcagtaattgattgatacaggagtagccaactattgtgtggcaaggaataaagtgagtgctggccagagcatctgtgagggggcaggttatgccagtgggctcattttaccagcaattcaattccacattcgttgaacacttaaagtatgttctaggcactgtatcaagctggtccatgaaatgatattgtgaataaggcaaggatagtgctttcaatgtgcccacaaaacagggttggcacaggaggaatgaagggaatggagagcatgtcaactaatggggggtttcagctgtgtagtcttctccaagagaaatgcttacaaggtaaagcacaatgccacagcaccatctcattctgccttcttcctctaatgatcaaggcctgtaagctctttagtaacctctctgatgcaggtatcacttcaagcatcagtgaacaaatcatgccagcagcctccagccttaccctgtatgacctggttgcttagcactgccaacaagttcctactaggtcggagtgtactaattagtcacaatggaactgttatggatctatactgtcagtagtgtttaaagtttcttcttcctgcacttttaaaattatattccaaccaagaaatgattgtttacatatatttgagattgtgacgaatatgacaataaagacaaaatcatcagatgacatatgaaacagtttgatgattttgtttctggatataggcatagaatattttcatgaattaaatttttaaacttactttccttcttgaatcatggtaatgtaatattttctctcctttatatgacttctaagcagagtagcttaactaatatatgtatctgtttattaaaaaattcctttggaaattgttgtcaaattatgaattaattagtattccttttaaaaaaataaaagactaaaaaccaaattatgatagttaccacaaagtgagcaagtattttaatttttttaacatatatttctattgcagttttcaaaaatttcttttctattttataagttcaattaatgttagaaagaaaaacatcatctgcttacataaaaattacatgttaactaaaagctgtattaaaaagtgtaattcattaaaggtaatatcaattattctacaattattaggggctaaatgcaaattttcttgagaactgcagatgatttcaactctcggtaatgttgttgccacataaaatataaaatgagtaaagattttaagagtttattttgatgtttcaaggtagtttgattaaatataacataaatacatgcaactacatgatacattagaaagaaatgttctgagtaagaagtctggtctggaacatcgagggtatagtttttatgtaagtgtttttaaagtagaattaaattttgatacaaagatatgttgttatccacccagagttcttggaaatatattacagcagaaataatagtataattttgcaaataaaagcaatgaactaatgccatgtgatttcttttttttttttttttttttttttttttcctatacgaagtcttgctctgtcacccaggctagagtgcagtgcggcaatctcagctcactgcaacctccgcctcctgggttcaagcaaatctcttgccccagcctactgaatagctgggattataggcgcctgccaccacgcccagctgatttttgtatttttagtagagacggggtttcaccatgttagccaggctgatctcaaactgctgaccccatgatcagcccaccttagcttcccaaagtgctgggattacagacatgccatatgattttcaaaagcaaagataaaaaattaaggtttcttattacaggtggttttaaaatgagttccttgaaatgtggataccttgatcacagttttatgtaaacgctttctttctagaaatccagaaagcctgtactaattatgtacatgctatatagtatgtaacaacatgacaataaaaagatagtatcttccattctcattatagttagcaaaccctaaattttaaaaacaatatttctgcttgaatttcagagattgtaatattaaataagtttagtttctcctttctgttttctgattcttatgtaaaattagtttactaagctcattttagaattaagttatcaagatacagcatattggcattgaaaattaccccacctcaaagagagatacaatgaaatcatccaatccaatttagtttacactatggttctatccaaatcccttggtgtcatttccgttttttatgaggtttcctaaaaagatgtcccaatattatttgaagtatgtgattattgtgataatttgataatgtatcactaaattgtttccatgatccttatagctgtgcttctcaatccaatgcatcattcagttgtttgattaaatgccaatgctgtctgaaatgctgtctgatactgagtcccagaacagcatgatttccttcccactgaacatacataacactgtataattttacttttcttataacgcttatagttacaacttaatgccaggaattatttttcctactttataaagctagagtaaacctgaaggaaagtttttctacttaataaagtgcccagggatctctaacagatctattatagaataatcatgaatatttattgagcttaatgaggtagaggtatatagttaatgaagaactggaggagctcaagaagagtaaacctctctccccaatctcaaaataataacagttagattgaaaatataagaaataaaagtatgaaaatagcaataaaaatttatatatcatttcaagaccaaaaatgtgtagtacattattaattgtcaactacgtaaagcagaccataattgatggatgacttcatagaaaagaaaaatcacattagggtgctgatgttgagaaaggatttttatagaaattggaaaagtaattttgatgaatgagtaaaatttccatacccagaagagaggagaaaagggttttctttgtgtatggaataatgtaagcaaagtcatagaggtgtgattctaagagaaatcacatgagatgagattctaagagaaaagacatgagaatgggagaaaaacccaaattcctagaggcctctgtgtggtagggaatattacatgtcaggactgtgtgctacctaagcaagttggaaaataggattcagggtggtggtgataaggagacagctgtagaaaaaatgatcaaatctacagactctttgcaggaatatgttgagattgactccagaagagaatggaccaattgtatttggagttcctgtacctaataaacaacataattttctcatgccgaaggaagttaataggaaatctttttctttcatatgttttggtgcagttgttgagataatttttatcactaataaggttcagcctcttcaactagaaaagcacaactcttcctgatatgcttagggatagatcatgaatatttggcaggcagtttgataaaactcttataaaaaaacagataggttcctaaaataatcacactggctggcatccaagatttcattaaaatcgtaccttttctatcttgcttttaaactgaaatttattttgttatcaaagagaaaacatttcattttgggatatcaaaactttaggtgcatctacatgagccaataatattcagaatttttttccaatataaatatttatactagaaaataaaattgtacttgttttgtaccagaatacaagtcaaactaataataatgggtccaaatattgcaagaaacattttattaattaaaccgtcgaatcatttaaaagagaaaatgtaacttaagatggtgcgaagatggcatcaagtagtagagttaatctacaaaacttgagagcttttacactacataaaccatagtggctttttgaatagcctcataaaacgcagtgtcattgccattctgctcacaacatgtggattctctcttctgcaaatagaataggactcttggagcaatcataatgtaagcccactgaattttctcatttattttctgtacttataaagaatgctgtccataactttttatttttaatggcctggattaaatggcaactttctactgctgacaaaaaggcaaaatcctatgaagaagtcagagtcatatcaagtgctcctaaattataatatagatcttttccctatttttcttctttcttccttcttcctttctttttgcaagttaacatatataaaacacctgttcttattcttaagcatgcacagcatagtgataaaattttgcacagtcaatggtcatgatgcccacgggttagtgttgtaatagataagtgaatttaatgccacatgtgccctttgttagagtctggaaaacagtatgttaggggagtggaggagagggagttgtgaggtgacaaggaaagcttacaagaaagacattgctttaatctgttattgcagatgttaatcagagaagacagtagggataaagtggaagacccagaggacaggactacttggcaggcattctaaatttttgttgaatatatcttttagtgcaatgtatatctttaatcctcagcagagctttatattgatatacacttctaaataagtattgttcacaaaagaagagtgtcaataagttatatattctaccaccatttcctgaaatctctttttatatttgagatcaagaattatagaagctggcatttattatattgagcaataaagatacttcaatcaacattaaatgaaagtaggtatagattaagaatggcagttcttctgcatttgcatattgactaagcacatgaaaatgtatatattgaattcatggactattttaaaattaaggaaacactttggagctttatatagtgataatttgggcaatttagtgtagtagtaactgaattctagaagtacatgtggccaagattcaagggatacaaaatatagcatgcagtaaaaaaaggaaaatcaactgtaggcaaccagcttgatgccagaatgtggtggtgggattctaaatgattctgtgataaatgagttgagctgctttctaggaaattggagaggagaacaacaatagctttctggacagaactttaagtgactatgtgacacaatatctgtatggtcattcaaagtgtcatggatgcataaaacaggttgtattaagtacaattttaagcaaatgtgaaagagggaagctgtttttagaaaagaaatatataataacattttattggcatgagcaaaataatcagaagaaacattgatggccagttgattatattgggaaaagtttgtcatgactatgaagagtactgaatcttgttgaatgtctgagcacatgacagcttgaaaattgtcttttttttattagattaagagaaaatgattttctggcatgtattctcactgtatcccttacctatatacgataatacatttctatccttttcttcttgctttgctgaaggcagttattaggaattggagaatacagagcattcaggtattcccaaataatatacattcacctcctttgagacaataggttgatgtggtatgtgtcttcctatttctactcaggatataacagaaacaaaaaggtagcaattggcgtcatcagtttctgaaaaaaatctttcattttttctaatatgtcttttatttatcttcttcatcttgttctctatttctctgtcagcctcctgtgcttctactgctaaatggattatttcctctaatactttagcatccctgcctcctgctcaggctatgtcactttccctccctaatttcactgcaaatctctttgaaaaaaagcagtctactttcactatctctattcttcactgtcaattcatgtgttaatttattacaatctggcttccttctatccccagcattttgatgattctattctgtcagaatattgtgaggttaatgtttttgatagctttacatgcagtatttcacttcagtcccctttgaagagtgtcatatatttcctgcagggatatttctttgaaactacagagcatatcacagctccttctaagatgatacaccacttggatgtcctgaaaaaatctcaaactcaagacattgaaaatgaaaaattatattatttcccactgcctactccactgctactaatgtgctttctcgtgtataattgtgtgtgtgtgtgtgtgtgtgtgtttgtgtgtatgaagggcatcactgtttacttggtcctcaatataaaacctttggaatcctctccctttcactattcctcataacccctatgtagttaatttctgagtccagttttttttaattgaataaaaatttaaaaaataaaaaatcagtacaagagctacttctgtaaaaactctcaatattgtccttatttttatctatcttagcagtgagtacttaatatctttttttcagtttttccttcttcctttcctcttttacctgatgcaatagctttataacagtgcttcttgcctcagttgcttcctggcaaacaacatataacactcttggaatgtgagtctcaggtttccaacttcatctcaagtcattcttcaaggtattctagtatgtgctaaattcacacagcattagtgccatgtttgtagcaagccctttcatatggtccatgctttgggctgtgtagcctctattatgtagaatacccttccctggctttactgcattgtaaattccttcacagcacagtacaaaaaatccacttctttcataaattatttctgtcttaggcagaaatattctattttatttattttagtagcactttttgcagcatcatattttactggaaggtccttatgtttctgaaactcaaaatagactatttttcctaggaacagtatttatatcttattctttttgtaaacacagtttttgaaaaagtgtctggtacatagtaggaattcagaaacagttgttgtataaagtactttcattatagcacttattgcattccatttattgattcaattaacacatattcattgaaaaccttctacataccactcatactacaactgtgagtggtatgtagttctagtgcttaaggtatggcagtaaatacttgataggacatattctatcggtaaatactgataggacatattctagaaggggataagggaagaaataagtactatgaagaaatcaacgaatggtatattttgaacactgacagatctaagtgttattttaggaagggaggtcatggaggcccttactgaggaagtggcattcagttgagacctgtacaatataaaggagcaaagatctaggagaagacactgagaaagagcaggcacaaaagccggaagggagacataagtataccatgttgtaggaatggcaagaagacttggtgtttggagaagaggaaagaaaagttctagaagatggtgcgagagagttggatcttgtaagtctgagtaaggaggttggatttcattctaagcaagatgggagaactttgggagatcttgagcagggaatggcagacaatactttttttaaaggatgcctgagagaggaaagagtttaagtggagagaacagttaggaggctaataaaatccccagttgaaataactgtggtttgtaccaaggtagttgctgtagaggtgttgagcagtagttagatccaggatccattttgaagatgtattacataaaaataactcaggaggcttagacgggaggcacacttgagcccaggagtttgaggttatagtgagctatgattgcaccactgcactatagcctgggcgacagagtgagaccctgtctgttaaaaaacaaacaaacaaacaaaccaaaaaagaaagaaagaactgatagattggatttggagttgaacataaaagaggagtcaagaataattactgtgtttataacatgagcaataatataaatgacgatattattaaaaatggacaaaacttcagaaaaaaacataaccattagtttacttgtttgtatctccaatagaatatgaactcagtgaaggcagggctcttggcttattcttctttgtatctttaatacagtgcttagcagaagtagacacttaataaaaagtgatcatctctggatcttaatcagcaaacaactattggcactattctcactttttaaaaaattatctttccttcattcactcaactgatgttattgagtacctactaaatgcactgaggcaaaaaggatatattaatgaataaaacagacataaatgcttgttctcatggaacctatgggtttataatccagtgagatgatttctatgatataaaactaaataaaatatagagtgtattagattgtgataagtgcttcagaaaagttaagtagaaaaaggacattgaggtagagtagtggcattgcaaattaatagagtggttgaaaagggcatttctttggttaatacctttatgaaatgagactttgagataattaagtatttgagtaaagagcattgtggctcaaggaaacagcatgcacagaagctctgagatagcagcatgctcggtatattgtaggaacaccaaaagcccagtgttgccagatcatactttaaaaaatagagcagaaaaatgtgcattccaagggataagggaaggccaaattatgaaaagccatgttggctactgtgaggattttgacttttactctgagaaaaatgggaagacaactagagtttttcagcaggctaatgtcatattctgacatatactttcacagaattcctctggatactgcgttaataagagactgtattgggttggaagggttgaggggacagaaataagcaaaacaacagctacaataatctgagagggtggatgcccagtccaaggtggtaatagtgaatgatagtaactatggtttaactgtggatatatcttgaagtcagaatctatagaactttctgataggttgatttggggcaagagagaaaaaaagcatataaggttttggatctgaaccagtacaatggatttgtcatttactgagatggagaaatcaatgaggaagatgaggagctcgtatttgaatttgaacctattgaatttgagatatccattagacatctgattatagacagcacagaggagttttccacataaccctgaaatacacattgcaggctaagaagtgtccaggctagaggtatgaatttaggagtaatcaaattttagctatttttcaagtcgaaagactgggtatagtcatcaagggtttgatagaagcaaactctagggaagttcaaagttaagaaatagtgggttgtgaggaaaggagaggggaagatggagagagggtgagtacaaagttacaattagatacgaagaatacactctagtgttctattgcacagtagggtgactatggttaacaataagtcatagtatgttacgaaatacgtaggaaagagtttggatatccaaactacaaataaatgataaattcatgaggtaatggatacccggattaccctgaattgatcattagaaagcatatatacgtattaaaacatcaagccatatcccataaatatgtacaattacaatgtgtcaattaaaaaaaaaaaaacagtggcaataagaaggaatccagtaaagagtgtgctttctaaaacaaaaaccaggagcgtgatgtcttagaagtcaagtaaataacatacttaaatatggataaagtgagtaaatatgtagaatactgagagtttggcttaccataagatttattgtctgttttagtccttcctgtattgctataaacacatacctgaggctgggttatttacaaagaaaaatggtttaatttggctcattgttctgtaggctgtacaggaagcataatgctgacatatccttagcttctaggcaggccttagggagcttacaatcatggcagaaggtgaagagggagccaacacatcacatggcaagagtgggagcaagagagaagtggaggaggttctaagcccactttaacaactagatcacacataaactaccagagtgagaacacacttatcaccaaggggatggcactaatccgttcatgaagaatctgcccccatgatccaaatacctcccaccaggtccaccgccaacactgggaatcacattttaacatgagatttagaggagacaaacatccaaatcatattatcatccaatctggtacacttctgaaaatgaaaggggtcactattagttacatctaaactataaatacaaactggtactctttcaggaaacctggaatatatagtcaccaagtgacatttcaagtatgatgaagactgataaataatcgttgcattcagcactgtagagatcttgattaccttaagaattaaaatattgttaaaatattaggattaaaagtctagttgaatcagttcaagagaggaaggaaattggagatagtaggaacaagcaaatcaatgaaagttttgctataaaaattaagtggagctgaaggaggttgtggggaaaagatgtttggttttaattgaaataaaatacacataatgtaaaattttctagtttaatgattttaactatgtgtggtagagtgacattaattgtatttttgtgcagcaatcactaccatccctctctagagactttttattttaatgaactgaagctctgtacccattatatataatacctcagtctcccatcccctcaactcctgacattcaccattctacatcccatgtccatgaatttatccaagacaatgaccattctatttttttttttcttatgtaaggtactgtaggtactttactcactgtggatacctcatacaagtggaatcatgtagtatttgtcctttgcaattggcttatttcacttagcatagtatcttcaaggttcatttatgctgtagcatgtttcagaatactcttgcttctaaggctgaataatatttcattgtatgtgttataacatattttacttaccatttatctgtctatagacatctgtgtggctttcaccttttggccgttatgaataatgctgctctaagcatggttgtataaatattcattcatgtgagttcattcaagtctctccttttaattcttttggatatatacgattattttaagacaaaagaaattctaaaacatagtaagctttctctatgtctgtcagccagtaaagaatctggaaaagagatgaattatttgtcactatgtccagcaaatagctccagatatcatttaggaaggaaaattacaaacttaaatgacaatgagcctttataaatgctttaactaaattaatattttggggtcctaggtaggtagaggtatacactatgattaataataaagcatatttattgtctattcaaagttctgtttcattgcttggtgcctacaccttagttctgtgtgttttcagaatctaccttaatagatattttagcttatatctcaactggcaaatcatatcctgttagaagtaagaatgggatagttttatttgtataaccactaaagattgaccctgagaacgtaattatatagttattctttttactctgcctcttttttagttggctgtaatatttttgaaaaagtatcattttaatagatgtgtattgtggttgagtcttaaagttttaacttactttgaattgagtgagacattgagtgaacacacatttgtgaatatatcataaaacataagtacaagattaacatatagaatggctcctagagaatactttagcaaatagtgtaaacagcacatttgcaagatttttatagcaatgacaaccttcctaaactggtgtgtactgtattcgtgtatatggatttgtatcattgttaattgctgtgatctttgtcaataaaagctgactctttcttaattaacctattgcccctatcttaccaatagcatcagttagacattacaacattattattcaatacagtggaacacattttgtcacaggattctggcaccttgaaattgatcagtacaagcaggtttactagagaatgaaaaattttggccaagcttctgtttctatcacacaccatgttctgcttaattctgggaactctatgcacattgacaggagaaagtttgagttcctggagtattgcacgttcttgtttcaaaggtttcaaagtctttgcacacagggccacctttactcaaaaataattcctcctctttgcctctatttcaatggtgaatttcacaaagaagtatttttttgactgtatcctaagttagctccctcttatacaatatcatagcacaatgtagcactctttcctagtacttattatcattgtaactttacattttttgtatggtgatttcactaacctctgcttcacctacaaaactgtcagcaccatatgggtagagatcctgcctgctttcactcaatgctgcgtccctcttccttgcatagtgctggatactgtagtctgtactcagaaatatttattgaatgagttgaagggtaaataaatgaatgaatgattgataaagatctataaaggaaaactattttgaaatatattttatgtgagtttaatgtactgtgtagacctctaattagaaagcatagcatagaacttggttaccagtttcttcaggattttgaagacgaattgaacaataaaaagttaagagctgatatcaaggacctaagctgtattttcatttcatcaccttgaattgaaactttggaactgtgggacatggaaggaccaacaatgggcaggcatttctcaggggaagactataaataaaaaacatgaaaagggtttgttgtttctttactaaactgcttatatgagccaactgatgagttctgttttacccataacagccttaatttcacatagacagcattatattattgatccacatattttattgtattctgaatctgtcatgttcaacccttatgtataactgtaatttgatagtacagcttattttataaatcactttataatcactttgacagcacaagttactttataatcccaataaacttgagatatatgaaagtttattgaatttattattgatagtgtgaataagaaatcatttagcacttctatgactcaggtactgatttaggtaatttacatacatttttagtttttaagatattttacatttcattttcaactaaatgaaaagaaagtctgctatttccataggctgtgaaaatctaatgttactatactcagtcaagtttaaatagatatactgttactaccactgctagctgatgtgtcctcactgacttcacaagttttcacaatgaagaatgatcatataaaatcttagatctttctatgaagaattacacttctatagcaattggtatccatatagactatgtgacaaaaaggacagaagtggccactggtcatttccacataatacacatgttaaaactgtactttgctctatggctgctgctgctgctatttgtaaaactcagctctgcttgaatccctgcctcatagtcacaaagcctgccagactcctttgatcacaaagttaccccatgcctgcagccatgctctaagttggtctgtctgtttctcttctttctaagcagtgatattagaggttgtggctcagtatgtgtataaagtatttcttcttcttacctttttgcaattgccctatatcaggtctccatccagcagcggattggattagtgattctccacaattgccctcaactatgcagaaataccaagctgagggaagtgcagtttcttcttgacatagtcgatacatataatgttgttatatttttatattgacgtgatgacttagtataaattatacttcatttgtagtttttaatttcatttctgattccactatgagaatgaggaaaaattgctaagctatattaaaattctgttgttcaccattttttatttctgttcctacatagaattcaccattgaaatccaattaacacaagtctttaataaactgtgatcactgtagtgcccgtcaccttgtttcttaaaactaatcttctaattaaactatcaactaaaatagacaacataaaagacaataaattatttccattgaattataaaagattatattgaataactatatgtttttcctctgggatctattttttcacttgttaatttattacaaagaggttggatttcagctcagaagaatctcatttcctggcaattataataagagagtattccaaccaatcaagaagtccagtgattttattaataatgggtttatcctatgtgactagttcagaggccatcagataactttcgaaagttttatatttgttctggataaaatctaccttgggtattgtagaagtatattcacacaaatggtacagctgctacaatcttgttatttatgtgatatttattgagtacctactaacggttgagctttgttttaaataattggatacattctgtgattaacagagaaaaaaagaatattgttcttttgtttgtcgatgttacctacattttgtgactttctacgaaggcaaattattctgacactagtttctcacttcatttgtcagaatgattaacatttttacatagaaagtagatttttttaaaaaattgatagtcaggctcatatggagagtcctgcagaccccaaaccactcaatgttgccttccttaaaccatgttactttatgtttttgctagaaaattatcgttctgtcagatacatgtaaaagaaaagtcacacaaggcttgtagttgggatctttctgttctttataactcaaatattttgtttgaaaattatgtggaggaatgcttaacgtatgctgcagagaatcaactcaactagccctaaagggaaagactggctagtacattttgctttgttaaactttatttgatggtaagatgcagttttgctataacttttgaccttttggtttataatgtcattcatgttgtatatatcctttattctataacaattctttgaattctaggagtaactttgtaggcaatcaaatacttaaaataaccaacaacttctttactataacatcattaaaataaaccacatttaatagtaggcaatcaatgatgttcagctttgacccagagttgacccatcttctctagtaatagcaaccctatcgtttcaaattacaatcagttcacaaaatcattttaatgatatcagattggaagaaagccctgtgtggtttgacagctgtgctctatatttaagctcagataaggctcactttaaagcagcatgtctttgtagtcatgtagctccttaatgctgtgacacgtctgtgattctgtgcatcaatcatggcggcagaaaaccataaccttccctaagaggaggtgccaggcaaacaggcaacgagatgagtgttgccatgtttcggttactgtgcaggcttcctgcagtgtaaattcccaatgtcccttcttagctcccactggctctcgacactctcatcttctttataccctttccaggaatacagtctgctcttcttcgttaggttgtgatggtaggtagtagattctttgcctaattactttctttctatggattttattatttataaaaatataatcatagctctgttttcattttaaggatgtgactaataagcaccattaacaaggtggtaagaaatcatacagagagataaaaagagaaacttataaacatatctgggatagttacatattttgaagacttttttcacttcttatagtattgctctttgcttgtataataatgaccaatttgccacgtactggatgccctcgtaggcttacccagcttttcaatcataaagtcagaattcaaaccctactcataataagatcgttcagcaagacggctcctactctttgtagcaaatagtcccaaaggtaaatttaaagtgaaacaacaggaaagaaattagttcctcccatttttttagtcatttgttcatttgctttatttattcaaacactccttcatttttcactcatgatagaatatttcataatgttatctttcatcatatttattgagagctggtaaacaaaaatgaaagtgttcatacctttgaggatataatgatactttgtaagcaaaagtcttggaaagcttctcatattttagatattattctgttaatttgtgtgtgtgaatgtgtatgttgttaaaaaatattaaatatctttcaactatattggcctcatatcttctgtttccttttaacgtatatgaacaaggtcagtcataaatagttgaaccaaaaaatgagtagtacttgggtttaattcagaagactgtgccttcagtcagctacatgaggtagtagtttttaccataacattttccagagttaaaatagtcaatttttaaaaatttctggaagtatatgaaaagtacttttaaggaaatgttccaaatattaatacatctcacttggttttccagtattgagtgccactatgtggagacccacattttgtgtccatatctataaatcactttatcagcttttgaggtctatcaaagatgaacaatattttcagataggcaaaaacaaacaaacaaacaaaaaaccaaaaaaacccactgtattgtaatgcaataacaagattttataagtaacttctagaggtaaagtgttttctcatcaaatgaagaaatgaacttctaaacttatatcaagtagctgaacaataactacttttccccacccataccccatttctacaatcttataatgagtgtgtctgtgcctcccatcttctctctctttctctctcccttttcttctcctactcttcatccccctttttttttctttctctgttatttttttcagagcagatttaggctcttcagtggattctttgcctgataattctccaaattaggagttaaggtaaaggttagctcaacaggcttattgctactataaattaaatcctggccctgccaagatacaaaagctcagaatatacctgcaccaagatccaatttgcttttcacagatttaaaccttacaaggaaaagccttaagttagtgcatttggttgagcactgaagctggttactggtgaaagttaaaagaagtttaaaaatgagaaagacaaatactgcatcattccacttatatgaggtatccaaagtagtaaaatatgtagagagagacagtcaaatggtggatgccagaggattgtgggaggaggaaatggaggattatttaatgggtatagagtttcagttttgcaagatagaaaagttctggaaatttttttttcacaacaatgggaatacacttgaaactattgaactgtacatttaaaagtagttaaagtgtaatttaccacagttaaaaataaagtaaaataaataaatacataaaaggtattgacctttaagaaatagtttattccttttaaatgcagtcatttactagaatattacatggaatctcttcaattatcttcctttttctgaaaatagacaagctgtaccattctttgaagcaaagtattataaactatcttgccacatagtttatcacaagtgatcagttttgaaataaatagcctattgggataaaacatcacatttactttaatccatatgaaatggttgatactggataattttctgacacagagttttgaccaatgtaagaaaaacagaattccagaaccccaaattgaagacaaactatgatagtatgtcatagctggggtgaggaataagggaaataaatatgcatattgaaatacatgtatcaaatttaacctttatttagcttggtttagttataattttaattatttattcaaataatactcaatggcagcataggatggcatgaatttttaaaaaattatcaagcccaaacctgagaagcatttgcctaaaagtcactaaagaaaaaagtcatttaattcataattttgctaagggaggaattctacccataagttattgtgaagaacaaatgagatatgccattagtaattagatatttacctgctataatatctaaaaattaccctacctagaagaaatgtaaagttttctttatttcaaagttctcagaatctaagtactaaaaagtaattcacctagaaaacgtaattttatgtgcaactacacaggcacataaaggccatagtcctaataccatgaattagagctcttgtactgaatccctctgggtcttcagagaaccataactaataggatatgcatatatatatcttatatatgagattatatatatatatgtatgtatatataagagcgagagagagattgctttattataggaaattggtttacatatttataaaaaagaataagtcccaagatctccatttagcaagctgagacccaggagaaccaatggtgtagtggtttcagtctgagtccaaaggcctgagaataaggagagctgatggtttaagttacagttttaacctgagtttgaatacaggagaaaactgatgtcgaggctcaaatagagtctaggcagaaaaagtgaattctctcttactcagtcctttggataaggtccacccatattggggggcggaatttgcttttctcagtctaccgattcaaatgttaatctcatctagaaacaccctcacagacattcccagaatagtgtttaaccaagtatctaggcactccatgaccctttcagtttgacacaaaaaagtaacctttacaagtccaccctttgtcaacttggcacccatatgcaactccttaagtcatacttaatctccaaatgaaggaaataagaagttcataatttttcctaatatgatacagctatcctgtgtacagttgaaaatgtactaaacccttccccagaagaggaagtagagttcttgattaatgtttactcttcttcaggataatgtaatattaataatacttaaatattagaatatgaagtcaacataccttatgttacatgatgaggaaataagagaaggaagaaaacaaagatattttctatacacatgaacatattgataaaaaaaaacaaggaatatgtatgacaatgacagtcctcatttttgtaactgttcacatgggcatagctggtgtttataactaccttcttccactgccaattttgtattctctttgccttcagcaagcatctctgctgattgtgtttctttaccaggtggagtgacctaagccctgcctggatgaggttgctctagttttccattgatcttaatcacagggaatggtatgctaataggcgccctaaagatctcctacagatgcactctttcttacctccattggggagtgctattccaattcccccttggtagtcaggatcaatcatgctaagctggaacagtgactcttttccctgatggctaattcagatgcgtgaggagctcaaagtggccaggtggcagtcttaacttccagttcaatggcatcattgtgtctcaatcaacatagaagcattcctccctttgtaactaagatctctaggccagcagaggataaggtcatagggacaggaaacagaaacttagaaatttggattgtggatcactagaggaaatagtgaatgatgccacttccattttgccctgagctgagaaaaaaaggaaacataacagttattgagttatgagccattataacaattaccgttcataagtaataacaatttcactgttttcagaacattatataatatttttagaacaaaaactacctcaataaataaatttattgagtttaatatttaaaataagaaattccagttatcacaaaagtgatctccctaaccagtagtaatcagcatatcatttgcaaagaattcaggtgcaaatataaacatttaaaaaaattccttaatactacacttcttattactattgaaatttcacagttgtcttagaagtaaataattcttgacacatgatttatctatgttatgcaagttttattatataacaaacaagtataaaaactaaaaatcataaaaatataaaagaaagtcatatttcagatttgctacattttaatagtatcgacaatttatttaaaagatttgctaaaataaatgagttattaaatgctcaggattcactatttactgagcattactaaacatttactaaacatttaattcactgagctattattgtccttatctctgttgcatagaattcctttattcacagagaatcatttattgaatacattctatttgacaaatattatataaattggcaagaaatccaaatttaggcaaatttttcctggaggaaatggtgcctgagcttatcttaaatgataaaccagcatgataagagtgacgaatcatgttggttaataaaatttcttgcagagggggcattataagaaaagacatgtgagaatcagcatggaatagttgtgtgagtgtatatggccggcagtacaaatggcttagtctcctggaaagataagaattgagagagcagaggcatataatagatggtgcagcattttgtaaaatatatttttgagttaattcatttaataatacatgtagtcatttattattatgtacccagcactcttctaagtgcttgggaaatagtaaacaacaaatcaagattccatccctcgtggagcctatattgtacaacattagaaactaactagtgcttttgggggaaattgaataagataaagataatccactgtggggcagatagagtaggggctggtggcagtattaaggaggagcataggagtagagataatagagaaggtgatatatgagcgaattcctgaagaagatgagggagatagccaggcagatatttgggagaagagcattccagacacaggaaagagatagaacacatattctaaggttaaattgtgccttgcaatgtcaggctgaaggaacaataaggaggcaggggtcactccattatagtaaacagggaaaaaaaataacaggaaagcagtacaaaagatgaacagagagcaagacgatgcagggcgttataagccattgtgacaacttacacatttactctgagtcaaacagaaaatcactggagggtttttcagcagaggaagcaggatctgagatctgacttaggctttaaaactgtcattccagctgctgagatgtgactaaatttcacaaagtgcaaaggtggaagtaggaaccctcctaatgaagctattgacttaatcatctctagctgatagttgctccagcaacgctgctagtagtggaagtggtgagtagtcaagttatttatatgactgttaggtagagcctgaaggattttctcatggattggatgtaggatcagagcaagagcagtagtcaaagataacttcaagttttggggttgggaaaattgagaggaaggaatgcttctcaaatgagattggcaaggcaatgacaggacaggtttgctgagaaatgtgaggagttcattattggacatagaaagttgatgatgtttactaaaaaatcaaatagagacaaaaaacgagtaattagatattcagaaatttgcatggccccttaagcagtggaaagcctctgcaaggttttaagtttggaggaattatagccaattgtatgctgtagtttagtgctctctggtgataaataaaggagatagttctgaaagaataaaagactgagctaagggagaacagttaatagttttgtatagcaagataatttcaacaaataaacactgagtggtggcaaagatgggtaagaataggatgacttgagaaatactttacaagtaaaaatcatcatggccatgattgtgagtccaagagagagggaaaagtaaaatagttttctaaattgattgacttgttaaatgtaaatgtcattatctgaaatcaagagtgcagataaaaagcatatttaggtggaagatatttttgacttgtttcaatttcagctcatatggaatattcagatggaggcaaccagtagacagttgtaaatattagagtaaaattctggggacaggtccaagcagagcatataagttaaggcaaaaattagattaattttaaagttgaaaccatgagatcagatgtgagcatgtttgagagtaaaacatggaatattcccaagatatccaaatgaatgcaaccacttaaaatttaggtaaaggaagagagacatgtgaaagaaattatagactggttatagcaaggaaagtcatgagtcactggtaaaggaataaaaatttcaaaaataatatgatccactatgttctttgcacacagtcactctgtaagataaagactgtaaaagtatgctagaaatgagatcttggtgatagttgtgatagcaggttcagcagagggacgcaggtggaagtagaaggacacagaagtgggctgtgtacagagtcaggtgacaacaggggctcagagagtgggagtgaaaacagggcctacacttccaagaggttctaacaagaagggaagggataaggtggaactgtagctttggttgtgggcaaagagagaattacattatcctctaagagtatcatgtctccctcattactgggaggaaggaatataggaaacaggacaattggagcaaagtcccatagaaggtaagatgtgcttaaaggggaattttactttactgttaacagcatagatgttgatgaggaagaacaatccttcagataaatgtataggggttaagaggaagaaagtcaaggaaaactatgttttttgaccacgaactttttgatggagccctaagagttgtctttattggtaaacaagggttgagtacaaacttgaaatacttgcagaagaaaatagaagtaaatcctagacttagggagtcaaaaggattaatgggtatattaatttccttttgctactgcaaaatttaacataaatgtaatgactttaacaaacactgctttattactttacaggtctataggtcagaagtctaacatgggtatcagtagctgaaattaaggtgtcagcaggcctatatatctttctgctctaggatttccttgtctttttttttttttttttttttttgtttaccatctagaggctgtcttttttccttggttatgacttctcatatactcactgtcaccaatggtcagttgagccttcctcacaccacaatgcactgaccatgactcttttgtctctctcttccacattgaaaggatcctggtaattacattggacctccccgaaaaatccagggtactttccctatcttaaagtcaacttgttaacaaacttaattccgtctactttcttagtttcctgtgccatgtaacctaacatattcacagtgggctgtgtacagagtcaggtgacaacaggggctcagagagtgggagtgaaaacctaatatattcacattttccaggaattaggaggtagataccttctggaaactgatatctttgggaaaccaatgtcttgcctatgacaatggctgatgttgagggtcaagctgaatttagatacagtgaatggaaattatacgaatttgtacagggacatttacagagcacaataaaggaatataaacccttggttttagcatggattcagggttcaaacttgtggttttcatggaagaataggaatacagatgaataatgtgataatgagagagtattttttatactctctcagtataaaagaaaaccaaagtgtccagactcatttgcaaaagaaaaggctgatcagttgcagagagtggctgtgaggtgggaaatggaggaatcaaagaactggtggaaccaatgagatggaaaaatagctactatatatttaagaaagtaaaagaaccaaaagagaatattcagagaataggacatttgaatataaaaatcttagagtcagattggtactcggtgaaaaaaaaacaaaaacaaaaagaggacataagcgttagaataagtggttaaagaacagtggaaatgatgatcattgaagtggaggcagtcaagcatttgttaagttatggtgtcaaatggaccttacataccctaaaatcacctagggtgatggctgaccttgcagtagcaagaccatgagactcatctgtcctaaatcactgagggagaactgtcaggaaagtagtcaaatatggaggtactcacagtggaggtacagatggcatgagaaaaaagaagcagagatttatacttgaatctagaaaagaaactatctggaagcagctttagaaaaacagaagaagcctccctctacctcctgacactggagtctgtaagaggaatgagaataaagaaccatttcctagagatgagtgcagaggaaattttgggttgagccaggttttatttaaggcacaaaaatgatgacacggcaccataagcaggtgaagatgcagagacatttgtttaaccatagaggagcacttaaatggcacagtggaaagttttgcaagggagagtagcatttggagccagagagaggaattgtagagcagtattctatgctggtgagaacgcaagagaagttaaagggctctaagttattgaacttttaaatgacaacaaaggatagaagtgataagttttcacaaagaacgctctctatatatttatactaccacggatgaaaacagaggttctatggtttgtaggaagctgatcaagttaagagtagatggtatcatttatagatactacagcaagctcaggaacaagtctcaaatagatgggtcatctctaaaaaggaagaagggaaaaagggaggcaaggaagtaaagatggaaggatggaaggaaagaaggaaggagtcaaggaattaaaaagagagaaatagaagaaaattcattagattttttcccagtgctataatgatagtaaatttgtcctagaatactatcaacacagcccctgatattatcctttatttttcaggatggcattaaaaaccaaaaattttgatagttgcattttttgtttgttttgtttttgagatggagttttgctattgttgcccaggcaggagtgcaatggagcgatctcggctcactgcaacctccacctcccaggttcaagggattcacctgcctcagtctcccaagtagctgggattataggtgcccacaacatgccaggctaattttttgtatttttagtagagccagggtttcaccatgttggccaggctagtcttgaactcctgcccatatgtgatccacttacctcagcttcccaaagtgctgggattacaggcatgagccactgcacccagccaatggttgcatttttaaatattaaaatgtaagccttaagttaggtcaattctgcattaaaataaacacctatctaattggccacatgcacacacacacacacacacaaacacacgcacagtcttcctgaaccataagtcataggtttgacttatgatttttcaatgttatgatggaggaaatgtgaaatatattcagtactctccttgacttactatggggttatccctgcataagttcattataagttgaaaatattgtgtttgatgaatttatcatcatgtagccccattataagtcaaggagcatctatatagatataaaatgtttttatctttagagatctctatttttaaattggcattgttttggttttgctaggtgagtgtttgttaacatcaagggatgaggatacgtttgactgagaaaaaaaaaactcacaatgttagtaaggtcctgctttgaagaatggcatgaaatagtggcataactgttgtgtacctctttgtctagttacagtctatcactcctaatggaatctccatgcatttagtacaacaaaagagagaagtaagattttataacctcttacaatttgaataaatgattctgattacattactacactagaaatgtaaactgagcaagaaaatgattttaaaattgatttcttcagttttggaaagtgaatttgaaattatcaaggctactactttatacatatctgcacccagtgtatgttttaaaatgataatggtctgccatttaatctgtgttatatatatgtaactcaaaagggtttggacatactcaaaaatatcttttagctctatgtgggaagaagtagcaggaaaagggagatacagtattacaaattataatgggagatatagtcatctgagatactaaaatagctgaagcattaaatgaatatttccaaatacatttacaacagagaacatttatgactatctattctatatcagaatcactatggcaaaggtaataagacagaaaaaattcaagtgtgaatttttctcacttagtgtgttagtagcataagacaaacctccaaaaatgtataagttaaagtgcaattcctttaacatttcatgagggattgaaaatgagagtgtaacatttgtttataaagccaacctgcaacctcaaactttactaaataatattattcagaaaacatttttccattttatgtgaacatagcattattgcttcctaacaacatagttattgatcacaataattcattacagggtccaggttacagtgctccattcttattactttgcttttattttactgtaaatagtgacagtaataatgctaaagataaaaacaatgatatttttgacacataatttgaatcactgaattttacagcttgcaaaatatggagaaattggttgaattggccttttctggtaagttagtatgagaagtaaaacttgagatagcatcatcaaaattactcttcttaaaacacagcttaggtggttcatgatttcttttaaacaataaagaaactgatcagttaactggaaaagataacaaaataagtgtatgtacaagcaggcttggcctcacaaattaaccattcttacttgggttatgaatatatatatatatatattttgagtatatatatatatgtattcaaagataattactatacatatatagtaattatgtaatttagttgtatcatcttaagaatcattgtttgaagattgatccttgtattctttgtttcagtatttaaaactttccttttccaaataagaacaataatgttacaaaatagaatgtgacattgtcaataactttcaaaattattaggacataaaattaatatccgttcatttagatgggatttattttttgttcatataagcatttagaacatatgctatgtttagcagcattctcagggtatactggggaagaaatgtttgactgtaatcttgagaaagtaatgagctctttaagcaggcagagcatacatacatgcggggaaagccagctgaagaagtgtgtggtaaaattatctaactcagctctcagactgtaaatgaaggaaggggtcgaacatacttttggcagcctctgaacatgctccactaaagtcgtttctttgttctaaatccaagaacatcctgtaaaaaaaaaaaaaaaaaaaaagtcttgcagaaaggaaggatacttcatacacgggaaaaatatgagcaaagaagtaggaataagcaaaatgtgtgtgggactggtaaaaagtcttttcatatacagcagagtaatctccttagaacatctaagtgaatcttcaatttaggcaatggaagataggaaactgcaaaaagataaaaactccacagtagatgaattctcttgggacgtgagtcaaaagaatgaatgccagaaaccaacgctgaacttcggtcggggatgggagggctatttagagtgcaggtaaggaaaacaaacataatgtgctttacaggactaatcataattcatcattatcatgtacttatcatatatagaaaggactgccctaggcattgaagttttggcaataaccagattgcccttgtttttgaagcgcttacaatgtagtgagagagagagagagagaatgacaaacgtgtatacaaatcgttcagccacgtaataggtattatacaatcacagagtcttcctaaaggctgtttaagggaacaaatacacagatcaaaatgcttttttcttctgggacaatgagagaagacctcattgaatagctgaatttgaattcagtctgaaaggatgaatactgatttcaagagcagaaacagaggagatagggattccaggcctaggaattatcaggtacaaagacatgtgaaaacatactgcaagttcaagattaccaaacagctaaatggaactgcagcccagtaagcttactggggaatggtagaacatgaagttggcccactaagcagggattgggttgtgaaaggcctggcttggattttaccctgagaagataatgaggtgttaaaggatttaagcgttttaaactgtcaaattatgttatcagattctgcacttaggaccatctcttcaatagttgtgtcagggatgaattgcaagtaaaagctagagttatagaatctgatatgatggccattgacatgaaatgctgagtatatttttcttaaattgctggcagtagagaagcggagaatagtaaaaagctttagagatagacaaatcccggctacaattacatatgggtgagaagaggaagaattgtagacaacatgatatactttgagttggcaactgtatggagtatatgtatagagtgtgaagaaagagtaagtaagaaagagaaggataagaagggttttttttttttgaataaataagaagatcaagcatttatcctaactttactctaggtactgattttatgcagggaaagttccttgtttagagatgatatccagcaaatgcagaaggatgatagaattagaaaatcaccattttcaaactatcataaaataatagatctaggtgatagtcattgatgaatacggtaatcacatggatattgacagagaatttcaaaaggcaggtatcaggctgatattatctgaatgtgtaaataagtctcagcattactaaaagtaatgccttgttgtgtgatgcaataggaaaaggacagtgcctcatacgaactattcttctattaaaaatcaccctaacgttttcaagactttggatctaattaccaacttatggaaaatagtgagaatagtggaaaaagtcaaccactaccacaaaaaagtgagtgactagtacagaaaaaaaaaaaaaaaaagagagacttccgagacacgagaatcaaataaattttgtagaatttgtctgggtccttatttgtccaagttaactttaaaaagaggtccttaaatggctgggcatggtggcttattcctgtaatcccagtacattgggaggccaaggcgggcagatcacgaagtcaggagcttgagatcagactgaccaacatagtgaaaccccctctactaaaaaaaaaaaaaaaaaaaaaattagctgggcgtggtggcgtgtgcctataatcccaactactcaggaggctgaggcagaagaatcacttgaacctgggaggtggaggtttcagtgagctgagatcatgccactgcactccaagctgagtgacagagtgagactccatcttggcggggggggagaaagaggtctttaaaacaattcccaaatttgaatataaatttggccttagatatttttaagatttattgttaattttattgtgaatgttacctaaaaagtccttattatttacaggcatatactgatgtatttacaagtgaaaaatcacaatgccttggattttatttaaaatcaaacaaaaataaaataaaaaaactttgtggggggatagataaactgagattggaaatatttgctaatcactggagcttagttttcggcatagatagatgttggatcaatgagtgtttcttgtagtagtctctcttttaatgtttgaaaatatgcataattaggaggagaaaatagtttaattttaagcagattcattttagatgaccacgagatattcaggtatagtttttcagtagaacataatgtaaaaacacagtctagattaattacaaatgaagtatgactagaaatgtataaaaagagtagaagatgagaatgaaaccaacaaacaaaacatggagacaacaacatttagtgggaaggcagaggaaataaagttattggaaggtaccaaaaaggatcagagagatgggaagaaagctaagatgatgttacaaaaaaatggagagtcactaaaatgacccatgtgtacacagaataagtgttgaaatactaactacattttgaataggtcatcactggtgatcatatttaaagaaattttagaggaatgatcatggagagaacagaggagatggaaaactagatagaaatgaatttatgagaggactagaaaatgagacatttaagagggtttttcctgttattaaaaaccatagctatgacagattttcctttttgataattctcagttttttttcttcatttttaaacttatctttcagtagagaaataaaatagatgtcagaaatgtaatgggagattaatgagagcatggtcaaatttaccaaaaaactaattcaacttatgtttagagcagctcattaacgcaggccctactagcaaatatctttccaagatatgccaatgtgtgtgtaggaacacaggattttataaaagtataaaagataagatgttatctctttctacttaacttccaacacattttccctcaaatagagttgtggttgagtggccactagcatttttggaatcccactaaaacaactttgaattgggaatgaattcagtttctgttgagtgggatatgttcatgtagttcagttagagtttaaattattctgactagtcaggtgtatgaatggtttacaggaatactcctacctactgtgaaaactcattgtgacagggaagtgcaggatcacagtttgtgttgtaatatacaattgtccaatgatacctggccctacatgtatgcaagaagttgaggaaaaagcaaagtttgaaatatactgagctgtaaaaattaaaagaaaaggatttggttatcatcaatacctaggctaaacagaatttctccttgtcggggatttactaagcaacacaacaacacaacatatataatcataaatgtaccggatatgttccccttttttgatgataatcatgtgaaagtgtaattaatcagagtcccttttacagcacaagtcttcagtattcaattatgtttataattgcccgtgtgtagaataattttaaaagaagtttttccaaatttgacaatagatggcctctaaccaataacgttgtcatacgaagaaatgagtttagagtatgtggtcaaaaaaggaatggaaaaggtatttatcaagctaagtcatgtaaatgtaatatgtttattttctacatttcatgatgtctagggtattttgccattttttaaatttgtacttctagacttacagtgtggctcacgcctgtaatctcaacattttgggaggccgaggcaggaagattgcttgagcccaggagttcaagaccagtcctggcaacatagcaaggccctatttatacaaaacagaaaataaaataaaattaggtaggtgtggtggcgtgcacctgtagtccagctactcagctacttgggaggcttgcttgagctcaaaaattcaaggctgcagtgaactgtgaatgtaccactgcactccagcctgggtgacagagtgagatcctctgtccaaaaaacaaacaaaaataatttttattctccctttctgttcagtctaaataaatattcattgtcatgcctggccctagaagtatgcaactaactgcacaactttggtgtgtttttttgttttttttgttttttttttgagaaactttcacaaaacttggatttaaatctgtatgggagcccaaaaaggtacaagaaagtagaggaaaaatattcaacatttacacacacacatacacacagaaaactataaaagctttcatctttcttagcttttgtccaagaaaaaaaagcagttggcttttaacaatacagaaatcatttttccttaaaagagatattgtgaaaaatcttaatgctcaaagtactaggacacatacatacatacatacatacatacatacatacatacacacacagggtaccttacacattaaaaataaaatgtgtttcattcacatctgaagatttcttttcctactctaccctgttagtcactcctacccctatgagagaaacacaataactgttcatcccctttctttatttttttgttgtcaagtctgaggacagaaggcacataacacatatgaagatggaatattttttaaaaacaaggagacaaaatattaaacaatatggtagtgttgccttttagggaaatccgaataaactatttactatttcttggaaataaatctaaaaagtcaaatacttaactgaagtactttgtccttgacaaactatagtaacaccacaatcagcagacttaataatttatcagtacaacagaacatttagatgttctgttagctgtagattctatagatttaatctataattctatagattaaaaaggaatattaaaaaggaaatttaaattttagaagtatatttgtattctaaattgatatatatttagaagaaaataaatccatatatttaattattcatatggaaatatcattgttagtgttgtgtggatgtatcctttcaagtaaaatagcttatttaaatctttttgaagtaactcttcataaattcacagtctaacaatttcttatttttcgggagcaaaggtatatattaatgtttaatcaaggatccagcgtttgatctaaggtcatcttttgaactagaagtaaagcttttatttcaaagaaagtctatcctcttaccttttacatttacatatttaacaggaatgtagacatacttgcaaaagtgactggatgatattttgctgttgtagcacacttcaaagattagaattatccattcatttcatgagtgtagaccagcccaatttgacccatagtctttctgtgaaaatataattatcttctgaagataaaaacagggtaaattataggtggttgtagagttggggaaaatcaaagagggggacaatttgtggtagtcctgagtttaaatactgaacaagtcatctacttcttatgtgaccacaggtgagataattccttcaattataaagtatgatagcaatttaagtgttactatgttctctaataacatgagctaaccctctttttcttactgtcagaatgacactataacaaatattgcatttttccctatgaatccaaaagcttctgtcacagtcgtgattaggaatgctgtggatggaagccttacatcactggtgaatgccaaaacaaagcagtatttatcactggctttgatttcaacattattttaatattttcccacctttattaaagacgttaatattatgagtgagtatatttcaatgaaagtagcctacttgagcttggaaagactaaactaattaacaggaaagtaatgaaatagcaggtttatatcttgagcccccagtgatgaaaacctttagcaaaatacaggttacatgtttaggatttggttaattattttaggagcaaatatagagaaaaaatattctcatattttaaagaccaatattctcatttaggcctgaatataacagtgaattctctaccttatatgggctaactatccagttttgacagcagagaaaattataataccctatagacctaagtttcatcaaccctgttctctgaaatatatctgtaattattctggtacactcagatgtttatattttaagaatctatatctacaatgtagttaaagaggtgttttataattaagtaattaaatataagcgtaacttttaagtgttgttagaattcaaagtaaagcactcattccaaaatatttcaactttcttataaacatttctctttgtactacaatattctctttcccccaagtgctatgattaatgcaatccttaaaaacaatggaaacaactatctttattactgattttataattttggaaattccagggactagattccctactgttaaatttggaatatataaacttcctgggattgcagttatgacctaatgtactaaggtagcactcaaaacagctattaatttacatggaacaaagtcataaaaggccagaggaacagcaattattgtcacatgcaattaccaagagacaagctaaaaaagaacactcgtctgcaagtgtatcaattaaactccattattattaaaacaagtggtaagtgaacctgccctagaaatctattgtgtctggaactggttccttcagtgggttcttggtctcgctaacttcaagaatgaagccacggaccgtcgtggtgagtgttacagttcttaaagatggtgtgccaggagtttcttccttttggcgggttcgtcgtcttgctcacttcagcagtgaagctgcagacctctgtggtgagcgttacagctcataaaggcggccgcatctggacttgttctcctcctggtgggttcatggtctcactggcttcaggagagatggtgcagaccttcgtggtgagtgttatagctcattgttacagctcataaaggcgttgcagacccaaagagtgagcagcattaggatacattgcaaagagcaaaagaacaaagcctccacagcaaggaaaggaacgtgagcaggctgccactgcttgcgccggtggcctgcttttattcccttatttggccccacccacatcctgctgattggtccattttacagagtgctgattggtctgttttgacagagtgctgattggtgcatttacaatcctttaactagacagaaaagttctccaagtccccacccgattagctagacacagagtgctgattggtgtgtttacaaacctttagctggacacagagtgctgattggtgcatttacagtcctttagctagacagaaacgttctccaagtccccacccaacccagaaacccagccggcttcacctctcactacgttgcatagtactagacagacctaccctgtagaatttaaattaatatcctataaatactgataactctcccatattttttattcacaacttacataagtgcttaaagaatgaagatgaaataaaaatgatttacacaaaactttaataagattgttattttaattttttgcttacttttctgttatttcttcaaacctgaatacatatgtgaatatggaaatatcttcaaaatcttgctattttagttctttcctttaaaaaataattttcttcccagattttttctcttatatgcctcttgctcaccagtttttcttccttaaatgcaaatcgtctgagagaaatggatggcaataaatgcccccaagaatgactaagtgtaataagcagctgttaagatgcggttttcaaaattagacctgaaaaaaatgtttcttttctgtttgtttccatatgaataccctagatgagtagttactatgtatttattagccagtgccttatataacataacacgttcaggagacagttagcaaaagaacagtagaattgtaaatactcagagaaaaggagacatgcacagtcttccttctataaataggcttacttcagcttcatatccaataggcttaaccaagcatgaatttacactcctcctctttatacccttcaatacacaatttcactaaataatgataatgttctatttttaaatattttacaacttttttcttgacaaatttaccattgtgcactcattgtatgttggagatgagggattcactttggttatgaacgtgaaatcttattctaagttgttgtatataatttaagtaatttatatacatactattattaattagctaatattttcccctaaattaataagcgtttagttcataaagagaataacacatttttgatctacatcaggaatagtgaaagacctagattgatatattattaggttgcagtgagctgcattgaatgtgtccctttagctacagtggtaaaatagatttataattaccaatcttcaattatgattgaatttaaagcagttgttttaattggcacttttttgtaatgactgaaaggagaaagtatttggatttcaaagttttcatgcaaatatattttcttatatttcttcctgctacaatctacccagaacaaatatgctatattatatgagtaattatgttttaataggcttgttctgcaagcaattctaaatagtacttgtcttgtgagcagtgatcatggtttgtgtttgcaaacagtctattgcccttttcaaagacattcctggaatacaaacagctggcaagtgatctgctttccaaaaacttgcggtgtgtgtgtgtgtgtgtgtgtgtgtgtgtgtgtgtgtgtgtgtgtctaatttgagcaagaccacccagagaattagtagtaataaataaatatacaatgagatttcatatcctattttgacaatgtattaagtagattgaaaaccctctctccatctctataagaaaatgttatcttctgtccaatcttcatgttgccatttccctatttcttctggttcttttctcagaagtagtcattatgattcttgtatgtaaccataattaaatcattttacttttctgtatttattagttacttactatagatctgttagtgattatatataataactatctgtgagatcttattaagggctaattttaagggctaacattttgcatgttctctcactagtgttcaaaacagttcatgagaaacagattgtaatctgaacccaagcctgtaggactttatattcaataaccctaacaattgttctcattcttctaaactcttttcaagattaaaatagttatcagttttagacttctcaaatttcatcattgcctgataaatgtagattctaaattgagtgtacagggatgcttctttttcatctatatgatcctgtaactcaacaatgtgtataaatgactaatgtgctcagtgtttttattagttgcttgtaagaaaacaaaacaaaggaaatgcatttgcctattgagtctcatgagaaagtatgacttggagctccacaaagcaattacaaaagggataagttgtatccagcaaacttgtctaacaaagttgttttgaagtttaaataatataggtccagcccttggcatagtaaatactccataaacagctgttactctacatgctctgtgaggaaatagacatcacacttgtctattactgcattcctagtcttaggatggatcccagcacaaggaagagtcacaaaataatgtattaaatggatacattaatgaatgtaaggtattgtaataatggcaagtcagagtatggtgagtgtcattattaaaaatgcctaatagtcaggagatcaagaccatcctggctaacaccatgaaaccccgtctctactaaaaatacaaaaaattatccaggcatggtggtgggcacctgtagtcccagctacttgggaggctgaggaaggagaatggcgtgagcctgggaggcgcagcttgcagtgagccgagatcactccactgcactccagcctgggcgacagagcaagactccatctcaaaaaaaaaaaaaaaaagtgtctaataggagatgaattttgagcaaaactttaaggaatgtgattgacatcaattgagaaatgtgttccaaagcaggggactatattttattaatactcaggatgagaatgggcttatttcttgagatagataacataacacaatatacgatttgcagttcaatatagtgtgtactctatttgtttctagacttgaaactaatgagtgtttaactatcttaaatttacacagagaaacatgttgtgtctgtaaatttattactataaaatggtggccttttcctgtgcattaatggtgacaaaaaattagcaaatgagtaaaacatagcatttatttgtattaaaatattttttcaaggtagaaatataatttttcttataatattaatctactgttccataggtaattcatttcaaatattaatttaaatttttattacttttggctgtttttttggtaattataatcctagacaatccattattttcatttctctattggattatttacattacagatagaaaagtaaacttccaaatggttatatttaaagatatttctcaattactaacaattaaatgattgtcattgctaccaaattagtaattgctgggatatatgatatatgcattagaaaagcagttcttatatgcctatacattcttaaaattagctgtccatgaactggatctcatgttctaatatgtttctttacgtaaaaagtgaaaaaatgaaggaagaaagaattgtaaaaataattatcactgaaatgtcctggactgtttgtgagaaatcaaaatcttgaagtcgggtagctacctgacttcaaactatactacaaggctacaataaccaaaacagcatggtactggtaccaaaacagaggtatagaccaatggaacagaacagaaccctcagaaataatgctacgtatctacaaccatctaatctttgacaaatctgacaaaaacaagaaatggggaaaggattccctatttaataaatagtgctgggaaaactggctagccatatgtagaaagctgaaactggatcccttctttacaccttatacaaaaattaattcaagatggattaaagacttcaatgttagacctaaaaccataaaaaccctagaagaaaacctaggcaataccattcaggacataggcataggcaagggcttcatgtctaaaacaccaaaagcaacggcaacaaaagccaaaattgacaaatgggatctaattaaactcaagagcttctgcacagcaaaagaaactaccatcagagtgaacaggcaacctacagattgggagaaaatttttgcaatctactcatctgatatagggctaatatccagaatctacatagaactcaaacaaatttacaagaaaaaaacaaccccatcaaaaagtgggcaaaggatatgaacagacacttctcaaaagaagacatttatgcagccaaaagacacatgaagaaatgctcatcatcactggccatcagagaaatgcaaatcaaaaccacaatgagatatcatcttacaccagttagaatggcaatcattaaaaagtcaggaaacaacaggtgctggagaggatgtggagaaataggaacacttctacactgttggtgggactataaactagttcaaccattgtggaagtcagtgtggcaattcctcagggatctagaagtagaaataccatttgacccagccatcccattactgggtatatacccaaaggattataaatcatgctgctataaagacacatgcacacatatgtttattgcggcactattcacaatagcaaagacttgtgaccaacccaaatgtccaacaatgatagactggattaagaaaatgtggcatatatacaccatggaatactatgcagccataaaaacggatgagttcatgtcctttgtaggaacatggatgaagctggaaaccatcattctcagcaaactattgcaaggacaaaaaaccaaacaccacatgttctcactcataggtgggaattgaacaatgagaacacatggacacaggaaggagaacatcacacactggggcctgttgtagggtggggagaggggggagggatagcattagtagatatatctaatgttaaatgacgagttactgggtgcagcacaccaacatggcacatgtatacaatgtaacaaacctgcacattgtgcacatgtacccttaaacttaaagtataataaaaaataaataaaataagagtcaggaaaaaaaaaagaaatcaaaatcttgacattcaagaaacaattttttggtcaaagaaatcaaaaaatgttttagttatatgataaaatcaaatgaaaactttaatctttatatttgaaagcttcatggaatgtgaaaaaaccatattaatcttatctcaattttccaataataataataataatatctaatccatctaatttttttcacaggcaaatttatagcaatctatgttcatattaaagccagtactatttatcaaaatgaggattaatacatggggatacatgatttggtatgcctaaatattttcatttaaaacatgtataattaatatgagtggtcaaaaataaaagaaaatattgtttttaatgaagagtgaagagaaattaacacattgattaaatgatgatagtgtttgcatccatgtagagggtgagagtgggcaatgatccagacagatatttctggaaaaaaaaaatcttaatttactgttagagaatcctggttgttcacctttcacctggaataactaccaccaccacaacaaaatattgtgattttttttaaataggtgaaacatagaaaaaagaagaggaagatttctaaaatatatttttcctcaaaattatgatttttagaatatgattgtgctgagtgaagtgtgtttgtgttcttttttattttaactcttaatcctttttttgcaataaggttcaagaaaggccatatcacaatgtaataactgtggttcttaggtcaagaatatttgaaaatgtagttcccaaatgcatatcctcattaactttttagaaaagctgatatggtataataattatggagtgaccaaaagtatagcagttctgagtatactatttattctctacttgggagatgaagatgggaggatcacttgagcccaggagttagaggctggagtgagccttgagcacaccactacactccagcctaggtggaggaaaaagaaaaaaaaagattatgaatccattgtacctaaacttttcttgaatgtgatcaaaaagaacagttttacctgctttcttcacagaggtgttgaaaagatggttaaagttaaggatacagtgaaaatgttcctcagccataaaaagaaaaaatgtcatttatgaaataatggcatttgcagcaacgtggatggagttgaagatcattattctaagtgaaataactcaggaatgaaaaaacaaacatcgtatgttctcacttataagtgagagctaagctatgaagatgcagagcataagaatgatataatggactctggggactcggtgggagggtggaagggaggtgagggataaaaggctacacattgggtacagggtacactgcccaggtgatgggtgaaccaaatctcagaaatcaccactaaagaacttttccatgcaactaaacataacctattccccaaaaactattgaaataaaaatttaaaaagaaaatgctaagatggcataaatattaaattattagtaagtaaacaatcagaaggtaataattgattatagtacgtgtgggttctagtagaccctgttcttctaaataataattcttgcatatctaatgagtttttattcattttgcatttttctgtttcagcattatagttatatgtgcacacatgatgcacttctaaataaacaaacagtaccatgataggctcatcttttttggaactcatgtattctacaaatatttactaaagttaaaaaagtgcaaggtattctgtcagatattataaaggaagagagatgaattttccttgaacacttggagtctaggaggaaaagaaagatatataatataatattggtaatactgctcctgcatgccaaacacactactatgttatttctgctcttctcaaaacccagcacaaaacagcattataatctccattttgcaggttaggaaattgcccaaggtcacactgctaataagttagcagagctgtgtgaacagtctagagaataagaaggtaaatgttattttcactatagcacataatattaaaaataaccaatttcaaatagtaagtgctaagttctataaaaattttatagcaaaaattcatatactttaagaattaacttgtaaatatttattcttataatatgcacatcctattagccttaatgaaaattcactttccaatcatcaggcatttattttgttcactccatcaaatactttagttttgcaagaagcatttttatatgtgcattcgcttttgaaatccatgaagatgattaagttttttctaaaaccaacaccagaacctggaatgcccaataattgctgaatgaatgaatgaatgaatgggtggtgaattagcacaaaaaagtaattctttccctaatatttttagtgcaggttaacattttatgttggtacatgagatagatggaataggaaaaaatgacagtgtcaaaattcaaggcaataacaaaatcaattcattgtgggaatggtagcagaaatcaacagatcattttggtcagttattatcagagggaagcttaataattttgtttaacatagtgcttacagagttttaccagtggtgtgagaaccagttatcctaagggctaattccaactctgcacacagtaacatcatgttggtagcttgacaaagaacatggttggagtatttatatcttgaaaattgccaaatactagtcatgactttttcctgagagcagacatgttgcacatcactggcttctactcatgcttagtggctggcagaattcagaggtgataaatatctgcaattcttggaggagttcctctcaacaaaatgttgccctgtaattatctgagctgagacccctgactgtttgcttaaaaggaaatttaatttttgcctggttttgaaatttaatgaattttctgaaaatgtaactgtcatgtaaactgatgaaccactgaactttgcataatcatcattttataaaaatctctttactgagggaaatggcttttatgctgtttgagtcgtacaactggtattagtttttgttgctgccatgtcattcaatttgattctgttgaggtgtaagcacctggtgacttcagctatgtcttcaatgtggttgcgccagagcatttatatactcaagtatacatcattttatcataaaaattgctcatttctcttttatattatactcaatgcttttaattgattttttgaagccaagagtataggtggctatattatctgtgaactgcattttaacatattaaaagagcactgacgcagttcagccttttcatttccagaagagagagtgtgacctgatgaggtaaagtgacctgaccaaggtcacataactcactgacatttcagttttttaatttatctattttccattaactttcagtaaccaatattatgtgttagctttatctggaataacacatgcatagtatttgtgaaaatacacacgtagtcctcttgactttatttctaacagaagcctctgctagatttgagcaatatagcttcatctaaatcatgccgcattcttatgttcaatgacagggatttatttattaggtaatgagcccagaaattatgctgctacttttacacctttattctttttatggcacccgagaaatacatcccatatttcatatttctaagcatttggggagccacttgctttgattgaaattgctggttcatgctaccacctagacaaaagccactgacctgaatgccagagctaatgtgactgttgcatactaagctgacttttagcttcaaactttactaatgtgtttacactgaaaaagaatgaaatgaaaacctattttcaatttgctatgtcagctaaagaaagtaaaaaaaaaaatgtgtggtagatgcttaaggcagaggaaatgaggactattgctggaaatttagcactgcacaatagagaaaaacatggctttatattctaggtccccatggatagctgcctatgaatatcatagcaatgctgttctaagcaaggtaattcttctcataccagtttttctcttgctcaaggtcatgtctaagagtagaatgaaatcagcataatgctttaaaatatacgtccagtgaattcaggttaaattctaaaacgtcaggttgattctttttgtaagcttggttccagattttagcttgtgcaatgagaaaatgttgcctgaatatttttctgtacttgaattggcatactttaaagttcaaaatgggaggcaggtaaatttaagttctagaatttaaaaggtttaacattataatctgttttctgtctctgtatgtttgaaaatctttaggatatagccaacatattattctcaatatggtgctttattttccatttatgtaacagataaagtgggtctttgattcacttggctgcgacactcatttcatctatttatgcaattgcacgttcatatgtacgaaagccagctcagatttttcttcctccaaagtcctccttcaaggacttctcagagccttaagtaaaggctaacataaaatataaatctccaaatgaaaaatattactggcactgttcccaaatttatttttcctcaatgcaactttattctaggagcatctgaaaaaatgtacttctatttggcaaacttttaaaatgctgctcttttacatgatttactttttgttgttgttagtttccgatacaccaaggcctagcttccctatcacaatctgcctgttcagggaagggacaatcctctttatttatctggcacagttaatttaaaaaaagctgctcaacctttacaatgtgactgtatatttagagataactaattacagaagtctctttgattaatatatttatgtgtgtgatcattattgtagatgttgttttttaaaagcacacagagaaaccaacatgcaaaagaaaggaaaaatattgtctgcttgtttgcttcatgaatgtgatcatttagattatttttcgttatcacacttttccccatcgtgccatgttttcagacagacccttttatcatggagagaaaagcaacggcccataaaaagagtgttttgaaagctagcactatgacattaccaagtttttctattattattttttctttcaccacgtgaccttatgttgttcggtaactaagaaggtcttctaatgtttaaaattatactgatgcatgtgtgtgtgtgcgcgcgcgtgtgcatgcacctgcacgtgcacatgtgcacgtagttgtgtttttcaaaatcaaacgtaatataggaattcaaaacatagaaatgcaccttagtaaactgagattaccctttctggacttcctaaattgaagtagaatttaaactaccagtggatacacatgcaagtctgagattagctttaggattcctagtcttactattatgatatatactgcctacaaaggaaaaaataatcagtagtaattattaatatgttcagtggagattagaccttgagaatgattttcagaactgaggcataatgtgaaagtcttcaccatggatgctcatagctaaacaccaaatagttggtctaggctccctacatccctcctgtttaaggtcaggattgttcctgggtctttcagttatgaggttcacaaaccctgagagataagtagccaagacagagctagaacccagatcttttaagtcttactcttgtatcctttgagaattgctcttccaaaaataggagggtttctgtaactttgaaccagcttctccgatacctaaatatttggtctctattatatcttatctcattttagttaacaatgtttctaatgagctatgagcctcagtttctcatgtataaaattcataaaataatacttgtatatagactattaaatatgtatacacatgtataacatttattcagaataatagaattagcttaccttactgaagatacactttagacatagaattataatagttcttgtattgaatatttacaggcacagttcaggtactatactgaaaatatatactcagtacatttttgaatttattttgtttttatgtatgagttgattaaacattttaaaacaattggaacaaacttagtgagatttgaatgctttagagttctaattctctagtgaacaaacaaagggaagcttaattggaaagtaaatgattttgtgacattttcagtttatatacatacaaaatgacaaatcaaaaaatactcacattttaaaattttgtcttacccaaaatggaaaatacaggacttatattgttatttggggtaaatagttaaaaatcctgaaaaggaactttttttttttcattgctttctttatatgccagcatacctcatgcacacacaacttgcagcttctttttgttctcacacataatttgatattataagtagggaggatttaaatgaggatttagaaatgaatggaaacctcaatggaagcaactgcatgttgaaataattctaggttctacaaaaagaaaggagaatattggcaacatagttgaaggaaatgaactttaagaagtagattccaacaggattagtctactactgtgaaatggaagaagtaaataaaacaaacagaaaaaataattaagtagaaaaagaacttacaagacctgaattcttctgaattccagacaaaagagtaggcaacaataatgataaaatgtatacatctagaatggtactgaggacagaaggacaatttggaataatataatactctgaagtttaacatggtcactaagaagtatatagaagtagaaaaatatggaaatgacaaaatcaagacttctcaattaaagatgtaatatgttgagttaggtgcactactcgctgaggacaaggtgtatgtcttccttatgtttacacttctagtctgcttgtgctcagcactgcacttgccatgtagcaggtattcattcaatgcccttttatttaacccagtttggtaatccaggaagctcattgtattagtccattctcaaactgctatgaagacatttctgagactgtgtaattttttttttttttttttgagacagagtcttgttctgtcacccagactggagttctgtggagcgattttggctcactgcaacctccgcctgccgggttcaagtgattctcctgccttagcctcccaaataactgggattacaggcactctcctggctaatttttgtgtttttagtagagatgggttttcaccatgttggccaggctggtctcgaactcctgacctcaggtggtcagcccacctcaacttcccaaagtgctgggattacaggagtggccacgacgcctggctgatactgtgtaatttctaaagaaaagaagtttaatcagctcatgatttcacaggctgtaaaggaagcatggcagcatctggtcatattctggggacaccttaggaaactttcattcgtggtggaaggtgaatgggaagcccgcactacacatcgccagagaaggaggaagtaaagaaagggcaaggtaccacacacttttaaacacccagatttcataagaactctatcacaggaacagtaccaaagggagaaatctgcccccatggccaaatcacctcccaccaggacccatctctaacattggggattacaattgaaaatgagatttggttggtacatgtatccaaaacatgttactcttatttggggaatgtaagaaagaactaatgatagatgatgataggagctaaagatttttaggtcttccgcaaaaaaaaaaaaaaaaatgaacacttaccaagtaatctcaaatagatgagctttaatgagaaaatgccacattgattttgcactttgaaggaatgtataacacttaaatatttgttggatgtaatttatacggtacctactgaaaatgaggaaactgaggctcagtaaaattgaacattataccattaatgtgatctgagatatggttaccctcagggactatataccacaccatgtcaccatgttgtattcatatttagtcttcttctctctaggaagtgatctcatttttgtcattcttcactcattggatgagtcctcattcacacacatcacacacacctccaactatctgacaattcttagtcttagaaaattctctgaactctgtgattcccaagtgatgcagagtcaaactgatgttattaaatgacaaagggactgagggctatttaagttttaaaaatctaaatcttagcctgaggcctttacagaaaaagaaaagaaatccccaagaattttaaggcattttttggtattatttttgtgatttccatttttgaagggctaagattcacagtttaggttacaggtaagtcatttcataaataaatatgtagtagcttaaaaaagatgatgcccgtgatgtttcttaaaatcctagtggtcatgtttaaaatgtaacatgacacttgataccctgcataatctatatgactatatgtacttgagaagaaatactaatgtaatctagtaactctttattctcttaatgaggtatgctattccatagctctttagctttttggtagggtaaaactcaaagagacaacccacataacattaaaaagaactcattaaataaaatgcaacattttgagatgcataattttcaaatggaaccactgtgtattacagtgagataattaaatattttatgttttacctgaacttccagaataagacattgatatatacatttacagtatatagagccactgattttaccatgcatagaagtggatggaatatcaaaatgctttgttccagtactttgtgattataatgaagacttatggttttttaaattttgacaacttttaggcaacagtaaatatgaacacatagattatattttttgtttgtagagtatttattaactatataagcaacatctgtgaagtatagaataatttccatctacaaaaggaaaatgttgtaatacatatttagtttataatagtatgttaagaaccatcaacttattcttttaattccatattccacagatgttcattagacacctaccattaaatgttaacaaaatttcttcatgggtgaattgaatacacttagaggcaacccattttttaaaaaagtatgagtataatctggattcctgtgagtataaatgtagctcatatttattaatgattgtttactctaaaaatattcagactggtttggcaggctctctgtctgaggcttgaagagcttgctctgggatccttgttttctcagcctctctaattgagggcaccttcacagtttcagggtactttacagcacggagaagaacctaaaaacaaaacgaaaacatgatgggtcataactatgaggaaataaaaagaactgtataaattgcaaagtctgaaaatcaaaaatgtaatacttgaactaaattcattttaagataatattaatgtggaaaggaatgcatctgattgatataaaaagtgtaagaacacttgcagtttaatgttaagcagttacattgcaaagactagtctcaaattttagaacttcattgaaaaatcagtcataaattgtttctccataaacaattaaaaaccagttttctgattctggttaattgtttctttttcattaaatttgttaaatggggatcactaaaagtaaggtctcacaagatagtgtgcatattgctttacattttaaacttccatatggcagatctttcccctgtgaacttgaaaggatagatagtatcattttattttataaatgatgacatccacagaggctaagtgattagctgtgtcattccaacaaatagtagactggaaatctaaatcagtatttctttgaagggaaatatatacatctacacctgtgtgtgtgtgtgtgtgtgtgtgtgtgtgtgtgtacacgcatttcttatgtcacaggactaacacaatgaaatgttattttaagaattgaaacttagtgtgagaagtattatgtgcaaatgtataaaacattgtcacacattatacaatcgatcccagattgtgtcccttagttgcctgtagcattgacatttaacttgtctaaaactaactttatcatctataaaatgcaactaataatatctgccttatctcagagatagataaattctatgtgtcagtgcctgggaggattacatttgttttagctaatcattcatttatgcatctattcatgcaacaaacatttattaagtgcattcaatgtacaagcattagtgaagatgttggagataaattaatggacttatactgcatgaagaagaaatgtataaatcataaacaatagtacaaacacaaataataccatcgttaataacatcagacaattataaacatgttgcattggttggagaggaagctgaggattgctgcagtagtctatgcatgaagtgagaagggcctctactggaaagatgctgctaggaatggagaagacttcatatttatgagtaatgcattttaagtaagagagataaggtttctctctctccagtagaaaggaatagagaaaaaaagagctgaggaaagtcagttatgatgtaaaacctaagataaaggcaaaatagtaataagaacactaaggggtgggcagtattagaggaacagtgacaatttcagttttgatcaggttgattttgaggtgactgatacattcaagatgaaagaaaattcaaaattggaatttagatgaaagggtagtgcatgtattcagagttagcagtacttcggtatgaggaaaaactaagtttctgattaaatgttaaaagaccaaagtcagagcttaaaaccatactgatactagaatgcagaatgggcaaagcaaaaatgaaaaaaaaaaaaagtagtaatatcccagaaaactgtgaaggaaagaatagaaactttgtgaacattaaaattagcacaacagccaaaaatgaatactgaagagaaactatcttaatttaataataagcagatactttgtgacatttgatagagtagtttcagaaaacttgtgggaagtacaatgggttacagaaggaacggttggagaggaggtagagaaagcagatgttgcactgcaaaatggtgtgaagtagctgtaagacagagctattcaaatgatgaattagtaaaatccatgatggctgaagagaagagatggaaactaatggagaatataggagtttccagaggaagacgttctcttaagatcgaatgaagcagattttaaaagctcagctacagtagatgactcttaagaatctaaaggaaaagatgaagggttatgtcttagcaaatagggagttgaagttttggggagcaacaaagaatgtccagacgaagggaaggcaaagttcaacattataactaataaaagttggattggatgacttggggacttagaataacaagcaaagcaagtctcttaattcttccctttggaattatatagactgaactgacccatctcaggcatagctgaacaattccagtcttctctctcagtcacctttggttgctccaatgattttgccaaaggtagatcagaatgtgtgttttggtgagcagatttgctcacataagtgaaacaatgaaatgggggcaagcaagaggcaggctgcaacatacctacttgcttatttctttgatatcacctataggatgagtcattcttctttttggtgggtggggagcaaggctaagaggccataatttttctccttcgaaattctttccctttatggaacttagaatagggtgattaccaattatagcttaatatctaagacggacctaactttgttcccagaatgcacctgcattgggtaatctgtgtaaaacacaacacatcatataattctttatatgaaatttttataatgtgttttgaatttttttggtggtataatctgtctttgatagcataggaaaggataattcatataaaagctgaagaatgatggtttaatgtgttgaacagaatataccatgagcaaaagcttgttgatttgggtaagtctctaccttgtttctttaggagaatgtcatttatgactcctcctgcatttgtataccttcgtaattctcagtaacatagaaatttgatttataggtatttttataatgtatatattttacataaaatattttgatgcatctcacttattttttaattgcataaattatattgaccacttacatctattattaatgacatacctccccaacttcccaaatccttatcattaacttttctttttttttatttttagacagtctctctctgtcgcccaggctggagtgcagtggtgcaatctcggctcactgcaacttctgcatctgggttcaagcaattctcctgcctcagcctcccaagtagctgggactacaggcatgtgctaccatgcctaactaattttctgtatttttagtagagacgggcttttgccacgttagccagagtggtcttgatctcctgacctcatgatccacctgccttggcctcccaaagtgctgggattacaggcgtgagccaccgtgcccagcctatcattaacatttttatttatctcagaatcatagtatcaggatatcttgaaggatttggccaaatatatttcagcaacatattcaacaacattatgttaaacatgaaaaacatgaaaatcacataggtatgtatatattgagagactaaagggagcagaaaagcaaggtactgataatacagaagggctgttgttcctagaatggaaatagctgagattgcaaaggggcaattagaaagatgtcatggtgttaacataactttatatacgtatacacatgctgtgttcatttatgagcggcagtaaacctatagtgatgccgtctataagaaagaaacagagaaatcgagtaatatgatttagaaaataacaaagaatctgttataaagtaataattatcacatgaaatctgactttcatattttctcaagcactttgaaatgtacaaggttctgttccgagtataaagcttgctgaagaccatttttttcaaatttatagacaaaatgtaaaaacaatttgataagttctcatttcagaaagtttatgtcagtgacatgaaaacatatcagtaaatgcattgttaacaacttaatcgagtaatttgcctgtcatcatgactcctgggtaatgtcaagctgtttacagctaatgtaatttttggtagaaaaaaatctatccattggacatttttcatttcaccttatgggaaatattttattatagtagacaagtttccaaaaagagattattatgaaagtagttattctagcagtaacttctcagataaatgatctgtataaatatttttctcaatctctgaatagaatcccaatcaggagtattggtattacatgtaatccaacttctagctctatcgttatgtatttgtgtcatgtcagacattattttttactggttggccctcaattttctcaccttttgtccttagctttgaaccaatcaagttatggtaattgtgtttattgctcgtcagtaaaggcaactataataagatattttgcataaggttagaatgtattacagttgtttaataaaattaactgattaaaatgcagggaatatttttcaaaaagagaaggatgattttcagggtgggatccagtcgtgagagttgcatgagtttgcaggcagaagtaccataaaatattaaataaaagaggttcttgaatgccaagtcgaggagtgtgaatatatttaatatctgtagggtatggaaggcagtttccctcactgagtgaatataaaaggccatattaacccatgagagttatccgcagttagcatttgtgttgaagtaaagttgcactaaatgtatgtagggttataggagaatgatttagatcatatgaaactgtgaagggagaagaacataccaggatgaaagaagtaatttaagagtcaaagctacagatatttcaagtaatatgtaggagaaaaagaagcttaacttcaatttcattaaggatagtgaaaatccatctcagtagtgttcaggatgataacagattgcaaaagaaatggaaggaagagatggtgagaaaaatgaaggcagctggcatacatcatatcttctaggggtctggcaatgaagaaaaatagagaaaaacttcctaaaatattgggatgaaatttacttaattgcattttggcatgttctcgaggctttttaacttctcgtctgtggtttgtcagaagtaaagacagcttttcacatttcctgtcttttcaaatttggcttccaagccatgttgaggatggagttatcttcaaatttcaggggtgtgatgttgcgtattggaccacagatgctcctcaattctgtgaggatttttcattattttgatttcttttttcctataaaagtttgcatttcacccttctcatttttccctcagttgttagaggctgcctcagtgagctctaaattctctggcagatggtactcagggatgactttgagagaattcctagatttcaaagacatataccttttccctgcctccttgaataatttatgttctttggcttctcttacccatgacaatgggccctgaaggagacccaaatctaatctgagatgtaatctccagggaaaactgaaccactggggaaagctcagttgtggacaacctgtgtcctaaggtgagaaggagggccactagcataaaaacaacttgaacagaacttccttcacaagccaataaattctaataacaaaaggcaaaggaaaaagttccctatagaagctaaggattttccaaagcctaatgctcattttttatatccttctttgtatggtcaaaggttgattcttcctttaccagacacaaaaaagggcttaattaaaaatttgaaatcaaattttagagatataaactataaataaatacatttgcctttcaaatttttagaacattatcctagttaattcaaatttttttatttgagatgaaaggcgatttaagctaattttcattggatcatttattattattattattttgcagtgtattagttaactactgttatataacaaattaccccaaaacttaatggctcacagcatcaaaaatatattagctcatagtttttgtgggttaggaatctgggtgctgtatgtctagtgctcagggtccttcacaagattgccatcaagttgtcgactggggatgtagtcatctgaaggctcacgtgagtgagtatcaaattccaagctcactcactttgttcaagtttttgacatctgctggctggagaccacttgtttgccttgtgggcctctccacagagtagtttacaacatggcaacagcctctctagttagtatgagcaagccccagaagcacatttgccatattctaattattagatacaaatcaataggctcgaggtgaggggattacacaaggacaaggatactgggaggtggaatcatgggaaaccgttttacatgctgcctaccactcacgtaatatcctagtataataaaatcatcagctcttactaataaggacattttaccttttagttttcattcataaaacatctattgcccaacagagaaaacgatgctgaattttaattttataaggagaaaccacaaaataaaagacttgtagaagtgttctcttttgccccttcttggtttttgtttgcaaaaaattatggaaaattttcagcagtaaaagattaaaatattaacaaaattatatatagcttttactattttttaaatgcaaaaattcatttgtttcctacacaagtaaccagattttcaaattctactatagacacttgtaaacacaaacattcatatttaaaatgtattaaataaaatattttaaattttcaaaattttaattttataatgatttgatattttattcttaagctagtaatgacattggcttttttgatcaggaaacaggaaataagagatattaaagacatggaaaattatgcatggatctacaaatacaacataaatttaacttctcagtatatcctaacacatatattttttcttctaaaatggaaataaattgcaaccaaataaaaccttatatttctgtattagatattttaatactttactgcagaaatatatataatatataccttatatttgtgtattagatattttaatacttcactgcatatatatatatggttatatatatatatataaccaaactgtcgatttcatatacttctagtgaacagaaatgtgtatttatatatggcattataaatttatagaagggccttggacatcctctagtcctaggtttgtactgtgtatctaactaaactgaaacacaaaggcatcaggtgaaaggctgaaggctacacctaagtagctgaagtaaatccactttaagtacacgcatgcttactacactttaaaaaacttttatgccttgacattattgaaatattctgcagatactttgcatagaatcacagggccagaataatttttagttttatttacttggtctagattttgtcatcacaaatctgagaatggagctaaaaatcacagcctgtaggattcctccattctatttttggagccaatgaagtttcttacatttggccagccctctctcaaatgcttgcaattgggtaacattgttcctgtgagggaaggtcgaatatcacagaggttatcttataaaacctcatcatttttacaatgccaagatatatagacacttagatggggagtttggaagagtaaaataaaggtcaattagaaaactatgcacatgttcatgtaagagatgatggtgacattgactgaggttataatcatggggatgaaaaggctattttttgaaaatgtcattctcctaatcaaaaaacttcagtactatcccattcacattttttaaaggccaaacttctaaattgaacttttataaacgttgttgagcatttgcagtatttttctttcatagaaaaagaagcactatttttcttacagtaaatgcaagaagcttttaatctacttgaaattcactccacctgaaattcactctaccgtccattctttaaaaatataatcctttcttcaagtccctgctcaaatccctcctgctccaacaagacatccctggtgagcctagctgcttttattcctcctacctctaatctctttaatatttctttgttttgttgtgcttttatcaaaggcaccaacagatgctgccttttatgacagttagggttatctatctgtgaaccactagatcatgcttcgcaaggcattgtattccctgtgtccagcactgagctttgcaccaagggcacatttcataagtattttttgtaagataaatggaaataatgaattcattactagagctgatggtgccctcagagcaactgatctcagatatatttgtggctgaggtcaacaaaagacgagacaattactggttttatatctcttaaaagctgagtcaaacctttaataaatttactgtgactggaaacctattccatatttatttcactattaactgttctccagttttcagcataatttatatgcaccttactctatgaaaacttctaagaacagtttgcctgttcattatttatgccaatgcctataacttaaaagtaaattattcctattttgcttaatttaattttattatatataagccatttgataaatatacataaacactttcatagttatgtaacatttactaatatagattttaaagcacatataatttgtatagttgccatgcaaacatcagactatcaaatattgataaactggttactgatagaaaatccagtctctacatttaagaaagagtttttttcttctaattacagaaggagtatcccttctctgaaatgctcgggacaagaagtgtttcacattttggattatttcagattgtgggatatttgcgttatacttaggttcagtattcctaatccaacatgcctcaatgagtacttcctttgagcatgatgttggtgctcagaaagtttcagattttggaacattttggattttggagttctggattcgacatgctcaacctgtattattttcttatcaacttcaccactttattgtcttccacagtcaaagcaaggtatgagtcaaagatatcaaacttagagggaagaaaatcccattgaggctactgtctatgcataaacaaaggaaattcaaatatcaccacataagttattacaaatttacatattaaaacatggatcaactccccttttctaaattggcaactataattccactcaagtgacaggtttgtatacaaataagaggataagctgttagcagttactgaacactgagaccaaatcataactcaggattgcaaagtgctcatgaatgtggagagatatagtcattgcctaataattaattttaattttttaccaaaattagacttcttataatttcattaaaagtcacaaaagaatcaaatcagtataatttttaatttactctgaaaggcattttctttacattttcctaacatctgtattattagaatatctttggccttatatcattactaaataatgagatagttgaaggaaatgacattttaggagttctaaatgagggacatatctcctccatattccataatccaaaatggtgccttcttgaggaaggataaatgtggagaagaaaggagaggggagcctgcttaatgagatgcagctggattcatagtgtggcctgatagtaagtcccaaatcaaattcttactcacatgcttttgagatagcctcccattagaacccctttcctcttttcccaccccacatacttagcatggcagagggtaggcagatgccaggtgtattttattatgaggtcaatgagtaacaattctgttcctctctcttttgaagcctgttataatacggctacaatgttataaagcaatcatattttattcttttccccagcccacatcatgaatgttaagcaaaaggggagactgaatattacattgaggatgaactgcaaaatactaaagtcccttatgatagtgtttaatcctttattgatcaatgtttcacaaaggtgcattggtcattaccactgctgtacctttggttagatccatttatctgcctggaacatcctctcatttctcatttatctcacttatatcctactgatatttccagaccttgttgaagcccaccttctacatggaactaattttttttttcttgagacagagtgccactcttgacgcccagactggagtgcaatggcaggatctcagctcactgcaacctccacctcccgggtacaagtgattctgctgccccagtctcccaagtggctgggattacaggtgcccgccaccatgcccagctaattttttgtattttttgtagagacagggtttcaccatgttggtcaggctggtcttgaactcctgacctcaggtgatccacccgcctcagcctcccaaaatgctgggattacaggtgtgagccaaggcacccggccgctttctaattttttaatctactttaggtgaatcacaccctcctttgatatcttcctgaatatttcctataccttgtgatagagacagcagagtatagcacagtctttcccaaaatatctttctaatatccttatttgaaaggaaatgttgaagacttaaaaagcatattgatgtgtggaagtctttgaaaagtccttgagtaaatgaagaagtttgttcaactttttaaaactgaacatttcttaaacttctacaacaattgcatctttatttcatgtaataaccttcttgcaaaatacactggagaaatagaaatatatacaggtttggggccagacagacttgagtttataccttacttccatggcttaataaaccatctcattacatttacttaaatcactttaagcttctgtttttgcattaggcataaagaaatgtttcataccagtaggtattccaaaatatgcttcttttatattgtttctccacaggccctgaaattcaattgttttatgcagtttagtgtgttttcttctacagagcaggatatatgttgtgtgcatcttttaaatattaattacaatcttgcacatgataggtgtgggatagattatttctgcctgagtaaagctttatagtgtggctacattgtttagcatttctgatgtagaagatatacaacttttagattcattaacaaaaattttttacattagttctaattttgaatgcccgatgtcattattctcttacatcaaccatatatttgagagttggtggattgttgggttgtctatctaatttcatgagtatattcaatctcagttattcctcatgctgaaactgtcttatcattattgttactgctaatgcatgtcagaagatcacgtgattctggtggtgctgtgactatgaaaatttcataattcaagatatttataaaatcacattatgggaggattccttaaatagtggactctctttaataggcaaactcacacctacaaataaataactttgttttagccagatatgtagtctttatctctgagaaagtttggattgtggttttgaaagatgattacttttggttttgaattcatttcttacaattagtctaatgatccattctttcctggagggcttaatttgtgagttctgtcctctgtaacaacatgaaatctccttgaaaagaacaagttcagtttatttagactgaggccattgcaataaagaacaaagttcagtttgtgctgttctctaagtgccatagataaaattattctgattttccccaaggttaatgggcacagggtgacatttaaatgatattgtaataatctaataatttccagtgctaattagtacaatcccaaaccatgagtgaacataattaaaaatgttttctctttttgagggtaagtaccataacttcacaactaatctaatggtaggtgcttcattacagtttatgcaaacattgaattttactataaatatttggataaattatattccaagtagtactaacagtcaattctcattttttctgcattgcctgctttatgtagagcccccacacacagatcagtgaggagctgctatgtctcctgtgcccggtaggcccgacctagaaacatgaaggaacatagatgggcaatgagtatcatgagaagaacctgggctttggagtccaaactggatttgaatcttggctctccaaaccacattttatttatctatgatgcctgcctcacaaaattttagtaaaaattcaatttatctttactaaggctatattaaaatatgtaatcgttttacatacatcatgtatatgtaaaatgcctggcagagtgccctgatgctaagagctctcatatacatagttcccttttactatgaaattttactacggaatcactttacagtcttatatttatcaataataagtaatgtaggtattctatttatagttctaaattacccaggcctactctttttctcttggagtcagctgcatatttgatagaatcttcttcccatgactttgagactgcctcatgagtggcagtggcctttgtggagtaactattatcagagtgatttggggaaggattaaattgtcatccctccaccatgctccccgtttctagtttaatggtttaaaaaatggttttatggttgttaggattatgtgctaataatattagttaagcttttagaaagtttggaaagtgagaagctgctaaggaatggaatgagttctctatgtcctcaactagaagctcttttcccctccactacttgtttgtggtatccttcaagagctagtaggcttattaacttttctgcctcagtaatgtgtgcataatatataaactaaagaagtgctgagctggaaaattgattttatgcttatagtggtttaaaatttctaccaagcctaataatattactatttttttctctaagagctactattttccgttgcaaaaatagcaggagaggattatgtatagttctaattttaccacactcctcctgaatacaattcttccagaaacacttaatgcttttttcttttttattctttaatgactgcctagtatattgtctcagtattataagtctctttccttaccagattttcagcatatgactaatgagggaagccagtcaactcagatcattttttatttctgagatttatgtaaagttaatgacatcttaaatataattgtgtcaaattagtcagatatttttctgtatcttccttctagttccaacctactcagttacctttacttctctctacaccttctcatggaccctagtgttcagctaaatgaaatacctatcagtgcgcactccatacattatctacttccatgacttttcttacgctgttcctttctcaatttgtcctttctttactctttaatgtcttacttctacctattcttcaaggttctacttaaactatattcttctacataacattctttcatctatccatgatttctgaatctcttttaatctttatatatttaatccaaatacatggattatgtcacattttattacatatttggaaactcatgggtctgtcttacccttagtcctagtctatacaccaaatgaaataagaaattatgtctgtggtatttaatacttaggtttcatccatatggggaaaaataaactctaagaatcagacaaaaattattttaaataaggctaacttatttagaccatagtcatacccatatgaaattaatgtgatttaattaattactagtatgcacagaaaaatatgaggtatgaaagctgattttaaaaaaatcattgttgcccctgagggataaaattttaatggagaagaaagacatataagcattacattagtacaaatcaaggttgatagacacttaaacaagtgccaatagagcacctgataatatcgagaggagaggtcatttcatcttaaaattcatgataatataaagcattcctttttaaatgaaattgaagaaggccatctctttagagagtagaagggtttctatcccttatcagtactgagaacaatacagttttgaaaataaagaaatataaatttaacatctaaaagaatctcaagtgctctcttcggcagtacatacactaaaagaatcttaaacattcctaaggcaaatgtttcagttaaagggggttaaccaatacacttaaaatgcaaacattactttgtgaaacatgttgaaattaaaaataataaagccaaactatttggaatgtcatatatttataaaatatatattttcgtgctacaaggccaaatatatttttttctttccagtcctaaaatatgccctgtatcgtcagtgtagtttgtaggtctgttcatcaaaagagtgggaagtatatcatgccagaatgcatttgctgttcccctatcaagtgatcaccattgttattggctttagaattattagcttctgtacctggatctgaccttaattttaaccacaaatgtgggaatggttttgacaaggcatacagttttggcaagtcacctcacttgggtactaattacttctgggtacccagttactcctgggtcctaattttatctttaaatgcttgttatgttacttattactttcatatgagaattttgataatatgttgtattaaaaaattattagttttatagtgatcaatcaatgaggaaattctctgaaagtgatgtttctttacaagaaaagcacccaggctggaaacaatataaacattgtaaaaatatgtgaatcaacactgtcaattcatattatttttcttagtatagttttagtttactgaattcatatgcttgctaagagctagaagctttatatatattcccactttatatgacagtataagaagatcaaactattatatcccacaggggaaatattttaaatctttcacaattgctggttttccccttaacacaatttcttgattataacatttaagctattatactgctatctatctatctatctactaaattttatctatctatttatctatccatttctatagctagactataatctcttcaagactggtatctgacttcagtttctactactagttcctaacgcagcggtacagttcctggcatatgtacatactcctatagtgtgtgctaaagaaaggaaagaaattaacaagtctttttctcccatgttgtataagcccagtactagttgctctcagacactagtgaataatttattactgttcatagtttaaagaatgctgataattgagtgtattggtttgttattgctgtgtaacaaattaccacaaacttagcaatttaaaacagcacatatttattaattcacagttttgtatgttagaagtctggcactgtgtggttctctcctcagggtatcacaaagaagaaatcaagtattacctaggttgagtttacctatacaatccctatgtgtaagctaggaatatttggaaacagtggaggttcatgtgttcttcgctgaccgtttatggttttgaaggcctaagaggtttcaataaactatgtcgatatgcctagcagctggcgcaaaatttttggtgaagtatttacttaatttggggaggtatgtgtgatgcatgttaagataaaagtaaagctgctcaatggagagcatctcaaaatatgattttcatgcatagaaaaaagctaaaaaatattattcaattcaatatggaaatatttctgtttttttttaagatggaaaatgatgccccagagtcattattctgcatagcacgtaactatctaattgcatttagagaaataaaataaagtttgccaacaacgaaaaagggggaccagaaaatttgttgacagcatatccaatgaacacagtttcggacaataggatgcatgttaagcctgactggatctattcattctcctgtcaacagctggcatgcctccttcacaatggcagaaaagctacaggaagtttctctttggaaaacatgttgagaaattttcttgtctctctatgctccttactgtacactgagatatttttctagagaatgagtgaagaaattatgctattactatagagtgataactaatttacactatgtaaagggatagcacagatattgttttattcacactaaaagcaaataattggaagaatttctatgtaactatgaaaactagaaataaatggtgctaaaatgtgcaaaagatgatacattttcaggcacatattacagagtttcactcaaagtatgactagtatgtgaaatgctggtactcagttgtggatgattttcactgcagtggttaggtaggaaagcttactattaaaagtttttgaatcttatatccccgtttctgaagagctgcccactctggagatttgtttcactgtgattaacattgtacctctcatttacttacttgtcagaggttttattcagttagtatctttttctaaatagttacaccttaaaagtttaaaaatgatcagatttgtatttgattgttcactacttcacttgcaaaaacaagtattacagaaaagtaatatgttaacattagtttatgtatgaaataacctgcaataccaccaaaacttatcggatcagataacctccagttgacattagcaagctttctaatggtgtcatttcttcttttttgaattcctttataattccctctgacatttttaacttcaaaattatattcttctcaaataatagaatatgttgttttctactacatataaatgatttaactacacagtggtttttcttatttttgagttagatacctgataggcttacatttgccacttctataggaaaatgtgcttgcttagattcacggcatatttgaatatctatagcattactgaactgtgatgatttctgctggttcgtcatatcttaattcaagaaggatacttgggaatttgttaaatatttgcgctaataaatctaattgcatttagagaaataaagtttcatcgggaaaataggatgctagagcttgcagcttttcaggacactcttcaattagtgatttataaaagcatctacaaggtgaagtcaaaggcagataaacctcagatatgatctcttgccaacaattttgtctcaagaacttggtatacatactttaagtattctttagaagtcttactacactattaattttatgattgttgatatcttttaaaatattcaatcatataatcgtattttatctatctattcaatgaatttctactacttacctaatatgcgatgaacacatttctttgcattggtaattcagagttaacacagcaaacaaaaccccttgccctcatggaaagtgcatttgaaagagaaggaaataataaacaagagatatatagttaagatatgtaatgcatcagatggccatataaactatgaagtaaaataaagcagggatggcagaaagggattgaaggcagaggctgcagttttaaacagggtcatcaaggagggtctcactaagaagttgagcaagacctgaagcagttgaggagaagctgtgtttttctgtaagagaaggagcattacaactagaaggaataacgagatcaggactgctgagatgggaatatactttttgtattgcaggagcaacaaaaagacttgggtaactggatgtcagtgaggaagaggcggaatactaggatctgaggtctgaaatttaacaaagtgtctgattatagaagactcaataagccctgggaggattttgacagtttctacaggtgtgtcgagatgccattcaaggctgccctgacatacaaagaaacttttacaacaatcttttgtctccccatggtttctctcaagttttttgttggttcctcagatatgtgctacctttattcttctgaagtttctgaatatttgattttggtggcgggaatgaggaactctactagtctgtcatcttgtcagaacttgaagtgcaaaatttcattaaaaaatatgtattttttcagttttatttcaagttcaggggtacatgtgcaggtttgttatataggtaaacttgtgtcatgagggtttgttctacagattatttcattacccaggtattaagcctagtacccattagttacattttctgatcctctccctcttcccaccttcaccctccagtaggtcccagtgtctgttgttcccctccatgtgaccatgtgttctcatcatttagctccaacttataagtgagaatgtgctatatttggttttctgttcctgcattagtttgctagagttaacagcttccagctccatccattttcctgcaaataatatgatcttgttctttattatggctgcatactattccatgatgtatatgtaccacattttctttctttttttaaattcccaacttttaagttaaagggtacatgtgcaagacatgccggcttgttaaataggcaaaagtgtgccatggtggtttggtgcacagatcatcttatcacccaggtgttaagccaacatccattattcttcctgatgctctctctccttccaccccacaccctccaacaggccccagtgtatcttgctacctgacatgtgtccatgtgttcttatcatttcactcccacgtataagtgagaaaaggtggcacttggttctctgttcctgaattagtttgctaaggataatggcctccagctccatccatgtccatgcaaataacatgatctcattcatttttatggctgcatagtattctatggtgtatatttaccatattttctttatcctgtctaacattgatgaatgtttaggttgattccgtgtctttgttattgtgaatagtgctgtaataaacattcacgtgcatgtatctttataataaaatgatttatattccttcgggtatatacccagtagtgagagtgttgggttaaatggtatttctgtctctaggtctttgaggaatcaccacattgtcttccacaagggttgcactaacttatgttcctaccaacattgtaaaaacagtccttcattttccacaaccttgccagcatctgttgtttattgactttttaatgtctattctgagtggtgtgagatggtatctcattgtcattttgatttgtatttctctaataatcagtggggttgatcttttttcatgttttttggctacatgtatgccttcttttgagaagtgtctgttcatgtccaatgcccactttttaatgttttttttccttcttgtgagtttaggttccttatagatgctggatattagacctttgtcaaatgggtagattgcaaaaactttctcccattctgtaggtggtatttttactctgttgatactttcttttgctgtgcagaagcgctttagtttaattagatcccatctgtcaatttttgcttttgttgcataacttttgatgttttttcatgaaatctttgcctatgcctatgtcctgaagtgtattgcctaggttttcttcaagggtttgtttagtttaccactttacatttaaacatttaatccatcttgagttgattttcatatgtggtgtaaggaaggggtccagtttcagtcttctgcatatggctagctagttctcagagcaccatttattgaacagggtatcttttcctcattccttgtttttctcctttatcaaagatcagatgcttatagttgtttagtcttatttttgggctctctatgctatttcattggtctatgtgtctgtttctataccagtaccatgctgttttggttactgtagccctgtggtatagtttgaagtgagatagcatgaagcctttgggtttgttctttttgcttaggattgtcttggttatttgggctctttttggctccataagaattttagaatatctttttctaattctgtgaagaatgccaatgtgagtttaatgggaataatattgaatctataaattgctttgagcagtgtggtcattttcatgatattaattcttcctatccatgagcatgaaatgtttttccatttgtttgtgtcatttctgatttatttgacagtggtttatagtttttcttgaagagagccttcacttcccttgttatctcctaggtattttattcttttggtggcatttgtgaatgggagatcatttgtgatttggtgctcagcttgtctgttgttggcatataggaatgctactggtttttacatatttatttttatcttgagactttgctaaaattgtgtatcagtttaagcagcttttcaactggatgacggagttttctagatacagcattatgtcatctgcaaacaaggatattttgactccctgtctttgtatttgaatgtctttctttctttcttttgcctgattgccctggctagaacttccaatactatgttgaataggagttttgacagtggacaagcttgtcttgtgccggttttacaaggggagtgcttccagtttttgccactcagtatgatattggctgtgggtatagcatatatggctgttattattttgaggtatgttccttcaatacatggtttattgagagtttttaatatgaagggatgttgaattttatggaaggtcttttctgaatctattgagataatcacatggattttgtttttagctctctttatgtgatgaatcacatgtattgatttgccaacaaagatcaaaagagacaaagaaggccattacataatggtaaagggatcaattcaacaagaagagctaactatcctaaatatatatgcacccaatacaggagcaccaagattcatagagcaagtctttagagacctacaaagagacttagactcccacacaataataatgcgagactttaacaccccactgtcaacattagacagatcaatgagacagaaagttaacaaggatatccaggaattgaactcagctctgcaccaaatggacctaatagacatctacagaactctccaccccaaatcaacagaatatacattcttctcagcaccacaccgcacttattccaaaattgaccacatagttggaagtaaagcactcctcagcaaatgtaaaagaacagaaattataacaaactgtctctcagaccacagtgcaatcaaactagaactcaggattaagaaactcactcaaaaccactcaactacatggaaactgaacaacctgctcctgaatgactactgggtacataacaaaatgaaggcagaaataaagatgttctttgaaaccaatgagaacaaagacataacataccagaatctctgggacacattcaaggcagtgtgtggaaggaaatttatagcactaaatgcctacaagagaaagtagaaaagatctaaaattgacaccctaacatcacaattaaaagaactagagaagcaagaacaaacacattcaaaagctagcagaaagcaagaaataactaagatcagagcagaactgaaggaaatagagacacaaaaaacccttcaaaaaattaatgaatccaggagctggttttttgaaaagatcaacaaattgatagactgctagcaagactaataaagaagaaaaaagagaagaatcaaatagatgcaataaaaaatgataaaggggatatcaccaccgatcccacagaaatacaaactaccatcagataatactataaacacctctctgcaaataaactagaaaatctacaagaaatggataaattcctcgacacatacaccctcccaagactaaaccaggaagaagttgaatctctctgaatagaccaataacaggctttgaaattgaggcaataattaatagcttaccaatcaaaaaaagtccaggaccagaaggattcacagccgaattctacctgaggtacaaggaggagctggtaccattccttctgaaatgattccaatcaatagaaaaagagggaatcctccctaactcattttaagaggccagcatcatcctgataccaaagcctggcagagatacaacaaaaaaagagaattttagacatttattgatttgcatatgttgaatcagccttgcatcctggagatttgtgtatgttgaaccatccttgcatcctacttgatcatggcagataaactttttgatgtgctgttggattcggtttagcagtgttttgttgagtattttcacatagatgttcaccaaggatattggcctgaagttttctttttttcttgtatctgtcagattttggtatcagaatgatgatggcctcatagaatgagttaaggaggagtccttctttttcatttttttttggaatagtatcagtaggaatggtactggcttttctttgtacctctggtagaattcacccatgaatctatctggccctgggctttttttggttattaggctatttattactgcctcagtttcagaactcattattgccctgttcaagcattccgtttcttcctggttcagtcttgggagagtgtacgtttccaggaatttgttcatttcttctagattgtccagtttatgtgcacagacgtgtttatagtatcctctgatggttgtctgtatttctttggggtcagtggtgatatctcccttatcatttctgattgcatttatttgaatattatttcttttcttctttattattctagtgaggagtctattttatttttttcaaaaaaacagcttctggatttcagttttcgaagggtttttcatgtctctatctccttcagttctgctctgatcttgattatttcttatcttctgctagcattggggtttgtttgctcttggttctctagttcttttgttgtgatgttagagtgtcaatttgagatctttctagctgtttgatgtgggcagttagtgctataaatttccctcttgacactgctttagctgcatcccagttaatctggtatgttgtttctctgttgtcattagttacaaagaacttgtttgtttctaccttaatttcattatttacccaaaagtcattcaggagcaggttgttcaatttccatgtagttgtatggttttgagtgaacttctgaatcttgagttctaattttattgcactgtggtctgagggactgtttgttattatttcaattatcttgcatttgctgaggtgtgttttacttccaattatgtgattgattttagagtaagtgacatgttccactgagaagaatgtacattccattgctttggggtagagagttctgtagatatctatcaggtcaacttgatccagagctgagttcatgtcctgagtatctgtgaatttactgtctcaatgatctagtattttcagtggggtgtgaaaggctcacagtattactttgtagaagcctaagtctctttaaaggtccctaagaacttgcttatgagtctgggtgctcctgtattgggtgcatatatatttaagatagttagctgttcttgttgaattgaaccctttacctttaggtaatccccttctttgtcttttgttctttgttggtttaaagtctgttttgtcagaaactaggattgcaacccctgctattttcctgttttccatttcctgggtaaattttcctccaacgcctatgtgtgtctttgtatgtgagacgagtcccttgaagacagcataccaatgggttttagttctgtacccagcttgccattctttgtcttttaaatgggggcatttatcccatttatatttaagattagtatttttatgtgtgtatttgatcctgtcatcatgatggtattataactggttattttgtacacatgtttatgtgattgctatatagtgttactggtctgtactttagtatttttttttttttttttttgtggctggtaatggtttttgctttccatatttagtgcttccttcaggagctcttgtaacacaagtctggtggtgacaaattccctacacattttcttgtctgaaaacgacctctttctcttatgaaaggatctcctctcctttatttttgaagctgagtttgtccagatatgaaattctagattggaaattctgttctttaaaatgttacattttgccctccaatctctgggttttagggtttctgctgagaggtccactgttagtctgatgggcttccctttgtcggtcacctgcgttttctctctagctgctcttaacactttttctttcattttgaccttggagaatctgatgattatgtgtcttggggatgatcttctcatggagtatcttattggggttttctacatttcctgaatttgaatgttggcctttcttgctaggttggggaagttctcctgataatatctagaagtatgtttgttaaattatttccattatctttatctctttcaggtaccccaatcagttatagattctgtctctttagataatcccatatttcctgaaggttttgttcattcctttttctctattcttgtctgactctcttatttcagaaatatagtcttcaagttcagaaagtcttgcctcctcttgacctattctgctattaatgcttgtaattgcaatgggaaattcttgtagtgtgtttttcagcttcatcaggttggttatgttcctctacattgtggctattttgcctgtcagcccctgtattgttttaccatcatgcttaggttatttgcattgggttacaacatgctcctttagctcagcaaagtttgtttttatctgcattttgaagtctacttctgtcatttcagccatgtcagcctcagcccagttctgagcccttgctggtgagatggttcagtcatttagaggaaaagggacactctggctttgtgagttttctgtgtttttgcaatggttctttctcatatttgtggacttatctacccatgatctttgattttgctgacttttcgatgggtttttttgtggtttttgttgttgtttgtttttatgtttatttgttttagccttgctgcagtttgatgggggtcagctatagaccctagtcacctcattttttcccaaacctggaggtatcaacagtaaaggctgcaaaacagcaaatatggcagcctgtcccttcctctggaagctccattccaggggatactgactggttgccagcctgaaccctcctgtaggaggtggctggagtccttgggcaactcttcagctcccaatcctttagggctctcgaaggcccacagtctggaccagctgagatatttgaacagccaaggtggtggccacccccgttgttctccagacactccctcccagagagaaattagaactgttggctcttgaacatggacagggtggccagaagccctggctgggaggaccctcccatgagaaggagtggatcagggtcccccttaaagaagcagtctggatatgtcttgacaaacagctctgccatgctaaggaaccgcctctgcccattggcttggactctccaaagcccacaggctggaatggctgagttgtctaaacaaccaaggtggcaatctgcctttgcccgagggcactctgtaccagagagaagtcagcactttatctatagaatatgtgcaggcaggcatggctggagaccccagctgggaggtcccatccactgagaaggaatggaccagggtcctgcttatggaagcactccagccatgttctggcaaagcagctgtgctgcactgttggaatccttccttgtccggaccatttggactctccaaaacccacaagctggaatagctgattggactaaacagcagatatggtggcctggtccctcccccagagggctccatctcctctcaggcaggctccactctgttgctggtggctgctctggattccaaaccagtgggtcttatcctgtgagatgctatggaagttgggcctgaagactggcactgctcggctccctggattcagcccccttcctagggacatctcctaggaaggaccttctgccttgcttgagctgcagacaaccttgccagggttcctggggctggagtatgtaaagctcctggatctctgcatgtgcctgagcatctggtctcctgagactttgcccagcttagtgtgtcagacactggtggcatgggcccatgatgggacctcctgatccatggtttgcaaagctctgtggtagaagtgtggtttcctgggatcacacaatcactcatcgcttcccttagctggtattggagatcccttggctctgttgctcctgggtgggccattgctcctgggtgtgccgttgccccaccctgctttttttcattctgggtctgggatctgttctagcccctcttctttctctttgggctattttttaatatgataacatcttgtctcagatttttaatttccaaaggtaccttgattactttcaaatatatgtctgcagttcagacatctttctcttaagctccattttctacatatttaattgccaacataaattctccattttgattttaataggcttcagaagcatagcatattcgaaagggaaccattgatttacctcttgttactttgtcagttatcactgtttctgtaaaatggaatctccatcaactcagtgatcaggggactggaagtttctttgtggctgaagaacagatgtaatggaatgagtcttgaaaaaaagactgtgtagagtgttagataatagatttcaagatttctcatatagagtatacaggggatgtcagggacctgtcactggctgtgggtttagtggaggtataaacattaggattaagaaaaatgagattgagttgttactaaggtaaataagtcaactgttatcaccaaggatgatggtaggaccgaggacagagagaaagatgttgaaccaggtttcaatttacaaaatgaacttagtcatctgggcaggaggtagtcaagtgacagtgatgagaaggatcagagggtaggacagttaaatggcaagggattcagaagagatgattttactccataatggaagagtaactgtttggcattgtttttgaggagctaagcaatgttagctggttgtaacaggacttggtatgtgaaaaaataaatctccagttgaaaggactacaggaagagcaaggtcctctagagaaagctagaatttaataaaagctaggattcttctataaaggagttgaaaatattaatgaaatggaattaccatggaattaggtggtcagagtggagaacaattagcattgtgtaaaggtatggtgggcttttgtcaaaggaaaaacaatataaagaaaatgaggagctgatgaatggttagagatatacattttgggcggtaagcaaagatgccagtggtgaatcacgatgggattagctggcctcaaagtctcagtgagaatctcacataaattaaatggtgttttttccaaggttcaagtgaagatttgggatgacttactaaaattttctgaaacttagtttcttcttcttcttcttcttcttcttcttcttcttcttcttcttcttcttcttcttcttcttcttcttcttctttttcttattattattattacactttaagttttagggtacatgtgcacaacgtgcaggttagttacatatgtatacatgtgccatgctggtgtgctgcacccattgacttatcatttagcattaggtatatctcctaatgctatccctcccccctccccccaccccacaacagtccccagagtgtgatgttccccttcccgtgtccatgtgttctcattgttcaattcccacctatgagtgagaacatgaagtgtttggttttttgtccttgcgatagtttactgagaatgatgatttccaatttcatccatgtccctacaaaggacatgaactcatcatttttatttaaaatggaattattaaaagatagagcctctcaggtctggctgcctaaagcttgaaaagctacctctttaataaagcaaaagatatatggaaaacaacataattaaatagagaataacatcttcagaaatttatggaagcatggcctagtgactcacacctgtcatcccagtcactctggaggctgaggcagttgcttgagttcagaagttcaagaccagtctgggcaaactcatttcaacaacaaaaatatcattatctatctatctatcaatctatctatctatctatctatctatctatctacatatttgaattcttgtaattaccattttgacatgcatcatatatattttgttcaaactcttaataatgtagtaccagattacttcatcattagatcacaattttcaaaacactgaaatgcacatcgaggtcactgtaaattttcatctatttaccaaaaaaccagaattcacagatacaaatgtttgccaatttgctttatagcttatgttaaaggaaggaaacttgtttcttttttatttaaacaacaatattttttgagttttaatctgaagtcttaagatatatatcatagtagaagatcccgagaaatctccttatgtttcccttatgtacttcaactatggtcttcatacaccaggagggcataagaatttatccaaacgtgacttttattttattttttttaacttgagctctgtggtaaattacttaatatcaagttccataagtaaacattcttgctggacatattttgacttttagataatttttcaatatgtgtttaaaaggccacagtgtatactctatcatcgcttttaacatggcccacaaatcatttataaattattcactctttccagctcttttttgtttctttttcttcaaaagaggattactacattccatgtcttggtgtcaaactgtctaagaaaataaattaagaacacagtttgaaggcattcactgtttttctctttccctaacacattattccaaaagcagaatattttttctcaagaatggactacatttttaacatagatacagtttatataggataaaaactataggtcttggaacccagagagttttagatttaagtcctatatcatgtatgttttagcatgtgattaagtaattcatctaacttttctgattcttagtctcctcaactgtaaaatgaggattaagagagataacctacaaaaatgataaagtttaaaaacattatttcttttttcttagtatgaataaaacttacagtggcaagcatacacaactttgaccattttgtaaggtttattttctagcaagttattattaaaatactatttagaaattgatttttcttaagtaattgatatacaaaatgtcagagactgtgactatgatacagatcttaaaagatgaaactgagtctattatactatatatgtatacatatgtatataatatatatattttatatatgtgtatatattttatatatgtatatgtattttacatatatattttatatatagtataatggactcagttaatttcatcatatctacatatatacatataaatatatatatagtataatttgctgttatatatattgcagctaataaatacctagaaaatttgccgtccttctgagggaaactcatgtctcctttacagttgtctagtctacagttataatagaatttctgttttcttaatgcttttgaaatattttacatggcaattccctggaaatatctgtatattttataggacatattggaaaaataatcagtggatatctgtaaaatcttcattgttgctagttaaatgtacattcatgtaataaagaagaagaaaaaaattacaaatgagttcagagttaataaattatgaagtttgagatttatattggaagagtaccattttcctacctgaaatattctacaggctgcaatctgttactttagaactaaaacagtagtttacagaagttttaaaatgctcaattacaagaaacttatttattttggcccattcagataggtaaaatgatttttcatctcaaagtagagtaaatttttgtcttaaacataaaattagaatttttactctgtagaagacagcctacactatattatttgtgtgcaaaatgagtttgacccttctaagaggatcacattcacattatggtttcatacagatatttctttggcatatgattttacttatagtagtataggccaattctcacattttttttgtggaagttgaaggtaatactaaaaaggtagagtaaattgttacaagaagaaaaatgttaaatctgttcaatttctaaaaatatctgcaacttttctccatgaacatacttttcagtagctaccttatcagctttttgcctatttgtttttttttttttttaaatgcatcaggtcagtttgggaagaatttgaattggtgtgcagtgttcaaagtgtctattgtcaaaccaattctttttgttcttgtcatggcagaattttgtaataataggatattgtttcaattagatgtatgcaatagagaaagagactgcaacatagcacacaaggttctggttgaatcttcacggattcagtaagaagagatgtaaactaatttagagttaaacattgctgcctttatacaagaaaaaatccagatatttgagctttcactgtccagtccccccacccttttttttttttttttagaaatagtcacaagtactctttaaaaaattgcaaagtattcctattcaaagaattgatctttgaaatgtttattcactaaactagtataaaatgcataaactattctgagaggattgatattccaacatgaaattattttaaaaattaacctcttactatgctccatgtggatgactcagcttacctgttccttaggcaagcaccctacatttccttttctcccacatacttctggaagacacacagcagtcagacttttccagtgatagtattatcagtttaaatgtgctttgggtttctggataactatacaggttttccaaacgaaatgtgatttcacatgttattggagagtaaggctaagaaaagggtcttgtgttagaatgaagaatccctttgaatttgacttatttcacactatgagcaaatgtcacattcaaacataaatctctggagaaatctctggagacagtactgaaaatttctcttcttggtctatgatttagaccttctcattttaagtcactatatcaaaaatatattgaagaaaacagaatttaaaggtgtctgaattattaaaaatatttcggacactagctaaatgtaaattacaatgcacattcaaggatttctgtataatcattttaaatatctgcgtggaattttctccttccactcatacctttctacactatatcataactaataccctctgtgatcttgacaatatcctctttgaacttgatttcctatgtttaaaataaaaatgatgctttcctataggctaactaattatggtgggtggaatggaagttaatattataaggcactttgaactctcagaacaaagtgctaagtaagcactagacagtggaaaataacgagccagatagtttctgtacctggccacaatttgaatattatagacctaagtaaattatcaatgttccttaatatataaagtcaataactttatatattttatacaatttttattttatattttattgtcactctcttaggattattcgtcactaaagtaagcaacaacaacaacaaaactccttagaaattgaaaggctagagatttgttctgaattctgcatttaaaaatatgtcatagtccatattctattggaactcacttaacactattccaaggtaactgcaaagattgttatttaaactaaggtttagaaattcatatcaatttacatctttatatatattaattatccctaaacacccttaaatataaagtttgtataaaaacaggtaaatcaacttctgatatagtataaattaaatcactgagacaaatattgaacttcaaagtatgcaaaaagtactagaaattttataaaaatatgcctaattaataaaattttataaaacaaaatgtaagactgaaacctatttgagaattttaatatacaataaaattttattataattattatgaaatgatgggtgttgtggcttatgcctgtgatctcagcgctttgggatgcagaggtacagtgatagtatagtttctcaagtgaggaacacttgagctcagaagttcgagataagcctgggcaacaacgtgagaccccagtctctacaaaaaatttaaaaattagccaagcttggttgcatgcccctgtagttccaactactcagggagcagagacaggaggatcaggtgagtcggggagattgagactgcagtgagccatggctgtataattacactctagcctgggtgacagagaaagactctgtctctctctatatatattattatgaaagtaaaaatatacatattattttcttatctggaaatttgttttaatgtatatattgccagttattaagcttctagtgttttcagaagattgctaagaaactgagagctgtggattctgcagcaattattactagcttgggcctagggaaagttacttaacctgagtttcatttccctcaaagggtttttatcagaactaaataaaataatgtctatgagccacttagtacagttcctagtactaaaaaatattaactgccagtgtttctaatatttcaattattataaattggagagaaacacaacagagcacaattgtctctaattcagaataatatttgctaattgtcatgaatttgatgtatatccagcacctcctttccaacaattagagtcattgttttggtttccttctttagtcagtcagagtgcttgtgaagggttagataagatgaactgagaaaaatatacctcatgataaaaagatacagggttctgaaaaccctatttcatgcctgcaaggatattagcatagaacatattaggaaatgttctgttaaataagaggctgctgaaacatttgtaatacagaattaaattgtgaatgatatatcaacttaattaatatttcctgagcagataataattatatatatatatatacacacacatacacatatataatatacatataatttatatataaacacacgcacaaataagcacatttattacatacacacatatgtacattcattacatatacacagttgtaatatatatgtgagtatgtaataaatgtacctatttgtgcatgtgtaatataaatatataaacatgaacatgtattacataaatatatacacatatgcatatgtgcatatatatgtgtatatatttatatacacatatatgtatatatatatatgtacaaacattgccttcaccttcattgtaatgatatcccactgaaatagtagctgatactatgctaagtgaagatgcttattggtgtcaaagatactatctatgcttaagtaaagatactaaattgtatcaaaaacgctaatctcttttggtcataatactgctaatttctcttactacctagtagttttgaacatgcttaacattttttctccttgaactgagggtaacatgaatgagacaatgaaataaaggagaaatctgatttttacaatatttataatgccttttattatttgccctccttttaaaatgcctgtataatttccactggcaattgtaggaatgccatttgtagatgaaaaaaatgttataaatctcttgacttggatatatgcttacagtgcaactaacgtgtatgcaaaatgcattgtcagaattaaattaaaaactcacttgtgaatagtagcatctaaaacagaaaggatatatgatgatttaacaattctgaatagctctgcagaactgtaaatcctactgtgactaataaactccccaaggcagaaggttgcacttttttctttattttaacttcctaaactaaagtttttgaagcttctcaggcaaaggaattaaatttcatgtaaaactagtcttacgatcagcattttactacatttcatcaattttataaccttcatggcttaaaataaatggatttaatatgctaatcatcattatagtactatttattgaatatatatgtatatgtgtatatgcacacacatatatgtactgatgtaccctctgtctatatatagccaccataaaaaaaaatgcttaaagtgaaaaaagcataaaatggcagacatagctccaaacttgaaacaaggacacctaacctcctactctacatcttgtaacctttggctgtgtaatttgggtgaaaacatttaaaatgtttgcactacaatttatgaagcatgagaaggttttcataaaccatctctaaaattcctttcagctatgagtttacaaaaacaacatgattccttcttttcatgatcttcttatggcatcttatttccactatggctttattaaacacttaacccatttcaaatatttggccactaaataatttgttaaagagcacagtggcttggctttgatggttttctctgtgtttaggaaagattggtttgatgaatagatggatgaatggctggatgcatgaatgtgtgaacacaaagagaaaaagtgaggggaaaaatttggggggtagagagagtgagagcatgcacaaaagaatcatctctgttgttaaaaagaaaataaaagattcattgcatgtagcatctttgctaactttcagttaagtttattccttttatgattacctaccatatataatttatatgttagtcaaaattaagtgagtaaagagattaaaaagtttgaactttctgactaaaaaataaagatcagctatctttgattttatttggaattatgaaatccaacgaaatatttatgcacaaatgtttttatataagtttttctagatgatatgctattgatttgcaagaggaatgtagatgtgttgatgcttggtttcaatatttagagtcttttattttaaacacaacttgataaggttgttatagaatatgtatatcttccaataattctattcgctgtggaaaatttcttcaagatatatcaaattttttctcaatattgttagaggaaattatgtgcaggatgaacacataattttttctctactatcttatcaggtaaataatgtttactccacttgcctcttaaatttataagacacaaaattttcaatattcaaactaaaatgcaagtttttagtatgattattaattaccttgtgtatgattattaccttgctaacttgggttttctggaatcgtaataatgcctgtgacaacaaattaacatgcaagtacattttcaagtctacttttgttttaatttaggtttaggtgtaacttatattttatccatacatctgaatttaggtattttattttataagattatatctattttataagattatacctaatttaatgttaaaaagatttaatcaatgattcttgagtgtctaaactattcaggctcttttatacacagtgtaagtataaaaatagattatatggcctaggaaattatattttgctaattgataaggactacctctgtggtagaggaaacaccaaaaataaaaccaagaaggagaaaaatcttcgaatgtttggagacttgttgagttggttaggttagtgaacttataaatattttatttaaaaggcatatttgtgaatgtatttttgggtgaaatgattttatgatctgaagtactgacttatttcaagcacaaaaaatctacacacacacacacacacacacacacacacacacacacatacacacacacagacaccaagcatatatctattaggttaaaagaagaaatttggattgtcattttaaaaattggcaagtaagtatatgtattttgggaatatttaaatacctttctaaaacataattatgtttttttaacagaagtactgtagcttgtcagttagctttgaattgtacaataatttatgaattttcaaagggcatacctgcattaatacttttacatatgacacttcacaatgaaaatttaagccattatcattgctttaatattactataaattgtaattaagttgacaattatatttttgtagaactttgtctaaatttggtatttttttcatatatatgctaattggtccattagtccgtgaaaattgttttcagtagcattacatgtagtacaaactcataaacattaatatttttctaagatataagaagacatgtaaacatgatatagttttcatttaaaaatatatattttggccacttgcatgtcagtatgtttgtataaggattacataaagcctttatttctccccccataaaaggaacagaatatcaacctttagtgatggaaatgactaaaaattgctgtaataggaatattcaggaggtgttcctttcctgctttattgattggttattcttcccttcagtttggccaataagaaatatatagagagtactgatgaaatgctgtgtgtgtgtgtgtgtgtgtgtgtgtgtgtgtgtgtgtgtgtcagtggtggaataattattttatattgacaggtctaatctgcttttcccatgaaggttataaaataaaactgagtgtaaaatcatgctaataaaaatacctgagaaggatctagatgctttgacatcatgttaactacatagttaagaatgttacatttgagcaactatatagttaacaaagtagatctagtacctatagtattggattatctagattggtaatatttgtatattaatacaaagaatagagatgactttgctgtgactattggaagtgggtgaaattagaaaggaatttctgtcccaggatccttcctgtggaactaatcacattgttttcagaatgcttgtgttgaagacaaaatactgcatgcactcctgtagtacaaagtcagtttaagatgagatttttatagctgaagaaaaaagtaaataaataactgggatttgaaatgttggataagattttctgttctttgattacactgtttgcaataagatgaactgtttcttctgtgtacttccttgctgtttgcagaaagatgaactgtttcttttatccattttttcagtatatcttaattctgcaaaggattgactaatgtgctatcatttctgcaggtttctgctgtttattaacccaagtttaatgtttaaggcaatattaagtgttctgccatgtaatagtaaaatgcttccatcaaaaatgtattaccaatacagcagaagtcaataacgtcacctgctataaaacaaggttgataagaagcccttttttaaagactcatttagaacccacgacaacttgaaacatctttgtataaacacacattactactttgcgaatagacatttagattatctggtttaaaatgaattggttatttcagcttcaattgtaaaaaatttgtatcatacttcctaacaaactattaaagaaatttgtatatctaaacctgagagtattaaatttcaatgtaatgattaatctagatctacaaaggattatcacatattaaaataattcttatgaaagctgcttaaattagcaagataggtcaaacatttattgtctaaatgtttttacaagagcttagattaaaaagcattatctggttcagaaaagacaggttaagtaaaaattaaagtctataatatatatttgattaataaaataataatattctcactagtaaacatctgataacatattaaggaagtactcaatttatatgtcaattttaaaaattctggccaggcgcggtggctcacgcctgtaatgccagcactttgggaggccgaggtaggtggatcacgatgtcaggagatcgaaaccatcctggctaacacagtgaaaccccgtccctactacaaatacaaaaaaaaattagctgggcgcggtggcaggtgcctgtagtcccaggtaattgggaggctgaggcaggagaatggggtgaacccgggaggcggagcttgctgtgagccgagatggcgccactgcactccagcctgggcaacagagtgagactccgtctcaaaaaaaaaaaaaaaaaaaaaaaaattcttcattagtttctctcaagttctcagccatggacaggtattcaaaatatataggaaacaaggctatggcttgaggagactgatacaatccatgccaatataaaagagcagtgatggccaggcacagcggctcactcctttaatcccagcacttttggaggctgaggcaagtggatcacgtgaggtcaggggctcgagaccagcctggccaaaatggtgaaatcccgtctctactaaaaacacacaaaaaaatagccgagtgtgttcgcgtgcacctgtaatcccagctactcgggaggctgaggccggagaagggcttgaacccgggaggcggaggttgcaatgagctgaaatcacgccattgcactctagcctaggcgacagaacaagactccatctcaaaaacaaccaaccaaccaaccaaacaaaaagagcagtgaaaagataaagccagctccacactggctttataatacacactgtgtatataatgataatacacacaatgtgaggtttaaacaaatgtgtttaatacacacaatgtgaggtttagacaaatgtgtttaatacacacaacgtgaggtttagacaaatgtgtttaatacatacaatgtgaggttagacaaatgtgaggtgtagaatttgagcatgttgctcaaggtcgtatacttaacaagtgacggtcagtatttaaaatcagtttgctcttagaatcaatgtgtttaccaaatattccattaccaatcaaatagtcaataaaagttagcacagtgtttatcatcatcatatttacacatggataaaaaatgctataattatccattaggacttacattagttccttgagaaatatttatccattccctctgcacagagatttgaatgtctttacattttctataaatattattgactttactattataaaagataatgaaacccgtgttcaaaaaaatggggggagtaagaaaggaaggaaatgaaaaataaattaagatcgcaagaaaggtttgattcctatatattctatgaatggacctcaagaagttttctgaggttatttccttttattcagaaaagaaatcttccagctatgaattccttaaaaatttcatgatataagatatccaatgtattggatactttgtcatgtagaagctttttatacctattatgttttcttccccatgacctccccgcaataacactttgaggtactatttatcattccatttggaagaagtaactatattccttctcagctattacactgcttccagtacaatgtgtttcattaataaataaagtgcatgctctaagtgaaagtatatgttttttaaacacataagtctccttgtcatatttccagaggggatgacagaatatttatgttattatttaatggcaaaattcacttctttctaggagcaatttttgatgaatctgccaaaaaggatgatgaggtatttcgcactgcggttggtgaccttaaccagaatgaggagatcttacagactgagaaaatcacattttcagtgacgtttgttgatggcaacaaccctttccaagcagttcaagaaggtaaggtcatcagtatttattttggttttttggttcaattcaagtggcaatgaaattatctttgatgaaacttattaaacatggacatcatttttgtatcttgttgataatagggcattattttccttggagatcactgttttgtagatgttaatcttgtattccagttttgaaagggcagaatgtggaaagttattatattaattgaaatataatatgaaaatgaacaaatatttacatgtaaaagctttgcaacatttttatgacttcagtgtaaatgaaacatctttttaaaatagtattttctaacagaaagtttactttggacttctctgagataactgccaccttgggtattgttacaacttgggatgacatatcaggtgaactcatgacaaatgtactgctgaaagaaaaacccttggacactacatacaaatcaaagattttgtattaggactctaacatactgacctacgctataaattttactctctacgaggcaccaaatattaaagcactttcctccttttcctctgtaaacctgagtaaattaaattttttcattggtgcaaagtaatgcaaataccaattatttttaatatattggaatcatcattcctattatgaaggttttgattgaaagatcctagaaaaatggaattttctgtttgcttctattagtctaattaaacatttagccttgatccagaaagcactcactttaaatgaaactattggttgataattgggaaggtctgaatgtttgtgtcccctcctaccccgctgcataggttgaaactgaattcccattctggtggtattaagaggtggggccttcaggagatgattaggtcatgagggctctgtcctcatggataggattagtgcccttataaaacaggcccaagggaacttgcctgccccttctgccattcgaggactcagcaagaaggcaccgtctgtgaagcagaagaagatctctcacaagacacctaatctgctgggcccttgatcttggatttgctggtctccagaactgtaagcaataaatttatgttacttataaattacttagcctgaggtattttgatgtagcagcctaaactaagaaactagtctaccttattttttattgtgatgatgtatttaaactgaagataatgaatgcaaaattaatttagtcaaataaaacatttgcctcattaaaaatttaaatagaatttggcagaagaaaaggcagataccatattaactgtaacaaagttgggcaggattttttttgtaatgcaaacattgaaagagtaaggaaaataaaagtgtctgaaaatgtgtacttttcatttactgttttatctgcttgatgcgcaggtaacatttattgaaatatattttcaatcaatagcactggctactgttgaaacttatttatgttagttagaaaatagatatgtgattggtggtctaaaagttttttccttgttaatggaatggagtaaaaaatcattattttttgaaatgaatagaactgttttaagtaaaaactggctttacaaagaataggataataatgtttataataatacaatgagattttaatttttaataagtaaacattaatgcaaaaagtcagattgaaataaccattcagttatttacattttaaaatcagaatcatcccgacaatataaggatttcaatactggaaatgttaataaatattaataaattttctatggaaatatttaaaagcagtataaattaatattagaaataatagaaggatctggaaaatcataacatagaatttgaagataccaaatcattttaaagatatattcaataggaaatatatgtcattcatttttaagaaatctgtattatttttctttcttaactcttatttgtaaggaccagaatgtgagcaggaaaaacgtgaggactgatttctttctttatcttcttagtaactacatattaataattgtgaattaacttcaaagacaggctaaactacctatgctttttaaaaattaaccttgagtaaaaaagtagtaagaaaaaaaatgaaatgaagacaacacagtggtgagaaaccggaattataaattaagaagaaaaagtccctcacccctttattaaagactataatttgaaaagtaatgacagttttttaaatactacacctttttttttgtttcaacattgctctctttaattattctgctgccagctaaattctgaaaacaaaaatatcttgcaatagtgacgtgacggcactgaaagcaaattgagagaggcaataaggttcccagatagagaccactaggtatttgtcaagaaaaatgaaagagctggacagtttgcctgatggtttctgatactaacaggatgttctccaccagttattgtgatggtcagctttgggtaataaacctgaaatgagttccaggaagctttaaagacaatttgtttccctattcaatatcaagaagggtttcagttaatgttagaagtaaaaatacttatttatagaattttttttgtaaaacggtggcttgaaaaaaataagagaaaatattctattgaaagataacaaacaacccattcagaagcactattttcttcaatgttttgaggaagtaatttaggagaaaacctcaactgtgccattgaagatagtcaactttctctcacatgtttactgcaatactatgcaaacttgtattgagagggactaacatcaccttgtctgttttcatttttttacagtctaaagaaggaaaaaagattcaatgatacaattataagtgattgcttatatattagcactcctaatgaatttatagaaaaactcatggttttgatccctctgcctgtttattcaaatttgaaagtctcatccttgaacaaatagcatcatcaaacatatagatagtaataatgacaaatgataatagggatcactcagaggttagataagtaaaatctaatagcttgaaatcctcaatttattttattgttagaatttcctctaatcagccacatttaagagctggttttttattttaaaaatcaaaatttctgttcactgtatctttctactgttatcacttaataagagagaggaattcagtgacagcctatataacccataaacagtaataaagagtattggtgttttggaaatcttcctttgtagctttggctacagtacatttttggatagcaattaatcctttagaaaatgagtttctagacagatacctcagttataacacggggtacacattccattctctggagatcaatgactgtatctgttaattttgtcagtatttggtaacattgatttcagatctttgaaatacatgaataatagaaaaaaatttctgttttcacaaaagttatctggaaataaattacctattttgagattattcttttttcctttcttatgaatgtatttgttgataagccatttttcatcttttgtgtactgagctgcaggatattaactaagggcaaatacattttcaaaccttaactcacgaggttttcttgacaattttttttttcatttggataggctattttggtatctaggatgtagtgttctccgtaaaaagataaatacaaaaagaaaaaaaaaacgtatatgggttatttttaaaaaccttgagaattataggggtggaaaattatataaatctggttgaatattttcacaatttagatgaaataattgagacccagagaggttaaataattttccctagttcttctagggttaccatgcttgtgtgtagcagaaaaagaactaaaccaagacctcctttacatcactagtccagtatttttcttgctatatacccacccatgcatatatatagacacacatgagatagcacaatgtattataggacttcagtaaataatgtaaggactcaaaaaagtagcagatttatgttttgatatttatttgctatttattatttatgttcaaccatggaatagtaggaaaatttcaatctaggtgataaagaccagttacattatataaatcaatcttgttcttttggccttggttttcctcatttgtaaaaaatgaaggaatctgaatataatgtatttttaaggtaactttcatctctatgcttctatgacccttaagaacacagttctagaattagaaccttatagaaacgatcattatttagtgtccctttagagaaagtttcacgttgctgaaattgcctcctagtttttctgtgtctgactttaaaatagattaaacagatatagggtatccattgtttgttctgccacctcattcaactattcaccacaacccacagtactcattaccaccaatagaattcaaaggatcttgtgctgattcccttaacctgaaccaaagtagctgttcataggttactctttttattcataagttactctttttattttctcttataaattttttcttctgtggcatctatgtacaacatttagcataaatgtacaaatgtttttgtgaaaaacactgctgtcgtttctgaaagcagtacttattgtttatattgttagctcttagctgagatgaacataaaatgggccatgaaaggtggaaatttataagaaaacaaagtcaggaaatgtaaggatggtatatttgtagaaatcctcaagtcaaaaggtgaatgaagtatgaatccatatataattcttacatgtatttgatgtattaagaaggaagtgaagcatcattctttgatatttaatgacaagattcagctaaacaattttgaaataattgctcttattagaaaaatacctaaaaataagctgcatcgtgaatataagggcaacattatactataaagtcacaaatgattctgtttgaaagaaaatgtattaaactataatacttttttatgtattgcaaaacattataaacaatatcattataatttaaaaacacaaggtttttgaaaaaatgtccagtgctttttgaaatataaaaatttgaatcaatatctcaaagtacaattcaaagaagcaaactcttattgtaatatgcagtaatgggattcattaaagttaaactgttgtgatgctggaaatatgaacacaaaataaatgatatttttaatatatataaaaaagttgtagttaatagagatcatcttgcaagtttcagtctggtagaccttacgactacttctttgcatatcttaacaccagtgttgattacccattgctcttgtaaaaggtaaacatttcactaataaaatgatgatttcaattagatctgcctcatatatcttctaaaataaaataatttccagtatatgattatgcttataaaacaataaaactgcattcatttttggtttatgttaccaatctcatttctttatagttataaaaatacatacatatttatttcatgtgtgtaaatgggatgacaggaaattagcacagtcagaaaaagtgcaaggaaatataattaggaaaaagcacatctccaaaacacattaccatccatggtgaatatttctggtcattgattaaatctaaatagtctagtccaaagaagatgtaaatagaatgatttgtgtggctgcattatttgacacttctttccagggattattctcatttatatttcatttatttgcccactgctttaatatgacatttttactgtgattaaaaaatctgctaatttcaaacttcttacactggattctgcaactttcctagcataatactacagtatgtgtaccccaacagcctgtgtttcctggaccaattttgataacttcaattccagcttattttctgaattgtctgacaataaactaaacttgagaattgttgtctgtaggagctgagaaacaaaactaggagatcatgtgggtatgattctattcattcattcattcattcattcattcatccattcgttcatttattcactgttttcattcctactttccttcccacatcaaagtcaaggttgtgccttgagtctcaatgtctatcccagtgctctggttaactctggaccatctacatgtgtgaattagtggaaggagcaaatcgtgttgttgaacagccatctccaaacacctgcacatcaggagggatgctggatgtctattcagtgactaaaccccctgttttcctctatgagggaagatacttagcttggtcctttccccagcaatctcctgccaaaacctgtattactttttctccttgcctgtcacattctaaagactgggccacaaggtctggaattagaatctatcttatgtgtgatctttagtgtccatcatcaatgtagtattaaaggacaaataattctatgcttgttagagacaacaccaatatgcattaagaaaaaaaaaaacagctcacacaaaccttttccactgcagaatttcccattaagagcaattaaaaatatatatatttagaacctaattttgagattactcagtcaaattaatttattcaagtgcttattaaatgcctagtacttccaagattgagccagctacaatgggagataaccaaaaaacaaaagaacacagcatataactccaggaataaaaatgtatttgaggaaagctgtggatttttaaccatgaaaaagcatgccgttcccctctacctttaacttgaggtttaattgtgttaataatagaaggaacaagatggtctagctttttaagtatacttttcaggaaagacaggtattttcttttttttacgatcattataccaaatttatttatttttatttttatttttatttgtttaatttataaaggaaagaagtttaattgactcacagttccacatggctgaggaggccttagaaaacttacaatcatggcagaaggggaagaaaatatattctttcttaaagaaggttattactttacctttaaacaaaatattaatgaagatacaaattgcatagtctaatcttttttcctgttatttgttgttttactgctgtatttgtatgtctttcccttacctcatttgatatcatactcttgaagtaacaggtctctactacagtgaatggattgaaattcagatgtttacagacctctacatcataattttatagcctttgtgcttcgaggacttttacctcactatctacaattgtgatctgttgtgttacctcataaaatatatattttagcaatttgtgctgctctggattttgttttatttggaagagtctttagcagcgttctgtgaaagctgtgtttaaaggaagtaaagatttgttcttttgttgtctgtgttctttcttctaccaattcttttctcctaataatagcacatcactttcttgtattcttctatgtctgtatgtatggtgcatggatatggtaacataattcacttttaatcagtcttttttgaaactgactcattagaggaatcactacatatcttaaattaactctgaatatctggttgatttgattaaaaaccacatttacctacactcgcagttgtaatgagagatcattatgtagtcataaaataatttaagttcatgttgacaaaccaatgatgacttcagtatatttggaattttcaatctgttatcactattatcaatatccaacttttatatgatccagtttacctggttaattttagaagaaatagcaagctgacatttactttcacatttaacacctattttttgttgtccttgacaagtgtaatgaggtttatgggaatcacactgaatagtcttttgggactcatgcaatagtttgttatcttgtaattttcaaaataattattacagaaaagctctcttttaaaaggaacatgcaataagccagtgtgcaataggaaattgcatattctgggaaaaaaaagaaaatgaatccgccagtaccttttgggtgcctgtgaacattcagtcttgtgccaactactctgcacactgtcatgctctccattggctgccctgtcgtcttacatggttaatttggcctttactctgtaacctagtgttaggtcctgacctatgtgtacctctcttctttttgccctcccattatagtactatttttaaactctttatttagcccccttttaatccttgactctccatattatactgcagacactcaaaatgtctgcatttagttcggtatgtaaatcttaaacttggtttcatttacctcgcagggaaaaacatatatattaagttcatagcccatggaattagatacctgcctttattttatgtatgaattctgctctatgtcttattatctgtgggcccttgaacacacctactatttctgagtctcagtttcttcacatgtaaaatgaggataaatacatactccatagcattaatatgattatgtgattattgtgtaatgattatatgggattgtaaatatggtagatgggttcctccactaatctaattacattttaatgatagtgctgtatgtgatgatttagtaccattgcatgtgtccctcagtaagttttcacccgtttccaatatttccttcccaaacatattctagtacttttattagtggttcccatggatacctctgagcctaaccttattacctgcgtagtcagcgacatatttttgcccaaatgggactttccttaccaagattttgagtgctgtggttttaaatatatataatgaaatgcttttcctttttttttttttttttttttcctgtctctctctctctctctttccttgggctggttctgctagtcagcacaggaagatgagaattatacatgtagtgtaatttatttggcaaatagtagtgatgttgcaacatgtgtacttagggttgggaggatttaaaataccttgttaccatttctgggaagtagagaaaggccatggaggccaaattaaagctttctgatgatttgtgtaggcttaatacaatcggtgaagtaaataaggcgctgagtcatagctaaatggaatttggctgtagagcaacatagtgttgtaggagagtgatatatatgaaggttgaatatagaaattaattcaaggaaagctttatgctttgaaagatggatcatctctggcaaatttatatctgacatgattgtttaaaaggttatctttccatgctttgcacatttcattgcaattatacatagggaaatattaactttaaaaactcagtcatttgcttatttgaatttcttgtactgtacttcaaaaacacatgatatcatgttattttcttaagaatttatgcctcacttcaaaacagatttactttttggtctttgatagactaacgtgatatgatggttagatgggttaagtccatttcttaagctatatttcaaacataaatatacattaaaatgtctactatatataaaaaatatatattccaggccatgcaccgtggctcacgcctgtaatcccagcactttgggaggccaaggcagatggatcacgaggtcaagatatcgagaccattctagccaacacggtgaaaccccgtctctacctaaaatacaaaaattagctgggcctggtgccatacacctgtagtttcagctactcgggaggctcaggcagtagaatcgcttgaacctgggaggtggacattgcaacgaggcgagattgcgccactgcactccagcctgggcgacagggcaatacttcatgtatgtgtgtgtgtgtgtgtgtgtatatatatatatatatatatatatatatatatatatatatatatttctcagaatgtattttaggggagggtgtaggtggggaagcagttgacaaatcaaagtcagaaacaatcttagtatagagaatattcttgaatagtattaccttgaatgctaagaaatatttttgtatttttgaatgtatacttatacaaacagaaagttctgaagtggtctcatgtactcattcatgttattaaacctgagcaaggtatagagggctcaggtgagagagggtaactagaggattaaaaattaatacacaaaacagaaaaggtcacattcttacaggtcaagggatgagaagttgtcatattagcctcattctacctgctcagaaatcctgcttttattatgttatatttatttgttcagtaagctttagtgtttagaattgtgttgcacagttcaaagttttatctctatattaactccaagaactacgggattgtgtaaaaagactgaaatgatgactgactatggggactttttcgttgatgctgttgttgctgccttctgttgtttgtttttcttttaaagtcaggcccctcttctgtagggctgctgtggtttgctcggggtccacttcagaccctattcacttgggcccctcccatacctggaggtgtcatcagtggaggctgcagaacagcaaagatggctgcctgctccttcctccgggatctccgtcgcagagggaaaccgacctgatgctagcaggaatgctcctgtaaaaggtatctggtgacccctgttggagagtctcacccagtcaggaggcataagatgcaggacctcttaacaaagcactctggctgccccttggtagaggaagtgcactgtgctgggggcactcccatacatctggactgcctagattcctcagagccaccaggaaggactaagtctgttgatccatggagaccacagccgtccctcccccaaagggcttaaccccagagagaccagagctctgtccctacactcctgcctgaagttgctgaaattcctgcagggaggccccatccagtgaggaaggatcagtcagggtccagcctaaagaggcagtctagacaggatctgccacagatcaagtggacctgatagatatcaatagaactctccacccacaaataacaggatatacattcttagcagagcatggcacttacattaaaattcatcacataattagaagtaacacactctttagcaaatgcagaatagctgaaatcataacaaacaatatctcatacaacagtgaactcatattcaaactcaagattaagaaattcactcaaaaccatacaactaaatggaaattgaacaacctgctcctgaatgacttttggataaatcatgaaatcaaggcagaaatcaagaagttctttaaaactaatgagaacaaagagaaaacataccagattctctgggacatagctgaagcagtgtcaagagggaaatttatagcactaaaggcccacatcaaaaagctagaaagatgtcaaattgacatcctaacatcacaactaagagaaatagaaaactaagagcaaacaaaccccaaagctaacataaaacaagaaataaccaagatcagagaggaactggagggagagacatgaaaaacacttcaaaaataaatccaggatttattattatttatttaaaaatgtagaccacctgctgaaataataaagaaaagagaagaatcaaatagacacaagaaaaatgataaaaaagatactgtcactgaccccacagaaatacaaacaaccatcagagaatactataaacacctctatgcaaataaactagaaaatctagaagaaatggataaattcctggacacataccccctcgcaagactgaaccaggaagaagttgaattcttgaacagaccaataacaagttctgaaattgaggcagtcataaatagcctctcaaggaaaaaaaccccagggccagacggatttatagctgaattctaccagaggtacaaagaggagctgatagcatttcttctgaaactattccaaacaattgaaaaggagggacttcaccctaactcattttatgaggccagcatcactgtgataccaaaacttgccagagatttaaaaaaaaaaaaaagaaaagaaaagaaaaaaagaaagaaaaagaaaaaagaaaaagcttcaggccagtatccctgatgaacatcgatgtaaaaatcatcaataaaatactgggaaaccggattcagcaacacatcagaaagcttatccacaatgaacaagtaggtgtcatccctgggatgcaaagctgtttcaacatacacaaatcaataaacataattcattacataaacagaactaaagacaaaaaccacatgattatctcaatagatgctgaaaaggaatttgataaaatccaacatcccttcatgttaaaaactctcaataaactagatatcaatggaacatacctcaaaatattaacaggtgtgtatgacaaacccacagccggtatcatactggattggcaaaacctggaagcattcaacttgaaaactcgcacaaaacaaggatgccctgtctcacgactcctattcaacatagtgttggaagttctggccagggtaatcaggcaagggaaagaaataaaggttattcaaataggaagagaggaagtcaaactgtctctgtttgtagatgacatgatcttctatctagaaaaccccatcgtcttagtccaaaagcttcttaagctaataagcaacttcaacaatgtctcaggatacaaaatcaatgtgcaaaaataacaagcatttctatacacaaacaacagacaagcagtcaaataataaatgaactccaattcacaattgctacaaaatgaataaaataccttggaatacagctagcaagggaagtgaaggacctcttcaaggagaactacaaaccactgctcaaagaaatcagagaggacacaaagaaatggaaaaacattccatgctcatggataggaataatcaatattatgaaaatggccatactgctcaaagcaatgtatagattcaatgctattcccattaaactaccgatgacattcttcagagaattagaaaaactactttaaaattcatatggaaccaaaaaagagcctgaacagccaattcaatcctaagcaaaaagaacaaagttgagccatcacactacctgacttcaaactatactacaggctacagtaaccaaaacagcatggtactgacagaaaacacacacacagaccaatggaacacaacagagatctcagaaataagagtacacatctacaaccatttgatcttaaacaaacctgacacaaataagcaatggggaaaggattccctatttaataaatggtgctgggaaaactggccagccatacttagaaaactgaaactggacccctttcttatccaaaaattaactcaagatggattaaaggcttaaatgtaaaacccaaaatgataaaaaccctacaagaaaatctaggcaataccattcaggatagagggagggacaaagatttcatgaagaaaacgcccaaagcaattgcaacgaaagcagaatttgacaaataaatataatttaactaaagagattctgcacagcaaaataaactaccatcagaacagaaaaccaacagaatgggagaaaattttcacaatctatccacctgacaaaggtctaatgtccagaatctacaaggaacttaaacaaatttagaagagaaaaacaactccattaaaaagtagtcaaatgacaagaacagacacttctcaaaaataaaataaaaaaacatttatatggccaaaaacatgaaaaaaagctcaacatcaccgatcattagagaaatgcaaatcaaaacaacaatgagatactatctcaagccagtaagaatggcaattattaaaatgttaagaaacaacagatgctggtgtgactgtggaggaagaggaacacttttacactgttggtgggaatgcaaatcagttcaaccattgtggaagacagtgtggcaattcctcaaagaactaaaaccagaaataccatttaacccagcaatctcattactgggtatatacccaaaggaatataaatcattttattataaaaatacttgcatgcgtatcttcattgcagcagtattcacaatagcaaagacatagaatcaatccaaatgaccgtcaatgataaactggataaagaaaatgtggtacatatacatgatggaatactatgcagccataaaaaggaatgagattatgtcatttgctgggacatggatggagctgtgagctattttcctcagcaaactaacacaggaacagagaaccaaacaccacctgttctcacttataagtgggagctgaacaatgagaacacatggacacagggaggggaacagggaggggacttttgggggttatggagagagaaagcatcaggataaataactaaggcatgtggggcttaatagctaggtgatgggttgacaggtacagcaaaccaccatggcaaacatttgcctatgtaacaagcctgcatgtcctgcacatctatctcagaacttaaaataaaatattttttaatcctatttattatgtctgacaaaatggaaacaggcaggctttatgtcaaaccactgtccttcagcttacccacaatttatgccagggatccatgtgagcacagaataaatcaccagttgatatagttaggcttcctttttccacccaaatctcattttgaattttaatcttcataagctccatattccccacctgtgaaggaaaagaccaagtggaggtaattgaatcatgcgggcagtttcccccacgctgttctcctgatagtgagttctcgcaagatctgatggttttataagggggtctttccccttgcttagtatttctccttcctgataccttgtgaagaagatgccttgcttcccctccaccttctgctatgattgtaagtttcctgaagcctttcccagccatgctgaactgtgagtctattaaatctctttcctttataaattacctggtctcaggcagttctttatagcagtatgaaaatggactaatacaccagtgtacattttctttctttggaaactgcttaatgcttaaataagagaaggggaggccaaatgacggaaactaggaatttccaaggtcaatttattctttcaaaaataagaatcataattgttcacttatttgtaggatacttcttattcacggtacactagattgggatttatacagatgagttagactaatttaattcaagtactcaaggaatgtatagtctactaggggcaatatacaaagagatctagaaaagttgataattttatttatagtggaaacaagtgacataaaataatgatactaaaataacaggtagaatgtgtatgatttaaaatcaagggctcattttttataagatgatgatgatggatgccaaaaacaaacaaaaaacctttaagatttcaggttgagtagtagacagacatgaaaatatgaagggaatagcattccaagctatttcatatgggaaagtaatttggaggtaggagcttgctgtgttgaggaactatatgttcttgtggacactcaaatttttattctgttgccttacaaatatttatttccatcatcaatgtcattccttgcttgtcaaccatattacttgtgagttttttacctaaatcagctttggttccttatactccccttggacatggtgtgtattccgaaggaaaacctggtattcctgcagatctcactgacattttggcatggagacttttttactggaccctttttagattttaaattcacctgctataattctgattttgaatttaattatggaaacataagagcttttcctgtaagtgttcttctttccaggaaaactaaaataaataccaaaatttgtttttgaaaataaatttactcagttttcctgttcttctaacacagagtaattcacagagatatattattgaatcctaagaaagaaacctcattttgtggcttttatagttttctgtacacttgtacaaaagagcctcatttgataaagccaatagtaagagacatttattcataacttatcacatccaatgaactgttgaaaatactttgttttctcctgatctttatactgacttatgaggtataaggtagttactattcttattagcgttttacagatgaagaaaatgagcaacagctgggttaggttaacttattacacctggaacctttagaatagtggctagaacactagtttcgctttaagtctgctgattgggaggttcaggcatgtttcagtgagaggaagaagaaagaaggtaaggcatttattttctgtcttctgtgtgtggttgtcttaagctgactgtacctcaaacaaaattgatgtatctcttgatgcatcctgctctgtatcactctcttgaaattcactgtcttgtcctttatcctttgggcctggaactggtaccacctcactgctactagctctgggtttttgcactattcccctttcgttggctgcactccacccagacctgcgtaatttaacccattgaaaaagaagccctacctaaattatcctattttgagttgccattgttttctattggaattttaaccaacatcattatttaactcatatttgtctaatctaatcagaaagtgttacatctttgattgtattataaagtcaatctatgtatcacattacaaaacacagtaagggtgcctcacaaagatttctagcttctgtgcattgcaagataaaatctgtatgttcatggacactttaatgttgcagcaaaggtcgacatgatgttggagatactgagtggcagcaccccttccaaaaggcagtaagtctgagcagaaacacagctatctccaaattgccaatacacagcatagttgagtgtctgaacttactcatttatgcctggttgcaattttttgaatttttgcaatcagaccttggtaattaccttgagcagcaggatataaataactcccacatgcttagcgttccaataatggaacactaggcataagtgggtgaaggaaacatcactatttttaatttaaataatatgacaaatgaaataaacacgaatgttaatgctgaagttatatatttaaaatgtcttcttttaagcctctactttggttaaggaagttgatgaatcagttattcaaaaatttcttaatattttattttttgtgataagaatttttcagtgtttttcctttatttcattctttgtaggagcgttatactgtgtaaactagactcattattaagttactgggggtggggaagaaccgcaagttactggtgaacatttttcatagccaagattttcttttgcttggtaactttctgtcacctattacctagaataataatgagaaagtaacgagttacaacagacctgtttgcatctcatatctttttgtttcccagacttactcattaaataagtgctaatgaacagcaaatggccaaacaccaggcagtagagcaggcagaagagtaggaaaggtcttacaagatgtgatcagtataataaggttctcaactccatcactaattcaacattgttcagcctttcagcacaagacactgaggtagaattagcgaagaatgtagaggtaacttagaagcactctacctcttccaaagctttaaactatgaatgaagatgaaaaatgtgtgcgtaaacaataggataacaaggcaatatgtgtaagttctgtgaaggagaaacaaaatacaaagttcagtagaaaaagaggtgacttataactaaggatggcaagttgaggggggaaggaaaaaattaatgaaagggaaaagtagtaagctctgctttcctttctgaaaggagaaaaagtctaagcaacagaatcaggtatattcaaaaataaatccttgcgactgatagaaaaatgggaggtaggggctggaagatattgagaatgtaaacatcatgctgcaaggacagaaacagtaacttttctctcaagatctgtgtcctattcccaacttcaaggacacctctttcccaaactagtggtgcaatagtgaattcagcatggaaagactcatgattcagcaagtaaaattgaagactaataaagacattaataaagatatcaatcttcatataccaaagtcttattatttcttttaaaatgcagcaaaagtaatgaaaatggtttgagttcaaagatgccgcttcaaaggtacaatgcctccactgtgttttaagagcaagtgatattttaaaataattattctacatcttcaatggagtaattgcttttcacattaaagaaagagataagcgcccaagttttataatataaaaagtgctatgcatgtgtattaactaattctctcaaaggagttttactacacatttggcattgtgtgctataactcagagtgtcatggtgctgtgctcttacatgaaaacatggatggtttcctaactgagttagacagaagtagataaagaatatcaatatcatgtactgtggttcctttatatgcatagtttatggttactatttttttcattaagtgagataatgttttaacataagtatttttattggtctgattattacaagtggccattgaggtttgtttattctgaataaaacaagctcttcaatttgtaaaaattggccactttgttaatcgttcatttattctttcacccaaatatatattgagaacttataatttgcaaaatactgtaagtgctaaataccaaggtgcatcaatgtgctttctggcttcaaaaatttgttgtttagcaaataaaagacataaataacattaatatagatgtaaacagtcataatacaaagtacagtaagttataaagttttcattagtaaagatgaagtgttagaggattttgagaagcactgatgttggtatgcttactttctgttcttcacacacagcttgaaatacttgtttttccttacatgcttagtgtatccccaatatttggtaccaaatatataacagtctgctcgaggttatttaacattatttcagtcttgagagccttactatgtggttaagttttcattaatttaattaatgtaacaaatatttatcgagtgtctatgtgccaagtattagtctaggaattcatggtaccagtgtaaaacacaatatcttgctctctgggaatgtatattctagttgaagaaaaaaaataataaagacaattccagattgaagagttagtattaaaaaaaatgaagtagcatactaggcataatcatgatgatggtgaggtgccatttaaaataaagtggtcaggaaaatcgctttttgagaagatgacttttgagcagagacctgaatgatgaaagggcaaaagtgatgtggctctccagtggaaagcagagtgtacaacagttactggaaataatatatattatatatatataataatagtagatcactataatttttctttcttctcgtgaccacattagtaccttatttccatttatcatgtaactgtcatatctttgagaataccttcttcaattatctgaccactacttgcagtcacttatattttcacaccctgccttgttttgaaaattcatttttaaatcaaaattacacatactatagatgcagtttatctgcatatttgattttatttagaaactctgatcttgaaaagagagccagtgtatctgttaattaggcataatctctttactattgaaaatgtatgtggattatcactattatctgttaccataatttaataaacttttcatccacaatgttaaactattcaaaagagtcccttaccctcttctacagtagcagagttttagctgggtttatggtcccccaaataagattacatttcatacctttccttgatcctatacagagggccaatggaatgtgaacagaggtgtggacaacttccaagtcattccaacttaaacacaagctctttgccttagactgacaccccctttcaatgacctggaatatttacgttgctgggacccaggttttaccaggcagatggggacaatgcattaggggatgactgagcaacaagataggaggaacatgattctcctgtagagaagagttgccctggctggactgctatgagtaagagaaaggcatctctgtcttatttaatacccactttatgtgtgtgatattgttccacttttaaccctaaacataacgatcatacctgtctctaaatatttcactacatgtaacagaagtatcattctgcccaccttagtaaggatatccaattctgagaactcagatgctccacttctgttttttaccattttcttcttttcctttcccttccccctccttttccacttcctcgtccttcacgctgtactgagacatcatttagttcatcttattaaaatgtacaattaaactattaatagtaagtttacagagttatatggccatcaccaaaatccatttgtagaacttttccatcacccaacaagctctctcaagtccaatcaattgacagttccatactaccttcaagccaaccacgaattgtttctatagattagcctcttctgggcatttcattaaatggaattagataatacaaaatcttttgtgtctggcatcttagaatgagtttttgatgtttatctatgttgtagcaagtgacaagatttttttcttttaatgatgaatagtgttctattatagggatatatcattttgtttttccagtcaataattgaagaaacttagtttccagcttctcttaggaaaagtgctgtaatgaatatttattgaatagtctgtgtgtgtgtgtgtgtgtgtgtgtagctgtatatatatatgtgtgtgtgtatatatatatgtgtgtatatatatgtgtgtgtgtatatgtgtgtgtatgtgtgtgtgtgtgcatgtgtgtgtgtgcatgtgtgtgtgtgtgtgtgtgttttagcctgcttaggctgcataataaaatacaacagactgggtgtcttaaacaacagaaatttattttcttacagttctggagtctgagaagtccaagatcaaggtgccagccaggttgaagtctgttgaggactctccacttaggtttcagagggccaccctctttatatgtactcatatgatctcttctttgtgtgtgcatgaaaacagagtgtgctcaagccctctgatttctctgcatagaaagacactaatcctatcagataaggactccatccttatgccgtcatttaaccttaattacctccttagaggccctgtattaaaattaatccacactgagcattagtgttcaacatatgaacttttgaggggacacaaacattcagtcatagcatcttactagggtagatatttagggagaaattgctcagttttatgatacattaatgtttaccttcttatgtaactggacagctgtgtactatttcacattcccaccaatttcttcacatttttgccacttttgtaaaatacgtgaagtggtatctgattattgttttactttgtatttctctaatgattagtgacattgagtatctttttactgacatctgtgtattttctttgatgaagtgcttgttccaatcatgcatacatatttatttgaggttttttgacaatcttatttattttgaagtattcctttataatcttgataagagtttttttttaatcagatacatgtttgcaagtatcttctactagtccatgattttcccccctattttcttagtggagtattttaaaatgcaaattaaaaattttgctgcagttattttttaaacttatgtgtttagctttgatattgtatctaagaatatattccaaggtcattaagattttttttcatgtcttctagaaaatgcctatatttaacttttatatgtaagtctatccgttattttgtgtttgtgtttgagtatggtatgaggcactgttttggcatggggaaatccaatttaacctgaactatttcttagaaaggttatcctttcccctgttgaattattttggcacttttgttgatagtatgttgaccatgaatataggagtctatttcagaatactcgtgtcttccattgatctaaattcctgtctttatgctagtaccatattgtagctttatggcaagttttgaaatcttgaactgtaagttttccaacactttttttctttctaccgacttatttttggttattgagttctccttgttttcatataaatattggtgtcagcttgccagttgctgcaaaatagcatgctgggaaattagtaacaattctgttgaatgtataaatcaatttggggatgattaccatcttaacaatattgagtatttcaatttatgaatttagaatacatatccacctatttatatctgctttaatttctatgcagaaagatttttttggctttcattatacaaatcttgctcttctattaggttatcttaggattttattcattttgatattgtgaacggaatcatttcttgtagttatattgttcttgctaatgaataaactctattttttgtattttgatctgaaaacttatggccatgaggaactcaattgtttgttaaagtttttgtggatctgtcaggattttctgcaagtaggatcatgttatgcaaataaatacatttacagtccttccttttaaatctagatgccttttctttcttttatcattttttggttgcagtggcttgaacctccagaacaatggtgaatggaattttgaaagtaaaaaccatttcctgtttctaatattaggtagcaagcatttagccattgagctttaaatatgatgttagctgtatattttccaaagatgctatttatcatgttgaagaaatttcctaatactcatagtttgttgagggtttctaatcataattgatgctgagttttttgaaatactttacttgctcattgaggtgatcatgtggtttttatcctttattctgttgagatggtatgttgcattaattgattttcagatgttcagccaaatttgcattcctgggataagtctttaaaggttatggagtaaaatattttttacatattactgaatttagtttgccaatattttgttaaggactcatgaatctgtattcatgagatatattgatctgtgatattctcttcttgtgatgttttagtatttctttggtattttaataatgacttcaaaataacttgggaagtctgcctttcccttttgttttctagaaggctttgtgaaggattggtattattccttctttaaatgtttgatagaagttagcagtatgttctgaagactttttgcaataagattttgcattattcaattatttacttgctttgatctattcagatttttctcatcgctgagtgagtttgatactttgtgtctttctaggaatttgtctattttatctgctctgctaacatgaagttgttgataattttttttataatcctgtcttgttggtagagaggttctctttcattccagattttggcaatctgtaccttctttaaatttttgtcagtctagcaaatgaatcaacttttgattgtagtgatttttctcctttgtgtttcttttttatttcactgattttgctctttattatttccttacttctgtttaatttgtgttatttttgttttttaaacttttttacttggcacatgataattctgcatatttatgtgatacatagtgatgttgagatacatataatatatagtgattatatcagggttattatcatatccatcacttcaaacagttgtttttctgtgtttgttggtgcattccatatcctccttctagctatttgaaaccatatattattattaactatagtcatcctacagtgctatagaacactggaacttattcattttatctagctgtaattacgtgtgctttgacaaatttcttcctatcctgcctcctctctacacgttccagctgccagcatcctcagttctactttatgcttccatgagaccagttttcttttagcttccaaatatgaatgagaactatttgctttttttctgtcttaagttagcaacttaggttattgacttaggatatttttttcttttccaataaagtcgtttaaagccataattttgcggttaacactgctttacctgattgctataaatgtaaacatgttgtatttctgcttttattcagttcaacaattttttttccaattttgtcttgtaatttatttcaccaatgggtgcattgtttaatttctgaatatttgtggacttctcaaatttctgtatctttatttctgttttttccctatgtgaccagatagaatactgtatgatttcaatcattcttgattcattgacacttactctatagtccagtgtattctattctggagtatattcatgtgtgcttgatagaatgtgtatttgctattattgggtagagtgtactacagatgacaggtcaaatttgttgatagacttgttctggtattgtctttccttgctgatttcttacctattaataactgaaagcaagtattaaaatcaatagcattttattattgaattccctagtctatctttgattctgtcatctagatttgcctcgcatatttaggtctcagtttcaggtatttacatgtttagaattattatattttactgatgaatttagtcttttatactttgctatgttttttttttttcttttagtaacctcatttaccttaaaacttattttatctgctgttaattatcttagtctggtcaggctaccaaaaaccaaataccataaacagggtggcttaaacaatagtaatatatttcttaaaagtctggagactaaaagtccaagaacaatgtgccaacagttccagtgcctggtaagggctttctccttgggttgcaaatgcctgccttctcactgtatcctaacatggtctttctttgatacataccgaggtggggtggggcagggagaaacacaaagcatgaaaacccaaaggatcaagctctctgaggccttttcttctaaggacactaatcccatcatgagggctctgcctattgacctcatctaaatccaattacctctgaaagacaccatcttcaaaaacccatcacattgaagcttagggcttcaacatataaatttgagaggaaacaattcagttcataatatcagtgtagctacactaattcttttatggttaccattgcatgcagttcatcgttataccatccacctatttgtatttgtgttttaaagtgtttctcttacagacagcataagattagatcttttttcttaatccagtctcaaaatttatgccatttactataggtgtttaaattatttatattattgtaatatttcatatcattggatttttgcctgaattgtgctttttattgctatacctcatcatattattctggctattcttttttactgtgatctttttgttaaatatataaattgaaatgtgtcattttaattccttattagtttttgtactatatatttatgaattattttctatttgtgctaggtatacaatatgtgccttaatgtatcacagtctacttcaggttaatattaacttgattccagtaagatatacaatattgctcgaataacttctacccactgttgttatttctactcactgttattatgctgttattgtctttatatgttgtatgttcaacaacacagttttgtaattgtgatttatgcatttcttttaaatcagttaaagaaaagagaaaataaactatgtacactatcttcatatttgcccacataattatcttttccatttctttcatttgtttgagtggattcaaattagtgtctgatttcatttcctttcagaatgagtgctgctgtagtgtttattggaagaaaaatctgctagcaatagattctctcagtattttaaaatgtggtaatattgtgatttcaccttcaattttgaaggatagttttcctggatgtaggattcttggttgacagattttttttttatttgtttaagcagtgtctttccactgccttctggcctcctttgtttcttgtaaaacatcagctgctaatttattatggtttcattgtaactgatgagttacatttctcttgtttcctttaagtttttttctttggccctgtctgtcagtagtttgactatgatctgtctaggaatggatgccttcaggtttctgctaactagattcattgaacttattgaatatatgaatttaatactagcttcttgaaatttggggaaatttttacccataatttctttagatttttcccctctttcagagactcttattacatcattattacatatgtgtgtttttgttattatatatgttttgtttttgttctttgtttttttcctcaaagaaaaaaaccagttgttagacttagcatacagtgttcctgtatttgttgactacagggacattgaatttcttccttgtatttattgatatctgggagtatttagataatatattatagcatattaggtttgcaatcctttgatatttgttaatatttttgtttgcttttttgattgctgtttttttctagagaatcattctctgctaaatcttttgtgcatttttggcagtcttttaagatgcttaaacttggcccataataatggcatatatttatggggtacctagtagtgttgtgtgatacatataatgtatagtgattatatacactaatgtatagatcagggtgattagcatatccatcatttcaaaactttattatttgtttatgttgggaacattcaatatcctctctctcgttatttgaaactatataatatatagtttcaaactatatatatcctacagtgctatagtacacaagaatttgttcctatctagctctaattttgtgtctgtgtacccttactaccctctagtatcctcagttctacttttgttttttaaaggatctagcatgcaagtacagattgtgcaggtttgttacataggtatacatatgccatggtggtttgctgcacctatcaacccgtcatctagcttttaagccccgcatgtattaggtatttgtcctaatgctctccctccacttgtcccccatccccgacaggccctgctgtgtgatgctactttttacttccattatataaattatttttggctttcatatatgagtgagaacatgcagtgttttacttctgttcttggcttatttcacttaatgtcctctagtttcatccatgttgctataaatgacaggatatcattctttgttatgtctgcatggtaatgtattgtgtaccacattttttatccagtaatctgttgctagattccttggtttgtttcatttccttccttttctctacatcccggccagcattttttattttttgttattttgataatagccattaaaactacagtatgatacaacatcattatggttttcattttaatttccctgatgattagtgatagtgagcatttttttgtatacttgctagacatttatatgtcttctttgaagaaatgtctattgaggtcatttgcccttttcttaattagacgattttgtgttgttgttgttgttgttgagaaatttgagtttcttttatagtctagatattaatcccctgttgaatgagtagtgtgcaaatattttcttccattctataggttgtctttttatgctgttaattgtttcctttgcagtgtagaagcttttaggtttgacataatctcacttgtttatttttgtgttgttgccggcgttttgaagtcttcctcataaaatattttctcaaatcaatgtcctgaaatatttttcttatgttttcttctaaaaattatatattttctagtcttacatttagatctttgatctattttatttctgcatagtgtgaaaggtggaggatctagttttatttttctgcctatggatatccagttttcctagcaccatttattgaagagattgtctctgccttaatgtatgttctggatgcctttttcaaaaatcagttggctgtagatgtatggattaatttctgggttctcttttctgtttaattggtctatatttctgttcttacgaaagcaccctgctgttttggttactacagctttgtagcacattttgaagtttgatagtgtgacaccttcagctttgttcattttgcttaagattgctttggctatatagatccttttgtggtttcatacaaagtttagagatttttttccaattctgtgaagaatgtcatgaataagagttgcattgaatctataggttgctttgggaaatatggtcattttagcaatattaactcttcctatccataagtatgggatgcttttccatttgtttctgttattttgggtttctttcatcagcattttgttgttttctttgtagggatcattcatctccttggccaaatactatacacttcattgaataaatacttactattccgaggtaatttattacttttgtatctcctgttagtgggattatggtttttatttatttttcaggtaatttattgtctgtgtacagaaagactactgatttttgaatgttgatattctatcctgaaactttttgaatttgtttagcagttctgagagattttgtgtagtccttacatttttctagatcctgtcttctgagagtggggacaatatggcttcctcctttccaatttggatgccgtttattgctttctctctgatatctctgtttagtttttgtttgaatttgtctttgtttttttaagcctggatatctaggagttgcttttgagtcactatagcttaatggtcagccaaggattattcagagcttgtgtttacgtagtatgagtaaattttccactctttgctgataggtcagtggagaaacttatttaaagttcaggcactatgttggcatgccttggctttgcattttgataattctatttgtgtttcttctgtgacagtgcaaggtcttatgttggagaagcaatatgtaggcagctagagccctctccagtatttcctgagcatatgcataactttgctaatatatgcagcttcccagaccaggaggggcttatagagtttatcaaggaccactgtgttgctgtctcattcctcagatcttgtaaaatttctgactagtattctaatctgttgcttgaccaagcttgtattgcaacctcaggtttgttgagatgttggccttccttgatttttttaaataccaaaactgttatcatttttggcaattccctgagtattgttttctctacacaccattccaaatcaaatcagctcccctcccaaccccggcatggaagctgttggtttttatggctttcaatgccatgctaaaattcagtgtcatgctaaaatgacacagacacactcttcttatgtgatgttcagtattttcagtatttgctattaaataagtgatttccaatttgttgtatgtctttgtttttttgtttgtttttagaatccttaaatagtttcacacatgagttttatttagttttatcattgcctttaaggagatttgctgagctccttatttggccatttgcgaagttacacatgcctttttttttcccccacaggagggatagagaaatttagaccatgtgattcagtttttatggaataagtgtcattgtaggtgcatcatgaattataggcaatatatgaaatttacttttcatggtaattctgatgaaaagaagaatgtcagaaatgtggattatgggtagataacagccaatagtgtggttagtctggaatactatctattttgaggaccagataagactggcatgggagattgaaatgagctagtaaaagattttgaatgtgaaactaaggtttctaaattaatatctttaggtaatatcaaagagtggaatggtttgagtgatggaatgacatgatttatagatgtgcttcagggaaaagaaaatagctgcctacaatgtaagtgatggattaagggtcaaaaaactgaaataaaaccagtcagcagtcttgtaatagtccaaatggaaactaataaagtctcaggatagttattatcagaagggaaaaaagtaagctactatgaagctatgttacaggaggtcttgggaaggacttgaataacttattatatatctgggaccagtaaaagagagactcaaagaacgcttctagcatttggcatttggtaactggacaagtatacaattagcacaaataaagaacatagaaggaaagacagatatagggaaataattgtaaatggtagttcatatttattgaattgttactataattagatatagttatgagttttatgtaaattattagttactccttacataacactttgcatataataggaaacaaagggagccagattagtcaactgtaccaaaataaaatagctaatatatgacagtattaggacacaggaagtggaacatcacacaccggggactgttgtggggtggggggagtggggagggatagcattaggagatatacctaatgctaaatgatgagttaatgggtgcagcataccaacatgacacatgtatacatatgtaacaaacctgcatattgtgcacatgtaccctaaaacttaaagtataataataataataataatgaagacacattagctagaggaacaaaataaagaatgccaaaaaaaaaaaaaaaagaattttaacccaggcattctcagatcagagctgagatttttttctgacttttaagttgaggggtacatgtgcaagatgcacaggcttgttacataggtaaacatgtgtcatggtgaattgctgcacagaccatcccatcactcagattttaaacccagcatccattagctattcttcctgatgttagattagagctgagattttaacccctgtctgaatataggtctcaggacacatttagaaaaggaaagatgaagtgatggtttaagattttattgtctgagggtgaaaagttaaaattgtgatattggacaagattgtcaaagataaacatatgagagaagagaaactcattggcaactatttacattttgtgggaaaaaaagtttaaaattaaaagatgaaccagtgcaaaatattatctctaaggaaaaatgattattttggtgtggttattttaactgtgatgggatgttgcttggatcaggtgtataaaaactccatagatgaatagttggtgcatacctatagtcccagctataggaagctgaggtgggaggattgtatgaccccaagagttcaaggatgcagtaaactatattacatcactgcacttagcgcagggcaaaaagcgagacatcatctcttaaaaaaatccataaattccagagataaggaaccaagtaattaaattatggagagaattttcattatggtagtagtggttttaaaagaagagcagtaccagcagtaaggagtgagtggatggaaaggattaaatactgtaagtagaatttttcttcaaagtttgataatgatgaaggtaaatacataagaatagctagagtttggtgaaacatgaaacacacagaaattttctgaagaaagagaaaaaattcgaagagagagagattatgatgacagtttggtttagaaaggagctaaagaggagaaatttgttaaacattgaactattgagctaatagaacaatcatgtttgttattagtgaagaggaaaatggaaattcatgtggagtggttataataatctcagtaataattgaggcaatgtggaagtacagtgcagagtgaaaaagatttgaaaatgctactggggagagtcaattagagatgatggataatatttctgagtcatagtaagaattaacctgagatttcatagcaagaatctgtaagagattttataataaccatttcatattttcctgtaatattaggaatgccaatactaaaaaggtcacaattttagatatggatgttgctttactgttttcatggttaggcattattttctgaattttcttataactttaagaactcttgagtgaatgagtcttcagaaagaaaaaaattctcttggagtggatgctctttcccgactctcctaatatatgttaaggagattttaggaggatattttaagagatttggtaatatttctgtacaagagagtaataagaatgaggggaaaattaagtggtttaacatttttggaataatactattttttccccttgggatttcccaaaatacacttgttcaaagtgaacatcagtccctcatttttaaaaaagatttcctaaagatatttaagaggttttatttatcagatagcattgatagagtgtattatttaccacttggtctggatcagtcatcgtcatcatcttaatggtaaagtggagagtgcatcaaattttgagtctaaagcattagcttcattcctgcctctgactcttaggaaatttatctaagtacatattcctgagctgtaaaatggggataaaaatacctaaatgacttcacaggtttattgtaatatccaataggtgatagattggaaagtctatgtgaattattaagtcatggcatttgtttttaaatgccatatttatcaacaagcaggcccatgctaggctgaagctgaagcttctgtgtcttccaaaaacattttgttagtttaaataaggttcatcactattgggaatcttttgaagatgaaaaacttgttttctagaattaatatttaaatcaactttaaattggtctataaaaaactaataaaatttcaaagatttcaggctgattatctttcattataaaaatattttaaaatagttattttataaaaaacattcacctgcattagtttatgtacatcaaggcaatatgttcaattaatattgtattcaatagaataagtactttgtattcttcatatgattagaaagttctgtactagcatctgaactataaataaataaatcttaggatatatatatgacctgcttatcctcagtgtaaccctgcgacacaaggataagtaagtacaaaaaaaaaaagattaataccatcaaaaaaatcactctctggactggctaataaaagtgattcatccaagatacatgaaacaaagccataatatttacttaattattaactgaaaactatatgtaagcacagagctaagttctgaaaatatgaagttctccatctgtgatcatgtgtgcaataagaatttgagtggaataaaatgtgtgtatcttggtagtcagagacagtagtggcatgtgttcatggcaaaacagcttgaagaagaaatttattctgttaatgtaagcaagatttatttatttttatttctgctatgattatcctggagaaattaccacagtaaaagctgtggcaccgctaacacccacagtcatgttccttctgtttatgtgaaaggcagaaccattgagttggaactcaagtttttacttgaatgtattattcaaaaaaactttatgaatgtaactgatattttataccatattctataagattataatttttggcagttttttcaaaacatgctatataaaaggttagtctgcagtccctacacctaacacacatatacacacaatgacataaacatatccggtaaagctacttcctagaatttactatgttaagcatcattgattgtggtattatagactgcagaacatactgtagataattattcttttctactttcaattcaataaggtagcacagcagcaacatcatcacaatattcagcattaattaaataaattatgttccatgtcttattctacattcttcatatgtattaactcattcaatccttacagtcctatgacgtagtgttttaattatccaaagtatacacaagaaacttaaggcacacagaggtggagtaaagtggcacaaacaatcttattaagtataagagaggaactcgggcagtctggctccaaagctgcgctcacaacaacatgctatgagtgatttctcatagctttattatctacttttagttcatagcatttgcagttattgatccatggtgttttctcaaatgacaaaatagtataagattctgttttgatcactggatgtaaagtgattgtggttagcatgttgtgtcttttgattggacaagctataacagccaaatatctcttgatggaatgctcgtattgaatttctcatcaaaatatttttttccaaattagttttgaggtatagatttgctatcaggaagtcatatgagataacattacatttaaacttttcctttcagagtttctctcagtaaattcgaatgtttgaaaacaaggccactgtgaaccatttaagaatcttcaaccaaaggaaaaaaaaggttaaaatatccccatactcttgttttcagcaataatagagaatattttcacctttcaagtacagactaaatattgatttatacatacagaaacctactatgaatgagattattttattaaaaaggaaaaaaatttgaagagtataaatacaatctgaaaggttaaaaaagaggtaatactaagaagaattcagtttgataaagacatattgtgatttcctctggttactttatcgccttaatagttcagactaagaaagtcactaaatttttcaagttaacttaaatttttggtggtatacctttttagagtaattcattttctcactgtgataatatctttatatgctaaaaagcctgaaagtatatttttgtttaatgttcctgccatcatttaggagagaaatattcagtatttttatatactgaaagttatcttgattcctgagagcttacattattaaatcttagaatgcttgactatattaattttttctttaatttaaaagtttttcacattaatttttcaattaaatggttaatttgcaatttcatgatactcaagaaataattgtctaataggattgtgctatcacaaaatcttagagctagaagatcctcagagattaatctagcttaaatcactaattttacacttgaggaaaatgaggtctgagaaaatatgtgagtcactgaagatcaagtagataattagaggcaaaagtagaaagagagtcttcagactattgcctctaagtaagggatatttgaattggaaccagggaaatagtgtttcgatttatactatgagatagtaatacacagtggttagggcacaggctttatatcaagaaagcctgcatttaaaaaaacccaaccaatcacttattaactttatgaacttgacaaaatttttcagccctagattttttatctgtaaattgaaaataacaatattagttacctcaggagtctattgtgacaatcaagtgggctaataaatgtaaagcatttacaacgatgtctggtacaaagtgattcttatgctagcctatattattgtaaaattgcgactgtttctcatctccaatgcaatataaatctgttggaggaatgtttgaaaaatacaaaaaatcagaaataaaatagataattgataatacctaaaacgattagccatgtacttcaagatttttttatttgaatcttttattctgtgtacattttgctttttcacttacattttaaaattctgttttacaggattatacttagagatctgatttttggcatcagggaagtctagatatcctaattttcacttgctacaaaatacctaaaatactgcataaaatacaaaaataatatttttgatgcattgatgagctttcagcaaaataagtaactcaatcactcatttaagtccaacaccaagccatatgacaaatgaagatagtattaatcctgaagatgtcacttagcatgggggtatctataatcagaacctgagtggcctagagatttttaaatattgtggtaagagcatcacacaaaatgtaacctttaacaaggttttaatcattaagtataatattgttaatgtaaagcttttcatggacctttgcaatgcgtatggaaaagagatttgggcccatgggtggttggggttttctctcaggttgtgtaatcttgaatgcacaaaggactatcagtaggagtaagtttaaaacgaaaaacacaaaaacaccaaacaacatagcgattaaaggggaagtggggagtatgaaatttgtctcagccttgactttagatggagtgtggagaaaaatctcttctgagaatttattgtatgagaaggctgtcatgtggaagtggagccttagcacatgttatttgtatagtgcagaggaaataaacctagattaagtttaaaatggactcagggctttcccaagtattttacaaaaacatatgtaaaatcttccttgagtgttatatcttcaacccatgcattttatgattctcacagagaagataccacaacataagcaaaatcacaaaacaattatcaaatacacaagggatcaagggaccatgggtgagagacagcagacaaaaatgagaagcaaagtataaaataggtatggttaatttgtttaaacaaataagacagagtcaaatcattaataaaagcaaaatacattcacaaacaaccagccagaatcaggagaaaagggaaacataaaacaaaacacatgaagaaaacagagaacaactggaaataggaaatataataactaaggtaaaaactcactggaaagttagcagaataagcacagctgaagagaaccatagtgatcagaagactgatatgaagacattttgcagaatcaacaatagagcattaaacatactttaaaaattagatacaggttataagacatgagagattatcaaggacctagagatctatagtatacgtatggaatgggcaacaaacagtattttaggaggcagtggatgttagcatctggtagcagggagaatgaaggaagctaagggtccaatttcatagtagactttagcttacattctctatttttaacttaaatctctccgtttttacctacttgttcctgttttccagtgatgtgctaattaatgttggttcgctgaacaaaaacataacttaaaatgtaggtgtatatgttatatatatgtgtttattgtaaatttttctaatataaaagaagtgtaacaaataatattttactgttattagtaaattattagctgagtgtacattctctatagccaattgattctcacagaatgctttcactgatttttgctaacttcttatatccatagccaacatatttgtgcaatttaataataatttggccattggtgatgcatcccagcccactaattctttatacaataaaattatgaaaatttcttctgatatgttttctactgttaaactatttctcattcttctaaaagtatatttactaaactgaaatatcaccttgagcagcagatacaacacacttttaggtttgcctgcattatttatattttcactattactttattaaacctagacaaacaacaaaacaataaatcaagctctgatttgtagtgtttgctgatttccataagtgtgtaaatattgacactatggccaatttcatttgagctatcagtgtgattttactgagtgcagagttaaaagatgtgcagtgacacatcattatatagtattgtatagtatttccaccatactaatacagatacagacaaaatatgatcgagagcatagctaatagtaaaataattaggaagatgagaatttttattttatcatctttgtccttaatataattgagagtttatataatttaattattaataatgcctatgtttaacaattgcttaccacatttctaaggatacaacaatcagctctcattagccagcaggagaaggtgcctgtttccttctggtgtccatgatcacggagcagctcccacttattttctccagagagcattctcctcttatgtggcatgggagagggaaaaagatgacagcagtaaaagattaagaagggcactggaaattcctccctgttctttttgttttgtgttgttttgttttgttctgttctgtttgagactgagtctggactggagtgcagtggtgcgatctcggctcactacaacctccacctcccaggttcaagcaattctcctgcctcagcctcccgagtagctgggactacaggcacagccaccacacccagctaattttttgtattttagtagagacagggtttcaccgtgttgcccaggctggtctcgaactcctgaggaaaggcgatctgcccgcctcggcctcccaaagtgctaggattacaggcgtgagccatagcgccaggccccactgttctgtttacacactttcagcaaatacttttgttttcatccatgcctgcacccataacttccacagggactcatgcctccaatctgggcttctctgagggcaaattggatctattattattgttcctcccattgaaggcatttaatatgaaactgtccattctcctaaattggttgctatgattcctgtcgtctccaaatcacttgaaatcttttattttcttttaatcattttcctttcactttttctttgtgtgttagaattttattttgtgccagtaattgtggggtggcaggtggctgctggagaggtaaaagcaataattgctggtatcagtccttcaatatttaatcagaaatatcacttgatgtttcttatattcataatcccagggctcactagatacagttaatagtgaaaaaacgatacaaaatacggaatagtaaatattccatcatgtctttgtatatgttacctcagattaaacagtagaaataataatttgttgttttaaagtgtactttatcaacccattgaatttttttttctcgtatgtatgccaagaaaaaggtcagtcctatgtcctcagatatgcaacatttataggtgtcagagtctgagaatcttaataaggtctattattttggaatgttaataaatagtaccatggtatcaggtgctccatcttagtatggacaccatataagatcatttcaaacctcctcagtacatctgtcatcttatatattgctataaatcatccccattgaactacttcaaaatgtttcacaggcgactcccctaggtattcaattaagcactgaggtttgcagaaaggtgtcaaaagtgaaggggaaagaggtggaaaatggaattggatataacatgcttctttctgtcagacacaatttcttttcctcaaatagccagaaaacgtgttaagggtttgtaacaatatataaagaagtgatgaacagaaaaaggcataagcctgttagtgtgtatatgggaaaatgggttctacacatgtataaaaattagatttttaaaattttaatagctgaatgttagatcactaacataactgaagcacatattttaaaatatgttttttcttttttttttttcttgttctttactgggaagaacagggaagataaaattgtaggttttattcacaataacacaatgaaagtaattatataataaaatcagtaattatattatataatacatatttataaattatataattatattataaattatatattttatattattatataacaacatttataaaatttaaatgcaatgcttataggaatccatttggacagtagtgttagaataattcctgagctcagataattataacagtgtgataaaatgttgttttattcattttggaaacatttctgcactcaatattgtctatgttcccactgtgaaatctcgggtctagacatctgtcattttacaaaataggctataaggaaatcactgttgaacatggtgtagccgttatctactgctctgattatgtgttttgagggagcagaatataaaaaatggctaccctgatgcttgcatagcttatttctccatccttgtacttcatcacaaactccgtgtgtattctgtgttgcacatataatgagttagagtacttagattcaacttcttatatctcagttatttgtacttgtaagtggacttgtagttcccactgaaataacaagtctctccttttctgccccacgaaaaccttctcactctttagtaactgctcaagtgtcattttctttagggacttagcctttgctacatatgaaagctttccttaacctgatgtgttgtcctaaggattcctctctttagttcttccacagcatcctatgcttaatgcaggaactattttcctatactgtaatcagcctttttcttggttttagctcgctaaatcctaaacatctttagagcatggcttgtgtcttctttttattcttaaccgaaagtaggtatttgtaacattaatagtttgtcagtttcctctagtgaggcattttattgtgatggaattaggcattgataagagtgaagtaggaagaaaatacattacggaggctggaaagattagtaagttatactataaatgcttactaaattagatggttttaaactataatccaattgtagacaacatccatgtgtgggattaattaatgtattctatgcattgaaattgtgaactaaaataaataacaaagcttctgtataaagggttatcatattccaggaaggaactatttccttctttttttatagtgagtattaatgagtataatgagaaaaaaaaaaagaaaaaaacaagagatctatctctctgttcttctctttttttcctgtttctctttcagaagtaatgagttttgtaatgttccctaaagccccaaaattcagatatctgctaaaggctctcaaagtcaacataataaaaatcatgctttagataacaatatgtatcttccaaaaactatagaactcagatcagtgtccatacaacaccagaaggaagggtagaaagtaaactctgatttgagatgatggatagataagccttaatttagaatgtgacataaagcaaaggcccagggcttagtgctggtttactgagctctaggattatctatcgttagtcaggacttgaatgaaacccttgagttattttacctgtaaataacaggttaggttctattatgtgtttttaaaatttaaatctttttaaaatttaaaacatttatgtacaaatgatacttctcttacaatcacaggatttctaattaggaaaataattttaaatactttcaaatgttgttttcattttttaaattatttttttaaattagaaatcctgtaattgtgatagagaagtctcatttgtacataagagttttaactttttgttttaagtagagtttttatttaacttgggttgcagctgaacaaaacatgtttttaacattaaacaattttactttcatatctgtttgcctatcttcaactctgcatggaaagtatattgaatagatttttaggatattgtcaaatcttgtatcaaatccaaaactctgatatctacattgatataggatatttcatttagtcgcaagagaaactgttgataaaagaacactttccccaatgaacgttttaatagcttttcaagggtattggatatgcttgattttgtgttcaatttttttctgcccaagaaaacactttgtgttactgtaatcaactacaaataatgtcttcacatttaaaaggctgaaaggttctcagtttttaataataattagaaataatgaatgctttgttctgtctaaaatatatttcattgatgttcagaatttcaaacacttcatgtattcactatttcaaaggtcatttaaatttgaagactttgcgctttaaaatctgaacatggccttaaaatttatatcttttagcatccttgctaagtacaattagctgttttttggaattagactattatcacttttatcacatattaaaataattctttaaaagggcatcagtttacctatttttccactgaaatagtttttaattttgtattttcattcctttatatggtttttatgcacttagaaattcaaagaccagtccgggcacagtggcttacacctgtaatcccaagaatttggaggctgatgcaagcatgtcacttgaggcctggagtttcagaccagcctggtcaacaatgcaaaaccctgtctctactaaaatacaaaaatgagctggtcatagtggcacacacctataatcccagccactctggaggctgagacatgagaattacttgcacctgcagacggagtttgtagtgagccgagatcgcaccactgcactccagcctgagccacggagcgagattctgtctcgaaagaaagaaaagaaaggaaaggaagggaagaagtgaagaaaggaaaggaagggaagaagtgaagaaagggaaggaagggaaggagtgaagaaagggaaggaagggaagaagtgaaggaagggaaggaagaagtgaaggaagggaagaaatagccaaagaccatgactacaaattatacattgaaagtagattgggttaattaacaatttttacagtgttttctctttatggcatggcaaaataatttcggatttcattatttcatttcatattttaatttatcccctagtatctataagaatataaaatcatttactgccaagatacaatgggaaaaattaacagtaacttagaagggcacttgaattgatgagacagatgtagcaccaaatcccctacataagtaagccaattaaatctttgtcagtgaacatgcagcacccaagtcccacagacgtgaagtgacaggcttggactttgaacccagggccataagctctttctggtgcatgacacacattctgagcatataataagtgctaatgtatgttcaatttttcattgtatttttctgatttgatgtttgttgccaagaacacagtatattgagtatgcagacacatctcaataagtatttcccctataatgtgaaagggaaaaaaaaactttgtttctcagtagctttatgaaaatacaacttaaatttggaaaattagactgcctctaaaagagcaaatggtgcattttagaactcctgggagacacaacaaagggaacaaacaaaagagccagatggagaggttggaagggagaagaagattttcattttgttagatagcaacaaatttttcattcaactacatataacgaattcctagatcctaactacctggtttatatattcgtaccttctctctgtcttctgttttccactattcttgagtcaatcattatttgtgatgtcatggagaaaaaatgaggtaaggatttctgattatctcaggtttgaggttttgaagagattgaataatgattttggggtacagcttgtgtctaaatgtatttacattttcaaaggaccagaatatccatagattaaacttaagggcataatggccatatttgttaaaaagctaaaaacaaaattaccagtttatcctaaacttaactaaaggtgctctaaatacacagaaatcatcattttgccaagtcaactgcattctactatttttttttttttctgatgctggagaatttggcattttcactatatgaatcaccatcaagattattactttcacaaaagagaggaaatcggcagaactgaaatagataagcacaagtttacctctcttctctctgtttttaccatcgtctatagcaggggtgtccaatctttttgattctgtgggccacattggaagaagaattgtcttgggccacatataaaatatactaatgagctagaaaacaaaaattgcaaaaaaaaaaacaacaaaaaacaaaactcataatgttgtaagaaagtttacgagtttatgttgggccacattcaaagccgtcctgggccacatgtgattggtgggcctacagtattataaaaggacataggagtcttatgtcttatttattctctacaaatttaaaaatttgaacttctaatgttttccaaggtgatgtacaacagaatcatgtcagagctgaatattgtaactgtattgttcctagggcactcttaaaacttccacagctatggctgccacaaagtactgcatttgcttaacactcaaggttattggcacatgtgcccttttgcatttgaacaaaatctgtgttttattcacgtacaaccaagatgtcactttataatgctgcaaagacatagaggaaggtgtagaaacacacacttccagaaaaaaatactaagaggcaaattactgattaacatttaacattctaaatcattacttaaataaataccaatttttgaagatatggacagaaaatgaaagcagtcaaagcagtgtttggggcacatatgttaatgcattttaataagatggaagaaactaaatgacagggaaaatatattagaaacatttcttttttttttctttttttttttttttcagacattgcaggccatactgaaaagtcactgattttgtatttcagtgtaatatctaaaattgaattttaattcgcatgcattcgttgcagagagacagagagagagagagagagaaagagagagagagagagagaaattgagagatttaagttgattcactgggtcagacagaagtatttgcagctgcaataaagaagctttccccaaactgcattgccagatcttctcagctctgacccacagtcactgtgccaaaagctgccaggaatgccaagtgcatggtgattttgtgacgtagagaaatagggttctgggtgagaatacttaattgtcttgaactacaatatttgcttggtatccgagccaaagtttccagacataaaaaacagtggtaaaaatccacagacacaaaaatactttgtatctactgcctcaaagtaagcaggacctttgagcaagcagcactttgagtttgatttcggctgttgtttttaaattgtgatggctaaaggaaggcagtctagtttgtttatgtgtatccttgagactaaagatatgctctcagttgcccttagactcccgatatttgtaacttagatatatttgctgtatcttctcttctgaggttatatatgtctttattgtttcttaatcaaatttaagtataggaacatctctttgttatttctcataagtttcttgggattttaggtgttattcggaaagtttttttttccttaaatatttgaagtttggggttttaatctgcgttgtttgtattttaattgagctatgggaaattatggaattttttcaaattcttgtggaattcactctatacctttaggaaagaaaatacgttgaaaacttttatataatctccagggtaaaaatccttacaaaaatatatacaattttaagctaatttttattagggaacatttcaatacaactaacatttttgaaatacatttttagtgattgaaaatgatcttcagtatttcaatgatttcaggtacaccatgttgctaccaattaatccttagaaaagtcattttatttactagagtttattgcatctggttttgtcatgtaagtatccatttaacaatattatatttgcataagaactttttgagtacatcatagtagagtaagtgatgagcaccttctgttttctgaaaaaaatgggttgataagaatgaattcatgcttggagaattatgttaaaaattggtgcctgataaatcataaattggacaggctgcctgtcttgcataggtcttttatcaggtattatacaaacaactgattgtaggatgactgcatattttaaggactattgaaaattagtggatactgattttactgttagaaccctagagttggtgggcctgccgagtcctgcttgaattactatttcgttgaagattattaatcaccagctgccatcacacagtggcaggattccaaggcagcactctgaggactcctctgttcattcctctgtcgcagggtgacatagtatagaagcctttttggcttctctgcaaaagaacataactgcctctaaaatgtgtgcattatcaccaagtttaaagttagaggatgttcaggaaaaaaaaattctcagatattttattgagaccaactgagtacatatgctttttgttaagaatcatgttaattcaaaaataaaaaagttccaatatttttgctcacaatcctttgttctccctctatccatccatcacttggtgatacatttcacagtcacatggtggtaggggacagtgtgggaaagagaaagactttggcctttgagtcctgtaaattattcagttgtacattctagtggtttccatttcgtcagacttcaacatactgtgaaatggtgacatgtcaaaggttgcattattggttgataatgcagctctgtaaagtgtgtgagctcgggtcccagcgtcccctgccaacacacacagatcccaggacaggtgcaaatttgacttcacacatcacagttgaacaagccaagcctgaatataacctgactgggcttaacttttcacttcttttgcaatctgctttcttatcacttcttagattgttttttttaattttatttgtaagagtaagggaaatttggtagtttataagcctgagttcaaacttccatgatttctcagttgtcaaacgtattttctgagaaatgccctcatcaaagtaatcagcctaatattttttatttcttattaaaattacattatatttattcaaatttcaggtaaatttaaatataatgtaatttttcaaaataattctttaatattacacaaataaggaattattgcctttagtttgttctcataatgtttttgaataattgcctttcaaaatgcttgacttaagaagaggaagacatctacaataaaaatttactatgcagatttttttaaatttacatttgctactttttagtagcctttaaaatatcattttcatctaagaagcatgctgtgactgtgtttacagggttaatcacataaattaaaggaatgatgggaagaagttataagcagtatgtagagtaagttaactaaaagtggcatgttagctcaaaatagaatgtatatttttggcataatgaaacacaatgcttggtcttcttctaagttaactttttaaattaaatacttggagttgtattgtgaatatattcgtgtccttataaaggaccacataacttgtatctgagaacttttctttttgttgagatataagtttaaaggaatgtgaatttctaataagactaattcagttggatctcttaaatcttaatggattatggattagtgactgaagaaaaccaggtagagagagcaaggatattgaactcctatacatctttaaaactttaatcattgaacttatttgcgtgttctttggagggaaattagccctccagctggcttccaactgtgacagcagcttttattctaacattagtagaaagaattgtataatgatgctagttcagacttttttccttcctgatatatgttacaattatttgtcatggacaagagtccatgttttcaaaagagaatagtatctggtaatattatcattctattccagctagggtaatgtggggaatagaagttgttagaaacatgtgaatgcaaatttgcaatttaggaaactcaaaatagacattactgctcttcatttcaaagcaagttttagtgacattaaatcaaaactctccagttttatttttactataatctcctgacatgtatagctcacatcatgttttattgtaatgcttagtgtcagtcatttctagatttttttgcagtgactaattttatttttgctttaaaaatttatagaatagggggattatttatttaaaatctcttaaaataaatacatgagtgtaaaatctgagacccttgctgttgctcacattttaaatttgaccatgctaactcagtgtagaagagccagagaacaaactctgtaaccagaaacccagcttccattgccctctttagtatctacatgccatgttaccttgggcttactgtacaatcagcacctcagttccctcttgttaaataagactaatactagtacatacaagggacaaaattatatatataaaatattaaataatatataaaatacatatatgtataatatataatatataaaataaaattttatatatatagcacttaacagtaggtaaatgttagctattcttccaattgactcattaatgaatcatgagaatcttttatgtgataatgaaattcgagagtactaagtgaaataattgcacagtgcttataaatagggaaataagagtgaaagataatacaaattaattgaaatatgtaatataaggaaaaacagatgagaactcttgtaaataaaagattaatgaaatttagaatctattgaaagggatatttgttatttttaataacaaatttatttttaatattaaaaattttaatatttgtctttgaaaatttaatatttgtctttgaaatatctaatatccaaattctcaatatttcatatgatagtttttgttctatttgttcagtttttataaataggatatttcttacaaaatgtgtttgattttcaaatataactttatcattaaatttgtttagtatccttatgaggaaatttgcagtcatatttgataagtacgcataatttatttcactttccatgcttcagtattattttataatggtattttcaatttgtaaaccagactgtaatgaaactcttccctcataattgtttagaaataacgtatctttagaatgtgtcaataatttgtgctctctagaaagactttatttgttatactttaaaagtggaatctatttatatttctgttgcctaaccaaaatagcatatctaaaatatggatagagttactgcttttcaaagaacatatttaagatttctcttaatatcttaatttttatcttatatatagatcttatgtatgtctaaaagatacattaggtctcatatatctaatatttgctacagttaatataaaaacaaatgaagattaattgacttagtttaatatttctatgttcttgcttaaggaactgattggttttctcatagggcattgaaagagcctaatgaaaaaaatgctataaacgttagacttaaaaagatctagcttcaagttctgttctgccacttgtaacctgagaggttttgaataagcagtttagtatctgtgaagctttgttttctcctatacaaagtggagataatcacatagagttgtgataacaactatcacattaagatgttatgaaatgggggaatgaggggggcctggatgatgagaaatgacttcatggatacgacgtggattattgccatgatatatatactaaaagccctgacttcaccactatgtaatgtaacaaaattacacttgtaccttataaagttatacaaataaaaattttaaataaaatatcactctaacaaaatatgaaataaaatgagattacatatgtaaagcacttggaacagtatctgataacagtttttgcaataataattatataaatatctggcatttaactactaaagacatgttcgtatgtgtattatgtaaaattgaggccttcttgaatcttatgatttctaacacagacacttcggctgaaatgccataaaacacttagagatagacattttgcagagtacctggcaatggcatatataatataaaacacatatatttagtgcataatgtgcataatcctcaaataaaattagctacttttagaatattgtttttcttttaataccgttttacacaaaatgggctatcagaacagtagatcacatatttatttaaaaactaaaggagtgagttgagagagatacatgaaagaaaagaaagtgccacatgtggtatgccacctttatagagatttaatcttatataaaaagctctaagaattcctgttttaaagaaccttagacatttacttcaaacataaagctactaagattatttttgattgaatcatttttagatgtatttatcaacattctactgaagaaatgttccactgagcaaactattaaatggtaatgttagaatgcatgaaaaattaacgtaaaatcataggtcaaacagaaatgtaacactatagatctagtttggaaacaattaacagctaaagcccaggatatgactaaagagaaaggatctctgcttagattacagaatggaagaaaataaattctgataactaggtaattaagtttggcagctagggatgaaaaagacaactgaaaataaaatatggaagaagtaagaatgaaacacagcaagtactcttttgagaagaaaaagagttaagatttttctgtcccagcactttttgaatctaagtcccgtaatatatataaaatgagggattagactatattgcctctaccaggttattgcaagcacttaaacttgtaattctcatataaaataaaaaaaacaaaaagtatattcttccaatattttccttaaatatttacacattacatgatacattttatttgtgaataactttaatactcttaaattagaatgttataaatgctattaagttatctgttttaatataaggtgtgtgtgcatctagtaataggaagaaaagaaggaaggaagaataaggacgacaaaagaagagagggaaggaaagaaaaaacttgtcaaatatttcatagctgatctaattttgtgctctttttttctgtgccacatttattcccagaagtttctttggtggatcaagagatgtgaagccagtgcctggtatggaggagatgaacatacctgaatctctcaattttaatgacaatttatttttttactagacatatagacatcctaaatatatatattatgaaaatttcatattatattaaaaggaacattgttcctttttgttactttattaaatttaatttttttaggacaggatcttgcacttttgcacaggctggactcaatcatggcttactgaagcctcgaaatcctgggctcaagcaatcctctgtgtctctgggactacaggaacatacatgccaccgagcctggccaatatttttttttcttttttttttagaaatagactttatgtatttaaacataaaaactgtgaaaaagaaatcatcagaattcaggaggtagatgatgagaaggggaagatattgatcaaaaggtacaaaacttgcaggtataaaatgagtaagttctggaaatgtacaacatgatgacgtaacatagttaataatcatatatgcttgaagtgtcctaaaattattttaaaaatgccaacttttattttcaatacagggggtacatgtgcaggttttttacatgggtatattgcacccaggtagtgagtatagtacccaataggtagctttacgatgcatgccccctccttctccctcctccagtagtcttcagtgtctattcccattcttaggtctatgtatgttcaatgttttccttccacttataaatgagaacatgcagtatttagctttctgttcctgcattaatttgctttggaatgatgaaccctagctccatctagtttgccacaaatggcattatttcattcttttatgactgtgtagtattagatgttgtatatgtaccacattttctttatccaatctaccattgataggcgcctaggttgatttcattatctttgctcttgtgatgtttcatgttcagtgctatggcaatgaacatttgggtgcatgtatctttttgtataaggatctgttttcctttgagtatgtgcctagtaatgggaatgctaggtagaatggtggctctattttaagttctttgagaaatctccaaattgctatctacagtgtctgaactaattttcattcccaccaaaagtatgtaagcattcagctttctccacaccctcatcaacatctgttatagtttacttaatagtagccattctgactggtgtgagatggtatctcattgtggttttgattggcatttctctaattcgtgatgataagcattttttcatatgtttgtgggctacttgtatgtcttcttttgaaaagtgttgatgtccttttcccatttttaaatggagttatctgttttttacatgttgacttgagttcttcgttgattccggagatgagacctttgtcagatgcatagtttgcagatatgttctcttgttccgtaggttgtctgtttactctgtttatagtctttttgttgttgttgtttttgttgttttttttaaatgcagaagctctttagtttaactagctcccatttgtcaatttttggttttgttgcaattgcttttgggaacttggccaaaaattctttgtcaaggccaatgttgataaggaaatttcctaggttttcttctagggttttttatagtgtgaggtcttccacttaaatctttaatctacattgagttaatttttgtatatggtaaaatttaagggtccactttcattcttctgcatgcttgtttatctcagccttgttgaagatcagatggttatagggtgtggggctttatttctgtttcttattctgatctattgatctgtttgtttttgtaccaataccatgctatttggttactgtagccttatagtatagtttgacgttaagtaatgtgatgcatctagctttattcttcttgcttgggattgttttggttatttgtgctcttttttggttccatgtgaattttagaatagttttatttttttaattctgtgagaatgaccttggtagtttgataggtataacattgaatatgtacattgctttgggcgctgtggccatttcaatgatattgattcttctaatccatgaacatggaatgtttttccatgtatttttgttatgtctgatttatttcaccagtgttttatagttcttattgtggagatctttcaacatactactggaagtcttagccagagcaatcaggcaagagaaggaaataaagggatctaaatagaaaaagaataagtcaaactatctctcttctctatgattccatagttagaaaaccccaaagactctgccaaaaggctgctggaacttataaacaacttttgaaagttttcagaatataaaataaatgtacaaaaactcactagcatttttatatactaataacatttaggctgagagtcaaatcaagaacgcaatctcatttacaatagctacaaaaaaatgaaatatctatgaatacagttagccagctaattaaataaaaaatttctatatactgggtctccttatgttgttcaggttggtctcaaacccctggcctgaagtgataccttggcttcccaaagtgctaggaatcacaggtatgggcctctgcacctggccaaatttaaaaaaaaattgattgtttaactgtcatacatgccttgatttcagaagatattttacatttggtgaaaaatgagcaaatttgagctcttcatctgatgagaaattcaatctaatcagaattgtctttttcaattgcaaagtgtaattttctcaaggatcacatattataatatctatattagtaaattactatacacacatttatttaactcattgtcttatgaatgctttattaagattacatttacattgcaagtagagattagttatcctgagagacaaaaatctacaactagatctgactgacatgattaaaaaataacagattgtgttgcttataaaaaaagggtagtgttggcagaataacctgcaacaatgcttgatactttctaacatctttttcattgaaaaaagggatttaacattctataagtattgtagccatgatgtaaatggatacaacataaaattaaggaaattatattttattaaatgatacaacatataagtaaaatgtatttatagatttatgcatacatatttcaattaattttcctatttgatatcaatatgcttctccaaagtaataaattaagtctcactaaaataaacaagatgaagaatttggaacaaaacctcaaagcctctcaagaaattgtttctagattgtgaagtaaatagttgtcaggctgtagctctcatttttattcagctcttatatttgccagcttttgatgttatggctattaacttttatagatgtcatacatttttatgttaatcgttcagctttttgtctggtgagtagctagacttgtgttccttgaacaaattatatgagcaaattaccacatgccttcaacatctttaaaaggttttgtttcctgtttgtcattttagaattgatttttaaaattaagaatatttcaaatacttattgataatggacaaaatatgtttactctttttgtgaggtcatctttaagataatataagagttgtatagttcaaataaactttctcaaatttattagaagacaaataaatgtttatattcatataagtcaaaatactacatcaaattttacatagtaaaatatttatgatttatgtgcaacagatatgttatgtaattatttccctttatctcttttttttctcattatagaacagctgtcatccaaacattttgatggaaacttcacttttattaaggaatatttttaacatatattcttataaatattttagatctagcttctaacataaacataattgcaattatatctcaaacttaaacaaaaatattctagtatattcaaacatttcattagtatttaaactttcaatcttcctgtaagttctatattttataaaatatatattaaatttgaagcatttgttttaaaaggatccaaataaaattttcatattgttagaagttgataggcttaattccatgtgtgtcttttctttttccttggaatgtgtttgttactgaaactgaatagtttgtttttgtagttttctacagtatgtttcagtctgattgcatcactgcaatggtgtttaacatgttccccttttctccctatattacctatttatttgtagttgtagtcaagaaatgaaagaaggccaaatttaattgactttgttttggtttcattttgatacagttatgttataggaagaactggtttgtctctcaaattttcttaacagtactttattcatatgtactttacatattgagcataaacattaaatatacagtcccatgaactgtgatacatctatgtacctgagtaagtaatatccagatcaggatatagatttctattactccacaaagtttcttcatgctcctatccagacaagcccccatctccctgctcactacccccatgagcgaccactatgatttttatcaccatggactgctccttaacttgacatgtattcttttgcatctgacttctttcttccctcaggcttttgagactttcccatgttttaaaagtattgatagtattttttcatcaaattatttccccgtaagaattagatcacaggttgtttttcctgtctcctgttgatgaacattgatgggattttttattttgggctcttatgaataagctgccgcaaatatctttagagaagtcatcttatgtgaaaaacgcattcacttttcttgcagtcaaatgtcctaggagtagaattggtgggtcataggatgacaactgaaaaagaattttccatcttgattgcactgttttagactcctaccggcttcgtaggagagttctcgtcgtaccacactcttggcatcacttgttattgtctgttttcgtaatggaacgtttgggtgggtgggctatctcattgaagttttaacttgcagttcatctataattaataatgtgccatggagatactttcttattatgtgccactcagctatcttcttttataaagtgcctgttaaagtctttagcccaatttttaaaaattgagttattttctctcgcttgtaataatttgtgggtattttcaaaactattttctagatacaatttcttgttcagtttgtgtattgtcaaatatattacattattaacctgcctgtacagagcagtagtttctaatactgataaacttttacctattaatattttttcttgttcttaacacttaaatcttgactaaaaaaaaaaaacttgttcactctgaaatcatgaatatttatgttttcatctagaaatgctatagttttagcttttatagccttagcttttaaatttagatttataacccatccggaattattttttgtctatgatgactgctggggctaacagtttaatccttttgatttgttattatgactattaaaatgtaaacaaatgtaaaacaggttattgaggcaaaaactattttcatggtgtctattcaatatcttcatgaacataagtatccttgagggaattttaaaattgcacccattttgtgaaattatttcgtattctatttatgttttcatttatcattattatcactcctgaattagtaaatgctgttaataatcaacaaacttatacaatcacagtctttgaattctttttttttttttttttttttactttttcctcaagcctttatcctatatcaggtgttgtacttggatttagacattttggaaagtatccaactgtttttgtaatttcggtagtagcagtacaacttgttccctaaaaagctaaatagccacaacaaatgtacaatgatcggttagagtgggactgagaggcaatgtttcccaatatgtagaggagggattcagaaacatttaataatggtgtgatcctgtataacttactttatctccttgtgtatctccttgtttataagataaaatcatgatagtgtctgctgatagggttatggggattaaattaatgttaacatttgtaaagtgtttggaatggtgtcaaccacacagtaaaattatataattgctttactattactattgtaagattttttttgtaaggggacctgagataattttgttttttgaacaaagagaaaacaataaaaaattctaaccaataaatgatacagtgtgaagttcagtctaattagatatacaagtaaaccttatccaaccataggacaatgaattgttgcaaaatgatcatggcttgaattatggtttttttgtttgttttaaataaggaaactataaagccactctttataagcatttataaaactgtggctccataatggtttctcattatttaggtaaagtgacattgaagataaaatacatattttctgcagaatagttaaaaatttctatagcataccaacaattttagatcactttatatgttatgaaattttccttagttgattgaactttaagagaaaaatgtgactaaggaaaataaaaagaaatcttattttcttaaacaaatatgttacattccatatacaagtttggaaattcattatacttaacaaatttaacatgtatgtctgaacccagtttcactctggaaccaataatttgaaatgttccttatctataaatagaaattagttgaattagacagaatggcctagtttcacttatgtgaaaattctcttgtatgatatgttcgatttggaagataatattctgctcattttgttatacagattaaggaagtaaacagatcccctttactttgtaccctgttaaaaataatttcataaaatgaagtttcactcattggggacattttttatcctgaaatttttgatgaaatattcaagttttaccttgtataatgacaataaaattctttttgagatctgtagcattcagtgccttgattcaatagtaccagcaatgaaagttgaagcaatgtctaattcagtccctttatcttaaagagctagaaatatttatagatttgattttattttgaatacatttaaataaatgaggtaggtaattattagtgtgcatacgggtgcatccccaaatactgtaaatcaccaaaagttttcagcagtataagcctcctcatttttattatactattgatctcagtatcttatgtaaaagtagttacatttcttggaatattttgtcacctctccacattatttcacaatgggacacatatcagaagtagtttaatttaataaacaacatacatttatcaagcacttagcatgtatcgagcatggctgttaatgctgggggttgaaagaaacagccgtttctcccttcactgaagttacattctgtctgggtagaaaatttaaaaataataaaaatgccatgttaagagtaattaataagactgtatataaattgcaatggtcaaacaagcggttgataaaggagaagtgtgcccagtaaagcaagggcattgcttgaaatgagttatggaagtataccacaaccattttagtatgatttagagttaaaactttagttcccatttgattattgcacttgattcatttactatatcagttcacatttattccatattaataaatgatgattcatgatgcaaagataaaaattaagttgtcaaattgatttttaaaataaaatatatattatcagatacataaatatgataaatatatttcattatttctttagagacaattatttatgtgtagaactagctgatatagaatatgtagaaattatttcagtgtttacaagtctacaaacagtgttacaagtttacaaatatatatatatatatataatatatatataactaaccactttactaaaagttaactatagtaactacttaactacaaggtgtagctactacttactacttaactactatactaactatatatgtatatagttatatatgaggaagaggtaacgggagagagggaaagattatgaaaatttgccatatgactatggaggtagagaattcccaccagtttaccatctataagctataaaaccaagaaagctcatggtgaaattcaaagtttgaaggcttgagaaccagacgaggcaatgttgtaactccaagcctgagtgtgaaggcacaagaaccatgagctctgatgcctaataccaggagaaatgatagaatttgcccttcttctgccttttttttttcttttcagaccctcaactgattggatgatgcccacccacattggtgagggcagatctttaccccatctactgattcctatattaatctcttccagaaacattctcacaggcacacctacaagtaatgttttaccagctatctgggcattgcttggcccaatcaggttgacatgtaaaattaaccatcacaagtccatcactgggtacccataggtatttccttgaaccatacttaataaccaaataaagacaataacaagatcataattctgcttaacattatacaactatcctgcctgcaaccaaaatggaactaattctttcctctgaagtggaggtaaaatcctggagtaatttttactcttgatatctcgtaacttagaaactaggatgtgaaattaacaataactaagtagagatgctcttcgactggtgatcttatgtctctgtaaactcttcataagttataaatattattaagtcagaagttcacatttgacttaatacgttcaacttacaaagggtttatcagacataactccatcataagttgaggagcatattgaatgcatatcactttcacaccattgtacatttgaaaaatcataagttgaaccatcataagctggggactgtatgtaatgttatgaggtcaatatctattacatttcataatataggagaggggaaaaacaatagatttgcttaatatatgtatatatgcataccaacatatttataacaaaataaggaggaaatattcatgatactggcagttctcattactttagcaagtcattcggttatagctggtatttataacgaccttcttctactacccatttcatattccctttgccttcaacaatcacttccactggtcatggttctttatttggtagggtgacccagatcttcatatctgaatagcctggactattgttagtcctgcttagtttgggttgttgtagttttcaatcaccttaatcacagggcgtgatattactaagagaagttctaagatatcttctgtattccagacatattcattcgtatctacattgagaaatattagtccaatttccctttggtaataaggattaatcaccctagccagtgcaataattcccttctttgcctgttgattcagatacatgagaagtacaaggtatctgagtggcagccttgactcccagttcagtggaattatcattgtgtctcttggtggaagcactcttctttctggaaatgagacctgtaggccagcagagtataaagttatagaaacagggagcacaaatgtagatagtgagtcactagaggtaatgctgagtggtaccactcccatttcttttgcttggttcctggacccataaatcctggctatcagagaaacagaaccacatatagtggatgctgattcagagcctatacagtcttctgtaggaccctgacccaaccccacaaggtattatcaccttgctggaattggaacttgagtcttaaaaaggtcatttcactgttctgtcaaggcagctgcctcaggatgatgggaaacatagttgtaccagtgaattccatgagcatagcccatgactgcatttatttgtctgtcaaagtggttcattgatcagaaacaatgctgtgtagaatatcataacagcaatcaaggaattctataagtgcatagatggtagttttggcagaaacattgtatgccggaaaggaaaacctgtatccagaataaatgtctattgcaataaagataaaacactgccccttccatgatggaaacagtccgatgcaatcaacttgccaccaggtagctggctgatcactctggggaatggtgccacatcagggactcagtgtgggtctctgctgctggcagattgcgtatacaacagtggtcatagcctggtcagccttgatgagtggaagtctgtgttgctcataccatgcctaacttccatccctgcctccgtggccactttgttcataaacctattggatgacgataggagtgcctggggaaagagactgactggtatctatataataggtcatactatccacttgattattaaaattctccactagctaggtcaccctttgataagtattcacatgggactcaaatattattatttttcattctgagaggtcagtccacatacttcctccccaaatttctttgtcaccaattttccaatcatgttccttccaagtcccagaatagccagccaaatcattggctacagcccatgaattgatatataatcacacatctggccatttctccttccaagcaaattcaaaacaggtgcactgcctgaagttctgcccattgagaggatttcctgttacaactgtcattcagctatgtcccagagtggggttgtagtactgcagctgtccactttcaggtcatgtctgcatattgtgcagaaccctctgtaaacaaggccaaagttttctttttctctgtcaactttcatagaacactccccatgaggctagaggtgcaggctgggaaaaagaaggcatgtgtcaggagtggggaccatggctgtttggaccacttcttcatgtacttacttgtgcattcagggcctcctcaggatcaatcacatacgtaccatttccatttgaagatgcagtgcatgcacaactttatggtgtggtgagtcagataacactcagtttattatgggcagaacaagatggattttcccctgcctttttgttctattcagattgtcaatgtattggatgatgcctgcccacactggtgagggcagatcttctttactcggtctactgattcatatgttaatctatccagaaactcccatatattcacagacagaaataatgttttaccagccacctgggcatcctgtagcctagtcaagttgacacataaaattaaccatcacagtctttacttaaaaatcaaatatagccaagcacgatggctcatatataaatattcccagaactttgggaggataagtcaggaggaatgctagaggccaggagtttgaggcttgcctgggcaccattttatgaccctgtctctacaaaaaaaaaaattaaaagttagccaggcatggtgacacatgcctgtagtctcagctacccaggaggctgaagcaagaggattgcttgagcctggaaagttgaggctgcagtgagctgtcattccctccaaactgagtgacagagtggaacactgtcttaaaaatatgtaattttggccgggcgcggtggctcactcctgtaatcccagcactttgggaggctgggggggttggggggtggatcacaagatcaggagttcaagaccagcctggccaagatggtgaaaaaaaaaatatatatatatatataaatatatataaatttataaatatatatataatatataaatacatataaatatataaaaatatatttataaatacatataaatatatatttataaatacatataaatatatataaacatatatttataaatatatataaacatatttataaatacatataaatatatataaatatatataaatacatatatatacttttttttttctaagttggcgtctcactctgtcactccagtccagtggcacgatcactgcaacctccacctcccaggttcaagcaattctctgcctcagcctctcaagtagctgggattacaggcacttgccaccacacccggctaatttttttgtatttttagtagagatggggtgtcaccatcttggccaggctggtcttgaactcctgatctcgtgatccagccccgctcggcctcccaaagtgctaggattacaggtgtgagccatcgcgcctggccaaaattacacacacacacacacatgtgtctgtgtgtgtgtgtgtgtgtgtttgtgtgtttgtaattgttttcaggagctagagaaatttcggttacatacacacaaacattcacttatcttttttctgagtaactgcaatgaatttatcatgaaatatggtaaacttctgtaccactagtttctacttttgttcatcgtctggttttcccctattatcttgggcacatttcctttaagccccatgaaaatagagaatctgttattattgtgttaaactatgtcttacttttctatcaaatatattttggtaaaactaaaaaatgaatttaaatgttcattgattttaatgaggacctattgtatgctgtacttgctggatgttccacagctataaaacaatagtgagccagcagatttgggtgggaacaacatcttcactatttcagacaagtcactaggggcatagcttccattcttacagttcctaaaattatcagtgtgggctcatgcccaagcatattatgaaagctgccctttgtaatatatttgtgacatcttatgtggtcataaattcttgaatactttttggctattaggatggttaacctctgtagcttagatatcctatgtcacaaacatacatgagaactaattttaaggaatagtaaaatacacttcatatgtggaaagaggatggctgacattcttaggggcagaattatccagaaagtttatatagtttgtgatattgctggaccattactccaaagggtaaatgctgtatgttttagtgatcttgggtggctataacaaaacaccacagactgtgtggcttaagcaacaatttatttttcacagttctgcagacccagaaatccaaggttaaggaaatggcagattcagtcttggtgagggcccacttcctgactctcctatcctcacatggcagaaagaacaagctctgatgtctcttcctcccttaagaaggcactaatctcatcacaggacttcattctcatgaggtcatttaaccaaattacctccccaaagccacaccttctaataccatcacactagcagtcaggatatcaacatggatttcaaggagatacaaagattcaatccataacactgcccatacactgaagatttcaaactcatgagtggcattataaaaatttgaagaaggtgacaagtagttatgtagaggagcagtttgagccaatttgagtcaataagagtttccttttctctgcatccttgccagtatctgttattgtttgtttatttaataatagctattctgacttgggtgaagtgatatttcattgtggttttgatttgcatttccctgatgattaacaatgttaagcatttttttcatatctctgttggctacctgtatgtcttctattgctatttgtgtcttttgcctattttcaaatggaattttaaaaaaaaattgttgaagtgtttgaactccttatattctggatgttagtcccttgtcagatgaataatttccaagtattttctcccattgaagatgttgtctcttcattctgttgattgtttcttttgctttgaagaagctttttagttgaatatgtctcattaaaattttgcctgtgcttttgaggtcttagccataaaatctttgcttagcctgatgtcctgaagagtgtttgtttttttacggtttcttatagtaattttataaatttaggttttattggaagtctttaacccatctttagttgacattgtaagtggtgagaaataggggtccagtctcattcttctgcatgtggttatgcagttttccaagcaccatttattgaagaaggtgttctttttccaatgtttgttcttggtgactttgtcaaagacgagttggcgtaaatatgtgggtttatttctgggttctctattctgtcccatttgtcaaactttataccaatatgttctgttttggttactatagccttgtcttatatttcgcagttaggtagtatgatgtcccagctgtgtcctttttactcagagttgctttggctatttgagccttttgtgttgttctatactaatttttggattgctttcttctttgtttttatgaaaaataacttttgtgttttgacaaggattggattggatctgcagattactttgagtaatgtggtcattttaattattttgatctgtgagcatgggttgtctttccatttctatgtgtcctttttaatttctttcactggtgttttatagttttccttgcagagatctttcacttctttggttaaattcatttctaagtattctttttttttgtagccactctaaatgggattgacttcttgattttttttcatctacttcattattgatggctagaaatattactgagtttgtatgtgattttgtatcctgtaagttaccaaatgtatcagttctaagtcttcagattttccccatataagatcatgtcatctacaaagagggataatttgactccctcttttccagtttggacaccaattattgtgttttcttttttctttttttctttcctgattgcactggctaagatttccagtaccaagtttaataatagtgttgaaaatagacatccttgtcttgttcaaggtatttgaggaaaggctttcaacttttccccattcagtattatgttagctgtgggtttctcatatatagtctttattattttgagatgtggtccttctatgccgagtttgttgaacattttatcttgcagagtagtagttctatttttatttttttgaggaacttccatactattttttataattgctgtactaactggtttgcctagcaagagtatacaagggtttccttatctgtacatcctcacactgactagcttttgtattttttattttttgataatggaaatttgtaacaaggtatgaggtgatatcttattatggctttaatttgtaattctctgatgataataaacatctctttttgatgtcattaccagatagtgtttgaaattgctgaaaagctgctatccattgttctccatatactttttgcaagtgtaaaggtctaactcacaaagttaacaacaatgctgagaacagtacattctagcaagttccttacctagccaccatgaaagaaaaattaaaaaaaaaaacacttttctaatcatttcacacagtaacaggccatgaaaagtttgtgaaattggtctgtataatggcacatggttaacaattacagaaatgtttcaaaatgtactaaaactttaaaatcatcacaatctaatcatagaaagtagttctaataccacatatgactctaaacctacaattgctctgtcaccctctatggaaggcaatttcctgtgagctctcccatgcaatgaaaattaataaatctcatgctgaatccctgagaaatgtgctgcttcttgagagaatattaacatgaggaattaacttgtgttttaaagaacattttttagcaattagagtaattttataagatgtgacgtaattaaggtaggaaaacagaccaaagttggtatatacaaatttttagaaaggtaaacattatgtcaaaatatgttctgaagcaaaggaatatagaggatgctaaaacagaagtgcccatattgcatttatttttttttctataaaccattggtttgtcagcttacagtatggaatttccaatcataaaataaatgtcaggaaattagctgcagtatcttaatacttttactgttgctttcaaatagtacaataagaaaaggctttcttttaattaagatatatattttggggaagaaagagtgattattcaggggcatttgaaaagttggtggtgaaagaaggctccagggcatcacttactacttttatcaatataccatcacataatctgtgtgaatcatttacttggattcttattgtacttatttgtgacttcatagtgtctgaactgtcactttactttctttattatttgtcagcctctacacttatatttattcttgttgtttcttaaattcaagctgaatttgatggtatgttttcctaattaatatttttcattatttttctgttacaccaaatatgcgtatactcgtgctatgaaattattcaagcagatagcgtcctagatcattttaatgttttacaaatatgtatttttggttcacatggaaccagcttaaattataccactggatatttatttatttttatttttaaaagtaaaacatttagaattaagcgtgtgtcatttcgatgccagagttaactttatcagtatctgaaagaggaaaaacaaaaagcaaaaaacaaaattaaaaaaacactaataaatgctctatttgttttcctcagtttagttatgcaggattagtttattttaattttgtttttattttttattgaaaaaatccttagacatttccctttcataatacagcctttgataatggagtttcccttgtcattcagaacattgtccttctattcagaatataattagttgaaatctgtatctcaatatctgtgcatgctgtggcaaattgaaataacatgtagatgtgtatctttgttcagacatgtgaaatacagtggtaggagaaagaagacacaatttctgtaaattttatctcccaatgactatggactttgctaatatattgtgattgtttatgatatcattgagttattagggtaattatttactgttctccacttttttacatgaaatggagcttcagcccttataagtaagaaatattaaaacaattaaatatactttactatggtaaaaaatgttgtcaaatatatttataaggcatatcatgaccttatgggaatataataaatgatccattcaaagtagatttactcattatttcaaacagtttagatacggtactccttattccagttacactggtagctgaatagtgatgaattattctaatttctctattaaatacttctattaaaatatttcatctcattaaaatgtgaatccacagtatatataacttcagaaagaaatgttcagagaaagtgagtgtgtctactgagcaaacagtgaagcaagaaaaaaggattgcacagggaattagattagccacgctggtaaaggcatagctgaagccccattaggtctggcccagacagcatttgtgtttggaagagctaagcaaatcacattaattaatgcttacaattttctttggtgaaaggtcctgatgtcagagagaagacagacattttcttttttatctgtacattatacaagcccacccaggtcactgggccattggaaaggaagcaaaaggaactgaagcaaaaataatcacgattttagcctcaaagcaaaaagaatgcttactcatttacaccattccttttattagaatgcttaattttgaactacaatgaatgtgtttgcatgtatgtgtgtgtgtgtgtatatatatatatatatatatatatacacacacacaatcacattcattgtatgtgtatatgtatcacatttattatatgtgtatatatatatttatgtacacacatacacacatttgcatgtagacatatatgtgtgtatgtgcatttcctttccagaaaattccaccagaaaggactctttgaccaaagagaaaattaaaggagtactgtagtgttattttctacactctagttgtttctacaggactttctgtgccccaatagattacaatgtcatgtagatgcagaaataaagatggttatattataaggaacacagagtgcaaataaaatactaaagttatgtataaaacaaaattatatcttctaaaaataaagtaatatagcatctaaatcatataaagccaaatgagtgttagcaccttcaaagccactatgctaaagtagttttcatttagttattgccatttacatgttttttacaaacaacactttacagtaatgcttagagcctgcatttaaaggagaggaattagagaagggaaagctgggtaaatacacaggaaatccagttgattgcttagacagagcctcatgtagtagcaattacatcactttggtggggaatcaacacaaactgatctctcacttttcagatctcgactttagaatgtttcagatagagcactcaaagataattttatttaagtgcactcacttcaagattgttgcatgaaatgatatataaacaaaaatcataatacagtattcttatgcatttaccataatatttttgttttctaagatgtactcttcctgatcaatactttagaaaacataatgaaaaaatagaaaatattttgggacaaggatgtggggggaaagtaagttatacaaaataatagtccactgagattgaagtgtgaaagaataaatccattcctgtgctacatccaatgctctctggtaccccacattttccagattcattaacactcctggaaaatgctttctgatactgttgaattctcaacctttacatttccatttttgtaagcagcatgtggaaagactagtttttctttagttagtacattctttcctcggataacgtgcaataaaatctgttagatagatgcacatcctttcttataaacaattctaacactgaacgttaacgttcactgtgtacctcttctgttttccgaaattttgtaacagcatattttcatgaaaattattttgttattttttcagatggtagagaatatccacgaaaatatcattcttcccccattcatactgaaaattctaagatgccttaatgtagaaatcatgcatgcaatattcatttttaatggctaatcatgcaagtatatgtggaagaggccagagttgggccaagatttcaaaagtgatgtgttttattcataaagatgtgctaggactcagtaattacccattattataggaagatacaaagaataagaacagatttttcaagctgctatccctaatgtatttgtcttttattacttatgagtcttttagctgggtcagattataaaaggctggttccagtttacaaactgtccaaaacgatgactaagagaaggttcaagtttgctcttgcttggatttacataaacaggacaaaaagtgcaaagaaatgatacatgagtaaatgaacacagcttttccatgtttccttagttccttaccaagcgattagcaaaattcggtagtgtattacttagaagagtcttacgttttatacttctagaacagagaaggaaccatatgcacaatcaagagtttaccagctactttaaaaggtaattccttacttgctcatagacacctactccttcattccatttttttcttcaactttatatcacctcatacttatatataaatacattcatttcccttgcatatacccaataaaacctctttgccttcctatgaaaactgtgatttcttctattgaactagatttaaattaaaatatatgttgcataaaacaagggatgatttcattgtagcatttgtgccaagaaaaataatttgaatattttgttcattaagataaacctatgccttcaagttagtcattttatgattagaaataatagctattatcggaccattttggctaacctttttggaggctactaattattttcatttataacttctgagataaaaatatttctatttccactattgtaggactttgtcaagtggataaatctttaaaataaccgtgggcagagtgtatcattatcagctaacatgacagtatggaggcgttattcgcattgctaacaacacaagcagaaagggagaatggagaatttttttaaaaccattcttttaattttcttcatgatgaagttagaacatttaaaaactaataaagaggtgttctaagaaaattctgaaatgtgacaaaagttatatctaattataattatgacaaataacattaaaaagtcaccctgtttaaaagtatcaaaaaatctaacatctaatgtaagatttcattttcctaaatttaaaaatccttacatttatgagggcctaaatattttgtggccaatacattaaaaaatatctttaaatgaaacagctttaccataagttttagtgtggaatgattcctattaatgtcattcttggttgggtttcggggtgagaatgagctatgtgcctcatttcttaatgaacatttattgatgcaaatgaaaattatataaatattctgaaatgggaaaaggaatatttgttaaattcccaaatatatatttgctccttcaatttacaaatcatacctgattgattacccaactttggaatattttaaatttaatatcagccatttaaattttattgttattgataactagataatttttctgttgtcttaatgatgatgtatatgtttaatttctcaactgaaataatgtgggaaattacacaataaattgtgtcaattaaaaagagggaaatactggtaagtgtaagcattttaaatagagttatctttggctaatgtccaagggtaaatgcatatttctaattctttatagctttagtcaatgagcttaattttgaataactaaaaatgctagttactatggcatcatatttctttatatagtatctattttcatacaaagaaaagaaaaaagtttcaggttactttaagctgaggatgcccacagtttatgtcttagttgataatggatatgaattttcatattttattctgccacgtaaatctcaatgaagccctaagcccttctcatcctcacacaggtttcctttctgtgtatgaaaaagtaaatcattattaagtaatgcaatagatagccaaatcagacaggaactattacaaccaattttgttgttacatattttcaaaggaaacttctacaaggggtaaaaattgaatcttatacattgctattaacgggcctctaagtagaaggaagcatatatttactgcgtcataattttattatggtggcgctccaaaaatgaccaaaaggattcttaggataattgtagctatcaaatactgagctatgttatcttgtaacttgaggctgaagacaataagaaaaattcaggaaatgtatttttaacatatacatgcataaaattgttcaataaaaatggatatatgatgaatcatatccaagcaaaaaagttactttgaatcattgtctctactatatagtattcctaacttctccagacactactttgcaaaccagggataaagaataaaaaaaaaaggtaaactttgaagtgaattattgggatattattgtgaatcgtttttgctgcaggcagcatggcatgaaacagagcatacaaactgggaaaagtagaggagagatgaatttatggattatctggaacatatattccaaatcaattgttttctaagttatttcctgacatggttttgtaaatgcatttaaatcaatgaacaatattggagttttctggagtccttatatcaggtttctgattataaaagaatgtatactatattatttaataaaaagtatgtaattcatcaatatatttaaatacagaaattttaaactgtcctctaattgtgaagtcaaaactaagaagttacttgctattttaagtttgctagagaatgatactgtgcttttgagctcattaaaaataattaatatatatttatcagtcaaacacactgagattgattatcatcatgcaattcatatgctagaggctggagcctgtgtcttcaggccactacacatataaaaagccaaactgctcagccttgatacaagtgaagtgacttgatactctaaaaagaaacaccagcctcttgatggacaaaaatatgaaatgacaagagtaatttcaagtagctccaagtaaattaaccataatatttactaatagtatcatctttgctaataaggattagggcattaataaacactggaaaaataaaatgggcttcaaagttcacttgtgtaaattgatgaaggtcacaagaaatcaaaaaaggttagagataatattgttttaaaagcttaatatactagtcaggaagtaactgggaaattcattgaacatcttttggtttttagggtcattctttctgtaggaatatgcatatactataagtgaattatcacaattactaaaattagttgtctagtatacagacaaagttgttgcctaatattgtgtcattttttggaagcatcaatttcacaaacatatcttttttgtttgcttattttgtggtttacctttttttccaattcttattttggtaagtacaaatggtataaaatttgccatcttatctatttttaagtgtacagttcagtggtcttaaacacattaatgttgtgcatccatcaccaccatctgtctgcagaactcttttcatcttggaaaactgaaactctatcccattaaactaaatctctatcctcctgtccctgcagcacctggcaactggcattctcctttctgacattataattttggctacgctgagtacctcatataagtggaatcatgcatgatttgtcctgttgtgatctgtgtatttcacttcacttaatgtcatcaagattcgtccatgttgtagcatatgtcagaatatttcctctatttaagatggaatcgtatcctccattttacttatctttgctctaacgtttattatttccttccttcttctacctctgggttttgtctgtttgtcttgttacaggtccataagttgtatggagagactatcgatttgagatctttttttcttttaaattctaagtaaatgaaaatgaaatttcatttcagttattatacttcccagctccagattttccttttgattattttaaaatgtatctcaaaattttcttcttagcactgttttgctgcatcccataggttttggtttgttgcatttttgttttcttttgattctattttctagtttcccttatttctctttcgatcaattggttgtgtaagactatgtttttaaatttccattaatttgttcactttctagcttttcttctattatcgatttctaaattcatcctgttgtggttggagaagattttcttttatgacttccatttaaaaatatatatatattgggacttaggtctcatgtgcagttaagaagaatgggtattctattgttgttgggtatcatgttctttatatgtctgttagacctagttagcttattgtgtttcttctctttccttacttatcttctgtctggttgttctcttcattattaagaatgagatatcagtctctaactacttttatagaactgtctatcccttaaatactgttaatttttgcttcatgtatttgatgtctgttattaggtacatgaatgtttacatatcttcatgcagtgttgattctgttattaatacataatgtccttctttgtcacttgtaacctttttaaatttaatgtccatattttctgattttagtatagttactcctgatctcttttggttactatttgtatggaatatcttttttaaatctgtcattttcaacctatttctgtctttggatccaaagtgaatctttagtaaacagcatattgttggttgattttaaaagtccactctgccattcttttttttttttttaatttcagagcttaatctacttatgtttaaagtaattactgataaggaaaatcttctgtcattttgccatttttttctgcaagcattataaattttttgtcctgattttttgcattactgtcttctgtgtttaattgatttcttttgtagaaaaatatttgaattcccttcatatttccttttctgtgtatcctagagcttttttgtgtggttaccatggtaattacatttaacatcctcaagtcataacactctagtttgaatttaagccattttaacttcaataacaaaaaaaaaaaaaacctctgctccttggcagcttagtttccaccctgttcagtagttcagctgttgatgtaacaaaaacacattttatgtattatgtgtccaaaaatgtaaagtaataatttttcctaaagcattagtaccttaaattatgtggaaacaatatgtatagttataaaccaaagttacaataatgctaacattaaatttttcatgtatttatttttactgcagtctttattttttcatatacctttgagctaccatctagcatccttcattttaaactgcaagagtgttttttagcatttctttcagggccaatctagtggttataaactcagcttttgcttattttagaatttttttatttttctctaacttttgaaagataattttaccacatataggattcttggttgacatgttttttttttctagtagttatttaaatataatagtccattgccttctagactgcagtttctgatgagaaatctactgatagtctcattgaggttgcatattataaattacttttctatttatgatttccagattatttatttgcctttggcttcccacagtttgattaaaatgtgtctcagtgtgtgtatctttgagttcacaatatcgaattcattaaagttcttgaatgtttatattcctgtctttcctcaaattttggaaattttcagaaactatttaaatattttctctgcctctttcattttcttctccttcggagactactataatgtgtatattggtcttcatgattgtgttttatacctttagttttcactttcttcagtcattttttatttccatccctcagattcaataaattccattgtcctatatccaaatgcactgattctttttctgcctattcaaaactacctttcaaacagtataatgcatttttcatttcagttattatacttccctgttccagaccttccttttagttatttttaaaatactctatttatattttcattttgttcatacatatatatttcttacttcccctgtgccttccttcagttctttgagcatcttgaagacagttgttttaaagtcattttctagtagatctactatcaggactttctcaaggacaatttctgttggtttattaccttccactgaatggaacatactttactgtttcttcgtatgccttgtgatttttgtgttgaaaactgtatattttaatccaataatatggcaaatttggaactcatatttcactccttcacctggatatgctgcttttattttgatttggtttgttttgtttggaatgctgtaggctatctctatgccaaggattaggctgatgtgtaaacttaagggttgttttttttttttttttttttcagatcttttctgagcctgcatttctccctgggcattcctgaaaactttctaattttcccgtattttcaggtgctgtgaatgttttagtctttaatctctggttcacaaaaatgagaaaaagaaaaaattaagattaaaaaaaacctcacttgagctttatatactctggaagtcacttcagccaaagaaaatgctacttggaacaataagggggagatgtagcaagagtgggtgcctgcctttgtgtttgtccctccttgatcaaatacagcaattaatgatcagaacacacagccccaatgttagagaacagtgtccttactgcccaccctgcctcccatgagttgtatgaaaactgctctagtaacatgtgtacaactacctgccatagagtttgttagtgtgaaaggtggctgctgtcgagttaagaagtgatactaaccaaaatcttcttcagtttaccactaaagccttcccctagaagatacaagcctttatagcattctaaataagttacatgggaaagatttttgcttgtgtaattattgtctgagtgagaaaacttattattggtgcttcctactccactgtcttcccagaattctcttattttgagtttttaataatatttgaatttcaaagacttcctaataattccaaaggatataacactgggtaaaagtagaagtgggtcagcagactttttattgtaattatactttcatgagtcccataatataaaatttagacggtttaatccctcctctgaaatatatgtttcacttattattagaagatacacattatttttaatttaaagataatgactacatttactattttctgttcatttacaatccaagaacaaataaatatccatagcaacatagactctagaaaggtcctccatatgcgctactcaatgcatacttcttacttatttttgcctagactatatatattcataaagttttgttagctggacagtcacccaaacatatgagaattcatttaagacaaatctagaaaattaaaaaaaataccccctagagtgaaaaattgtatacagtgttggaataaaaatttttaattccttattaaagtaaatctcattctcttgcttggattgacatttgatcaattgatgttcaaattaaataagttgtttgcgtttctaaaacagacaacaagatatagttaaaatatatttagttccagttcctgcacttcaagaattaatgtagccctcttcaaagattatgaccttttctaaatgtactccttgtatcaccagaaattgagagctttcagcatgtggtactaccggtatcatcaaactgaaaaagcagaaatgctgtccttatcctttcctgatcattaaatgtcatcagtgataaagcttaagtgaagcagtttgttaagatggaggctgttggtactgctctgtagaatacaggaggtcagattccacagtgtcaaggaaaatcaagctaatggagcaatttaattaaaattaattgagtataattctgtctcttaagaatgagattgatgtagggttatttccagcttttttggcttaaggtgaaatgaatgtccatactttttaatgttatcttcctcaatcttttcctataatcatagttttaacaaataataatggtttatagaagttagaaatgtaaaagacctatgaggttatttaagctactatacactgtgattggatttttttattctctttatgtacctctcatacccatactgagtttagttcataatatagactctaagctgagaagtaatatatattgaggcatctattaatgcttcatttaaaacccatacccttaccttaaattttagtggaatcctgctgacaaacttgtgtgagccaactaggtagattttagttgagcaatctagattcctgcttctatcacaaaacagtttatacaagtcagcagaattggcatatatctgattaaatgtagtagagacagatgtagtacacctttagcatgacttacccatctgtcattgggatatgctgttctcttcataaaatcacttttactactccagaaagttaaatagctcacatttttgcttcctccactctgcttacttatgcataaatattatagtccccttgccaagtagtcagtatttataattaacatatttactagattgacaacattaagtataaacagatagacatggtggtgaccaaaagaggaatatattgggccttgttacttgggaaaagattttagcatggtagtatagcttgatagtatttggtcatcattaagagattaaaaatttctttcatgactttgtttcttcactcttgcgatgtcatttattgcatatattgatacggttttaaaaaattaaaatttacctctcctaaacattttctgcctttgaaaaagtcattgaaaaaatgttttgaatatatacaagaatgaaattaaagggcaaaaaaataagagttaaagttctattcatttttatattattagtctaggagagtggtacatttaattaaacatagaaacttaaagacattgaatacgacttctctgttgctactctatgccttataatactcactgccagacagggtaggtatgtaactactaacaaccctaaaatataacaaatacatcaactggaaagctttgtatattataaaattctgtcagcgtggtagggtacctgagcagcgatcctatggagagctgaaacagagtaactgcaggcagaagatatctttttaaaggaacttgctgataaaaagcttcaacagcatgacatatctctgacttgctgggaaacagcagctgacagagcaaaccaacatgtaacagttggtttcaggggtgaatatataggaccataaagcaaatgaaacttgtgaacagccgccagagttgcaaatcaaaagccattatacacctattccatgtggggccaactgttgaaactaatagcgccctttcctttagattttcttgaataaaggcagctatcaactagtgatcagaccataaggaatataattttacttatgatagagaaattatataccatttggaaattttatttaatctattatccctttcaattttgtattcaaaatcttatcgtaagccaagccaccttccaataacaattattaaatatctgagcttcaattgactatcatgatttcttgcattctaatcaactaaagagaacttccagatatattctgtactgtaggtaattgagctattcctcattatgccggccttgatttgcaaaggtgatgaaatatcttcacagttgatgaggaggctggttgcaccaaaacttgcaaaagtgttttcttcattctcgctactgtaaaataatgtgaataacataaaggactttactaggctgtatactgaaagaacaataaatcattagcaccacaggagagagttgtagtagcctttgattaatctataatctaccactattgcaatattctttgttaatggaattttcaattagaatattatttgaaacacaattcattttacatttattaaacgttccgcatactattatgttgtcattaggtagcatttagcaaactgatcattaaagcagcaaatttggaccacagatttgttatcatttttgggagcttgcagtggctttgggaacttttttttaaactgatttaatgataagattccatcatcttctttcacagttatttcatctcattattcctatttgtggatgaacacttggtaaggtatttactattttgagttcatttttatgcttatgaacattaggtaaacattggcttcatgatactacttactttataaggttttatgtaaattattaatacatatagagtaagatttcaattaacctcagctattttattattgctaacaataaatgtaaaatttcagtaaatgttaaaactactaatttaatatgtaacatatgtagagctacaaggtggcaggaaaagttctaaatgctttgcatatcttaattgtttgacttgcataatataagcattctttgaagtaggtagtattgttatttctacattacaaatgagaaaaccggggcttagagaggataagtagttggtccaaggtcagcttgaggtttggacctgagactgttcaacttcaaaatctgtcctgtcaattactgtactttaaaactctctgccagcagtattgaacaaaataggatattataaaatactcatttgtgacactgatgtttggaacccaaaatgtatatatcaaatataaaaaatgcatactaactgtattagtctgttctcacattgctataaagaactacctgaggctgcataatttatgaagaaaagagatttaattgactcatagttccacagactgtacaggaagcatggcttggaggcctcaggaaacttaaaatcatggtcgaaggtgaaagggaagcaaacatgtcttaccatggcagacaggagagaaagagctaagggggaagtgctatccacttaaacaatcagatctcatgaaaacttactcactatcatgagaacaacaagggggaaatcccatgatccaaacacctcccaccaagccccaccgccaacacttgggatcacaattcaacatgagattttggtggggacagagagccaaaccatatctctagccaatacccactctagattcaagccttgttagattcatattgtatcaaacatcatattatatgggaaactacattcaggcttccattttcagccttcattttttaaatcatgttactgaactggcagttgaaatagtgaccatctccaaatcctaccaagttccaaacagacagtttttcctcctttggcctttgacagaggattcaggagtcaagtataagaaataaggaatagatttttgtcagctgtggacccagaggagttaattgttggaagtgttgcgtaaaagtagtctagggaggcaaatgtacaatgtactggatagtgagaagcaaggagggttttgagagagaaaaagtgtccaaataggaagataatatattctttttccctttacctttgatctttataatgtagctctcctcccatgagtcatatcagttctcagatatttgaaaaataacttttgctaacaactgtaatatctttccagaacctttccttgaatgtatcaaatgctgtcagaccatatggtttcaggatactcttacatactgattgcttgaaactggttgttaaattgaggcttagaattagattaactattaaaaaatagcttaaccaacagtttgaaatacagtgagatttttattatttaaactttttaatattatatcataaaagattgaattcagttttttattgattttgtttttatcataggaaatttcaaacatattcaaatgagagagaatcgtatagtatatttccatgtgtccatcacccaccttcaaaaattatcattacatgtctgatcttgtttcacctatatccttattcatttctcacctgttcctttcttctgctcaagattattttgaagtaaactccagacatcttgttttcaacaaatatttaacatgtgtctctgacagtcatgaactttaaattttcagctctaataccattactacatctgaatttacaatcattccttaatatgaatacccaatgttaaaatacatgtaatagtctagtaatattttatgattaatatttttacagctttctccagtcttttactttcaacttatttgtacttctacatttaaagtgaatttctggtgtatagctaataatggggtcttgtcttttactcagtccaacagtttctaacttaataagagtgtttgctcagtccatttatatttaatgtacttattggcatggatgtatttagtctaacatattgccatttgttttccattttcccatctattcttcattacattttttcttcatttatttattcatacataatacatgtaaatatttagggggcacatgtttataatatgatacattgatataatcaagtcagggtaattaggatatctatcaccttaaatatttattgtttctttgtggcaggaatatttaattgttctctttgaactattttgaaatgtacaatgaaataatattaactatagtcatcctaccaatctatcaagcaccagttctcagttcttctactaagtgtgtatttaagcccattaaccacactttatcccccaattccccttactcttccaagtttctggaaccaccagtttactctcttatcttcgtaagatttacattttagctcccacaaataagtgagaacgtgcaatatgtgtctttgtgggattggcttatttaaattaatcaagtcttcttttttatttcttactgttttactatttgatttttaatgacatctagatagatgtgtgtatctttattttatatatatatatttgatggttactctagtgtttacaaaatttatctttcacttactatattcaatcttttggataaatataccacatcatctatgctataagactactgtagcagtgtattcccatttatgtctgtatgcactgttgtgcaattgtggacatccacttcatttctacatacgctattttttaaatacattgtgtgttttaaatattgagttgttgtttagataaatgaggaaacaacacttttaaaatttaataaaatatttaacatatcaaccatgctccttcatgaagatctgtgtttcttttaagttatttccctctacgcttaaggagtttttaaaatatttcttgtactgcatgtccgctaaggaaatattctgtttttttaggtgaaaccacttttattttcactgatttttttaaagatattttccctgcatatgaaattctaagacagatttactttatttctgtgttctttcagcatcttaaaattttgatctattgaattctggctggcattgttcctgataagaagacagttgacttttctgtccttgtgaaagtttgggaattgaacaatgagaacacttggacacagggtggggaacatcacacaccagggcctgtcatggggtggggaggaaggggggagggatagcattaggagatatacctaatgtgaatgacgagttaacgggtgcagcacaccaacatggcacatgtatacatttgtaacaaacctgcacattgtgcacatgtaccctagaacttaaagtataataaaaataaaaaataaataaaaaaagaaggcagttgacattccttttatttttcttctgtatataatacactgtttattacaagctactttatatttgatttttagtaatcttattgtgttgaattgagtgctttttcattggatttatcctgtttaaaatgaattgagtttcttaggccttcagttgatatttttcatcaaattaagtaaaaacaaaaatttagcattaactcttcaaatgtttttgaaccttattttctctctccttcctctaggacttcattacgagcatgtatgactgctttattgttccatggatctcaaagtctctgtttatttatgtatttatttttttcctttctatacttcagttcaatagattggtctgtcttcaagttcactcattctttattctctagtattcaatagctgttaagtccaccctatagctttcttaatttcagataatttatttttacagtttcaacttatatggtttttattttatctgatgaaattttcatctctttacccatttgtttatttattattactattttttattttagatggagtcttgctctgttgcccaggctggagtacagtggcacgatctcagctcactgcaacctccgcctcccaggttcaagcaattctctgcctcagcctcccaagtagctgggattacaggcacctaccaccatgcccagctaattttttgtatttttagtagagatggggtttcaccatcttggccaggctggtcttgaactcttgacctcgtgatccacccgcttcggcctcccaaagtccaaaagtgctaggattacaggcatgagccactgctcccggcctgtgtttattttttattgtaaattctcaaacatacatgtaatagctgttttattgatttttttcctattactttcaaaacctctggtcccctctgtatctgtttgtattgactattttctttttcttatggtcatatttttgcttcttcatatgtctagtatattttctttataatttatatcacacattgttggggccatgttggtgagcagccagacttatttcctccttttaaaatggttggattttgttctgacaagtagttaacttactggtccaacaacttgatcttttgaggcttggcttttactttgttagagcactattactatataactctgcttctaagtgtggcacttctagggtctgaatgcctggggtattcatcaaagattcctgactcaggttaatcagaactccactgttcctcagcactttggcttttggaatagctgtttggctcacagcctccagtagctcttgtctgtcatgcctatggtttctgactgaaattggccaacaattcaaaattcaaaaataatcactatccaaaaatttctcttcagaattttggagctttttctgtgactggttccctcctctctaatactctgtacattaaatttcagctgccacaggccacagggactccaaactccaatcactattcttcactattctctttgcccactaagaaacaccagtctctgtttgggctacaatttttttttttttttttgagacagagtcctgctctgtcacccaggctggagtgcagaggcacgatcttggctcactgcaagctccgcctcccagggtcatgcaattctcctgcttcagcctcccaagtagctgggactacaggggtccgccacgacgcctggctaattttgtttttgtatttttagtaaagacagggtttcaccatgttagctaggatggtttcgatctcctgaactcgtgatccacccgcctcagcctcccaaagtgctgggattacaggcgtgagctaccacgcctggcctgagctaccatttttttagtggtggtttggaagcgtccccaggtagaaagccaagctgaagtggaggtcacctaatatgtttaccttattgaaaaagaaaatacagccctacgctatatgttatttaatgcctgagaagagttttattttattgattatccattttcctaattattcatggaagaggggcgagttcgatactcaatattttgtcataaatataactagcactttttaaaatagttttttgtttgaatcagtatttaaatcagttcatatgttatgatgcattgtcgtgtcaagccccccccccccccttttttttttgtggttgtttttgttgttgagacagagtctcgctctgtcgcccaggctggagtgcagtggcgctatctcggctcactgcaagtccgcctcccgggttcatgcccttctcctgcctcagcctcccgagtagctgggactacaggtgcccaccacaacgcccggctaatttgttgtattttttagtaaagacggggtttcactgtgttagccaggatggtctcgatcttctgacctcatgatctgcctgcctcagcctcccaaagtgctgggattacaggcatgagccaccacgcccggctgagcctcttttaacctgtaaattctgtacgtttcttggcttttttatttgttggttttatttgtttctttgtatgtccttgaagttcactgttgattcatatggagcatggacttaatttaagctccaagacattgccatgtcctctgtaagataagatccccatattccctacatatttttcacaaaattttcattatacatttatgtataatgagatgttacattttcttaatagtaaagcaattcctcaaaaaaaaagtaccatgtgattcagcaatttcacttctggctatacagccaaaataagtgaaatcatggcctcaaatagatgcttatacacctgtgttcagagcagcactattctcaataaccaaaaggtggaagcaaccccagtgtcaatcagcagatgactggacaagcaaaatgtgctatatgcatataatgcaatattatccagcttaaaaagtgaggaaattctgacacatgctaaaatacgaattaatcttgaagacattatgctaaataaaaaaaaatcacagaaagacaaatattatatgtttctacttatatgaggtacctaaagtgtacaaattcatagagacaaaacagattggtggctgccaggggttgggaagagaggaggttggggaaataatgtttaatgtgtacagtttcagtaggggaagatggaacagttctgaagatggatggtggtgatgattacacacagtgtgaatgtacttaattccacaatgttgcacacttagaaatggattaaagagcaaattttaagttatatgtattttaccacataaaaaagagattaaaaaataatatagttcagtaggttcttggctagtaagttagacaaaagatcagaggaataagacaacttggcaggaaccttatgaaaaggattctgctactgaaatggttaaatttaataactcttaggtggtaagaaaatgaccctgtgtctatgtattaattcttattactggtatatccactggcctctttctcatttctccttgcatgtgaaaaaagtttttctaattcatgccccaaattgaactcttgatctcctttataaaacaccacaaaaagctgctcttgctgcattacattccgtctcagtgggtgacaactccatcattctgattgatcatgccaaaatgttggaggcattttccctttctctctcatgatatatccagtcgtacaagaaaatttacaggttctattttctattatccaggattagatcacttctaccctgttccaaagtgacttcctttctaggtggcaagcttttgtttgtttgtttaatagctttctacctgatttcattattttcttccttggtgaaaggctattttccctacatcatccagggaagttatgttacgtaaatcagatcatgctccttcactactgaaaattcatttgattccctttctacttttaatgaaatccagtcattccttagtcactccacccatgccacattgacctcattttattcaaataaaccaagtaccttaccaccttaggggctttgcactcattatgtcctgtcctataactgtttgccctcaaatatgagtttcatgactaatttgcttactttctactctctttagatctttattcaaattttacctttttaattaggtcttcactgaatattttttattgcgatttcctccccctgcgtatctatcagccttctctgctgtacttttcttagtaatatttatcagcatctcacatactatgttacttctgtgttttatttattggtattcccatattcaattataaattcgataagggcaggattttttctctgtttgatgtctaaaacaattcatagcatgtagtaaaccacccaacattttttaagttaaatgaataataacatacctttactttatgactaaggagtatgttaaaggcctaatgggtaaaattactatcgtagaagcaagaaatctcactcaaagtctgaagtaattcaatacgttagtcactggtgtctgctacttgggtatggaaagaagattagtgtgggtcatgtagcaccgtctattgcatttggaattagctctgcaagatcccatgtagttggtgttactttttttaaaataaattgatgagcaccttaaaaaaaaaaaccttagattcagggactaatactgataatgtatgctttgatgacagtattaaaaataaatgagttatcagagagtgtaagcatttatgaaacgtttgctatgtatcggatactctcctgggccctttagatatcattttcacatgctattttattcagttctaatcaatgcactacaaagtgtgtatttctattggcatattttcaaaagtgaaacttgaggattatagaataagaatcatttgtcaaatcccataaaatgagtaacttgtagagttggcataccttgtgacatctctccgactgcaaatagcttttttttttttttttaatcctcccagtatcttatagtagagaacatgtgtcccttggaaattaattaaatattagcagaaataaatgtgatcagttttaaatgtagcttcaattcctaaacatctattttcagaactcttctctgttaaaccatggaaggatctatttccttcttttcataagtctttggtcaagccttgaaaattaaaatcgttgtactgattcaaccagtatggtctttttaagttttattggatttttgtttgtctttagttcttttattttttgcagttttaatctgtgcacagagaacatctttctagcttgtaaatacacatcagacacaccctgctgtttcctagaagtctattccttgttgctgttaatagcagagcagcatttttttcttagtcaccatttcttcctgcatacagaaccattaccctctgtctacttctatcaccctgaaatcttccatcttacttttcagatgtttttcactatacctatttcaagaaatcaggtactaaaaataaataattattctctgatattcaacctatttttaacacctcaactatttatttttaatacctgatttcttgaaaaagcatattgttaaggaagtaaggtatcttcattaatatacatctttcacaactgaacaggttcatttttataaactagcacttgtttttcattttatactcaaatttatttagatctgttaattgcgtctgaatagtatgtgaaaactgtcatcattcagcttgggaaaaatattctcataatgaagttatttacagctatgtctgtcattagtgtcattagtaccactaatagaaaataagaaaattggaatggcaaaatttagacatataattgatttctttcttctgatacgtaattgcaagtgctaaaacttcctagatgttaaattgactgaaaaaaaaaaacatatcaaagaagcagatgtatgttgcagggatggagggttcactgtatttgatatttatatagctctgtgagtgactcaattcaactttcctggcttaggggaaaagggttaatgtttggcctgaccggtgagtcccaatgataagaggtcaggaagaactctttactggagttttagaaggtaatagaataatgaaggatgcagctatgagtctagcaaattgtgaatgtaaacagagggcattttagggaaatcatttagtgtaagtttttttaccatggtggatgcgatatgaaagaatagacacaagacaaattcgaatccaaaatttaccttaaatatatagctataacttacattaaagaacctaacaacttaattttaccattcacacatttaataagtgtacattcagaaatgtactcttcagtgaactgtaggaatacaaatgtgaatcaaattagtcaaggattaggccctgaaaattaaattgtgatcacatgttaagtgtgcacaaatatttaaacacaaagtagaaaatgatatatttttaaaagaggtctcccccaaaaacaagcagtaaaagaaagggggtaattttcatcagctgcggaagctttagggagaagtagcaactaaactgaatcttgaacagtttgataaaggcaactaagtagatgaacagcataaagaataatgaaaacaacagattcgttgttattttagaacaataatcacagggtcagagctgtagtcatggaagaatacatgacaagggagaacccttaggtaaagtcactaatgaaaatgcacagtttaatcccagacatgaggaatggcaagtgtacaaggcatatgcatttgcagcacaaagagaatcacaaaagaaaaatgagatttctgtcccagagatacttaggtggcaatttctgtgccagaattacttaggtgattggaaatgtaaagcatgaactcaaatctgaaggtaactgtccaagggtcaagagttactgattttgctaagaaaacaatatagaaagaaaaagaagattaaagtaattttcttaagaaatacctatatttaaagaataaaagaaatttgagaatgaagagaaattggaaacaatccaggagagaatagcaccacagaaacctttaaaaagaatttcaaataaaaggattattgatactgtacattaagattggttgcagcttacaaaagctacatattctatatatggatttatatgaggctatagaaaagataaaactacagggacagggaacacatcagtgattgccagcgactgtgggtgagggtaattgttgaagacaaagggaaagcataaggtgatttttgaattgatgaaactgttctttatcaatattgtgggtgtggatcatgaacctatgcactgttcaaaacccatagaactcattgttcaattcccacctatgagtgagaacatgtggtgtttggttttttgtccttgcgatagtttgctgagaatgatggtttctagcttcttccacgtccctacaaagggcatgaactcatcattttttatggctgcacaggaaggggaacattacacactggggcctattgtggggtggggagaagggggagggatagcattaagagatatacctaatgttaaatgatgagttaatgggtgcagcacaccaacatggcacatgtatacatatgtaacaaacctgcacattgtgcacatgtaccctagaacttaaagtataatttaaaaaaacccacggaattgtacacaagaaagagtgattttaccaattgtaaatttttctaaaaattaagtaacagaaaaagagaaaaacaatagagtcattggtttgttgatttaaaaatgtatattcagaatgtggaagatgaagggtatatggtaaagaaatggaagccatatgcattctgttttcaaaacgtttcccagttaagaagaaaaaaaaagaaggtagcttcaggacatacctcagttgattaaagaaaggttatttaaagagaggaaacttggagatgtcttttatagaggttaaaaaagaacatacatattcaaaggagagtaaataattaataaagaaaatctttgaggccattggaggtaacggaaagagagaaagagtctttttttttttaatatacttaaaagagggcaaaaggaatagagaatgaatatagatagaatcattttaagggatcatcacttcaacatgaatcttgttaaaagattgttcactggaatttgagatggaactatagcaaaatcttgtttagccaggtctaagacacctttcttattaatagagtccaaatattcaggtttcttaacctcccaaatgccctgccctcttatgagtcccaaagtgcaagtgttgattggtctaaaccaatggctctctgtatggtccgtagaccagcaacagcaccatcacctgggaatttggtaagcccagagatctgtgtttttaaaaagcctttgatgcgattttgatctacagtaagctttgagaactactggtctaagcctgaaagtatacttccatttcatatctttgtgattacacatgagtataccattcaaacccagccaaggaaaaaaactgggaagattgctgtttgttattggtgaacgatttctttctgagaagagacacccaggggcaatcagccttttctgcttttggattggtcatatgtggatgagatattaaaatcgcagggcacacacacacacacacacacacacacacacactcttcaccttggggaggaaacataaacataatagccgatatgttgcatatggtggaatgaaaacttggaaggcacctgggttattgaggacatccttatgtcactaaaatttagtaaacttaaaactgtctgtatctggtaaattactagtaagttaataaatgatctcattgattaggccactattaattgtggcatcttatgcttgtagccacaggcatcaaaactgatatgaaaaataacaaattggttctgttacattctccagcatcttccttcctttaaaaatattctagttaataggctaggtgcggtggctcacacctgtaatcccagcactttgggaggccaaggcgggcggatcacaaggtcaggggatcaagaccatcctggctaacacggtgaaaccttgcctctactaaaaataccaaaacttagctgggcgtggtggcgggcgcctgtagtcccagctactcgggaggctgaggcaggagaatctcgtgaatccagaaggcggagcttgcagtgagtggagatcgcgcccctgcactccagcctgggtgaaagagtgagactccatatcagaaaaaaaaaattgtagttaatagtataaattttgtatgcctttatcaataaatgttttaatcaacaaatatgagcatatcagcatcatctttgcctagacagaagtgcacaatctgaaaccagatatcaagatatttaccaagtcattattatcaagagaagtggtgtttttggcaaacttgagcagcctaattccacaaataccttaccattaggatttaatttgcctggaataaaaaagcaatataaaaagaaggaaaatgaggatgatgaagaaaatatacttacatttttataatccttgaataatgatgaatatgaatttcattatatagttatctttagtttttgtatatttaaattattttatattaaaaaaatacatcaaagcaaaacaaaaaagattaaaaataaaaggatagaaaaatacaaatgcatgaaaacaaatttagctattttattataagacaaatgtcatttaaagcaaaaataaattcagttacataataaaataatctttcttaatttttaaatatgtatacatatagaagcaatagttaaaacatatagaacaaatgttgatatgattataaggagaaatcaagaaatttgcatcactggaagatttttaacatatctctctttaaaaaatgatcaaaaacacaattaggctgtgattaacttagccaaaaatattacctcaaataaatagatttgtagagtataatgcaatcaatggataaaataaattcttttaaaataaatataaaaggtttagaaaatttgatgtactagcaagtaaataaagtagaataccattatgtaaattttaaaaatatgaaaaacaatcatatgtaatttatactatcatatataaaagtacaatattttgtgtgggaatgaaattttaatatctaatttcagaggtgggttatgtttgaagtgcttaaagtgcagagtgattatccttggttacacagggggccagtgggaaaaatagaggtaaaactcacatttgatttcttggatttttttttactattagttaaacataattttactataatggaaataaggttgtacagtgtaattttattacttcaatatacctacaattatttacagtaagtataaatttctgtaaatgagaatgtgacattctctttctcctctgcccctcatttcttgttctgtctttcctaacaagaacatcatgttaggattattttaaatttaatgggtctgtatttgtgaattacaatgatcaaattgtattacaaacaggcagatagtaattccaattatttgtatttagagaaaactttttcatgaacagagttaaaattatgagccaggatttaactactaatgtctgtgaacaagacatgtatattgccacacattacctgaaggtatttgtaaagcagttttatctactctaaagcaggtgacgtatataatgaagccaaggaaataaggataacataatgtttgtggttgtcagatgatttttagacttatgaaatatcccgaatcaagcattttatatttttaatacatatcagaagaaagttcttggatttatcttctgtgctaatttatattaagtcttgcagtattttatttagaatgatagtgtctgacatgaatgtcttcagctttctaattactactaatactctcaaagtgaatgtagttaaacccaattatatatctagttactgaaatatcaataataaaccatataatgcttacttatttcctttgttaactcgtaaatttattttactaaatcttactcgaggcagctattaaatagattaatgaataattgttaaaatttaatttttcaaatctaaatattttatcattatagaaatgttctacttacttttgtcatgtgtctactctgtgaaaacattgttctgaactgtatagtagctagagaggagagggattgagaaatcagttgtaaagatgcataagatagtcttgatgctcttaggaatttcccgtgcccaggtaagggagacaggtaaatacaagtgaaagatgctacaataaaaaatatagtagagaaatggggtttacttcctggaagaatcagggaaggatgaagtgacatttgtgctggaatcctgacagatgagtgagaactcatcaggaaaaagggaagtggcatattacagataagttaaaaaatagacaaaagttttagaaaacttaatctcatatgagttaacatgcctagaaatttaaatggatataatactttcatagtaatgaatttttaactatctgcacatattttcatagagttcactgattttattaaatgacagtacactcatatgatgtggataaatacaaatatatgaccatataattttaatatccaagatgttgccaaccctaaagaatgatgggagtgaggatgcagaattccctcagcttagaatctctcatctttatattctctacctgttctatcatcctgatttaggcagtccttggaactatagtctctattcaacacatttttgaaaatgctaatctattttcaaaacagtccaaccccttcagtaaagtgagtatgattttgtacaatatgccacaaaattttaagaaaatttgaatcacattttctttactctcagtttaacgttactttcagtgcttcttgctgcatcattggtatcttataattagaactaaataggtatgaaaaaaatcaatttacattctggagaaaaaagaagctgaatgactctctctgtaaagttttcctttcatcttgatgaagtcccttcattcattgcttaaagattaacagtaagattaacattgtaacccatttagttagctggagggaatttcattcctgcttaaattcaagcatttaaagcctcaaactacttaaaattaaattggccccatagagaaagcacatcaccatgagtattacttaaagatggtatcaaccttcaggaatatatcttaattggtaatgacaaaaaataaataataataaaattttaaatgctatttctgttatgtgggaattttctagttttttggatgttacaattaaatatccttgcttagtagacatttttatatatctccaatgttatcaaatgtcaggtctatcatgtatcaaaagcaatctcttgggttgtgttgccttgacaacaaatcttggtttcgttgttcttgttaagttgaattcttggattctgagaatttaataaaacgcttgctggattcaaatcagtgacctttctcagagctgtaaaaacaactgatcattcactaaaccattcatcaagttaagataaatatacctgttaatatttgtgttcctactcagtttggatacaagtcaaaataatttgataatattatttttattctttaaaattattttataagaattagtaatttatttaaaaaattagcaatgttatttctaagggatactaattgtgatatgaaagacaagtcctcttgtcaaagcattttgtattcagaaatgagtaaactactttaaattaaaaagtagatcacaggtttaatatctagagtttttcaaaaaatatgtgtttcagcaattttataaagtttgaacctgttaagctaggttttaaattatttgaatgttttttgaaatttccttctctgtcttgtcattataagttagattttgttccacttttatttatttcatgtaaggctgatatctcacaaacttcaaataagtcataaattaactacagcatcatttgcaaatcttccattttctggagttaccatgccttttgagatttaagcaaaattgaaccaaacattcattgatttttcacaagatacggatttttttgattttttttttttttcaggaaagaggcccgtgtacttgcaattgctcttctagtcatttcttgtgcaaacctgctctttttgaagcacaccaactcaatgaagatactgttgactataattcttaccagaaatatatatacacagataacctgtatatatatgtagatatatagattggaaatattgaagatttgattccataccaccacaataaagtaactattgcaataaagcaattcacacactgtttttagcttccaagtgaaaataacacttatgtttatgtgatactgtagtctattaagtgtgcactagcattgtgtccaaataaaatgtagatatattatttaaaaataccttattggggccgggcatggtggctcaagcctgtaatcccagcacttggggaggccgaggtgggcggatcatgaggtgaggagatcgagaccatcctggctaacacggtgaaaccccatctctactaaaaatacaaaaaattagctgggcgttgtggcccgcgcctataatcgcagctactcaggaggctgaggcagaagaatcacttgaacccaggaggcggagcttgcagtgagccaagattgcaccactgcactccagcctgggcgacaaagcaagactccctctcaaaaaaataaaacctttttgctaaaaaaaggctaatgatcatgtgaactttcagtaagtcagaatctttttgctgatggagggtcatgcctcgatgttgatggctgctgactgatcacagtggtggttgctgaaggttggggatgctgtggccatttttaaaaatgagatagccatgatgtttgccacattggttgacccttcttcttctttttttttttttttttttttttttttttgggatggagtttcgctctcgttgcccaggctggagcacagtggtgccatgttggctcactgcaacctccacctcctgggttcaagcgcttctcctgcctcagcctcctgagtagctgagatgacaggtgcctgccaccacgcccagctaattttgatttttttagtagtaacagggtttcactattttggccaggctggtctcgaactcccgacctcaggtgatctgccctcctcaacctcccaaagtgctgggattacaggtgtgagccaccacgcccggccaactcttctttcacaaaagatttctctgtagcgtataatgctgtctgatggaactttacccacagtaaacctttcaaaattacagtccttaaactctgcagctgctgtatcaactacatttatggaatattctaaattctttgttgtcatttaaacagtattcccaacatctttaccaaaaatagattccacatcaagaaaccattgtttcctttttttgtcactgaatgtagtggcaaaaatcacaattctgcaccaacctactcagtcacatctttagggttcacttctaattttacttctcttgctgtttccaccacatctgcagttacttcctacactgaagtcttaagcctcccaaagtcatccatgtggattggaataaacttcctccaaacttcttttaatgttgatattttgacctcttcccatgaactgttaacgttcttaatggtatctagaatggtgaaatctttctagaaggtttccagtgtattttgccaaggtctatcaaagaaatcaccatttatggcagttatagccttacaaagtgtatttattacataataagacttgaaagttgaaattactcttttgattcatgggctgcagaatgggtgttgtgttaaaaagtacacaaacaaggagatttacaaatcttgtacgtctctataagagttctagggtgatcaagaccagtatcaatgagcactaatattttgttgtatgagcactacatctcaacagtgggcctaaaatatttaataaaccattggtgaaaatagatgtgctgtcatccaggctttgttccatttataggcaaaatagatttagcataattcttaagagctaggattttcaaaatggtaaatgagctttgacaccaacttaaatttatgtttccccctaaaaaggaagtgagcctgtcctttgaagccaggcactgacttctcctctctagctatggaagtcctagatggcgtcttcttccaatataaggctgttttatctacatttagaatctgttatttaatgtagccaccttcatctatgatcttagctagctcttctaaatcaggggtccccaaccacggggccagttaggaactcgaccacacagcagaaggtgacttgcgagcaagcattaccatctgagcccagcctcctgtcacatcagcagcgtcattagattctcataaaagtttgaatcctgttgtgtgaactgcacatgcaaaggagctaggttaagcactccttatgagaatccaactaattcatgatgatcagaggtaaaacagtttcatttcgaaaccacccccacccccatctttagaaacattgtcttccaggaaaccagtccctggtgccaaaaatattgggggtggttgttctatacagataacttgctgcagcttctacaggagcatgtgctgtttcaccttgtaccttcattttatggagatagcttctttggctaaacttcatgaaccaacctctgttagcttccaacttttcttctgtagcttccttacctcactcagccttcacgtaattgaagagagttagggccttactctggattaggctttggcttaagggactgttgtaactggtttgatcttcagtgatgttccagatcactgaaactttctctacatcagccataaggcccttttactttcttactattcatatgtttactggagtcacccttaaaaaaatttttttaagcttttcctttgcattcacagcatgcttaatgggcacctgaggcctagttttggcctctctctgatttcaacatgacttcctttctaagctcaatcatttctagctttcaactgaaagtttaaaaaaaaaaaagaaaaaaagtatatgactcttcagttgaacacttagaggccgttgtaggcttatcaattggcctagtttccatactgttgtgtcctaagtgatagagaagtctgaggagagggagagagacatgggaacagttggtaagtggagctgtcaggacacaaacaacatttattgtctaagtttgctgtcttatatgagtgtcgtccaagttgccctaaaacaattacagtagtaacatcaagatcactgaacacagatcaccataacagatataaagcagtaaaaatttggaaatatctcaagagttaccaaaatgtgacacagtcatgaagtgatcacacactgttggaaaaatggtgccaatagatttgcttgacgcagggttgccaccacatttagtttgcaaaaaacaatatccgtggcatgcaataaagcaaagtgcaatcaaacaaattatacctgtatataaaaattcagtgatctatatcctgaaaactgaggcactttactgtattaagctatacaccccatgagaaattcaataaaaatgaatttatatttcttagtaccctcattttaacatgttcttaactggctttattcaattaaaaaaaaaaccaaccaaaaaccttagtttgttgatttagtcatattcttccaaatcatggagctaatacatagcttatttttatttttattgtgttttcagccttgtctggaaacaaaaatagttggaaggagagttagtttagaatgatgaaaagagagcaaaatacattccaaaaattttcaaataatttccaaatcattggactctaaattatcacctggccttattctcttctgcctgaaggaactagtcttcattatttcttcccattagggtggagataattagtgtcagcaaagtgaactatcaaccatatcccctccttattcttctaaggtctgattaattggtactgagaagaaatgatattttacttaaagtttttacaggatatttttattttatattttatatcgtatccaaaaattatggtactttgctgaaccttttcatacatttctttatatgtaactttgcaggcttttgctactttattatgaagagactccagaggaaacaaataacacaagcagataatcaatgagaattgaatgaagggactgtttacacattagtgggcaaggggaaccttagggccagcacagtgggagacttgactgtccctaaacttaaggagcaaaagccatgggatggaatctgaagggagcgatggcattggtcagatgtatgcaagcagagctaagtggttttgctcattgtgcggtatccagtaatcactgatactctctttgccctgtatcaatatatttcaaagaggatacactgacatattaaagtaaatgtaatatttcaaaatctctgggctggggcccaaaatcttactttaataatccacataaatgtgttttgcagaacaagaccatgtttggaaaacggcagtcatcctgggaaactttttattctaagctgtttttggttcccatcatcacacataccaatgccagagtcattattgctataaaagtatcactttccaaggttcctgagtttaccaccctcatgtacttatagggtttttataaccattatattttgaggcaaatagtatttgttcctcaacaaacacatttattatatagaattttatggaaatactgattctctgttttaatagtttaaaatcttttgtgagatgggaaaagaactgttgcttcattttattataatgaaaataacttagagacaaaaagccacccaaaatttcttttaacttgtaaatactggttactattccaattttaatatattagagccccctaccaacatttttgaagcaaaattaagctattgaaattaagattcctgtttctcccagtgaagttaaaaactaacaacatgtaagaaacaaattagacaaatgagtttcaaggatttgagtgtaaggaatgacttctgtttaagttctattttgttgggctttggaatatttctgctacaagtactacactgtagcaccttgtcattttaatatatgtcttactttgttatcaaaaaattaggcattataaaatatattttatcttttatatagtccatttcacagaatagccataatgttctttcaagtaaggattatgggaaattaaatgctcttatgtttaaaatagatatttatatcctctgtatcatttattaacttatcagaatcactttgcactttaagatccatctaagtatacttaataatatagctttttccatgcttttttaaagccttagtcaaaatatagtaacttagattttttaatatgttactacagttttaaaccagtattgggaatgctttgatattgtaatgtttacagtatatttggggtaaagtggtgagagaaattggaagatggaattttggtattttagaactagactgtgtggccaagcatatagaaatgcagaatgttgccagacacagtggctcacacctgtaatcccagcactttgggaggcagaggtgggtgaatcacttgaggtcaggagttccagaccagcctggccaacatggcgaaaccccatctctactaaaaatacaaaaattagccaggcatggtggtgcatgcctgtaatcctagctactcgggaggctggggcaagagaatatcttgagtcctgggggcagaggtggcagtgagctgagatcatgccattgtattccagcctgggcgatagagcgaaactgtctcaaaaaaaaaaaaagaaaagaaaagaaagaaatgcagaatgtggtgtagaaatatatacaatatattatatttaaaaatctatagtaatgcagttccttctttttctaaatttaaatctttccccctttatgcttatataatttttaatagacttcaaaatggaaacaacgttctagtaatctcaaatgtgaatgtagagaatttcatccagtgacctttcctgatttatatttctgtcgttcttgattttataaatcaacttgaaaataaaatttataaaatttcttaactgttaccccgaatcttagaactgtagtgatttctaaattaaaaatcctgtagacataaatattctcatgcactctatatatacatttcatttgtgcagttttgcatctgtttttccagttttccactttgttgggaaatggtttacatactaaaaataatgtttgaacaaaaatattttctcacgtaataacttgttactgctttgcagtttgtcacaaattttaccattcactcatttaatctttaacacagtactgtgagatgaacaggaaatgactatattcccatcttaagttagagaatactgagactcacagacatttagggactgaagttacaaattgagtggaattacatctaaaactcaggatttatagccgggccctgctggaccctaacagactcacaagaagagagaaaatggtgcttaacatatttttcaaatcaatttcatggaacttaaattatagttattaaatgcttactatgttaaaatactctgttaagtaaagcagttatataggatagattaaaatgtatgagaagataagaaaatatatgatattacacgttataaggacattgctaacctgtgtgaaaatatttttttaacagagagttgtgataataaccagaatttaggggttaagaaataagggagaggtaaggcctttgaagcagcagatgtggactatccttttgacagattgaggatttgtgtggggaggagatagtgaaggggatgaaagaatacaagcatacaaaacagcaacatacaaatgtgctatcttaaaactcgaaaagtgtaaaatgctaagctggacaaagctagactgaagaagaaaggccactttgcatttattatcggattgggaaaggagcaggaagcacctggttggaatccttgtgcttgtgaaaatggccttgttagaaaagggacatgacaagaggaaattaggaaagaaggtaaaggaacactgcagctcttccagggagctaattgaggtctcctgagcctgctccctaccaagctccaaaaggaagatgggagaaagccacctagagccacatccaccagaactatctggaagactaaagttttgtccttccatctgtgttcagcgctacagggctaaacaattagcagaactgagactggaccctggtgggctgcctctccagtctgtgtcctcaaccctataattttcatttctgttgagatcacatatattcagattataagtggagtattacttttgtaaattttttgaagggtggtttgataattagtttcattattttcaattttgctctgtgtatgtcttattaatctgactttttctcataaatgtaaacataagcacaagttgacatcttgctttggaactggtacagtcctgttcataaattcaaatagttaccaaaatatgtgaaacttgtgcatatcttattttaattggctactttcttaattcagaagtgaggttcctcagatgtatttcagtgatgctggaatttccagcaaagtctctcacgtctgtcaaacattcagtaaatcacctaatgtttataatttaccaaataatcagacctaatgcttaatatagctgactaaatgctttgatactctgcattctagtcattttatcagatttcattttgttttgttttttgggatggagtctcactctgtcacccaggctggagtgcagtggtgcaatctcggctcactgcaacccctacttcccggactcaagtgatcctcccaccttagccttcctagtagctgggaatacaggtgcacactaccacacctagctaatttttatatttttgtagagacagggtttcactatattgccccgtctggtctcgaactcctgggcttaagcgacacacctgcctcagcctcccaaagtgcttggattacaggtgtaagccaccgtgcctggccagatattttaaattttaaaatttaaaaataagatttagagaactcatttaattttagttttttttatatctcctctttttattcttcttattctttcttattgcagtaaaatagaaacacaacaaaaggaatacaatgataccgtaaaccgtaagaaaactattcattccttaccagaatgaaaatgaaagaaattcatattttatctgaataatttttacaatgcttgcaaatttaccagaacaactgtaaagagttccaaaatttaacttaactcaatgaactagttatgggagatttagtgtgtgataatgtgaaaaaaaaataaaagataaagtagcatctgaggaacaaatgctaatatcttagatttggatagcatactgccattgtctatactgtatctattactttttgttttgtaatctcctcttttcctatgttcattggaaatgaccagtgccactagcttacttttctttcacgtaaaatattacattaggggaactggcttgctattatcctgccatttacccagaaggacagatgtctcaaatagttcgtgaattaaaaaaatacgaatcaaaaaaatctgaaatcataccctgtaagtttgataagccttacttttcagatgatttagtgtacgatatattaaacaatttattttttatttgaaatctatatcttgcacagataaaaattcagacatgatggggcaggtcctagcctaaatgaaatacatatgcttcactaaataatactgtttttgttattagttctaagacttgttagttaatttatagtatatgttcaggaaaaagtacataaaatttaacatagattttaaagtggatttctttccgtcttttaaagaaatcaattttccttttcttctcttgatataaaccccattacagtctaagataaggacaccagatactgccctagtttcaacttatttcagagccttggagcataatatggggaataataagacacagagcattatttgtgctttctaatctgttcagactattttaaataagcataaatcagatattcacatgttaatatgttgaagggtaaaacgcgaatatatatcattgcttaaataggcttaatgctgtatacataaattttcatcaaatcttgctcccaaatatttctattttaattttgacaggagttaattttccttttatttgttaactcccagataatttactgtaattacatataattgacttagtaaatatatagttgcctgagtttttgaagaaagacaaaaatcttttatcccaaccaaactatattcatgctaaagtcacccaaatttgagccagaatcgtatatccatattgctgtgaacaaccgcagaacactaattacaataaatctaatctacccatttgcaatgacactttagattagaaaggctgtagagaggggtatgatttaagagtgaaaaaatatttccaaaattaagtaagagtttagacctgtaattgaaagagacattaatgtgtgtgtcataatagatgataggatattctactactgtgaagctgagcctcttgttaccttgcagcagggtacaacaataaaaaatctttgattttatttgacattcttctaatagactccacacttctaaacatgaacaaggaatttcatatagctgattcagcagcacatggaatattcattttctctaaagccttgtacctttctctcaatgacccttgtgaaatgaattttagtgtttgtgtgcacttcctacatttgaacgcttacagtggcatgagccttaaatgagcaagcttttaaatatttgtttataacacatatatcctccttgccagtttattttcagctttgtcttccactgaactttacttttcctgtttctgatcctggctgcttatatcttggctaagagtaaatgtcttgttgtcttaatgaccatggaaggctttttggagtaggtggagtttgcaaaaccccttacataacagaggaaatgaagcggaggctgttcctgatgataccttcatacaagcaaaagtccaatgtacaaaagtacaaggggttaacactaaacacctaacacatttattcaagctaagggtttgagtagaaaattgagtagggttataacaagaattggttttgattcttaattgcaaaagactctgcacagcaaactatgtagtttgaattttaccctttaggggccagggaaaattaagaagagataactggcatgaccaaagcaacagggtccaaatactaactgggagtcttttgtagtaatatcagcctatgttgtggtagtgcccgtgagataaagggatatatgtgagcttttttgacagaaaagtcaatacaaatagccataggtaaggatagtcttacaatttggaaaggcaaaaaaatagaaaaaaagactaagtaaaataatgcgaattgtgagtataggtatctgggaaacagcacactcttaattgatatagagaagtcagagacaggttgggttgaaggatgatgaggtcaggttgcaccatttgaaacaaaaccatcaatggagtgtatcaggaagaaattaaaatataaactgagatagcatgagagaagtctaaggtgaaaaaatattggaaaaattaaaacagaggtaggtagttgagtctttttttgttgtttgccattttaatttttgataaggagttgtacaacatcaattaaatacatcaactcattctgaaaaaagttactgtgtaaagaaatgcatagtaacaaacctcagcttcctgaagttggagctattgtgcacgacagagataacaactgtgtgactttgcttagtttggttgtctttctgtctaaatgctgcctaagatccttggcttggcatatgtgacaagcagagtaacgagtgccataataaatgaaattaatgttctgatttcagcaatggtttaggttctgttcataatcacatattatcattttcacagaaatggtaaagaagtaaagtccactaaagcagctctcttgatctgaatggaaaacttatttgttgtaaaagtgtttataatctctctctctttctgtctgccctacctaaaatgggggtaatgatgttacctgtttcagtcactgacatgtcactattaataacccactagaaaataagaaaaaaattaataaaaatagtaaataaactactggattataatatagctggagggtcatattatgacttaactgtatataatatatgctctttatggatttctaatctaatttttatacttttagaaatgtccatcttattttagtatttctgatatagaagctgatcttgcctttaaaaaaaaaagaatggaaaagtagaaatacaaagaagcttctttgaaataattcataaatatattattttaaaaataagacaattgcctattttaaaatgtctctgaagtggcaagtgaaaatgtagaaattgctaaaatatgattaaaaagagaagtgtttcttatattcatcataagccatgtgtatctattaaaagacaaaaagtgaatattgtcccgacgcaaaattgcattaacaaaaactacgtacagaatatagaaaaacttaatatcataaaattgctcattcagtactgacaacacatattttgtggttcattcggaccctgatatttttttcttctcaaccagttgttttcttattttgcacaactgaaattcactatttttcttttctattactgttttattatagcctcaaagcactttataaataagaaaaaaaacagtaatttcatggttattagacattccaaaatgttctatctaaaaaatagttatcagctacattaatactgccaaactgttgaaaccaatttctgtgtattctttgctctaagttatttagcttgaaggatgttgggtgagttgctggatcagactggccagttggattcatttctcactgggaaaggaaataaactgataatgctataatgatattaattttaaatattccagtacatttccctagtgagtgcaaaagggcagttaaaagctcaattttgaggacagataggcctattagtcttgcatctgccatttaaatagctgaatgatgtttggcatgcctgttgtaacctctctaagtctctactgctcagatgtgattaaatgaggtacatttgaaaaataggacagagtaatgatcattaaatggcagatatttctcaaagggaggctttatcactgaccacaattttttactatagagttagatgctttcattagtaaacttctcttgttttgaaaataattttcgttgctgttgtatagctgaataacatgagcacaaaatcaagcacaatttttatctattttatctgtagaagcatgcatggctaagaaacctctactcatctttatatatgttttataagacaatgacttctgtcttcagtgttctctttcttctgtaagtcctggaagaccctcattattatattgccatattatcttctcagatttataaaattctgttatttttggattaataaaagcccttttagatctgatttacaaaaatctgtgttatatgaatacacacatgattttgttaagtatacttgtaaatataatcaaacacaatgtaaatgtatctattaaaatatagatgtctttaatgtgtactttaagataaagcaaaattacttaatttttcaacaagttttctgttggtaataagccaggacctgaggtttttggtgactatcaggtcttttagtgtaaaaaataatacatggaaaaaaatacttgaagcatccacaaatcgaaactcagctgggttaggagttttcctctcaacagacaagtcttgggaaagtggtctgtctcaggaaatattctggtctgttattttctcacaatttttatacactctcctttgataacgatatattgaagcaacccaatgtatgcattcataggtctctccttgtcatttggctaggtcataggttgagaaacattggtatcattgattgctcacaattctcatctttaaccatgctgaaacttctactaccagacacctaaaatatctcatatattctaagactatcctaggggtacaatggacacaagagatttgtcttgagaagattgcctaaatcatagggggaaatgtgcatagtaggcattttaaaacctaattctcctttcccttagtttttccgttaatttatttccacttgttcacttattcattaatttactcaaaatgagtaagcacctactaggtacaaatatggaagtctagaccagggaagacacgggtttaaggaatattttatggatgcggatgaggcatcatttgaatttcatagtatagttaacaaaaacatacatttcaggctgggcgcggtggctcacgcctgtaatcccagcactttgggagaccgaggtgggtgaatcacgaggtcaggagatggagaccatccttgttaacacagtgaaaccccgtctctgctacaaatacaaaaaattagccgggcgaggtggcaggcgcctgtagtcccagctacgcgggaggctgagaggcaggagaatggcgtgaacccgggaggtggagcttgcagtgagcagagactgtgccactgcactccagcctgggcgacagagcgagactccatctcaaaaaaaaaaaaaaaaagacacatacattacagatagaagggttgaacaaaataaaatcagtagtgagcaaccttactgtgtgtaaatgctttaacatttaccagatttaaccttggggaggtgaattaaccttccttatcgtagactttctcatctatgaaatgaagataatctcatagggttgttgtgagaattaaatgagataattcgtagtactttttagctttgtgtctaatgcataataaaaacctaatattttttagcccttaaatcgttcctagaactctactaacccttggtatgattatccaagcactttcactccaaagttttcaattttaatcactgcaaatatgttaacttgtattgtgtatacaagtgacatgtttaagcaaaatgatgctaatataataaaaattttaaaatgagacaaagtactcatagtgttaagctctccaatattgtgtttgtattggcaatggttagaaatgaattatagaccacaggaaaatctaggtaactcaaagcagttgaataattcaaatgtttagccacgatgataaggaagaacttttatttgttttaaaagtgttctatctacgatgtgtgatgttaacatttccaccgacaaatgaaacaagtttgtcaataaatatattaggaaataccatataaagaataaaaaaagccctctttaataaagccaggacatattttcttgcctcaattatatagcactatcaaatcaaaaattagacttttggcatatgatttctgacaattccatgtttcctcctaggtaacactgcaatattgttaatctacatggaaaccctgcattaaaatttttggttagggcgacctcggggcataatctaacctctgagcaacctatgctaagactaaaccagtttaagcaaattattatacatatactgacccaataatttgatcaacagaataagttaccctaggataacagcgcaatcctattctagagtccatattgacaatagggtttacaacctcgatgttggatcaggacatcctaatggtgtagctgctatcaagggtttgtttgttcaatgattaaagtcctacatgatctgagttcagaccggagcaatccaggtcagtttctatctattttatttttctcccagtatgaaaggacgagagaaacagggcccacttcataaagcgccctcgccctatagatgatattatcttaagctaacaaatcacctcatatcttacccaaaagtagggtttgttaaggtggcagaagcccggtaattgcataaaatgtaaaactttataatcagaggttcaatgaatcttcttaacaacatgcctataatcaacctcctactacttatatctactctggctgccgtaacattccctacactcattgaatgaaaaattctaggctacatacaactatgcaaaggatccaatattttaggcccctatggactatttcaaccatttgctgatgcaataaaacttttcactaaagagaccctaaaaccctcatcatctactgttaccctttacactattgctccaaccctagccctttctattgcccttttcttatgaaccccactgcctaaaccaaatcccttaattttaatttcagcctcctatttattcatagtatactatactattatatagtttagcattattatatattaatattattgtataatggtatacaataatattcacagtatactgtgaatttatttttttaatgtatcaccataatacctttttgggtattataggtaggtcactagcttgtaattcccaagtacttttttatgtgccttctacaaattggtaagaaggagtcttttctagtcatctaaaattcaagtactctcccataagtgcttatctataaaatagtaatggctgtgaaagttcatctcccagttctttagcactctcaggtggatggtttttcaactgacctacaaccattaagcttgcttaagtagtccccaactatttggtctctgtttgaattgccatggctgtgcattcaccagtttgaaaaaattaccatatatgaatagaattaagcttagcaaggaagactgccttgtagaacaatcaaggtggaaataactattttatatatgaaagttcaatgacaaatgatacatagaagaaaaacatggtaataaataaatgtaatctgaatacgagaaagacatatatctattttgtgcttaacagtgcctgtgacaatgacatggagcctgcccctgcaaatcaaggcccagatttaggaccactgttgaaagcaaggttttggaaattggaaagagttcaaagggaaagaacataaaatagttattatttaaaaatactgactttaaagaaacctaagatatatgaactattagggctttagagaaggttcagtttatgatgaaggaactgcctttaaagaacttttttaatgtccttgtgacctcctagaagagaatgggctttggagacagtgaacctctttaaaatagcacttctgcatttattagctgtgtgatcctgtgtatatttccaagtctctaagactcttcattaataaaatgaggaaaaacattatatatatatatatatatatatatataaaatcatgagactcctgtaaaattaatgtatgtaaattactttgtatattgcctagcacatgatgcattccattaattgatagctattggtattaaataacaataattgagagctatttctacagaatatattaactggttacattcttctaattgcatcaaacaaataatttactcaaactgggcttctagcacttttacttttgtatatatctattggtagagaaatggaaacaaaaataaaagacaatgatactctgaccattcaccattcaatgcctgaaaattgagagcccaactctcattaaatacttcgtagatgtttgcagaattaaaaataagagaattggccgggcgcagttgctcacgcctgtgaatcccagcacttttggaggccaaggcggatagatcacgaggtcaggagatcgacaccatcctggctaacacggtaaaaccccgtctctacttaaaaaatacaaaaaattagctgggcgtcgcggcgggcgcctgtagtcccagctactcaggaggttgaggcaggagaatggcatgaatccgggaggcggagcttgcagtgagccgagatcgcgccactgcactccagcctgggcgacagagcaagactccatctcaaaatgataataatagaattatatgacttgtatgatctgagatagatgaatttaaggaagaatttggtattgagagatttaattcattacttccctagttgttatgggttgttttgagttattaccccacattaatcatttgtcattttgttttgttaaaatgagaacacattttctgtacatgttgcatgaaaaaaggcaagggaaccacatatctccattgactgcatactcaagtctatccattattttacataacagatagatgaaaggaaacattttttaaatatttgtctttaaaattatcatagaatggataacagtgattgtatagatgatggagacctttctttacgtgtagaattgcttgggcacagcacagtccacactggaagatttcttttctccccaatcaatcaatcaatctctctctctctctctctctttctctctctctctctctctctccctccctctctccctctctgcccctccctccctccctccctctctggggccctccccttccctcttttctccctgccttctttctccccacctcttcaactgcattggtaacgtgataagagcagaaatgacaagtggctattagattcacttgtatataaattctaagtgtcacctatttctatatcttaattattctataaaatgctatccagtttttgtaagcatttcaaggtaataagtgcaaagtaccttggacataggggatagtctttaatatttcctcttttttctttactttggatgaatgttaccagacagtaataacattttaagttcttcaggaaaacagcaaggcctatgcagttatatgaaagataagagaatatacctgtaataagagtattttctaataacattaactttttatatttaatattgctctgaatttattattctaaaccaaaagaaaaaaatccatcaaataatcttgaaaagaagcagctaatataatctatttctgacacttattctattcatttttatcaatacttgcatatcaccagacttacaataaagaacattcatgtaattattctttcgacatttatttattgagaacatactacacgccaggcattgttgaaagtgcttaagaaatatgagtggacaaaggagacctgcactgaagaaacatattcaggcagaaaaagttaccttttgacactctggggcatactcccttaactagtgtttgttggcttccttttgaagtttaaagtatcagaattgtactctgtagaagcttgttgaatgttagaaataaaaagaaaaccggactggactaggaaaagtcaatgccacttttattgtcctacctacactctggttgctcaggggaatttaatttgcctatttcataatgcctctttcttgcaactgccttcagctattacattttcaatcagcttatttctacccagcagaagcagtctggaagaggttgcctcaaagttggtttttctattgtatgtattagaatgctgtcagtaacttattatagtatcttattggatggtctttgtcctgctgtatcaccttcccagcagaggtacagataatgaaaatctatatggctaggaccttggatttgggcagttcaattagttgttcaggaagtctatcaaaaatgtgactccaggtccctgaactccagcattctcattattagagtgaaacgttagtgacaaatgaggtatgatggtctagacacctcatcagcctgctggcttgcagcctgaagtaaaggcgcagttttaaaaacatcaaggtcttgatgggttctgaacatgtgattccagaccaaaacctaagaaaaacgggggagcatcatacgttttaagacaataataaactcataggcctctgaaattctacagtcaagagtcaaagctacgtatgcacttgaagatgtggaaagatgttacagttcaagatgagatttcttattggctatagttgtaaatatcagggttattctaaaaaaagattgtcaacggtttaatgatactagaaaagctcacctatttttaaagttttttatttaagcagtgattaataaatactgatgtttgttattttaataaatgtcatgtgtatggagaggtatcatcaagtaaagtttgtactaatctatatgaaatccatatggatatccatatccaaatgtatgagtcacacatatattatctacagatgtggataaccactcaaatagtggttatccatgggaatgatgctgtcctctaggggtgttttggttatatgtggggtaaattttggttatcacaatgtggagggtgctattagtgtttagtgggcagagatagtagaatacatgcaaaataaagaattgttctgcctccaggaaaaattcctgtttcagagctcaataggaaaacctgtttgattatcagaacctagacccaaattctatcttacatgtaaatataaacccagcatacatttggtgtggtttaaatacagattaaattcagattaaattctctataattacaactactgtctaaagtgaaataaaatgatgctttattttgtctgaaagtttgccaacagtgttgtaccattttaaagaactatattactaattccagtcatcatttttagtcaccaattcgacatactatatcatttttatagccatcacattcatggtgattatacatttacaaacataggaccacttaattttacacagaattaaaaatctaaatacttacgctagaattactttcctcttaattcttctgtaaatgttagatagggagttatattgattttttaaaaaatcagctaagttacatgtctataagctgaatctcaaatagtaaaaggaaaataaaaagtacattataaaaagaatctgagtcttctgaaatttgaaattattgatttacatatatgggaggtctggctttttgactatagagccaagcacaaatgctgtatccaaacggtgggcacatttctttggtagaaatatatagattctgaaaacactcttgacacattcagacctataaatggatagcaaaattttgacataaagatctgaaaataaattctaaagttggcataatagattctcttcaagcagttcaaatacaaatatattaaatgcctcattatgcaagacaccttgataaatgcttggatgacaaagacaaatatgaaataattcactcctctagagagttgatattctagtgggagagacagaaaaatatctaaagaatgctaatgcaatgttaacgtggaaagatttattttatacagttctataaaagaatgaaagaggcatttgagaggaagcctggtatgagatgtagcttttgagctatgctatggcgtatgttgtagagtgcctaaaatattgtgcgaaaataacattgcaaggaaagagacaaaaataaaataccattttaaacaagaaaataacagcaagaaaacttttctcagatggttctgtgtttgaaggaagttcgactgtgttgtaacagaaaacatttgatggtccctgatgggtttcttggaagaatagagtgatgaattctgtgagagaaagaaaaatcagaattattctgcagaattaaaaaaccaacgaacaaacttaatttggagttccaagggaattcctagagagaatgaatgagggaatgagaaccaatggaggaaggtaggtagatgtgatcttggttttggcaatggtgagagacagagaaggctatggaagtaaaacagaggaaagttaagagataatggaattgggaagaaaggtgcccatgaaaatgtagtattctaggagtccacatagtccagggaagcactggacttcccacagtttaagcgaagggaatgaaggcagttttacttaaattttaaaggaaagaataattccaaaggtggagaattaaaaatatccagcaagtcagaatagttattaccttgcaaactccaaaccaattcaagtttctcccatcaatcagtcacagactaatgctttctaaaaataaaaaatcatgtacctcagtgtcacagcaatgcaactgcttcaatttctgtcgttatttcctgggggatggtaatactgtatttacagaccagtactggttcatgagttaaggttttggtagcaccgctctggaattgggcagcatgggtttgtatcttagctcccacacattattgtggacctgggaaaaacacttaacctctctgtcacttatttatctcatctgcaataaaaattgtgtctaatttttttggaaatgtgacagattatcaccatattggtattggttcttcatttttatttagtaataaaatttctgattttcagttgaatacttggaataatccctacttttctcagacatgtttgtagcgaatgtcttttaagaggaccagccagactaacatggtgaaatcccgtttctactaaacgcaaaaaattagccaggcatggtggtgcatgcctgtaatcgcagctacttggtaggctgacacaggagtatccaggcggcggaggttgcagtgagctgagatcacaccattgcagtctagcctcggcaacaagagtgaaactccgtctctaaataaataaataaagggggaaatattttgtgtatctgaattgtgccctccaggatagaatgtgatgtttggtgcttcttgggccaggaaatagaactcacaggctgagagttggtggatcagcaaaatagaaggagcctgagtcctgtacatcatgggccattataccagccctggagtgtccacttttacgtttcttataagctagagaaaaaacaaattatcttattaacattcttttgaattttctctcacatacagattaagcaatgcccaacttatcaatgaataagttagaaaatatgtgtaaaccaatacttgactcatagaagacattcactaaaatttaatagtaattattaaataagtaggttgaaaaagtcatctatttgttaagtaaatatttaataacaacattctgcctgccactgtgctttatactggtgatacgaagatgattaagataaatcagctgcatataaaaagttcttgtctcaaaattacagtgtaatgatacgctattcgcagtttgttgcaatttttcaaatgatctacaaagtggagagttaagagaaaaactaggaacgtttgtgtctggcaagtaatgtccttactgaaatttgccattgtgaggttcctcaaaatagtgtagagaaaaaaaaaaaaaaaaaatatatatatatatatatatgtaatttgatcattctccatatatttgcttctgaattagaggggaagtggcaaaatataagagttaaattttatggaaattgtattaagtcttttccttaagacataagcttagcaagatgccattttgtctgactgtagagtgataacgaatcaggttagagtgaacctgatctaacgttacaaaggtcaaatatatttcctttctcagattcagagttggatcaagactacagatgtatctattagatttcttgatgcctattctcaaacatctgagcaaaatttaaggtctccaaaaagtactattattctaatagaattttcagtatatgtaacaggttgtctttttccaactgcagtttggaaaaatacaaatttgattatctaaaatttgaaagtaaattaattttaatttaaattgctctaatatttttatatgtttgacatacagtttatattacttgttttattagttttaaatgaacatcattacttttattaaaatttgcctttgataggaaaaaaaactgttcttttcttgatgccataccaattatcaagtgtttattgttttgatagatttccagccacttcaatgtgcaactgatatggacaaaactttttgtgtatgttatttaatattttatttgtaattgctaaaagagaagaaaatagtaagtactaaataaacaatttttagataaatgaaataattaaaaacttgaatcttattttgattatttatagtttgtgggtgcatttaaagataaccaaagtcttataattcatttagcagcttgagttataagcagtggctccatcaggtatattttccaatgtgctatgtatgtaatttttcttctatcagataaactaaaagcaaacgtaagaggaatgctctcaacttttgccaggccctctcttagcttttgtgccatgtcctggtgacgactacacttgaaatccctgggctactgtacttctgtgctatccttattgagagaatggctttcgtatgtttgaagccaatgttttattactctttatttccttgatacacccttgatatcttttgttcttctagactcacattccaaggttacctctaggttttcaatatgatattcatttgagaagacagaaagcatacagactgtaagtaaataagagtaaccttattatggacataatatttactctcacacccaaacacaataatttgtaaacttccataataaacttatattactattaataataaattgcttgcaacttaaataaccatgatgaaaaaactagcattcagattcagtgttttttttttaattattaatctaaagtattaaggataaagaataaaccttataggaccggttatttattatttataaatcttatctataaattttaattttccctggaggttaaaaaatcagaatactatttagtggtaatcccactattaaagtatttatttctaagttaatgtaacttatactttgtactatttttttaaaaaatgctatttggggttgattgcataggtacaaattattccaaaagtaaaattttaaaatgaagtatgtattcagaccctttagagacatgctaatggcaattcattccttactgcttattaaagtaagcctgctaagcagacctacttattagttgaatgtgttttaactgggtcctctccccagagtttcataggctgaaatcaacatctcatctcactgcagtccgacctgggggcttgactaagaaaatatttactttaggatattagcagaatccatttctttgtgaaagtagaactgaagtccccagtttttgttggttgtcaaccaagagctactgtctgcttctaaaggccactctcaggctttgccttgtggtcccatccatttctgcaatagagtaactgtttcctcaaatccttctcacacttcaaacatctgtattctgctaccagctggagaaaactatgcttttaaagagttcatgtaggcctgatggggtgactcacgcctgtaatccaagcactttgggaagtcaagacaggaggatcacttgagcccaggagtttgagaacagcctgggcaacatagtaaaactctgtctttacaaaaaatacaaaaattagccaggcctggtggcagacacctgtagtctcagctactcaggaagcttaggcaggaggatcacttgaacccagaaggttgaggctgcagtgagctatgatcctgccactgcattccagtttgggtaacagagagaaaccctgtctttgaaaaaataaaaatgaaataaagagttcatgtggttttgttaagtcaatccagatgatgtctttatcttaagttcaactgattcatagtccatctgcaaatactcttttcttataaggtaacatagttatagaagtaacattgagaggagagtgatcatgacggccgtattagaatttagtctaccatactaatctgatcaacacgaaaaattaattcataaagtatataagagtttctctgagtaaattgtattttacaaaattcctttcttttaaatatgctaaaaaaatgagttattcatattgctaattggtatatgtattttgtatttacaatcggttattttttatgttaatctttgaaggtatttcatttagctatgttctacattattatttttaatattaaggtatttatactttagtgaacaattttttaaaaaattagttttatttttccaataaattaaactgggatgctgtgttggtattattatttctaagagtttgcacttgtatcacattagcacttttaccagttgatgccatagcaacactccaagttgctatttattatgctgtatattaacaattatggtttctaattatagcgaaattccagtagatcagcattcccctacttccatatatagtatatagaatattaaatcttgaaatatacttatggctatattaggaagaatgggtgttttttatttaccaatacatctttcaaataatacattacagaatttgctaatattgctatagtttgcaggattctcttatttaatatgttaatatgttaaatgaaatatgcaaatgtcataatggattgaatttaggtaatcattaatatttctgtgttacacatttctttaggtaaatgtatacaaatagattatttagcttcacatgaattaccatcaataattcccttgaatattaaaaataaatgttaatatttgagatctagctactgtatgtaactcaggggtaactcagggatagaggaatgttgaaagttcaaacccagagtcaaattattgatgatattttggatttgcatttgacttgactttttcttttttcttttttttttttattatactttaagttttagggtacatgtgcacaacgtgcagattagttacatatgtatacatgtgccatgttggtgtgctgcacccactaactcatcatttaacattaggtatatctccaaatgctatccctccccgctccccccaccccacaacaggccccggtatgtgatgttcataggtgggaattgaacaatgacttgactttttctaacaagatttggtagtgttttcacatctttcttttgtgtactttttaacacataaaatgacaaaataagagctaaaatattctaacttaccggaatatagtaaacttatgttagtaataggaaaaaataagagaatggccaatatttcagtacttttttagacttgttctctctctgagtgggttatataaccaagaataaaatttaaaaaaattagttaacatagacagtttacatatatttacatatacatatacatatatatatatatatatatatatatatatatatatatatattaccaaaattaggtcttggatagtgttttcatgctggattagtctgttttcatgctgctgataaagacatacttgacactgggcaatttgcaaaagaaagaggtttaatggacctacagctccatgtggctggggaggcctcacaattatggcagaaggtgaaaggcacatttcatgtgatggcagacaagtgaagaaagtttgtgctaaaaattccccttttataaaaccatcagatctcatgagacttattcactatcatgaaattagcacaggaaagacctgcccccatgatacaattacctcccaccaggtccctcccataacacttaggaattatgggagttacaattcaagatgagatttgggtggggacacagccaaaccatatcattctaccccttgcccctcccaaatctcatgtcttcacatttcaaaaccaatcatgccttcccaacagtcccccaaagtcttaacacattataatattaactcaaaagtccacagtccaacatctcatctgagacaaagcaagtcccttccacctatcagcctgtaatatcaaaagtaaattagttacttcctagatacaatggaggtacaggcattgggtaaatagagccatttgaaatgggagaaatgggccaaaacaaaggggctagaggccccatgtacgtccaaaatccagtgaggcagtcaacttttaaagctccaaaattatctcctttgactccatgtctcacatccaggtcacgctgatgcaagaagtgggttcccacagtcttgggggctgccacctctgtgtcttcacatggtacagcctccctctcaggtgttttcacaggctggcgtttagtgactgcagcttttccaggcacattatgcaagctgtcagtggtctaccattctggggtctggagaatggtagccctcttctcacagctccactaggcagtgccccagtggggactctgtgtgggggcttcaaccccacatttcccttccccactgccctagtagaggttctctatgagagccttatgcctgccacaaacttctgcctagacatctaggcatttccatacatcctctgaaatctaggcaaaggttcccaaacctcagttcttgacttctatgcacccacaggctcaatgccacatggaggctgccaaggcttggggcttgcaccctctaaagccacaagccacagcttgagctggaccttggtcccttttaatcacagctggagtggctaggacacagggcaccaagtccctagagcacacagcagagggatcctgggcccagcccgtgaaaccatttttttctcctagctctccctgcctgtgatgggaggagctgctgcaaaggtctctgacatgccctggaggcattttccccattgtcttggcgattaacatttggctcctagttacttatgcacacttctgcagccaacttgaatttctcctcagaaaatgggattttcttttctatcatattgtcaggttgcgaattttccaaacttttatgctctctttcccttatgacattgaatgcctttaatagcacccaagtcgcctcttttgctgtgctgcttagaaatttcttccaccagataccctaaatcatctctctcaaagttccacacatttctaggacaggggcaaaatgccatcagtctgtctgcttaaaacataacaagagccaccttttctccattttccaacaagttcttcatgtctgtctgagaccaccttagcctggatttcattgtccatatcattatcagcattttggtcaaagccattcaacacgactttagggaattccaaacactcccacattttcctgccttcttctgagccctccaaacggttctaacttctgcctgtcacccagttccaaagtcgcttccacattttcaggtgtcttttcagcagcaccccacccctgctatcaatttactgtattattcctttttacactgctgataaagacatacccaagactgggcaatttacaaaaaaaaagaggtttaatggacttacagttccacatggctgaggaggccttacaatcatggtggaagaagatgaaaggtacatctcacgtggtggcagacgagtgaagagagcgagtgcagggaaactacccttttataaaaccatcagatctgagatttattcactatcacaagaatagcatggaaaaaaactggcccagtgattcacatacgtatcactaggtccctcccacaacacgtggaaattgtaggagtaagatgagatttgtatggggacacagccaaaccatatcagatagcctactaaaatatcagtaagttgaattttaactataatcaaacaattgacttttactgatatggagtggatattgagaaagaaatgcatttatgaagaaactgctatagaatgaaaaaatttaatggttttctacttgagatgttttctgtcattagacatctgagcagaatcaaatgactcctttataaaaatcttcatttattccctattaatgtggcaaacacatgtaaatgacatagtcattagcaaggatgagtaggtcataaatctgcattttcacattagtgggttgagtcacatttgaattcactaaatgaatacaacacattttctttcacgagtcaaaattccaataatagattttaagattgtttcatgaaagttagatccttccattgctttcttctatcttgccctttgactttctgcaaagactttcattttttagccaatttcctcagtgaaaagaacaaaacagaggaagttttgagctttgacatgctcatgatatcattagcaggaatactgtgcattaatgcaaagctgtctggccctgtagtggtcatgtcccctgccttaaaaggctttgagatgttgtaattatgaattaaggcatagaacagtaaatttggatagtacgttgtaaaggaaaactgaaggctttggtgatataagaccctcacttcccctaatctcttgttattcaatgaagaatgatcattttgatggtcttttattactacaatctaatataaatgaaggcttgttcagctgtctgtgttttatgtactgcttcccacagcactgggacccttccatattatttgacattacagcatcacatagggagttgccttagtggtttgctctcctgaggaaatcctattatacgctttgagtcagttcatccatgattgcctgggagaaaatcatttgtgttgttgaaatgtattcacttaaatgtttaaaatctgggagtcctggagatttttcattgaggaaaaataattttacatcttgtgttatattttgattttcgattctgacctgatatcagcaaagcaatctaaatatctccagagcaaaagtggaagtgaggagatgacaagaatcataaatattctactatttttgtggtaaatagctccatgacttagttcctaaattcaaaactcctcaaaggatgctgccccattgcagcattggtacccagcacaatgtctggagtgcaatgaccacttaatacgcagttgttgaatgcatggcaatgtgaatgaggggagggtaaagagaggcagaggcagaacaacaacctatctccattcttctttatggacacttgaaaatgccctgagaaaatcttacgtacttttctgacctgagactatcataaggcaatacttccaaggtatatgtaaagctagaaggaaaacagcctcttcatgctcccaagggccacttgtatttcaaaggcaagaataaaccttaatagccagaaattcttggcaacagtgccaaagaaatgttaagcaataatgacagaaaattagttatcttacattctacaggtaggtttgtagagtacaacaggctgacaggtgcctgtcaagaaaatgatgtttgacgagctataaagcatatttaatatgctaacccatttagttaaagcaccatatggaccttgatgatttgtttaactttgttcagttaatatatgttaaagtaaacacagtatgtctatacttaaatgaagcacacattttttgagtaatgtaataaatgtattttggatcaaatgtgttcacttaaagtcacagatgtaactgcattaaaaagaatatgcagttgtcattaaaacaaaatgtattttcttgttcaatgaattgaactacaagaaaatagtgttttattgaataaccactaatcaagcaaattgacttctaatatggcacaattcattcattcacatacttccagagtgttgctgccatgctccagaattacacttgttttccaaaaagcaaaatatcccaatgtttctatgtgacaaatgacatagataatttacaaaatattaaatacaatgaatgattgttttaacattaaatttttatagagaaatataaggatcccatttttcatacaaaattatagtatatttactaaatttatgtttgtctaaaaatatatattactcatttgtagaaaacctgtgagaaaatttgttacagtatgcatggcagtataaattgaaaagattttaatcacatgtgtaatcaaccttaaatgtgcccacaaatacaatctcataaggaaaaatttgagactattttgcaagaaaatattccccaaatcaggaaaaaattatatagtttagataactctataatagcaaatgtgaagaaacataggaaaaagctgagaaatgacctaaatatccaaaaatattggaaaatttgaagaaattatgaactgtgtacttgtttacatggtgttttgccagtaaaagggtaattatggaaatacagaaaactccttttgcttcagctgtaaattttaaaagatacaaaattttaaatatagtttatttatagatgcacacatttattatataaaagtatatatttttaaaaatttcaggccaggaatggtggctaatgcctataatcccaatttgggaggctgaggcaggacgattatttgaggccaggagctcaagaccagcttaggcaacatagagagaccccgtctctgcaatttttttttaaacagctagacatgatgttgcatgcctgtagccatagatgatcaggaggctcaggcaggaagattgcttgaacccaggtgattgaggctgcaatgagccatgatagcaccactgcccttcagcctaggcaacagagtaagaccctgtccaaaaaaaaaaaaaaaaaaaaaagccagaatactcttaagtgataagatagtggaaacaggaataatcttttactctctttattatttattatcttctgaacttaaagaatttttattaaagattaaaatctacaaaacaaacaatttattgcaatcttacttttttaaatctctttcacttaggataaattttgtgacccagtttcttgatgaaaatatcaaaagacagatttttttttttttaagatggagtctcgctctgtcacccaggttgcagtacagaggcacaatctcagctcacttcaacctctgccttcggggttcaaactattctcctgtctcagccacccaagtatctgggattgcaggtgcccaccaccatgcctagctaattttttgtattttagtagagacaggatttcatcatgttgggtaagttggtctcgaactcctgaactgagatgatccactcgcctcagtctcccaaagtgctgggattacaggcatgagtcactgtgcctggccaaaagacaggttcttaacaggactacttatgaagttataaaacacttttaacaaatgctataaccatatgtttatagaaagcatatttgtccatttatctctaatggttccttgtacggtgattttcttgtaaatattaaatgctacaatggtttaattaatgatcgttactctttcatcctcatctttatttgaaggtacattatgtttagaccaaaacattaaaaaacaacattgcttaatagcaactatttcaaaatttcaaaagaacagaaagttgacaaatgctactaaaaggtagagaaatgctactaaaaggtagaaaaatgtggttggatctatgaacttgcatgagccagaggagtaatgcagataaggtttctaaacaaagaggacgtcaaagatgttgatctagagaaatggtacaaatgagaactacaggggggagaatagggggaagaaaagatgacgaagtaaaataggacatgtaattcaagaagtgaaggctcttaatgtatgtttgtagagaactttcagtcttttgatcagagaatgagccaattcttgaagtagcatattttcctctaaggatgttctaagtcaaggatactagcaatagataggtgttctgcttcttctcctagtaagataatacggttttattatttaaggattttccaccttagaataattttcttagctataaaaaatggcaagtattatgatgaattaagtgataacataaatacatatattaagaattgattcttcagctttcaaattcatattactaaggttttgcatgtactgtctccagaacatttcataggatgttcatatttctttttaagtcaaattatattttactgtacattaattttcagcattttttttaagaacaaaagatgttctggacatctttccaagcatcctaataggataaaagaaaattacacaggtaaaattgagaaaaattatttgaattttcacttcactatgtgtgcaatttatccttagtctaaattgatgaggtggtctacagttttcttttaaaatatgtgattgttacagtaattctttaaaatacgtttggtagactatttaaaacattaagaaattcatactcagatgagttaaatggattcagaaattcagccaaatactacctttgggaataaagctcagggatttcagaatcctggtattgtacactaattaaaaaaagctctttgcgagactccatctcaaataaataaataaataaataataaaactcttgtcctataagcaaatatattgatttgtctataccatgtgattattaacaaagttgtgtatctttaaatatgcagaaacattacaatttaggatcaatataaaaggaactgaaaaaatatctctttataataacctaatatatatggaaaatatatgatatgtactacttttttcagaaccatcttctgagtacaagccatcactattcaaaaattgatgatggcaactaccctctgggtatatacccataaacattggcagcagggacttgaacagatatttgtacacttgtgttcatagcagcattatttacaatagacaaaacatgtaaatagcccaaatgttaattgacacaaaaatgaacaaacaaaatgtggtataaatataatggaatattcttgagccttaagaaggaagaccattctgacacatcatactgcagtataaatgaatcttacagttattatgctaagtgaaataagtcagtgacaaaaggacaaatattgtatgattctactatatgagacacctagactagtcaaatttatagagacacgaggtaaaatggtagttgccaagggttcagggtgggacaaatgggaagttagtgttcaatggacagagaatttcagtttggaaagatgaaggaataagctctggagaaagaggctgttataaaatgtgaatatgcttaatgtcactaagctgtacacctaaaagtggttaaaatgggaaattttatgtatattttattttaccacaataaaaagttggtgaaaacatcaatgtgattagtacatgaatccaaataaatcattggtggtattaactacatgaaatttcagttttctgaatttattctctaaatttgttgtaatttataaataaagcatagtgaaacaatagggaaaataatatattattctaaataagaaataactgaatgaaatttagcaaatactatctagaaagtatcataagatagcaagagaaaagtactaaaaagacagtacttttcaaaccatctaaatcaactatataaggagtagacagaattatagcattaaaaaatgccaataaaaggatcttatccaattgaaaattatagcatgtcctctgtaagaatacctttttctgtaaatattttgtggctgcctcttctttcctaaaataaactcttagaaattttcagaaggaacatctttgtggaagtagaaaagttaagctttaacatcaagagcagaaggctaaagaactggatgacatttatgccctaaactatatggtgaacacatttaatgccacaagtcatctttgttcctaaaatgaaataaacatatcattgaccagcaggatagagtcaagaatttgaaggtctaatacaaactgggttgaatccttgtatctctatcacctgcaggtcagaacctaagaaaattatttaaacctgagaggactcccagaatgaaaggtggtagcctgagtgatcaaaagattcatagagatactcagcaaccaaaatggtttctggacagtggactggcaatggctaaatcagatgcagtgtagtccgtgagagacatcagagggggactggtggatgagtagaagctggtagtgaatgaagaaggcatctctggatttgggaagaatgccactgaaagcatggatactgatggccagccatcatggagtgcatgctacaaacactttagaagagtatgaggcaaggagaaaagctcatactggaacgtgaggcagcaccaatcatttcagcagagcccagagaaaagcagagtgggagccttacctcatgttctttctctgaaccaagaaaaaaaataaaatgccctagaatttatcttactcctgagaatgaggaaaaggggaacgggtggggtggcaatccagaatataactgaacatttaaccaaaagaaactattgtgtactggaggtaattaaagaaacatgacaaggggaaagagaaaaagaagatattaactaagtgtggcccagttaacaagaaataaggaaagtttcaatttagtataccagagacttatgactgtttacatattaaatctgctatacccatctgggaaccactcctttagatgacgccaagtgactctattaatttggaaaaataacaccctagaatttagtgtctgctggggttagagaagtgggatgatttgctcaaagaaacataagattatttagagaaaagtccctagcttccagatccaataccctttcccaattgtaacataatgacctgttgatgattatgattagttcttattgaacatttataataataatagaaaaggatctcaaactttaggctgtatattcaaatcctaaatcttttgtgaattgttaaagtaactattaaaaacaatcattaaagacaaagatgtttgttgccccagtgagaaagactttcagaaataagtcaaacaacttgtagctctgcatgtgtacttttttttttgaggttgattttataatatgaataatggataaggccttagtgattgacccccaaatatcttcatttattaaaacatgaaacaaaaggaaagcttagtggacaaccacattgttgtaattattttagaaacatggcctttgaacaatcagagtatgacatgagtattgattaaattggaatttaagatgttgtcttaaagtagtgctgatttgaagtgcttttactttcagaaaaatttcaataaattactttgtatagcttgcaccagccacactttaagacgttggtaatgaacagttaaaatttgtccatctgtcaaactgtgtttgatgacagtatatgttgtaagagttgtgtaatgtatcagcatttgaacaagaataatgaacaaaaaaaggtagttttctttgaatcattacttaaatatctatcttgcctacagctcagaaacttgacagaaatatgtcttttttcatgaaacttaaaatcacctttcctgtctttaatatctaatcaatctgtactttgaggcattaggtagttacttctttattttaaaaagaagcattagcctttcagaattgctgtttcttgcagaattacagtctattatgataaaattgttcatataatgaagaatggccaggatgtagccactttccctggttctgctaatataagaaataggagagatggctcaaagccttctacagactttgatttaggactaatcccttaaaaatcattatggcctcatgcctctcacattacaacaaagtcggctacttctcttcctattacctcttgtttgtaaatatgattaaatgagcatattcaaaatagctattaaaatcataattattcaaaatgatttttttcgtattaaatgttcatagggactttttcttttttccactgtgaattagatatattattaattccaaactaagctcactgcattttagtcagatagcaaaaatctgtatcaatatacaggagggtttatcaattaaaattaatttgacaccctaatggtacatggtactataagacattctttttaaagtagtcttacaaatcatgagaagatggcctcaatgatattcaaaaaggcggtaccttctgctgccaacataagataaattcatgcagtcatacagtgtctatgtgttaagagcagcctggtctgagaataaaatatttccatgccacaaatctctttcaccaccactttcccatccttcagcgtccactccccactcaccaccatagttagaagcatcactgttacaactctgcagatcctgaatacgcctaggttagcatactgcagctctatcatgttcatctcactcttattctaggactgagtaacattttaaaactatttttaaaaaaagttgcacttggagtctgaaatcaaaatctatgctccttaaatgcacatggggactagatttatagcatccaccacgtgaactaaccaaatgtaaaattgtatgactattgtactttttctgtgcaggtatttctttgactatagtcatgtaatagacaaaagcacaaatgtggtgtctacttctaccactattaactgtaacaccttgaacaagttacttaacctcatgtgcctcaattttcttatttctaaaataagggtaataatgatacctgaaatcaaggaatgctgtgaagaatacataaactaatatgcacgaagtatttagagtaattaaaacaataagtaccatggaaatactagctctcattaagaattcatgattctagaatgaaattttaaaataagttatagaatttgaagaacaaagttttaaattccaatttgctttgttaaaattgcacataactctatatatcctaggtagacatgattgacagtagccaagagtgaaccacaactattaccaccgtttattaagaataaggagttagggggctgggcgcggtggttcatgtctgtaatcccagcattttaggaggccgagaggggtggatcacttgaggctgggagttcgagacaactctgggcaacatggcgaaaccccgtctctaccaaaaatatgaaaattagcccagtgtgttggcacatgcctgtaatcctagctacttgggaggctgagacacaagaatcacttgaactgggaggtggagggaggttgcagtgagctgagattgcgccactatactccagccttggtgacagagcaacactgtctcagaataagggaataaggagttagaagtctaagtaagttggataaattggagagtctaacatccttattatttcagttttcacaaaggggctatggagaatagttgcacataattctaaatttacaatggaacaagttggattaaactgtaaatattaactactatatctaggtatctacttgaagtctcattcagttaaaagcagaacatctgataatttttaccttactgaaaactctgcttttcagaaagttgagtaagggcttcattttagatcttattttgtcaaggaagcgtcagtttgtaaaatggaagtgacaggaatcttgggagatgttcgtatcgtctaaggtgccataaagccaaggaaataaatgctttgtagagtctaatatattccctagattttaagaaaatcttctgaacaaagtgagttcatgacaaagatagctgtgctcaaatgctgaaagctttaaaaaatgaaagttttattatagcctcacagatttcctaatgagaaagcaaacatacatctaataaattaatgcagttatatagagataaagctttctgttgggcttagcttttatagcagaacatataaaaagcggaagtaagcacaaaatgaagaataaattgtaagaaaactgagagaaactctaaaacatggaaaaaggcataggtgaaaatattgagtacaacataaattgtgctttatattatgcatgttctagaaaaacaaggcaaagttaagtttattgcttgaatcatagatgagagagaaaagagatctactcatcttgtattttacttccattttgcctgtttaccaggaactaagaaatggaataaatatggataagagttgaaattaaaatttaagataggagagggacaaatgggatttaaattaaacaacctttagtttcttctctcaaatatattctcttctacagattataaaatcctatgtgcaggcattaagtttattacaccagccttaccacaaacacataagtaatgcattgtactgtagtgttgccgcagctgcaacgtcactcagactataggaatttttcagcttcattataatcttttgggacttctgtcatatatatagtcttttgttaactgaaactttgttatgtggtgcaccactatacatgaaagtagctgcttttttaattggtataaaagaaatgcaaccttaaaaattcttttgttatgcattgtaatatacagaaagtagtgatgaaatatttgaaaattatcttaccataaaatatttcttattttgaagctgtagtgaaaaaatatatatgctggtttcagttaaacaaaattaatttttataatcacaaagcagtttgtgaaaacaagcagattgagtcagatagcccatcttttgataaagttactaaagcagttaatccatatcgattaagctgaaaggactcaggttaaaaatcaattctatgtaccagaacattggttcggctccagcgaaataatttggtgctcctgtctagaatcactgagtattgattcttcagaatcagactatgaagttgcaactttgattccccagagattttacaggaaaaaaaatggtcatcataaattagacttgagagttgttctgatgcattgagggaaaaaatgaaagaaattagcatcacctttggtaactaagggtttctttcctttctgtaggaaaacataggcttcaaatctcaaataacattctcagttatctagttatctaataacatatcttagttatcaaatatttatctgaatttctctccaattaaagcttattccctatgtatttgtatatacagacattcagtcaactaatgtttatcatgtacttactaaatgtgaagtcatagcccttttaaacaaaagtaaaaaaagttcgtatacaataaaaagacttaatttacaaaatggtgttttaaagtgtttctgggtttctttgctaacagaataaatctcaatataaatttataaatttatgcaaaaacattttctgttaagaaaacaaatcaaaccaaaagaattctctaggaatagaaaggctactactttatgcaagttgtaacactcacttcaagtcaaccaaattttgaccctcaaatcataagtatattactattttggttaagggcctgccaggattttcttcatcccagtttgctgatatcctttgggttggttatcctctagtaagtatgtgttatatacttatatgcacatcaataatgtatataccatatatttgtgttgtatatgttacagtagtgacacattaatgatattgtgatgtgtgtacttggcaattataacaatttatacaaattgctatgtgaacatagatgaaaacacaatatagattacaacttggactggagcaggtaattgatggaggagagaagagaagctatcatttataaaatgcaccaagcacagttctttgcattcattctcctgttgatttgacaaagcaatttatgattactagtatctccattttatggatgaaaaaaactgatactcactgatccatatgaacccagagctatatggttctaagtccccttccaatatacggctttgcaaatttggggtttagcgtttaaatttaattaagcttatgagcaaagcatgcagaagtagggaaatttagaacatgttcaagaaatagaattttcttggtttaatttgtgattaagagacaggggagggaatggagtggtgagaccaggaagacaagttggaacagatcatgtaaatccttagatggaaaactgagaaaggaatgtattttactggtagtgagagtcattgaatattttgcttgagggtataatgtgattgaacctcttataattttctacttccctacataactcatttccttctcttttactcttctgttgctagtaacaaattaccccaaatgttacagctgaaaacaacaaatatttattatatcacaattgctgtgggtcagaaacccagaaacaacttatctgggtaagtctgattcaaagtcttttaagaaggtgcagtcaagtggtttcatctgaaggtttcacagggcatgtgggaaattggagatctacttgtaagctcgctcaagtgattgttgacaatcctcagtccttcaccacgtgggtcttccatggggctgtctcagacccaggtagctgacttagtataaggaatataaaagagaatgagaccaagtcaaagagcacatgaagacaaaatccacagtctttcagtaaactactcttggaagtaacactccatctctttgctgtattctgtttgtaagaagtgaatcaataagtccagcccaaactcaagtggaaggcactgcacagacttgtgaacacccatagctgtatgattccaagtccaagaaaacaaagcaagcagagaaatagcctcttactctttggagcttatcataatgttgaaacagaaatatgaggaatgataatatgggttatcatttatgccacgtgaagatgagcatacaaagatatttgttagctctactgttgctaaactcaccttaagtcctttgagacaaaaaagaattacatagaactctagtttatatttcctattaaaggtttttatttttatttttgtttttattccatagtgcttaggataatatacacctcaactaggtattcattctataatgcaacaggcagtgattgttggggggttttcttaggggctgcctaccatgctacctctggccttgcttatattattcacctagagttattcaaattcagtaaaaatatttcagtgactacctttctcaatgatctatctctgacatgttaaactatatttttttgacctccagaaataaaagcaaaaagaaaaacaataaaccattggcttcaccatgcacttggacacatcattttgtttctttggtaagatctaggacatctactccacttgtgtcctcagaacactgagcaaagtgctaaatataatatatacccaatataactatattggcaatagaaaattaattgaaatcatttttggagtattacctgtgtatgttcaccacccttacttttagtttttatttttgattttgattgataattttttgaatactgcttgagtggctcaaataacatttcaaagtcacttctatgggataagaagcatgttttgctttgttttggcatttcctgaagcatttcttgtactgtttaatgcgctaaagcgtaaggattttagaagttcagaattttcagaaattctatgcaattttttgcatttttaaaactcatttgaccagcagaccctttgggaaaatgttagctgacttcatacatcatggggaaaaaatgtaagctagtttacctgctaatcagtatgagaccaaaacagtgattcaccttcaaatgtgatctgagttttttgtagccagagagtccttgaagtattgcaaaaatttaacaaaacagtaaaaaaaaatcctctttatagtagaatttcatgccattgttttgggtttcccatgtactaaaacctcaaaattggtaacaacaacaacaagaaaacaaagcaagcaaagagaaagcctcttactcttaagagcttatattgctgaaatgtagaaatataatgaggaattataatatgtgttatcatttatgccacatgaagatgaacataaaaagatatttcttagctcttgtattagttgctaaactctctttgagtcctttaagacaaaataattatatcacatagaactccagtttatatttcttattaaagatttttctttttatttatttttcctttctttccatagcacttgggataatatactcctcaacaatgtttgcattctataataccccatattgtctattgattataagcataaaccactacatagaaaaggtagaaagcaaaactgtcacagcaatggtgatctcagctatttttaaaggaagcttcgtttttttctctccacaggaaaagttgttttgacacccacccactgaacagtaaaataaagctgcattgattttgttttccccaccaggaatggcatgttactggattcatcttccacttagattaggcacacaaaaattaatgaattttaacagagctaaattcagcttcattttgtagccattttctttatgtatttacaatatgatctcaaacttgtataaatcatttgctttgaaatatatttaaagccatttttactcagtccatgctaagtgagtaaaggtttgcatctagaagagatgtcaggatattttagtgattagactaaaacaagcccaaagtaataataacatggcatctttcaccagaacagaagaaaatgttccccgattctttattgatgtttgtataatactgaggtgccaatagagataagccttggttttggctggtgcaagcgaataagcaatcagttaaatcagagcacaaagctgttaattcaaatctttgcagaagatagtaaattattcagaaatctaactcatctatctatcaaaaattgcactgagtaaaaaggtgggtttgaatactaatatattatacaaaaatagaattacagcatttaaatcattgaatgcagtgaaaattggatgagatgtggcatgcaagtaaataaaatactaatttccaactttaggaattataatttatgtggtggtttaagctttcaggtgatgtgtaattggatgtcttagctttactctgagaaaaagttccaattaaaaggaaaaccatctattgtttacatttaatacaactttgagggtttaaaagctcttcatcattatagaatttagagactaaataatgtacttagactctagctaattttagacaataagtgatttttttttttctttctttctttcttttcttttcaaaagcaagaccagcaactttgggaaaacctactgtcgggtaattgccatatggcaaaaaccatgattacttttgtaccaaggcaacctaataccaatacctaataccaattaccaattacttttgcaacaacctagtaaagtagcaggattctgactactctgaaccttggcaatctaagaaaattctgaaatacagtgtattcagaagaagcttataaatttgataaaaaagatgaacaatacctttattttaaagtatatttctacacaatgtatatttgcacttatcttcaaactgattttgtaatttgttatagtattgtttggtgttagcctaagtagtaatctatgatattttatctattaaatgtgaataattaaagagggtgaatttgggtaaactgatttactaatatttattaattaaattgagtaactttaggaaaactacattttcttatcacatttgttctcttgtaaaaagcatgtcaatacctaggagacaatagatgagtgctttcattcccaataaggcaatcattttcagaatgagctttataaagaaactaatagtcatatttcaacttgattatttgaccatcacaattttataaattgaaaggagtgtttgaaatcatagggcatgggtagtagtggaattgcattttttaaattacctataatttttttaaatgtcactgccttagaaattcttagggtatgtagtcttatcactgttaataagaaaagaaaaattatttaaaaatggggaagataaaagaagttgaaatgcttttttggaaggaccaacagaatccactttacagtgacatacatgaaatgagcaatgtttagtatattgtagtcaacaccccatcccattcatttaaattttgcaaataatttcatcaggagtaaatgtgaaaatggacctagagaattgtgagtataatttttttagtgttctgtcattgtgtgtatgtttgtatatatttaattttaaagaataattttaattgcatatatgaacagactttaaattgtatggttactgattcagtatcatctaaaatatatgtattcattaatttctctacaaatcttttactgagtgtatactatatgtgaacatagtatgtgctagagttaaaatgataatatatgacaagcacctgcattcaaagaactcccaggtaaatcagcacttgtcatgaaaacaaagtttcattacagagtgataaatgttaatagagtagggctctattgtcttagcttggacatgattagactccacttattgtggtaagtgactctagttcccttgtttattccagccattattacagagttacatatgactgctcagtctgcagccttttaaccaagatttcaaatggttgttatcattccttcttagaattaacatagacatagtgatactcctttcatctatctgtctatctttctatctatctacctatctaacagaaacaggagaacatacagctttttcatatatgtatgcttgtctttcccaaaattataagtttatagattaagcctttattttggagttgacgttgttttgtgtgcttttgcatttgtcgttgtacatttttctcccaattttgtggctgtaaggcctagtacagtgactgacatatatcaagagctaatttttaatgtgaaacactaagaaactttatgattaattatatgtatgagattggttttaaaacagaaacagatacccacaaagagacttgaaagatttgcttttaaatcaggaaacccacactctgctccctcttcatgtcttcctctctctctctctctccagtgtgtttattttagtaagataagtaagattcctgataggtgtaaagagacaagagaaaacattgctactgtatcacagcacattcattttaaattcaattaagttttctgatttctatccaaatggaaaaccctgcaaaccttcccattctgctaatctttgggccatactaactttctgattctaacctgtaactgattaactggacctttaaagctttttctgttacctttatacttggccttggtctagaagagtctcacagactctgtctctgcccaagctaattccaggaaatgctgtctattctattcagtgacctctcccgaggagtcagagctagttggtgttgatgacagggttggggaggtagtcaggggacaggactgaaaagaagtgtggagttaaataagtagatagccattttaggaagcctctgttttcctctggtttgcatggggattcatgcaaattagtgtaaactagacatctcactggcaaggctgcagggactcagctagaatctgtttggcatctgttcctcttgctcaacaatttctaagagaccaagaacaattccatagcacttatcaatcaaggggttgaaaatgacattgctatcactgagttaaatcaagtgtaagatcctgggggctgtgatcctggctctgtccctttaaaactggtgtgattactggtgtagctaccaccaagcctgagaatgccaaatctgaacgttgatggaggaacagcaaggatcctccaggcaaacagattgttctactccctcaaaaattcttcagaggagcagggagcccagagggggatcaaaatttctccaactcttcctcacttccaattatgtgtgaaagggaagatctatccaccacatccaaggagaagctccatcctaaacttgcagctcttatttctgagccagtcttgttgcagtgttgttttgatttttttcaaaggaacatgaaataaacagttgctttgtaatttatttttacatgtttctatcagcccttagaagttcaaagtattcaaaattttaaattatgttaattttacacttaaaaataaatgaactgaatttaaattacttaactttcttaagataatatttataaatttaaatgtgcatcactctatttttttctttttattttctttgctttactttactttttttttaagatagggtcttgctctatcacccaggctgaatgaagtgcagtgttgctcactgtggcctcaaactcctggattcaagtgatccttccacctcagcctcctgagaatctgagactacaggtgcatgccaccacacctcactattttattttccttttttataaagataggttcttgctatgttgcccaagttggtcttgaactcttggcctcaagtgaccctccagccacaggcttccaaagttctgggattacaggcatgaaccacctcgcccagccttacttttttttacttggtgaaatttctaaagaggaaacttgacattcatgaatactggaattaagaatatgagtaatatatgtgtgattaaatttagaacattttttctcttcatcttcatcttttacaatatatgtattttaactatgaattattgtacattgatggttatatttcttttttttagttttttttttcttttttttttttctggagacatgtcttgttctgtcactcagcctggagtgctgtgatgcaatcatggctcagtgcagccttgtcctcccaagggtcatgtgaccctctcaactcagcctccaagtagctgggagtacaggcatgtacgatcacatccaattaatttttgtattttttgtagaaaaggagttttgccatgttgcccaggctggtcttggactcttgggctcaagcaatccaccttccttggcctcccaaaatgctgggattacaggcatgactcattgcacctaacctgatggttatatttcatttacctatttagaatgttagtattgaacattttaacatataattatccaatttaatattaatcctttttgatattaatctcatattaatgttccatggaataatacagtggtcctttccttatatgccagaaatatgttctgagacctctagtggatgcctgaagctatggatgctaccgaatcctacatacattatatttttcttatacatagaagcctaagataaagtttaatttataaattaaacacagtaaaagataaccatacaactaataagatacaacaattataacaatatactgtaataaaaggtatgtgaatgtggtttctcaaagtatcttattgtcctgtaaccatctattttggaaccatggttgacagcaggtgactgaaactgtgaaaaacaaaactgcagatgggatggggactactgtgtttattgtcttacaaaaggaaataaaagtataatcttctttacgtaaagatttaagttttatttaggaactttaattaactacactctttgaacttaaaatttatattgtttccagctgatgtaagtgctactcagactctcttgaacttctttttcaattgtatgaatgtttcctagaaaattttatttgcatgaaactcactagcttcttttttttattttatatcataagatctctttcaggtggattgaatgtctgttccttaggtcacttgatagtacttgttctcaactaataatcaatgaagccatataagtttggatcttgaggtcacatgaaaacataacagtatttataaatttaaaaattagaaagaaatatttcttaaagaaaaagttctagcttaagaccagttccaaatgactgaagaaaggttcacgtggtagacagaaaaagcccccccaaagatacccactttctaatctctggaacctgcaaatatgttaacttacatgacaaaaggatttagcaaatataatcaaattaaggatatcaaaatggagagattgccccagattgtctgagagggctcattgtaatcacagggatctttataaggaaaatagaaaggtaagagcatcagaatcatagaaggaggtataacactgagaacagattttggagtgatttgattgttgatgttggaggtggaggaggcctgtggatgacagaagaagcatttaaaagttggaaaagacaagaaacaaatttgatctagaacctccagaagaaatacagccctaaagacatttgattttagccacatgaaatgaatttggaattctgatttgagatatagcataataaatttttatcgttttaagatgctaactttataaaatttgttatagcacagtagcagtaggaaaatcgtacagttctaaaaaagataaagagcagcaattcccaaaaggatatactcatgaattcttacctatttattcctttaacctatcgaatgtcctaaccaaatacaaaaatatgccattaccaaatacaacaacatgcctcattagcaacaaacacgtacttaggcttttgtccatttaggagttctaaatatttactcttctctccatcttagacaacaaatcctggggaatgtaattataatttactattaacctaaacactgccccagtttatgggccctaaacatttcaacgtttttcttctaacagtcccaagtgggccacctcttacaaagagagtaaagtgacaagtgttgaattatatatggtaaagtttatagaaggaagagatcactgtggacaggaatactcagaaagaattctaaaatacatcagccttagcaaaacaaggtatgtgctgagagatggttgcttggagagggacagagaggatgtggggagagaacattccagacagacatagaacaatatgtttggttgagatactcatatactcatatttttaattaaaaacatttttgtactaagaattatgcattttagttggcagaaagcaaacattcaggacatctagctcttcaataatgataaatgcagcttccacgtgactattggcatgtacagtttgccctatagaatcataaagctaaaagtaattttttgatacaaatcctcattgtaaaagggtctcaagattaaaataattcaatgtcttaggtaaaagctactttttaagtatgatcaggaatactgaagtgaatactaacatttttaaagtacatctcaatacaatcatagaagaaaggaatcttatgattatgtgtatgcgattttgtcagatagaagagtctgcccatttcaatttttttaagcggttcctaagctcagatcttaataccaaaacaagctactaagaatactcatttatagagtgaacaacaactaacaatttatttaagtacaattctgtgactttagctatatgtgtcatttagttctccttcataagtccttattcagctatggctaagctacgtctaataggaatactatggtttatatcaccttctatttaccaaccttcctctgttgcatattcaattagtcattgcaataacaggtaactattagagtaaaatgacaaatgttgaattatatatgccaaaatttatagaataaacagatacctcttacagatctataagatcttcaacaaaatagggtattctcaatattttgtttatgtaaaattcagagaaatgagtatttttcttcatttaatgcatttcaatatttttggggcttttgtttctaaactaatactatagaaatctattcagagctggaatgtaggaagtttcttctctttcagtgtattgcctccaaaataccagctacaactgttaatttcccggtaattgtttcctctctaatctctacaatgtttctctcattgtttcatttttactctgatgacatgatttgaggaaaggtttttgcacatttttggccaagttttttgcacatattgcacatttttcacattttaaaagttaattaaaagtttcctgactttttaatgatcgcccttctaactggtgtgagatggtatctcattgtggttttgatttgcatttttctgatggccagtgatggtgagaattttttcatgtcttttggctgcataaatgtcttcttttgagaaaagttaacttgtatatcataagctctctttcagatggattgaatgtctgttccttaggtcacttgatagtacttgttctatggagatgatagtacttgtttctgaggtgaataagctaacttttagcttattcgccccagaaaaagtcttagatattcagaaatcacaaaaatttaggctgtttccttggttgttgcagtccttccatttgttttaatatctcatctattatgtgttggctaggtaacgaatacatatttaatctaaaaatggatgtagtctgaatgtattttctaagttacattttaattttggaaaacaataaaaaattaatgtttttaaattttgatttcagtttacttgaacagactttttgcttataaaaagtagaacttgttgacattaccctctgattttccctttttattttttatttttagagacaggatctcactctgttgctcatgctggagtacagtatcatgatcatagctcactgcagcactgaactcctaggcttaagtgattctcctacctcagcctcctcagtagctaagactaatggcatgcaccaccatgtcagctaatttcttaaaaattaatttttaatatccctattattaattgttaacatctctatgttgcccaggttggtctagaaccctggctctaagcagttctcccatgttggcctcccaaagtgctgggattacaggcaggcgccgtaacacacagtatgattttctttaataattcaacatcatccattgctgaacagaagatgatattttgaagaaaaacaggaaaacagatattcgaagaacaaaagagtagcaaatactcactcctatctagctgtctctctccagactatttatagtcagtatcattttgttatctctgtcatagtacatttccaaattttttatctccactggccttgagaagtcaagttaccctagaacatgacaactttagatcattacagagtgtaatgggaatattagctcttttgtgtcatttaaataatttaacttaattaacaaacttaaattattctaaggattcttcaaattatgtcagacttttaaaaagttttccatgtttagccttttgacaaataaaattatacacaatgtgagttttatatcagcggcagtgatgtctttaaacacactttaaacatatgagtaacattttttttttctagtttgggcattttacagaccccttctttaaatctggctgtctttgaaaacttttaccattcattaacacctatattggaaagtggacaaaataaataaatgggtgtttgattctcaaaccagtccgtcctgtgatttcagtgaagtgttttggtggaagagcagttatacgagattcttataaaatctatgaatttcagtttaccatgatttccttttaccccactctaggtcaggaaaaggaagaaatagtttaatggtatgtgtaataacattgaaaataagataatcacaaaggagaaaagaagttataggagaagaggaagaaaggaaaaagtgtttctgattcttcctctcatgtaacatttcgacataattaagtcttattcattggtactgtatttataaatatttcaaacttaataagtatgctgaaactgatattaccagtataagaataatcaatccaattaagtataaaattaccttccataatattttttctgatcttgaaagggaatccataatctcattatagaaggatattactatccttatattcttttaaaagttgaaggaaatttcaatatagaataatatatcaaatccatcttctttcaactcagtttcaatagcattttcctaaaaggccttttcttcctttgagattttcttttctctgctttggatcgtgttttagtcaatgcccatttaaaggcaaaggagagatacctagtaaggccagctcaagtaaaaagaggtttctagaaaagacactggtcaactgtgtgtaactcaaggaaagcaaattgtcctgtgtgtcacaaggactgaagatgaaaaatagaaatgtgttaattacacagccatgcctttctgcatttttctttatgggtcaacatgagtgctaatctctgtttcttcatgcatgtcagtgttcatctctgtatcttcaagcacatcctacatttcaattccagggctgtcacatcactgaaatgtctgaatctctaaatcaaagcttcaaaacagagagggattatgccacttgagtaactgagtacaactcaatccatgtaagaatgaaattccttatccctccaatcactgtaaactggcttttactccagagtttccaatctcaagttgacaattttataattaatctcagatttctctttattttctactaaattttctcactcataatggtagcacatcatgtttattctgcatagatagatagatagatgatagatagatagatagatagatagatagatagatagatagatagatagatggatagatagatagacagatagatagatagagtttcactctgtcaccctggctagagtgcagtggagcgatcccggctcactgcaacctccgcctcctgggttcaagccattctcatgcctcagctttctgactacctgggactacaggtgcctgccaccatgcctgacttattcttgtagttttattagttttattagaaggggtttcaccatgttgggcaggctggtcttgaacttctgacctcaggtgatccacctcccaaaatactgggattataggcatgagtcaccatgcccagcctataattcttttcatatgtgatctgcaaattttcagtcttatacaggagttaaagatgaagattctggttaggacacctaagttcaaattacgtctcttactttggatatagtaaatatcctaagtcccatgaatttccggtgcctcagttcctttcactgtaaaatggggaaagtgattattcctatctcatagatggttgtgtggatttaatgaactagtatttataaggcacaagaaacactgtcagtcacattgcaccatataagattcagataatcgtaataatttccattctaactacaattgccataaatgtagtccccctaaactactgtaatcaattccttataggtccctattttagatcagttttcctaaatcactggtaggtcatataattttcacactatgaaattcttacttgtatatgaaatcctacatgccatccaaactaaacccatgtttgctccatcattgaaagtcttcctcaatctactctaatttatgttcccagattcatacttttatttcatccctttaaaatcactctgcttctcatgtgggatttcacctactttcatgtctgcaagcctttgctcagctgtctatgtcccccaactctagccttaaaagcacttcaactcttgtctgtccgttcaaatgttttcaaacaaaaacttttgaaatcttttttcccctcagaatagaaggtgttgagttacttggcttatttttgtttaaagattcattataagcaaagaacaggaacatttaattcagaattggtgtcttaagtaacttatttttctgccattttatccactaccagcccttacacttttataagcggttttacctattaaatgagaaaaatgctattttacaaataaaaaccaataacaactctggctcgaaatgtttgtgtgtacagataatatttcactgatgttactgtagggtgtttcataatttttatgaaagtaattcaagaaatgtcattcttttttaaataaataatgaattatactctgatataatataggaaaattgtctaaaatatttggtttaaaaatatcttttcaaaacattgaaaagctggcagtatttatttatagtgacttctttcttaatgtcagcagatagtacaatttctgtaagtgagaattttaaaattaattgaaaactctcctgttagtaaattaaagcatttataatatttcattattatcattcagtctgttgaaacccattaaaacattatattctacataatgctcatttctctggactatagttaacttattttttctttttcccccttttcccttctgtcctgcctctcctgtcatctgcacccctccagcctaccccaggatttttcttcttcatttctgtgttatatttttggaaatttcccttacccccttgacacattctcttaatctctatgcatttttctttaatctttcagaggtttcttggggcagagaaatgctgttctttaagttcaaggatgagcattttggtcctgcatacatctctgtctgtgtacagcagaaagtccattatgtttgatttttggtcttcactgaactgtgaataacctttgacttctttacaagaccaacacttcaaacagaaaaagggctcatctttgtttttggatataactgaatactcagccacctgaggaactttcatcctcacagcaacctttctttttcattaagaaaatattatgcaacagtactacaagcatcaggaacctctctctaggaaataaaataaaaagaagaaaataaaaggagaattaagaccctagttgtgtcacagagcaaagggctatgtgtagtgagatcttgttttatcttttattccactagttctttactgataattattccattacagactagtcttatatgtatttaataatctaaaaaataagggccaggagcagtggctcatgcctgtaattccaacagtttgggaggttgaggcaggaagatcacttgagtccaggagtttgagaccagcttggacaacatggtgaaaccctattcctacaaaacatacaaaaattaccctggtatgatagtgttttcatgtagtcccagctgttagggaatttcaggtaggaggatcgcttcagcccaggaggtcaaggctgcattgagctgtgatcctgccactgcactgcagcctgggcaacagaatgagaccctgtctcaacaaatcgtcatcatcatcatcatctaaaaaatagaatgatcatttctctgttgttataggccattatatttttgtgcttttttctttcatttctgttgtatatgagcagtcatatagatttctgatttgtagaaactctcactttgaataatgataactagaaaatagattctattaaatttagaaagacagagttgacagccaatgctatgtaagtacatgaggaagaggacaagaaatagcttttcttcactacatatttttatttatatttatttttattgttttgacttcattttatgtaaaattttgggggcatgttatagctgaatactaaagaaactgctcatcaaattattggatcttcctctctcaaagaaatggactggaataaatcagtgtccatgttgtacaaatggagggctgcattttacataaggttgtatgggcctctttgataattatatctgtttgatgattcaggggctacttgtatctcatctgctattctcctgctagttcactttgttactggaaattaaaccttctctttaaaaaagtctcaacgaaattgagtgtagacagaagatctgtaaatagaagttgaatttttatgtttgacatatatgttgtaaaacagaggaattcaggtttcttaagtctatttgaccgcttgatatgatgctccttagttctctattcaaattgtccttcacttattttttttctttgttttccttatctcatgcttgtttttatttttcctactcaacctaatatcacatttgttatgttataaaagagggaaatgtgattatcaatggtattttaaatgcatgtttaccctgtgtatttccagtctgcatgagaaagcagaacaaggagaaaagaaaatgaaaaggagataataaatgcttttaagatattcagaggggccaggcacggtggctgacatctgtaatccactttgggaggccaaggtgggcagatcatgaggtcaagagttcaagaccagcctggccaacatggtgaaaccccgtctctactaaaagtacaaaaattagccgggtgtggtggcacacgcctgtaatcctagctactcgggagactgaggcaggagaattccttgaacccgggaggcggaggttgcagtgagctgagatcacgctactgcactccagtctgggcgacagagcaatcctccatctcaaaaaaaaaaaaaaaaaaattttttttcagaggtttggtacatgaaaatgtgtgactccatcataaaccttactccaactcttttcaacctcctccactactttttacccacattatgtctttcccaatgaatctggtacacccactgccctagaaagtgccttgcacttttctagtgtttctcatcctttagtttttttccttaatttgaaaatctattacctgaggctcaaggcaaatgctccagttccatgaaaccttttctgaatacaaagcaaatatttacctactcattatgttctactgtataatgttttgtaaatcgttatttatctcttatgtaattatgctccatttccctaactggattatgaattctttaagatttctggcgttctgtctgggtacagtgctttgtagcaaagggaagggctaatttagcactgttgagaaatccatctttgggggtgaaatttatgtcaaaatcacagtttgaggtctgtaggatcaacagaaatttataaagtaaatgagaagattctagcactcagtcctcttgttcctttctctgaagtgtcacatgagagattaatctaaactccacagaggagaataaaacagaaacataacatgagtggaaacttgtagtgtccaaatgtcctagtctgacagcacagatatattaaattacttatgatcattgttttggtaaacatttccaagatcagaaatgacaaagttaagtgatacttcttatttctgcttttaaggtatgtctttaaaaaattacttacattgagaatatttaaaaaacataatatgctcatttgatttagagtatttccctttgttgaattgatcataaattataaagctatttagtgtctaatgtactatttttcattttcattctctcttctttgcctaggcatattgtatagacacacacacatacctataggtccatgtttatactgtttaacatgctacttactaaatattagggagcaggacagttgttctactcctgacagctttgataatgtctaaatatttaagaagagatattttaatactagatgagaattttaaatgtgaggtcattgtattcttgttatgaaacaactagatatttaaatttagtttaatttttttcagtagtggtacttgctattgagttctccaatatatttgagcatattctaagttgaatgagagcaataatttggtgtgtggtggtggtgaggtctcacttttgttctttggtttcagtttagatatattgggcttggaagtttataatatatttaaatacaaaaagaccatgtagcaaattcaatgctataaagtaaaaagaaaagcaaaaataagtgatataaaagaaaaagaagcatgatcagcatataaatttgtgaagtcataggatttggctgaaaatcatcgggtttctttctttctcacatgttttcatgatttgactgctgaacaaagcttcccaaagcgctgcattttctcagtttttccttacataaacatgagagaataaaatgcagtacgtctgcatccagccactttttaactcctgtagatctagtgtttaggtagtaacctacaatgatttcactttacttcaaaatatttgtgctgtctctgtatatcttcctaaaatatcatcaccttgcacatattttgcgctatggtacctgattaaatagtctgttgtatgctgtgaataaactcatgattgaataaactcaagggtaacttcaagtatctgaattgaaatttagggaatttatgtcacactacacatagcatataacttttaaaatatatttattgtgacagtttttatttttaaaatgcaaagatttagaaagaaaatttatatgtagttttatcctatgattagtggccaagaacaatattaaagccagaccatctagaggttcctttatagagatgtttagtggctattgtgtaggctttataggagtatgtattaaactgctgtcaatttaccagttattagatgtgtttacctgaaagcaacatgaccattttgttttgctctggaatgctaaattagtggagttatgggatagtttatctctgtttatcagctacaactcattttacttcatgtcatctctttacgtacttacagaatgtttcactggtatgcatgctgggattctgaagagtctttttttcttaccttctgtatttctagtctgtcactaacttgctgtgtcactttgagcaaattatttttttccactgagtcctaaatctttatactcccttaagatatacttttcttgaacactaagggcctgaaattacatgtcactctctctatagaaaggtaactttttcctttaacccatcgggcctatgcacacacttcttcccagaaatcttcaccaattaggtaagttatttgtagagcagatgcattatttctaacacgtcaatgttggaaagtgtactgccttttcattaagaatttactaaacatatagagaattgatggaataaaaatcccccaatccttgaaagtttatcatataggagttggataaatattaatttagtttattatgaaaagcttaagttatctaactatagataaatccaaacatagaattagaggtaaaataccctaaaatgatatctattgccgttttataatggcaaaacaataagacaggttacttttattgtaattatttataaaaaaagatatataaatttgagtaagttctgatctttaaaaaattctcatatctaattttttatatatgcttgaatgctttgtaagaatgaattgtggttcttttagaaattgtttttattcagggaatgttgaatatactagaaaaaataaattcccctaaaagctaaaagcttaaggcatttgccttaaatttcagaagtaaaagtaaaagatgcattattcagcgtatgtttcttaggactctcctacgctcaaggcagggtaaagtttctgttctgtaatgagtatgttatcagggagggagggggaaatgatatcctgctacaactcttatccatagctattgccattatcttctttctcatccaactatctttactttttcaattacactttctaaatatggtattcttttatattatacaagaaaagagactattacaagcttcctgacctttcctttttcctcaagaaatgccagcttaatcctaccctgatcctattaagaatcaaaagcatttactaataaacattcaataatatttattattaagccatacttccaggtaagaccttgatgttaagtcttcagatgcagctactttaacccttaactgttgtaatttccctctcctctgatcatacatggactcctgagacatagctgttttccaaacttcactgatgcaatttcttcttaatgaagtccctatactagaagtttctgacttaagaattactaggactgcattatttcctttctcagtaatgggtagtcttgtttctctgtttctttctaggactaagacaatgttatgtttttgcctgactcctttacttgctttcatcttttctggtcctgctcagcctgaggaatgggaccctgataccagtagtcaaatcttgatgacaactactagcctgcttagatttctgaatacattttttctatgtttcccatctcaatatttaaggcatgtattagaaaaatataacagctaaggtaatttgtttgggaagtgccaaaaaactcaacttaaactgactaacacaaataaatgaaaaaacaagcaaggaatgtgttgacttcaaaaaagaaaattcagattcaggtttgacatggaggaccagcgacaccaccatctctggtttctctagtttcccgctactttcccagggtgttgacttcatcctgaaaaactacatgatgatctccatcccaccagcaactctaccctcttcctatgtggtagtaaatgttttgcagccaaggagcattctagccctcatactttcacagtatattgtccaagagtagagaaaatctcctttggtaggctctgcacaagtcttgaggttcacctcctctctggtctcaatcgatttgtaccatttaattaaattgtattattattattattattattattattattattattattattatttgagatggagtttcactctgttgcccaggctggagtgcagtggtgtgatctcacctcactgtaacctccacctcctgggttcaaacgattctcctgcctcagcctcctgagtagctgggattacaggcacacaccaccaagccctgctaatttttttgtatttttactaaagaaggggttttgccatgttggccaggcaggtctcgaactcctgagctcaggtgatctgcctaccgcagcctcccacagtgagattacaggcatgaaccaccagccacctcacccagcagattctgatttgtaccatttctatttatttatttatttatttttggaggcggagtcttgctctgtcaccaggctggagtgcagtggcgcgatcttggctcactgcaacctccacctcccaggtgcaagcgattctcctgcctaagccgcctgagtagctgggactataggcgcgcaccaccatgcaccatcaggcctagctgatttttgtatttttagtagagacggggcttcaccatgttggccaggatggtctcgatctcttgacctcgtgatctgcccgcctcccaaagtactgggattacagcaggcatgagacgccgcgcccggccttgatttgtagcttttttttttttttttttttttgagacggagtctcgctctgtcgcccaggctggagtgcagtggcgcgatctcagctcactgcaacctccgcctcccgggctcaagcaattcttctgcctcagcctctcaagtagctgagactacaggcgccagccaccacacctggctaatttttatatttttagtagagaccgggtttcactatgttggccaagatggtctccatctcttgacctcgtgatccgcccgcctcggcctcccaagatttgtaccatttttaaatgattttttgtttccaagacagtagatgcgctggtattttaagccaattgaagttctctgctgaagctgagggtaagattagttccacataatggcaaggtttccttttaaggaaaaccagaggagagaagatggataatgctgaagaggggttgtttaatgggtacaaacatacaggtagatggaaggaatatattctttaggatcaacagtggagcagtgtgtattccttacagacatctccaggcacctcacattttattgattgattgattgattgattgattgagacaatttcgctcttgttgcccaggctggagtgcaatggtgagatctcggctgactgcaacctctgcctccctagttccagcaattctcctgcctcagcctcccgagtagctgggattacaggcatacgccaccaagcccagctaatttggtatttttagtagagacagggtttctccatattgctcagaccggtcttgaactcccgaccttagctgatctgcccacctcggcctaccaaagtgctgggattacagatatgagccaccgcacctggcccgggcgcctcacattctaacactttgcaccaaccaactatagaatgtgatgaagtcaccacttccccttgggaactctagcttatccgctgaacccagtatctgttactatctcattcagctagaaatacttcctccaaacaggtcctgccatagagggaaaatctttaccagctttttaccctcttttgcctcctgcctattctactttcgctaagcccttaggatcgataattaatatgaaaattcaacatttgtgaatgaaaatattagttcaattcaaaataacaaggttatctagttaaagaacatgtccatattcacatagaccaaagaaagaatttaagagaatgtgtgctagaatggtgctagaaatgatacacttgccctcaacaagtatttgtgattccagaccctggctgttgaggcgacactatggggaatagcacctgaacatttcttatgtcagtagcctccagcctgtataatacattttgaaaagttccatgcttgttctgtaaccttaatatcttctatgttacaaaaagtgtttgaaggagtgtctgccttatcaactattagttgattttgagtctcagtacttcaacagtgttgcagaagagcatgcttcatttttgaatagcagcaataatttacacagatattcaaatatatacttgaaaatatatacatacatatttattggtaacaataattttagagataagtaattttttaatttatcaagctgagcttcatattgtatcaatcaaatataaataatgagatgatttctaatgattgtgtgttcacaaaatattaattataagaaaatcgtatttcactagaaaaattggaatggtatttgttaattcttggcaaacacacctttttataagaatgggcaaagcaaacatagagaccatgggtacattttatttatacagatacccaattaagaaaaaagcgtaaataatcaaatgcagtagaaaatgtattaagataataaaatattgttgacattttatcaggttttaaaataagttaggtggtaacgatttttaaactaactttaagaaaatgcaaaaagatacgtagattaaaaataatatagttttaagcatttaaaatatgaaaatgcagctaagagaaaactagtaaataaataaaaaatagccatctttcaattatttgtcagctataaggcaataatcaaaacacatttaaaatgaaagtatttgtttacctattctaaatatacatcaaaataatttattgacttttaatacagttaaagaaattagtccaaaaaggctgtttgatttacaaaatataaaacttccaagttgagtaactgcaaagagatagttcttagaaatagacaagcttaaatcaatgttctcttttccacagagctttcttttcaatgttgttaaataaagtatatatgtgctataactcagttttgtggcttttttaacacttgttctgaccttcctttgccttcaatgtcagacaggatgggtaggcactaacagtttctagacttttaaatactaacttatactatactgtaatgatttttgacattcatagtcatttcaacattctagtaactaagcaatctaaagctagttggcaaaaaatatgcacaactctttgattagtaactatgttttgatgtttacatcaaggagtctaatctgaaatatccttcataataacctatgtagacaagggcaaagtaagacttcaatagccacctagacagtttggatgatggccagatgagccagtgttctaagggctgtcggtgaccttgtagtgaattttgcaaaagtgcgaatttctctgtctcaggcagttgtatgattaatgaaacacacccacgaagctacagtgcttggtaaacacatgttggctgtaaacaatattcgttctctgaaggattctgagagaagtggtgaatacagagccagatttacagagcagtattctgtacctcaaatgtaagcagtgctggagtggattcatgaaacttcaattcagtagtgagaaagtcaagccttatagctttccaatcctttgaagcaagatgtaattctttcacttttccatagtatttcttgtttcaaacaacattctctcttaatcatatagaaaaaaatacaagagatgaacacagtaaaccaatgaatttgttcatgtattcctctaagaagagcccacatttcttagtctgtgacaagaataacacctttgagtggaatactaaacaaaggtatgaatggattcttagcaaaataagagtgtacaaaagtcaaattatcagatagctatataataatttctgtagtgtttaaaatgttcatgggcgtagagagatatgaagggatattttaggatatctgtgaaaaagtaatacatttaatatattttgatttcagtggattttttatttagttcattttgatattcctctgataaatagtacagatcgtaatatgatacagactagactttttaaactgctagtagctaataggatacttgtgatttgaaaaacttttactgaaacatacaccaaatatatatattgtggcaagtgaatatgtaaatgacttattaatagaggtccagtaggtaaatgtctgtgtctgtaactttgtgtgtgtacatatattgttgcagaaattggaacaagtatgcttaaaaaggagagaaagcaaatttacgactttcaaaggcaacagtgtgtgtttcatttataccaattcttttttgaacaaatacattttaaaattgtattttaatctttatggtaatcaacataggagaaggtacatattaagtgaagagaggacaaatgaatgaatattcatagcactcagatttctatattttactgtttctgattgttatataaaactgatttattacaaatgtaagtaatacacacatttttagacaatgattagttaggtaactgctcaaagaataattgaaaccaataaatatcaccatctgtggacatatcaggtattgtcctttaaagataagtccttggcctggttttattagattatgttatcagaatatttttagtgatctatagaatgataccactttggatgagattgccaagatctggagagagaggtaggatttcttgtgactttgaaacactggaggaatgatgcgtaataaatgacattgtattcaaaggggatgagtgtaatagaaaatagctggctaggcaaaaaccaggttgtctgaaaccagttaatgtgcataagcaatgtgatcttactaaaagcatccttatgcatcctgttttcatagagtggcgtttgttcagttaaaaacaaagcataataacgaacaaaaacttgaatgtcctcagagcaggatggctgcaagtattagaaaacaattctcagtctgagtcagaacaagtgtgcagtttaatttctatacttcaaaactgatgggatgaacatgtgtaagacttggagatggcaactaaaatgagtaatgggctggaaaccaggacctctaaagaagggttcacggagttactgtcagtttgaggaaagaaggcaattcaagtacatgaaagactgtggtaaaaatgactccccaatgaacaaatgtgtgaaaaccaaaatatgtaagattaagtaaaaataagactataagaatttcatgatactatagtttttaaaaggagggtttttccattgttaaataattatcaaattagaattagaaagtctcttaactgtatagataccagtaatagctatatatgacaatatagaaactccttcagtatttgttctccatcatttccaaaacaacaacataaacacaaacacatcgtttacatatttgctaatgcataacctgtcactgataattgtaggaaagttaacgtgcaaaccatttaatgcattaacacagatcccttaattacttgccttaggaagggcatgtaatgggtgtctgaaaagactaatgtaaactacagtgcccagacatttcatagtcctgtgaatactgagggcttaggctgttgttgcactatctgtggaagaacagttcaggagtcagtatgcttatgagttggggaaagattaagatctttacatacaccaaaaagctcgtgaaatctgccccatgagaagcatgataccaagaaacagcatgatggtagtaggagatagacgatcccaggtaataggggctttccaagagagtgtgaggagcctataaactataggatcaaaactatctaggttcaaacccaaatctttcagtaacttacatgctttatgctttaatttcctcatttgtgaaatggcagtgatgatcatgataccgatctcaccgtggtgttgtggggattaaatgaattattataattaaaccccttaaatcagcgcctgacacagtacaaaacactgtatagggttagtattatttagaatgatttatatagctttgatgtgtttaaatacccttcttgaaccagtgtattttgaaatggtatttcaatatccagacttaaaatgaccatttgggaaagggtccaactttccggacaaattcagatgagcaaaattctttgaattggagattcaaaagagaaaagagaattttattggctatgattattttccaattgtcgctctttttactgctatgtatattttatatctcattttcatttacatctattgtaaaccaaataacagatttaatattcctgttagcatcacttctactatttccttttctgtgcgtgtgcatacatgtgtgatattctttacatgacctggtgtgtgcttcatattgcaactgcaattcccctacaaagagggaaacatgatgtgacaggaggctgtgtctaaagacagtccatgagctgcaggcagagctggtaccatttgtgctggccttttcccaggggtctacacgtcaaatatgggcatcagactggctttctggcttttgactgaactccagtagacataatatgaaaatgaatgttaaactttgtttctgccatttttgagatatttaatctatacctattgttattcttctaaaaaaataacttttttggcaggtactgctcttagcactggggatacagtgagaaatcagacagaggtttctgcttgtaagaagctatcattgtatagataagtaaataagcaattcatgaagataatttcctatcttcaagtactattaccaaagaataaaatagataagcagataaagcaatgcagagtaacaggatggagtgtcctattttaagtggagttgtaaggaaacatctctttgaataactgaattaggaacgcaaagtgagttaagcgagggagcccaccatgtaaagacctggatgatgagtgatgaacgttacaggcaatgttaagaaaatgtgcaaaaagcttgagtcaggaaagaatgtaatgtattaatgaaacaaaaaggaggcagtatggataaaacagagttgttaaagggaaaagcctttcaagatactatcatagaagtaagtaccctagagctatttgtataggaatcttgcatttaattttattctgagtgtatatcattgcaagaatttaagcagtgaaatgacattgttatatttacatgtttttattgatacataaaatttgttcatatctgtgggatacattttgttacatgcatgcactgtgtaatgatcaagtcagggtagctaagatggtcatcaccatgagcatttatcttttccgtctgctgagtacatttcaagtccacgcttctagctatttgaaatgtacagtacattgttattaactatagtcaccctactctatgatcaaacattagaacttattccttgttccttccaaactctcttcacacgcgtccccacccctgcatccttcccaggctctggtaactattattctcctctctacctccatgagatcaactttttagctcccatatatgagtgagcacatgggatatttgtctttctgtatctggcttatttcacttaacataataactcctatttccatcaatgttgctgtaaatggcataattttgttctttttttagctaaatagtatttcattgtgtatacataccacattttccttatcttttcatctcttgacggacacttagtttgatttcacatctttgctattgcgtagtgccgcaataaacataggggtgcatgtatgcctttgatacattgattctctgtttgattttaagataaatatgtagtagtgagattattcaatcaaatagtagttctaattttagttttttgagaaatatctatattgttttctataatggcttctactaacttgtattcccaccaacaatgtataacaattcccttttctctgcatctttgccagtattaatgtctttttgataaaagtcattctaagtggggtaagatgatattttattttggttttgatgagattttattttgggtctgattttcatttccctgactcttactgatgttgaacattttttcatatacctgttggtggtttgcatgccttcttttgagtagtgtgtatttagatcttttgcgcactttttaatgtttggggtttttttatgttgagttgtttaagttctttgtatattctgtgtattagtttcttgtcagataaagattttgcaaatacttcattcaacagtttgtctctttattatgttgattgtttccttgctgtgcagaaggtttttggtttaatatagtcccatttgtctgtcttcgttttgtttcctgtgattttgaattcttacccataaaatcttggcctagaccaatattctggagtgtttctcttatgctttcttctagtagttttatagtttcaggtcttatgtttatgtttttaagtcattttagtggattattgtatttgctgagggataagcatctagttttattcttctgtatatggacatccagttttcccaaaaccatttattatgttttcaaaattattaagattttgcatggagaatacattgtggaggccacttgttttcacacagatcaatgaacagaatctatgtactcagtggagattgtatacctagtccatagataattatggggtgaaaacgatgctatctgtgatgaggtaaaaagggattcaaaattttctttggaaatagacaccttgatggactggttgtgaatgttgacaaaaatatttattcacaaacatttattcacaacatctcagatgtcaggggctgcttttctccttgtcttatcaaagggaagttgacaagaaatcatatgtatgtacaaatttggagctcagggagattttatttctgagtatataaaaacagatgtcatccacatacagattatgtttcaagtcatgagaacagataagatcatctatgaaaagagtatgatagagaagaataaagggccataaattcagctcaagagccactaacatacagagttaatttgaggaggaagagtaaggaaatatcactagtgaggaacagccattgaagcagaatgaaaagcagatgttttctataggctaaaaagctgtgtttttggaagcagggagccgtctacataatactgccgagaagttacttaaaacgatgttaaaaaaaaaaaaggtttatacattggatttagtaagatacacgtcagtagtaatcttcctaagaaaggttttaaacagagtagtggggcaaattccaaaaaaggaggagatcaaaaagaacatgggggtgagatggggaggagtcaaatagaattcacaagtagtaacaattcctttggagatgtttttctgtgaaaggaagcagagaagaagtgcatgtggacacttactaatttcaataaggagaacagattaaacatttaaacatggaggtagattggtagatctggtattggaaaaaagagtctgttctcttttgcttgtttgcctttttttctttcaaagtggtatataagtcacaattatcagctgagaataggagaagtggtattggaggtttgaggaccaaaatgtgataaaattgtctcaaggaatgaaaatgaataataatgaattagtgagatgcaaaatttatcagtacattttgtttttctttcactcaggattttgttctatgactatttggaaaccaacaagaaccctttttttgttacgacaactatattttaagtcttgtttaatatatttttatgtgggtcctcatagtctagtgattagaagtatgaacttttgagtcaaataggcctgactacaacaggttaaattccttaattgtataagcctcaactttaagtactcaatggggataatatatttggggtaaacagcttgagtttgaacctgaactccgctgctgattagctgtgaggattcaggcaattcacttatcaggaaaattagaataaaaatacttctaacaataataatgttagcagtaattacaccactcagaatctggtgcttgataaatagcatcttcatggctatgggggtttgtttgtttgttttacattttaattaaagtatttcctcttatttcagtatcagttgagtccatgcaggacagacttaacctattctatatagatgtaaagattggtcctatacttagctaaagtataaagtttaggaaattatttcaaaattatgcatggagagcagcaaaggtttgggaaaattttgtaacttctttctgcaaacaaatatggaatatttaggctaaattactctcctaggagaatcaatttttaaaaagtttaacttttaaaacttagttcatttgaaaaacagtcagtcaagatgtccacaaataaaagtaaacattttgattgtctactctagggacgggattctagaaaaaccatggaatttttgggaaaggtcatttggctatactagtagagagaaggtcacatctcaaaatgtcattccttccatctattcataaacaaacaggtagtgatcttttggtagagatccataatatctccaataaagtctgggtttttaaatgtgcaccaacttctattttgacaatatcaacataaacttttaaaatataacctatatttctgtcaagttggccttgttgcttgggtcctattttatattgactcacatactttctaatttttttttactttatctccccatgttaaaatcccattcatatttaaggcctaattcaaatgaaaaggaacttccccccaatacttttcattcactgatgagcgctccactttgtaaatatcttgtgcttgacttttacctcttacatgtctctaaatatttgttaacttacagagtaatatcaaatatatgttatgtgtgtatatgtgtatcatctatgctctcagctcttttttattcttttcagatggagtttcgcttttgttgcccaggctggagtgcaatggcgtgatcttggctcactgcaacctccacctcccaggtacaaggattctcctgtctcagtttcccaagtagctcggattacagacatgcgccaccatgccgggcttttttttcttcttcttcttcttttttttttttgtatttagtagagacggggtttcaccatgttagtcaggctggtcatgaactcctgacctcaggtgatcacctgcctcagcctcccaaagtgctgggactgcaggtgtgcacgacagtgctcagcctgctctcaagctcttggaggaaggaattggtcatataagttttgaacgccttcgataatggtagtttatacggcacatagctgaggcgggtggatcacgaggtcaggagttcgagaccagcctgtccaatatggtgaaacctcatctctactaaaaacacaaaaattagccaggtgtggtggcatatgcctgtctactcagctactcaggaggtgaggcaggagaaccacttgaacctgggaggcagaggctgcagtgaccaagattgggccactgcactccagcctgggtgacatagcgagactctgtctcaaaaaaaaaaaaaaaaaaaaaaaagaaaagaaatatttgaagaagtcagttagtgtcagagatgctgtgctgttccacccagatctcctttcagtactaaaggattccttcctctggctgctgggaagattgtaagcagaaggctctcgatccttttggggaaatgctttggttgaagataccaacaccctttcactgagcaggtcacagccagtgcttgtgacatgggagtatgaaggcacaatgccctcaccatacccagaactactctccacagccaatccagcttcagggttgcttcagggttgcccaaggtcttactgtgactatatcacagcctaatctatagctctcccaattcctactccttcctctcacacactgccaaattggtgttgaccctgagacagcatgtcctgataaatctcctgcattcacatctctatacagagtctgtttcctgggagacctcaatccatggcattcaggaaaaaatgctgcaaactaaaaagcacatttttatgatatgctatttttcaagctttttgaatcacatctgctattggcaatggcatgttgggctttatttgttctttaaaaatatacagatagctatgaatacacttcatcttgaggctctaaatgatcacattttgttgtgactaatattcattaaaaagacaggttaccacagtaatatgatgtaatagcctttaagtactcaccctgctagtcaattattaactaatatctttattagttaaatccatatatggcaactacataaacctctatttcatgtgtttgatttactgcctattttaactacattgtatcctggatcaattgttttttatccaaactttgatcattgcaaaccttagtaagaaaaaggttttctgggattgactttctgtctgctttgcactagaacatatccatgcttaaaaaaaaaaatcacattattcaaattcctgcttttttctagttctatattatatattacatatatttctctagtttgttttagaagttgtgattaagtccttttgcataggttgttacaacagggaactattgattaaattagtataggaaagtaatgaccagctatttgtactctttcactgtgttaccaaatttcagttctgtgctctggtttctttacagctctatttagtcagatataagaaatagtaattgagattttcaaaagacaggattcatgatgatgttagacaattcatatgtggtttagcccatggcctcatgggttatttgaggtcaaaagtgaccaaatattttgtgtctaagtgccaccaaaatgcagacttcaaagaatctgtcatgctgcatatcctgaccctggttctgtgtcagtggtccttgggctgtgagggacactgcatgtgggcctgtgctctgatgacaactgcagggctcacaaggaaaggcttataaaatatgaatagacaacctccactccatccacctgtccctccctttcctctttctatcaataatgcacagctggtgaggagagatcaaatacaactcaaatcagccacttcctcagccaagggttctaagcaaaggtatgtcagaaatgaagaaaatgccaagttcctgacttcgatttgaaaatataaaatataatatttctatataatatgtgttaagttgttttttatttttgtttgtttgtttgttttgagagagtctcgctctgtctccaggctggagtgcagtggcacaatcttggctcactgcaacctccaactccctgattcaagtgattctcctgcctcagcctcctgagggcatgtaccaccacacccagctattttttgtatttttagtggagacagggtctcaccattttggccaggatggtctccatctcctgaactcatgatccacccccctcagcctcccaaagtgctgagattacaggcgtgagccaccgcgcccagcctatgctaggttttaactgtacttttatgatactgtccaggctgagattaagagcaatttcttactgattaaatatattaaaatatattaaaatcatataatagtgaatgtgtatgaatgtaatgcatttcttccaagtagactaagctttagtgtagagtcaaatgaatactcctttaaatgaaatagactcttttatctgtcactttatcctaattcaatttccttgctaaaattaaaaaaaaaaaacattttattgtatctttttatctgagaaattcagtttatcaaaatttacctcattaatattttacataaacctcttaacctagtcagagtatatatttctataactcagcttcagaaggaatgaaatatgataccataaaccctaggatgtagtgatgccccacttgttcgattttccctcaaaaagttgtatgcagagtctgtggtttttgttcgttgtacccctaatgccttaagctcaagtcatatttgttgagtgaataaagactttccaaaggaatagacaggaagaggatatttaaattgtggtgcatttagatctgcattactttttatcctgtgatgttgtggcatctttcccagccacactgacgtaggggattctttccagtctccaggatgctactcttctctgttttctcctttttctgacctatgctttactctgatgttttccatgtcttcttcagacacagtttcttccccatctaaccagtgttactgagtttactacatagttattgagggggttgtgttatataagtctggggattgggaagtggttaagtagcttttaaaaagagtatcagccgactttgggagtatacacactgccaagacttttttttaccctctcagctaggtaggctacagggaaacatcagcttttacttttgctattgtaacaatctataatgagctagagtgaacttaataaagatcttttatttctgtgttcaacaaatatttataaattaacttctaggctttagtcacttttatcctaagtgctgggtatacattgaaaaactatgcacaaagcccttatcctgatggagcttacaactgaatgataggacaagggaaaaatgcacatatatgtattttcccataaatatacataatatttatacagtctgtcctccatatccccaggttctgcatcccaggattcaaccaaatgtggctcaaacatatttttgaaaaacaataaaaaataatacaacaatttaaaacaatacacatttaaaaatatagtttggcaactattacacaacattaggtattgcaagtaatctaaagatgatttaaagtgaacagccatatgtgcataggttatatgcaaatactatgatattttgtacccatataagtgacttgagcactgctggacagagtaatatgtggagcgtaattttttgtaggatgatcatagaatgcactttatgctttaaatgagtggggatacgaattaagtgacagagttagctatagggttatttgaggttaatagtatttcaagagaacacagtgaaagagggagagagttagtagatgaggctaaatcacaaagggccttgaagggccagaagactttgtattttactctgagtgagactagaaatcatttaggggtctaaacaaagaacagatataatctcatttaaattttgaaagcatcactttggttgctgggtggagaatggaatataactgctaaagaaaaatttatttatgttaaaaaaaacgttaaaggcaggaagtccagcacaggaagagtagactcatcaggaaccagcctacttccatctggttccctctttattctccacctcatggtctaagatggttgtctgtgctctagcgattccatccataatctaaccttttctttgaagactttctggaatgtatgaccgttcagcagcacaccactggcgagaattcagttcagtgaccttgcatggttggagggaggctggcaaacacattctttaacctagccatttgtttgcctggtcaaaaagaaaaaaaaagtcaaagattttgaagcagtcctcttactgaacatttagggaagcatcccaaaatagtacaaggaaggaggcatgtaaattgaggaactctatttaaacaactgaagctcaagcccaaggacttacaattgggtcttttgagagtgagcatgtggacaacccattgctcagagtacccaatcctctcccctgccagctcacagttggctgcccaccctactcacccacacacattgtttttgtaaactttgtagcttcgtgcacttcttcacaggagccctctcaaatcacagattaaattatcccactccgtattaccctgtcattaacatctataccccttttttatagaacttaacacaatttgtaattcatgcatgtataattattttattaatgtttatctctcttctaaggctttaaaagacatgagcaggatccatgtcttcttttcccatcattgcattttcagtgctaacacaatgcctgatgcatagctgttgactggaaatatctattgagtaaataaacatcgaggaattcacttagtattgtatagtagaaagcaagacatggggttgaatgtaaaggtcttagtgctgaactctaggagactagaaatttcctggaaacattaaaataaacacatcaaatctattaaatatttttcataatatatgttgctcatgtatgtataatgaccaccataataactcattccctctttataacacttttaaaaaattcaagagtttggaaagctacaatttaaatatcaaaacatgatattatttttcaggcctaaatgatagtttttattctattgggaaatatatggaatgtcttttgaggaaaaacacctgctcacactttcaattttatactattttttggtattatgtttctcaataaacttagataaaaatggtataaatcattaatataacatttttaattctttagaaatttaaaaatctggatgaagaatgttacagaacacatggaactaatttcagaggaaggtcagaaacataaaagcaaattacttggacaaatctgagaactatttttcattaaaaatcgacgtccaaactcatcattatatgcattgttatacacatattttatgggtaaggataatggaaatgcatttggaagctgtcgttgatctccaggaaggactgttgctgctattcaatgaagcagagagtttgtctggcatgtgagacaagctattttttttttttgagtcctgtggaccatgcagatagttgatagcttctcacagccagactgacactttttaggtagaggtttactgtagcatacaagaaacagtgacctgtgatacagccaaatgactgctaaaatggtatgaaaagagatttcaactccctatggcactgctaatgtacctgaaatttttaaagtgcattttagtagttatgaaagtatccagacagagagcactaaagtctggtggtgccctcactttatccacctcaactcccagcacagagaggcatcccctgattgctggtatcacttgtagtggaaactcaaggcatgtgcaagattactttattctcaatttgctcttggccctctctgtttgacctttgcctctctgctgagatttaaagttagtggaattcaggagagagcttttattttgatatacacttctgtagagactgacctagaaatagactgacttattatatgtaagtgatccgatttgcatactgattctctctcactgaaagcttgagccatatttgactagtgagctctaggagatagatttcatagcctacagtcaatacagataatcttctgattttcaggggtacattcttctggcaaagctactataagttaaaatgacattagtcaaattttctgccagaagaagtcacaaaagaggattctttttgaagacctggtagtcagcctcttgtagataagaagacacttttagctgggtgcggtggctcatgcctataattccagcactttgggaggccgaggtgggaggatcatgaggtcaggagatccaggccatcctggctaacatggtgaaaccccgtctctaccaaaactacaacaattagccaggcatggtggtgggcgcctgtagtcccagctactcgggaggctgaggcaggagaatggcgtgaacccaggaggtggagcttgcggtgagccgagatagtgccactgcactacagcttgggcgacagagcaagactccttctcaaaaaaaaaaaaaaaaaaaaaggacactttcactaaggaatggtaatgtatgaatgaataagttgaatgaatgatatatttgtagaatataagactagactgtctaaaggtcatatacataaaagaataatgcattgctaatcatagaaaaatacatataatgtgattttgaacaaaattgttgcttactgaagatgcagtttcatattttgcaatgcttctgagaagctgctgaccttagagaaataactttatctctgtattcataagtatacatttatcagtggggttaatacctgtttcacagattgattttagatgtagaatatcagctaggagttaaataaggactggatttgtatctcagctctgtgaattagtagaagggaacccaggtgatttactaggactttttaagtctgaatgctaatagtccccaatattcattcccttttactcacttttggtaatcatccaccttcccttggagctatgcaaagtcatatgactaaattttggtcaatgggatatgaaaggaaatgatgtagcacgttctcaatctcacccttttaaagcacctctttaccctccactgctctcagatacttccagtgggcttgaatgtagacatagtcatggaaagctggtttcagccatacccttgaaagcaatatctggaggatgacagaaccaacagacagaaagtatctgggtccctgatgattgctcttgtgaaacaaaggtgccttgctaacttgcctgtaactttcagctgccatgtaatagagaaaattctatcttattgaagccactgtacttgtgtgtctgttatggtaacttggcctgtaaccagaaaaccatcactttgagcaaagcactagaccccagatttttactttgataatccataaacatgatgtataatagtaatgatactacttataatgttatttttaagacaaagcatttcatgggaggccaagacaggcagatcacttgaggtcaggagttcaagaccagcctggctaacatgctgaaacccaggctcaactaaaaatacaaaaactagctgggcatggtggtgggtatctgtaattccagctactccggagactgaggcaggagaatcgcttgaacctgggaggtggaatttgcagtgaaccgagaccacaccactgcactccagtctgggcgacagagactatgtataaaaaagaatttcaagccaggcacagtatgcgtgcctttagttccaactactgggagggttgtggcaggagaatcacttgaggccaggatttcaaggctgtagttggctaagattgtgcctgtgaatagccactgcactccaatctcaccaacatagtgagccatcatctcaaaaaaaaaaaaaaaatttaatagtgcctggtacatgatcagcacataagtgttacttatgcttattttgtattcttctaattattattatatctgttatttgtgtacttaaaaaatcataaaattaaatattttcatcctcaataagacatattgagcaatactaaaagaaagttgtgattgaaaataaaatctttatcaatgtcatgaaattattttcttttttaaccacaaaaccctttcaagaaaattactgaaatgagtttttgactttgatattgatgcagatttatgtttttctattgttatatgtgtgttcctgttacatatgagtgttttgcattgcaaattttcaaagaacatatactgtttataattattttttacctttgaaaaaaaattttttacttttcaaagttgccatccaatccgggctggtactttgatctgatctgtgaccttaatgccacatggttgttcttaaacagggtttggaacacctcatttaaaaaacaagtgtggatggcttcccctttactgaaatatgttgtgcaagttccttaacatagcatctgaaagactttttcaatctagcagcaaattagttatagcagtgggcattatcctggtgtattagtttattttcccattgctaataaagacatatcagagactgggtaatttacaaaataaagaggtttattggacttacagttccacatggctggggaggcctcacaatcatggcagaagttggaaagcaaggaggagcaactcacgtcttacaagaatggtggcaggcaaagagagagcttgtggagataaactcccatttttaaaccatcagatctcatgagattcattcactatcacaagaagagtacaggaaagacccgccccataattcaatcacctcccacttcgttcctcctacaacacatgggaattgtgggagttacaattcaagatgagatttgcgtggggacacatacaaaccatattattctgccctgactgctcccaaatctcatgtcctcacatttcaaaaccaattatgccttctgaacagtctcccaaagtcttatttcatcattaactcagaagtccacagtcaacatctcatctgagacaaggcaagccccttctgcctatgagcctgtgaaattcaaagcaagttagttactttctagatacaatggggggtacagacattgggtaaatgcagccattccaaatgggagaaattggccaaaacaaaggggctacaggccctgtgcagtccgaaacccagtggggcaatcctaaagtgccaaaattatctcttttgactccatgtctcacatccaggtcatgctgatgcaaaaaatggattcccatggtcttaggtagctttgcccctgtagctttgcagggcacagcctccctctcacctgctttcatgggccggcgttgagtgtctgtggcttttccaggcacatggtacaagctgttggtggagctaccattttggggtctggagtatggtagccctcttcttccagctgcactaggtggtgccccagtggggactctgtatgggggctccaacctcacatttcccttcctcactgccctagcagaggttctccatgagagcaccatccctgcagcaaacttttgcctggacatccaggcatttccatacatcctctgaaatctaggtggaggttctcaaacctcaagtcttgacttctgtgcacctgcaggctcaacaccacatggaggctgccaaggcttggggcttgcaccctctaaagccacagcccaaggtgtaccttggccccttttagtcacagctggagtgactgggatacagggcaccaagcccctagactgcacatagcacagggacccagggcccagtccacagaatcatttatttctcttaggccttcaggcctgtgatgggaagggctactgtgaaggcctctgacaggccctggagacattttctccattgtcttggagattaacatttggcttctcattacttatgcaaatttctgcagctggcttgaatttctcctcagaaaatgagatttaatttctattgcattgttaggctgcaaattttccaaacttttatcctctgctaatcttataaaactgaatgcttttaacagcactcaagtcacctcttgaatgcttcgttgcttagaaatttcttccacaagatagcctaaatcatctctctcaagttcaaagctccagaaatctctaaggcaggggcaaaatgccaccagtctctttgctaaaacataaagagaatcacctttgttccagttcccaaaaagttcctcatctctatctgagactacctcagcctggatcttattgttcatatcactatcagcatttttgtcaaagccattcaacaagtctctaggaagttccaaacattcccacattttcctttcttcttctgagccctccaaactgttccaacctctgcctgttacccaattccaaagttgcttccatacttttgggtatcttttcagcagtgtcgcactcccagcacaaatttactctagtcatctgttttcatgttgctgataaagacatacccgagactggacaattcataaaataaagaggtttattggacttaacagttccacgtggctggggaggcctcacaatcatggtggaaggtgaaaggcaaggaggggcaattcatgtcttacatgaatggtggcaggcaaagagagaacttgtgcggggaaactcccatttttaaaaccatcagatctcatgagactcattcactatcacgagaaaagcgcgggaaagacccaccaccataattcaatcacctccaaccgggttcctcccacgacacctcggaattgtgggagttacaactcaagataagatttgagtggggacacagacaaaccatatcccctggtctgatttttctcaatgcgttgcacatacaatcgccatttttttcattttcataagaatctttgttatctatgacacttattttaagaaggtgtttcttagaacagtacttctgacagatggctcatgagaactgaaatatatttataaaaaatcatgatgtattgtggattattctccttttttgccaatacctaaggtgtgttaagtattaaagtctctgagcagtccttgagaaacaaaacataatttgctttaacccagtatttccaaacatgttactgaaacacattctttattaatctcagacaactagttgtttggatcccattttgagaaaccttctccaaaatattgcagtcgttagtatcacaagaaatgccattgcccttctctcatcgtcacagacacaattattatactctccctttgatctgtgctgctgtatcactttaccactttattgtgcttgccttactctgttttgtactcatatttctttttcacatgtgactccctatatggttgtgagttcatttaaaatagtaatctgttttcttctttctgttatcctacattttctaatagagtatacggtggggaggtcggagattattttctgtatttcatccctcttttggttggagtgtgaatgtgtaagttttaaaaaataaagcatgttaagacttaatcaaatgagagttgcctttcaaatggtctaagatgttgtttgtctacataattcttcctttgattataagttttatgcaactttattggaatcttcatctagtttcagaggctagaattcccttaattagtttaaacagaaaaatattttctaagtattaaatcactgggtagggttgatgaaacagattccagattgagctgtcaagaacaagtcccaaaatcatatcactgagttaagtaagctacccaagggaggtaatgccttttctgtgatgaaaagccatcggcttgagaaccagttcatagagccaagatcaggatccattcactgtcaggaatcatgtatgctccaaaaaccacaaggatcaggaaaatacgtctactattgctagattcagaactgtattagacttaattcaatcagccatgtctagcccctactggcctccaaaaacgatgatggaacactggaaacctagctaatgctgcagaaaaaaatagaaaaagtattttcttcatggccaggttttcaaatagaaatgaaaacactgcctctgcctcactttagttttccaaatcatctttaattgtatctgattggttgaatttatcatctaaaaccttggcaccagtgagtttaggaaatgtatccttctttctagcctttactatgctgaaaggcacacagaaggaaagtgaaatggatattggagccagaccaaagtttatcagactaactacatatctcaatcttttattcatatgtaatgttctttttcatttacataccttcttacctttctgtgtccctctctacttgatttcctgtgccctactctctttcttcctgcagtttatggcgtttgagtcaatagtgagacttttaccttcccaccttaatgaattgtatacaataagggaggagcagtggcacattcatgaaaacatatgctctgtgttaatattctaatttattcataacgagcatatctaatttattcttctcaatatttccatattgtagatattatcccattttagtaatgacaaaactgagtcactatgaataattacatatcatagctcatgcatcctataaatttgcgaccccatgttctcttcatattactatgtagtcaaagattgcctgcaatttgaaacacactgaactccattttcccacattttgcctggaaaatgaaggttgagaatttatagcacactgtgcaaaaacccatgttactgtttgtcatgggacctgttgtatggtgaatagcacagttttacttatgcatacacatcaattcttacctcactgaaaggtgatgctatagtctctgaacctcagcatctacttcagcttccaattgctttagtctctgaggcttcatattgctggatattttacatgctctgtcaagtcattctagaaaaatcacctactcattagttcagcacaatggaaatttgtattatctgccataggatttcttcatatttttcacttgtattgtctttacttgttaaatatccattagatatgataaaaatctaattaaatggaaagcctgctaatgcagtctatgatattatgaatccattcctgggttcatagtatactaaacatcaatacaatggatataaaactgtggctatttagctacactttaattccctctgaaatgccactctggcatcagttgaaagaaaaatggaagaaatgtgttttgaagctttacattcattttaacagattaggttctagttccctaaaataccaagatttggaaatcatttaactcagttatgtcttttcacttcattgtattttacttacagattctgtgctcataatagagtaactgtaccagaaaagaagcaacaatgataaacagctctataaacaaacataaacttttagtgagatttacacatttgaagatacttctttgctaattaaatgtaaaatatactatgaaagtctttctaccttcttttaaagtccaagatttatatctaatttaatatatcacaaatattaaaatgtataatgttatcaaatattatataaaaaatagttaataccataaatttaactattcccatacagtttaatgaaaaaggtaaaataccttaataatttaatttttgttttatctatctattttaaagaggccacagtcacactatatcccttagcaatcatttgggaataaaagaaaaacaataaaatgtaaagtataatttagagctttttagtaattttgagacatatataatccacaaatgctgctaaagaaattatcctgtcatatttgcacatttagttgtacaagcatgcattaaaaatatatatatttaaaagcccttctacattccatatgcttttaagtgcaaaagacaaatagattgaccaagaaaactacgtttcattacctttttgaatttatacacaagtgatggggagatataataaaagttataaatataactaaataattttagttgcatagtgctataaagaggaaaaacaagacccatgaaaacatgtaagtgatctggatccagcccagccaaggcagaaggtggaagtaagagtataagacctcactttaagctcagagtgaaggataagcaggagttagacaggaaaagtagggacaggggtgaggcatgggataggccatggagggagagcattccaaggaaacaaaaaatctgatgctccacaaaatgtcaacaacccacggccatgggagaagagactggtagttctaaattatatgaaaccttgtaagatatactgaaacttttgaagaaatgcatcagtgtagcttttcttattctatgattgggcatgcattatttgtagagaactggggtatcattgatacagaatgctactgaggtactttacttataatgtttattgagaatgaaattatcccatacatttagattaaacaggaatgaaggaatgaatcaagatattctaatttcttccagaatttttctttcctttttttttttttttttttttttgagacagtgtctcactctgtcacccaggctgaagtgcagtgcagtggtgcagtggtgcaatcatggctcactattttctccacctcccagtctcaagtgatcctcctgcctcagcctcctaaatagctgggactacaggctcacaccaccatgcaaggctaatttgtgtattttttgtagaaatggggttttgtcatgttgcccaggctggtctcaaacctctgggctcaagcaatcctctcaccatggcctcccaccacatgtgatctcttccaaaatttttctaaatactttagtttgatttgatctattcttattttgttatttgaagttaccaagtaactcatttttctaatctgtccattatttagaggtaagtgataactgatttatgttcatcagagtttgtgtggagactgggcttgggaagatccattttgcctgtaagactataaaggattctctttctaaatccctccaagatctttacaatcccactccatttcacattttagtaaaccctgagttatcattagagttagtgttaccttcattttcttcttccaattactcagaatgcataggattcctagggtagcagttcttaaaatttaatgggaagtttgattcagtaccctgggatagagtttgagaaatctgtgttattaaaattacctttcgctcactgttttgcaagacattcgcagatctgcatgttgactgttgactactgtttccttgaaagtaaaacagctgacaaaaacaaaattatcgatgacagaaaaaccatcaagtgcaagtaacttgagtctcagatcagtcatctctaaataagacagtaaattttatgtatcaaccttccaagaggaagtctatgcctagagcagacttgctgatatagcaaactaaaaatgcaaatttcagagtatgctaaaaatttctatttttgttcctgttaatttttcaaaggaattcaagccttttctgtatacatacgggctcaggatactgccatgcaagtcttatttttgcatcccaacattagctggcatacagcttgcagaaaaatacctagactacctggcaagagtctaattttcactttcttgtaacttgcatctttgttactgttaaagtattgaaccagcaaataggtttagtttaattgtcagagtaattattggccttaacacatggcctcctctatcataactgtcatccttcacactgttcatttcttatgtcaaggcccagaaaatgattaatgctcacaacaaaaatgagattcattttttaaagttactaatgtcattgcacatacagttaatgcatacactatgtttaagaaatgagtaattctgcaggtagattgtcatacggaagataattttaaaaaattgacctctgacacactataggaaggccatatgattctgtaaaaattaacagatatgttttgataatctcagattaaaacttttattccttttattttgcctgagggaaaaataactggtatatgtatgagtgtgtgttaatctttcatcgctataaacttttgaaatatgttcagtgccatgtttgatataaatatactttgtaaaataaataacttttgtgaaatattgggtgcttttacaagataccagtatactgatacaggaaaattagtcacagtatgacacactccagggcaaatcttgggtcccatagatatatagtatatagtgagtcgtatttgctcactgctactcaaagaatcttcagtaattattttcctttgacacaaaaataaaataattagaatgggatatatacccagacacacatgacatccacacatacagctacccacacagaagggtcggtgtgagtgtgctccttgtgtagggggagggtatgtgtgtgagggtgtgtgtgctagaagaggattacattattgagttgcataataaaactgttacggtcaattagattattttttgactgttcgtttttaacttttataattaaagatctaccaagaaagtaaatgtgctggaaggaaacattagcatcttgtgttgaaatgttgcctcattcctctgtaaagattgttctctctacttctataggaatacaataaaatgaaggtctgctattttcattttaaagaagatagttaatatattaactaaaagaagttaatatattaagtgaatattgagtggaactcactctagagtatattaatgaaggtagtatatcagtatgcccctgataagaactaaagaaatgctttttctgatccctggagaatttaattatgaaagagagccagggaaaaaaatgatgtgaagtgatctgaaatatgtgaaataattttatcacataattaagaaaatgattgcaatgcatgaaagtttggctcaaacaataacttaaaaaattgaataaatttctcagtgtggaagtaagtcctccgctcatggaagtgcttatgtaaagactagataattcttcatccgagatactagagaagagattcccactttgcctgggagactggtaaaaattaccttgaaatctttttcagttttagagctctgtggttctaagcatgtataagtaggtttctcagtattgtgctgaattaatttctttaacttacctgtgtaaacagaaattttttaaaaatactatatactatgtaatttttctccccttttatgaccttgctgttatagttcagatagtcattatgttttgctttgtgtggtaataacagccccataccagtcaccgtgcctccacgtttttctcatccagtccaaatccacttaaaaattgtatttctccatatgttgctaagggaaataagaaatccttagcaaagtactcaaggatctgatactactacttttctttttagcctcacctcttgatgcatcgcttcttaaacgagatgatctggactgaattgtgttctccccaaaatttatattttgaagtgctaacctcaacgtgactatatttagagatagggccattaaagaagtaatgaaggttaaataaggtcatcgagccatgccctaattcattatgaccaatgtccttataagaagaggaagagatactaggaatgcatgtgcacagaaaaaaaaaaaaaaaagccatgtgaggacacagtgaaagtggccatctgcaagctgaggggaaaggccttgggagaaaccaaccctgccaacaccttgactttggactttcagattccagaactatatgagaaaatacatttctattgtttgagtcacccagtctgtggtattgggtattttgttatggcagccctaggggactaatacagggagtcctacgtttaacccccatgcaaatgtgtagagtaactaatcagtttccttaatggaagagataactaggcatttagggtgccactaggatcacaggtatagaagcccaggatgctgctgaacatcctacaaagcagaggactgccctacatgcttatttcatccacagtacctgcccctcttctcaacatgctcatcccactgaccttatgttcccatctcaatgagaactttttcaacacctcaaagagaaatacttgatcctcatttataccttctccattgtttttttttaaatcgacaattgctctttatgtaatgaattttgaatgatgtttgccttttaatttcttctactggcctgtaaactttttgaaagttttcatgaaatgttaaaccttacatccctcgtattcttcagagcaatttgtatgattttgcctagtatattcctaatgctcctgatctcaattttattttgccccattgataaaaatagagacaactagtaccctctcgtgtacattctgactgataggttcagggacctagaaatgcatatttttgacaacggttttacgacattgtgacaagctggtgggtttaagaagaattttattcaatcttaatatactaaacggtatatatctttggcatgtgtaacagattacttatataagtaaatgtagcatttcacaaattggcaataataattttatggcattatggaactttagagctataacatttcagctaacaggtatgaacattgagcgcagagttaaagtcttacagaactaagaattatggtcagaaaatatttacaggccatttcccatctagtgcttattagtggtatttatgtgaagttatcttcagtatatcatggaaatttaatgctggttcatgccttaaagataatctattataactctttattatataaaagagcttaatcctcagagaattttggtgaattgacaggttaccaagatcctaagaatgacaccctatcacccttatacttggctcctatttattcctaaaaaatcatttcagttcattcactggaaattttcattctatcatatgtatgaaatgtaaggcaatatcaaaaattaaaattatcacctaccctaaatatgcaattgttagagatgcttgagaagaactatagtagcatttctattgaagcaaacaagaattttttactataatttttaagtagtaagtaaatgtgtgtgtgtgtgtgtgtgtgtatgtgtgtgtgtattttaatctgtgtccttaacggaataaagtcaatgttggggattaggttacttttggatgcccctatcacacaatgcaaaccaagtttctggcagaatatattgctttcattactgttcattttcataaaatctttatgtaaataatattttgaatgaaaattgatgaatcttagattttctcattactttctttctaaactaggaagcattcagatgttaataacagcaatttaactaaaagagcttaaagacagatgagtttattctctcgcacaccaaataaagctagaagtgagcattcctaaatttacaaaagcatcaggaagcaggtttctcatattctgctctgatgtccttagttatggcttccatcctaaagatccaagatgaacctgcatgtccaactatggcatccttgttttgaacagaaaataaggaatgggagaagggcaaaaagaacatgtgcaagatatctccccttttataatgagttttccaataagcgccactaataacatatagttatatttcattagcaactaccatcatctggaataaagtcagggctttgttactatgaagaaaatacacattggattgttagccaacagttttctcaatgtatgctttgttattatttttgcttctctttagatgttttcacctttgtttaggggaatatgttcataaagtctagtttggaataattaagatgttttaatctttggtaactacagcatgtgatactaaaaacatttggcatttgcctcaagaaagttaatagagagaaatgaaaaaatatcaacttaattactgagaaaacaaaactaatagagaaggtgatacatagcagcatctttgtgcacaaatcacaacacataatgcataaacttctgttttcctacaggtaaaatcttagacacgcaatttagaaactaataatagagcaaatagtggataaagtcatcagtgtatgacttgtcctattggtcagattactttatttctggagttaacattaatcattatttttgttgttgttgagttgttttgtttttagcaacttaattcagactgttttaaataagaatgtattttagtaattaattcaacatcctgaaatattactttcaaatggacagtgaataattttgtcacatttaaagccagctaaagaaatcttaagattcattctcaaattatttgttttctcaaagttatcttgtctgatgtttagaagttttaacagtcttcatttttattacataacttttggtactataatgagtataatttaaatattttaaatcatttaaacaataaggaagggggatgaaagaggaagtgtttctaatgaggcaaggatccttttatgccttttgtagcacttagtccttaaggtttcaatccttatgaagaaagggtgaatatggacttccttcagataagtaaccctggcaaggtttctgtccatcctctggcctggtaagccctctcttcaaggtaatgagtattctgtgtgtatttctcttcctgcagttagactgttcatgcatgataataaaaagctaaagggattaaaacttgcttatatgccttctgatcttacattataatgtgtccacccatcaaactatttcattaaacattattattttcctaggacattggcaaatgactagtataattacttgtcagggtttttgatcgttttcttttgttttatttttgcttaaacaacaggtacaaaaaattttgccatgggtaatcccagcactttgggaggccaaggcaggtggactgtgaggtcaggagtttgagaccagcttaaccaaaatggtgaaactcggtctctactaaaaatacaaaaattagccgggcatggtggcacgtgccttttagtcccagctacttgggaggctgaggcagaagaatcgcttgaacctgggaggcagaggtttcagtgagctgagatcacaccactgcactccagcctgggtgacagagcaagactccctctcaaaaaaacaaaaacaaaaacataacaaaacaacaacaaaaaaacaaacattgccatggctattaagcaaaacttacctaggctttaattactatgtaatttttactttttcaaatgtgtggatacaaatcattaattgaagttttcaaacttacctatttggaatcagtaactaagataagtttatacacttatttcccatgcaatataaacttaattattttacatttcaaagagattgaaatcttcaaagtgataaaatacgcattaatcttttcaacacattattattaaaatgatagagatggttggaaattccgtgttatgattttttaaatgccaaattagttttctaccttcataattttttgcagtatataagctaactatgtatatatgttatactatttattactgggattttgtttttcaaacttctacttttatcagtaatagaaaggagctattgagggattctaatattctatatattgatcatagtgctgtttacctatatttttacgcgttacaatttcacatatgctacaaggtcattaatcaaaattaatggagctgtacattcgagatatgtacattttacagtatgtgtgttatagctcaataaaattttaaaatatgtattggacatcaatttacagtttattataaaacaaatgatacactgtattgatattgtctgcttatttttctttttatgaatagggactttattgtttttactttcggtatccttaatgcttagtacagtatctggattttaatggaggcttcataagagttttctgactgaaataatgaaaagtacattgaaacagaaaagtcaagtttttcaataccatcaatttacaaatgtatatacgaaaatgcatcatatttagatatggctgttgtcctcaaagggctgacagtaatactgttatttatataaaacaatttttccttatcagtaaaatttcttcaggaatttggggtttattggtactttgagagctctcctaatttgtgctaaaattgtatcattaatataatacttttgctaatgcttatttattatcttagcgttttcagacttttattattgtcaccataattttaaacctacaaaggctttactttgaaggtccattttacaaaatcaagatgattgaaaacacttacctatccatgtgtttctttatattatatacatatgttttcacttaagctgcctgtaaaattcttatctgagaattaaaaataggcttaaccaagtcctttattcatgctatgtatgttagcattaggggaaaccctaaaaattttactcaaagactatactgttcaatcataatttggaagactttaattactaggctttcaaacctgtgattagagagcatgatcctgaggtagatatggaaatgtattaccagtgatgaaaagacatgattgcaaactagagagaagagtgtgcgtaatacatgatgagtgggaaaagataaagatgagaaagttggtgtcctggagggtcgaaggtgagattgctcagggctagggaagtggtttggaggagatttaggtcttcatcttccaacagaagttggattagtactaaaagaggtgacagagggtgaggctacttaaggaaattttatagggaaacttaacaggagaacagaaaatgatacctgttttccaaccttgttagagataaaataactttttctaaggtactttgaaagcaagtttatataaatatttacttttattactcttagtattatcaatgtgttggtaaaatgtccaattgagttaatacattattattaaaattattcatatatcatgattttatgtataaatagcttgagatatgttatgcttataaaattatattcatagctaattctgatcacttaactgaactttcaaatagttctgaagcaagggctatgaagacacaatttggaatagctatgttgtgggttttcaaatgcttcttttatagaattagggttggcttagaaagtattgttttcacccgcaaaaatggcagttttacatgattcagtattacagttagaagtgtagatttgtcaaagtattccaaaatgctagcaaataaaatcagagaatgttgtattgtttccttactagatattgccttttaaaactctgaacataatgacgtaatagaggtcattaaaatccaattagtaaaagtgtctgaattttttatgtgaattaattcaaatattaagaatatcaaatcattgttttctttagatgttttgctctcattttaagtattcacttacttaattttatgtcattagctctaaaacaaatacacaaaaggccagagttggtggcttatacctctaattccagagttttggaggcccaggcaggaggattgcctgaggccaggagttcaggaccagcctaggcaacaaagtgacacccagtctttacaaaaaacaaacaaaaaattagccgagtgccgtactgtgcccttgtagtcctagctactatggaggctgagaagggagggttgctttagcccaggaattttgaggttacagtgagttatgatcatgctactgcactctagcctgggtgacagagtgaaacactctctctaattaaaaaaaaagtctataacttcaactttgcttcctcctattttaaaacttcttaagacgttttggtaattgggaaaaatttttatttttgcttgccactaaatcaatgtttttcctttcatatgttcttaatattaacaaacttatctgaattttacccttgggaatgatttttatctggtgtgcttttgtttttatgatgatatcaaatttatacattaatatcacctataaacaagctgattttaattatgtagatttggataagagcatgtttcaaagatactgctctttttatcatctttacttctatatcatgtaaatatatagtctcaaaaaatttaaaacatatttccaacctcatatgaaatttcaacgtggcaaaacattttttaatgcatgtccatttttattattttaacaaagactggagcttttgaaacattcccttaacaaaaacttcactgagaatgattgttaaaattatgtcaatgactacctgttcatccacataattttataaattatacaatttgtgaaagttataatttaatatattttatctaatatgcattgtatttcatccagtcaggcaagtgaaattcatgagtatatacttttactcttaaagattctggtaaaattaaatattatataaaattctgaggttaaaaattaaatttttgaagtgatatctgtatcatatttatcagaaaatatgaaatgataaaatgtgaaatgtttgaaatataagaaagtcaatactttagtgtttgctgacagtcttatagtacttagaaaataagtttttatatatttgggcatttttaggttatgtctatatttcttttcaagctatcattgatccaaatacagtgaaaaatagcaaaccaggtgccaaatatgatccatgtgaaagtaattttctcatggagaagtatttttctgtcttcaagcgtggcagtaaagattttgatccagtggtctgagctgtgtcatcttttctttaggtagtttaaagtcatttgctttgttatgggtatgaattatgtggtattaagtactgcagtagcactattaaacattatatcataaatccttttagaatgtggaaaagttagtgtctgaaaggccatttaaaattttccactttaattccaagctaggggcagttttgtgttccttttttttttttttttttaacaactgacataatccactaaaaatgataagtctcttagtaccactcatgcatttccagacaaaatccaaacattatatagattgttttaaaatacagattgagattgttttaaatttgtagacaaacggatgaagctatttctataaaactgaagtagcaatattaattaccatcaacagccacaatattaaaatattctgcaattccttgaatctataagtggcagaaatacttcattatgaagtagtttgtttacattaattcttcagctctctagcttttaattttttaaataaatatatattaaatattgttttctttcattaaaactgcaacttagttttttccaagatacgtttttgagaaatgaggagaaaaaaaatataagaaattaacttttttaagttctaagtcagtattctaaccaaaaatacaattttctactttgagtgctatctttaaaaacaggctatatttaaaggcaaccctggaagaattaatcttgattgttcctgtatttctttgattagttaaagaaactaagtcacaaaagagatattcctagtgttttgtcattttcagtatgtgtgtagttaagctttttaaattcctattttacttttgatataatcctcttagtgaattttttctgggaaaacatgctgtcaaacacacaaagtaaaagaaagacaagaaacagtagttaacaaagatttttgaatacttttgtgtattttagctttaaaaaaaactttttttaaaactataaattgtaaattgacatttcaatacctgatcatggaagcgtttcttgttttgaaaatgacagggttggaacatatgatttaagtttaacattagagatgtcagagctagcaatgcattaacacaatttctaagatctttagctaaacaaaggcacaagtgttcatggaaatgagttaggtacctctagaatctaaaaagttaaaaagaaaacaactgtatgtatgtcacatgaatctgttgtcctgaactttattcctgtgtcttgaattcatgcttttcttttaaccttgcctaaaacttcttgtattttatctaagtatctgttggcttcctgtctctaacatgccttccctctgtaatccagttattaaggaaatgttggacatggaccctagtttaaatataaataaaaataaattttacagttcctttttggggtttgataactttagtcaagaagaatttactgaccaatatttatcgtgatatctgctttgaaaatgagagagtttgaataatatttcattctaatagttttacatgtttattttacatcactatcttaaggcttttttaaactctatattttaactctatattctttttagcccctagatatgtgctgtcaccattacaaggactcagggacacataaatgattgggaagaaagaaagaaagaatattcaattcaaacactgaggacccttcccccttgcaaatgggcaagatgcaatgataatagggcatcaaaatataaatgtgaatataaaggtagattttagggtgctggcaatgttaaaatacattatttaggggttttaattggcaaaacaaaaagaaaagctgtcatttgatgatgctgtattcattattacttactctgaagaggcagaatattctcatgtatttttagacttaaaacagaccacagttgaacaatcctggtgaggggagagggaggaagttcccatctttcataccaaatttaaccgaaagctcaattaaatagattttaatcagacagctaattaaaagattacaaatgcagacctttgaaaataaggacagaagtgtcattgaaatgaatagcaacatgtgacaagatgaaatacctacagaagagttggtgcttctgagcagcacctttcctaaaagtcaatatatgtttgggtgatttctggtgttttgcttttacaaacacaactgctattatcaatactgcatctgaataacggtttctctagagaacataccaaatagtgtagtccatttatttatttagaatacatgtgttgagcccttactctgtggatagtgttctaagttactttgataaacataaaagacaaagatcccagacacatcaagtatatattctaactgatagaatcagatgacccaaaacaaacataaaaaggtgtaattacattttacaagactataaatgttatgggattttaaaataatagtgagcaggtgtaaggagtcctaggggttccaggaatgaaaaagaggtgaggaattttaaatgaggaggctcgtgtaggcttcatggagatggttacattttagaaaaaagaggaggtagggaattatccatataaatatttgaaggaagacaagttcaggaggggacagctggtgaaaagccctaaggcaggagcatgactggtgtgtgaaaacagcaaagactgcagcagagtgatatgatgtggaggtaaccttaaatgatggcatcacttaaggttttatagttaactgtaagtgttttagatttttctctgagtgaaatgggaagccattacaggatgttgcccagagaggtacataattattacattctagaagagtccttctggctatttcatagaacaaatgaagaaagcaaagttaaaagttaagaaaatgattgagaggtgttaccattatcctgataagagatggtgctgcctcctacggtgatagaagaccgatgacatgtggttggattctgactatcttttgaagtgagtgtcatcaggattgtctgaccgcttgatatgcagtgtgttagagagaagagtgaaggataacctcgtggcttttaggctgtataaatggaacatacatggggagggttgcaaggatatgtttccaaagcaatgtaagagttaaatatatataattaaacattccaagagggtgatctaggcctaatataattgtggatatatagatggaatttcaaaccatgagcttggataagattatcaagagtgtgaacattgatggagaagaggggagaggcgaggacatttctctggggtattctagcattaagtctggggaaataggaagatgtagcaaaggaggctgaaaagaagtaaccaatgagttactgggaaaactaaacctctcagactaaaggttgagagtcaacaatcagaatcagaaatgaggaaattattgttgaccttagcaagagcaggtgttatagagtaatgaagacaaagtcccaactgaagtggttttgatagagaattgaaagaaatgggaaaggggaatatagctaactcttctttcaaggagctttgctgctaaagaaagtaaggagtgaaatggttgaattataagatgcacatgtgttcatccttaaaagagaacatgcaagaattttttattcaaatgtttttcagtggttcacattctttttagaaatatgaaagcattctcatggatccacatcctcatcaatacttagtattatttatcttctaaattctaatcttgggtgtaacaattatataaaattatgatcttaatttttattttcctgactacaaatcagattgaacactttttcatatgtttattggacattattatctatcttaagatattgattttaaatatgtatatctatcttgaaatatctattttgaaatgtagcaggttttttctcttgagatgtatttttatctgatatttttagtattttttgtatgttttataataaactttttgacaattatatgttgcaagtaactttccaggttattggattctctttgatttattcttggatgaggaacagaattcttcttcctataacacattctttgaccattcttaatttaaagcatattttaataaatagtcacagtttttcttttaatttaaaaatatttgtattatttacttaaaagataattttgtcagatatacaattctggatttgtggttattttctattagcatttagaagatattatttcagtgtctttcagtttctgttgcttgagaaaccttgagaaacctagttttagactaattgtatgtcttttgtaagtgatctgtctgtcacaccctttccctcacacttgctcttcaaatctacactttatctttgctgttttgtagctgcactataatgtggctgagaattgttgatttttattcatgttgatttacatacataaggctttgatatcactgttttcaggactccattagttgtgggaattgctaagtgattatctagtcaaatataacctgacttttattctttccctttgggatttcagttggacacacgttagattatcttactctgtttgccatgtcttttatcctctctcacaaatttcattgacttgcctgtctcttatgcctttgaccaatcttccaattaactctctcctctttcggatctattgtactgtttacagtacaatatccattaacatttctgtgtttgttatttctaaaatgtgtatttgacttttagtatgttatctgttatttataatttcttgctatatatctttgatactttaaaatttcaatctatttaaacgtatttattttattttctgctatggataagtacaatatttgatgtccttacagttttaaatatttagttgttggtatttctctgctggttatcacacacgtccactgatttctttatatattttcagttttatactgtgtgctcatatttgttagaagtcaatatgagggaatgccaacagtctaattaggaattgttttgttcaaagatatgtgtttccttctgctggaagccagggaaagctgccagtctgagacaattacagagttcctgttcagtgcaaaagactcagatgggactcctcaatttctggtgggacccaggcataatctccagattttctatgttatttttagcatctgcactagagtaacctagctttagtacttgcttaatgtatgtatatatgtatgtgcgtatgcgtgtatacatatataagtatatatagttatacatataagtatatacacatctaaatatgtatgtgtacatagatacttatttatacaaatatatgtatatatttttttacaaacctatctgtctacttagatttggattccatcacctctaaatataagctctgtaaccttaggtcattttttaaaactttttcctaacctttctttcttttacaaatctcatatttctcaataaatggcaactaacattgttaatatacttatgttccttcaacattagaaaaaaatgtgtctttatttattatcatattttttggacaaggtcttattctgttgcccagtctggaaagcagtggtggattcacagctcactgcaggctgaatttcctgggttcaagtgattctctcacctcacctgtccaagtagttgggactacagacatgcaccaccacgcccagctaattttgtttattttttgtagagatagcagtctcactatattgcccaggctggtctcaaactcctagattcaagcgattctcccaactcagcctctcaaaatgttgggataacatgcatgagctactgtgcccagctttttaagaaaaaaaaaaaaaaaaagtgtttttaaaataacctttctcctcctaaatcctatgtggccagtaaatgtatctttcataaatattttaagttgggaatttgtcactttttgttgtgttttgttttcttcttggaagcattagagtgaaggggcaagcaccggggcacaggagccagactgctgagttttaatcccatttccactacgtaagccttatgttaccttcggcaagtttattttaatctctatgcttttgtttatttgtacaacagaagaaataatagtttctcctttatgtgcttcttgtgagaatgaatatttgttactatattgaaattgcttagtttaatgctgattctcggtaaatatttactatgattatcagaacaaaaaaaaattatatcccaaattgccagaaattgttccagcttactaatgaaataccaaaaatgagaaagagaatgacttttttttccttcttaattagtggtaagtttatggactgtggagtctgtctcaagaggtttagattcagccttattacttcccgccagtatcacattaacaaacaactcaagttgtcaaatcctcagatttcctacctacagaataaggaaagtaggaataccttcctcttagggctgatgtgataacttaaaaaaatcactaatgtaaaacatctgagtacacaatctgcacataaaaataaatgtcagatataatttttatgattagttttacttaagaattgtcatctaaatttcacatgctatcaaattatatgctttaaataaagaattatacagtgctaacttccatgtgtgctttcctaacctgttaggaagctgtagaaaacagaataatcagtttcaaaaaagcatgacagtaatatgaatgaaaatataataaggaaagttaatattaaactagtgctatggtgtctgttgtttcatgattataatgaaattgctaaaccatcactgaattgtgtgaggagtttccaggtgagatatgcaatcaataccctgagacagcagtaaccctttctttaggcagaactttataagcagtgttagttccatgattttacccaaacaagacatcacaatacaaactcgaattggaagaactctccttggccagatatctaaatttaacaggaatttaagaggttctttagtgtagggcctcatgcagcatgtgttgaaaatagtgctgaaaacaagaaatatgtaatatatggatatacttaaataaactccaggctgtcttgtttccataacattggttattttctgccaatagttttgtcctcagtgagccgtggccatgacatggaatctgtccaagacacttggtgaccaagagcctctttctagtaggagtctgagctgaaaatagcttcctgaattttttcagcatcatgcatttactgtgcagctttaagctcttccctgaacacattattgtttaattacttactgtccaatattatattatgccagttatgtaaggactccagtggacctcaagcatggtaataaaatcactcataaggtcacgtgaagttcagagttgttagggaggtacgttgcagttagcttttgcctcttcccacagtaatgttcattaatacctcgtgtgagacactgttttccttgtgtagttcagaatgctactttacttcctgacccctggaaaccaggaaatgattttattagcaggcaagagaacacacacacacacacacacacacacacacacacacacacacacacactgtcactctctctctccctttctctcttagcttttgtcccccaaagttgaataacataatttttgggaagaggaagaatccttggcactgaattgtagacccatatggttcttggagatatggtctaaaaatgtaattgtttgaaaactttagtgaaaacaaagtttgtgatactatagatttatagagcatagagaaatagaaattttccacatatttgctatgtctcccacttctgcataatgaggttgaaaaaagttactatattttaatttttttgagtgggagtactaaactaattgagtattcataatgccagtctacgatctgtaaagttaaaaaatatttttgaaatatttaattccaggaccagcgactcataatatccattttttttttttttttgtcattttgcactttcttaaagcttctggacataaataacttgttggtaaatctagtatcttggctttccctttgtcctcctacattaccttcttagatattccagaatcataacattttgcgtaaagagagtaattaagattttttatattttaaagaaaagaaatttgtttctgtgttcatttatgcaccagttccatataccaggtcagtggcagagctgagcagtaagacagttttctccgttttgaatcttggacgttttctgcctttgtatcctgtactacactgcttgtcactttcacatcctatggttgtgtcttgtttgattattttgcctagaatgttcatttttttgcctaatttttatgccaaaggaagtctcccttccttaaatattccaatggatttgctcaactggttaatatactcaatagcaaaaataggtacttcagtaacagttgaagtgtttgggactttctgagggtggagggtcggaacagggagaagatcaggaaaaataactaatgggtactaggcttaacacctgggagatgaaataatttgtaccacaaacccccatgacacaagtttacctatgtaacaaatctgcacttttacccctgaacataaaataaaaattaaaaaaaaaaagaaaatagttgaagtaggaatgaatgtctgtagggccaatcaggcttacttactttgaatatgttatgcatttaatttattttagaattattaatgaaaataagccttctgttagtagaatatgtgttttgggagtatttgagctgaaagttggctctctactttctcttgggcatgctctaccactttctcagacctttcatacttttcaatagtgaaaatctgctacatgaaaggacagaacacaaacaaaacccattagctcaagtcttcattaaaatgttgcagacaaggtaagaacagctttaaattgagtgttcttgaagacagcaaagaatttaaagcttttataaggcagaatggagcaggtacattgacattcaattggttactgcacaaatttttagaaggtagggaattagtcacacattagagtgtaggggcagcaagactggaatgccgattagtggccattgtttggaaaattgggatttagcaagaggagtaaaaagtaacataagagacaacattattgcaaataagtgtaaatcttttctttattttatttttttgagtcagagttcttactatcagccaggctacaatccagtggcacatgtaagctcactgtagcctccaactcctgggctcaagtgatcctcccaaactggtgagattacaggcatgagccaccacaaaaactttactttaaaatgaaacataggcaactcatattgcaattggccactggccactctcttctgcctgcaaatttataacaccctatcaccctgccatatatatatgtgtgtatatacatatatacatgtatatagtttatacattatctcttagttattaaaagaaaaattgtatggcaaaataccaaaacaagattctcttccatgtgtgactagcttgcagattcacacagaagccatggtttctcacttaaaatcatttcataaattgatatgtttatcctcattgataaatagtgaaactaattgactccaaaaactgccgaatatttgcaattgaaacattttatcctcaaagtaaacagacgtttgtcctagaagtaacctggtgagtgaaaaaagaaaagtaaaaagaaggaatagagatatccaaattctgatattctaatacagttgactcttgaacaacataaggtctaggggcactgacaccttgtgcagttgaaaatccatgtataaattttgactacacaaaaacttaactatcaaccggctactgttgaccagaagccttactgataacacagagtcatttaataaataattgttttatatatatatatatatatatatatatatatacacacacacacacacacacatatcctgtatacttacaataaagtaacctggagaaaagagaacattattaagaaaatcataaggaagagaaaatatattcactattaattaagtggtagtgaatcattattaaagtcttcattctcatcatcttcacattgaaaaggcagaagaggggcaagatcaggaggactttgtctggctgttttagggtggcagagcagaacaggtggaggaggtggaaggggaggcaggagagtgatatgatttgtctgcaaccccattcaaatctcaactcgaattatatctcccagaattcccatgtgctgtaggagggacccagtgggaggtaaattaatcaggtgggctggtctttcctgtgctattctagtgatattgaatacgtctcaagagatctgatgggtttatcaggggtttctgcttttgcttcttcctcattttctgttgccaccaccatgtaagaagtgcctttcacctccagccatgattctgaggcctccccagccatgtgaaactgtaaatccaattaaacctccttttcttcccagtctcacgtatgtctttatcagtagcctgaaaatggactaatggagagaggcaggcacattcagtgtaactttacagaaatatatcataatttttgcctgacttgttttgctttttcacttctctaaaaatgtgtctataccataccaatccttcttacaccatgtgctttactttcagtgtcctattcctagaagtatccatgtcacaaaataagtcaaaaatagtcttgaataattggaaccttctgtcagattgtctattgttaatttgatttctggcactgcttcttctgcatctttttcctcattgtctggaacgggttcaaaagcactcatctccatcaagttgttttctgttaatttatctgatgtggtgtctattagctcttcaattcctccaagatccctatgttgaaacccttcacctccctccttttttatttatatatttttgccacatccacagtttctttcatgatttccttgattggttctgttgtaaatcctgtgaagttatgcacaacatctggacagtttctttagtaggaatttactgttttagactggatggaattatggatttttttataatgatatcatccttaatactgtaatcattcccgacttccatgatgttctctctattaggattctcttccatagcactgacaatattttccgtagaatactgcatgcaatgagtcttaaaggtctttatgacccttgatctagaggctgaactagagatactgtgtctgggggcaagtagaccacttcaacaccttaagtattgaaatcttggggttctgggtggcctgggacattgtccaatatcaaaagaactttataaggcagtcccttactagaaaggtacttcctgattcagggacaatcaatggaaccagtatagaaaaagaattgtcattgtcccagccttcttgtacaaccgaaagactgacagctcgtgttcatctttgccttcaaggcttggggattagtagctttataggtagggcaatcctgatcataaacccaactttatttgtacataacagtagagttagcctattactggagcttgcttctcttccttactaataaatgttctttttcagaatatatatatatttttcagagtagggcacttttgtctgcattaaaaatatgttcaggcagatatcttttcttcttactgattttcctaatggcatctgggaacttgtttgctgcctcttggttggcagatgctgcttctcctgatatcattctgtacatcaaacctttataaaattatcaaaccatcctttgctgggattaaattctagaactttagacttttccccttcctcgtcagataatgacttcacttgttctcaaatcatgttagagtctataggtaggctcttttctagcaattctgcacccatgtaaaagctatatttttcatacaagataaaaagatatttttcaaaaagtggaaggtattttgcacttgcttgcacagttacagggacagcttcattaattttcatttctttttttacattgatccttaatgatagattcatttatcttgatatggaagacaaccacagctccaggcctccgtttatagtggatatcaagtagttcaactttttcttgtaatatcttgacttttatctgcttcttgggaacacttctagcatcactagtggcacttcatatgggtccccttgttttatccaaggtttatggtattgcattcaacataataaacaacatgcaagaaccatgagggatcacttttactatcatgcatattttactagagagatgaactgttcatgtagaaacaatgatcatcacatggcattttaagcacatgctcataagacttgagctcattgcaatagcaatgggagttgcctatgaaattgtgatactagcacattatgcagtatagtgaagattatacattgtggtttaatactagatctttacatttgtttacatttctttggactgcaaatagcaccatgtgctaaatgtatgcacatgttttgcatatatttttaagttaacgtaaaagttttaactctttcaatagatttgcatacacttttaagttaaaaattttaactttttcaatatatttttgtatattttatgatagtgaatgatgaaaaaaagtatctttatattttatgcatttatgacatatctaactttttctttttttgctatttctatgctacatggttcatctgcaaatttttttcaaattgtcacaaatctacaaaatatttttcaatgtatttattgaaaaaactctgtgcacagactggacctatgcaattgaaacccatgttgttcaagggccaactatacccaaatgtacaaatgcaaaactacactaatcacctacacttacattctaaagtaacaatcaaatgtaatacagcaatttaggttgaaagtacaatacttgataaagtttttactgccttaaaaattgttattttaatggagcagtcagcctgcttccttgaatttacttttttaaggtcctgaatcaaacaaagataacatagtttgaaaattttttaaatgtttctttaaaaaagggggggttaagtatcattgtttttaatattttcattcagtaaaacttatttgaaatgctattttctatattttaagaagcggatatttcaacccacctattttgatttcagacacgttaacatgtatatgtgaaaataagtcatattttgtaagaccttgcctaatatctaataactgtattttaattttatgcagcattcagcaacaattgtacctgatgagctattaaaagtgtgtaaatcaaataagcttatatcaagaatactaaaaaaagtgacaaggcaaacatgtcaacatagctaaatatggctctaggattgaatgctgttggtgttagtcagtcaggatttccccttgtgatgtctttctggtattaccattattgaatgtttacaaattaaagggaccactgctaaaaatatgggattgagttgcatatgcatgccccttaagagacccttagagatgatttacaagaatgacagaatctaactttggacatttggttagttttcacacctccttccctcttaaaacttgcattcattaggagtaactctctgaagaatctctgtcttaataaattcagatccatcaactactttatgcagtgttgcagtactcactgtttatttgttaataagtacctgaaattactttcccactcaatagatacaggactgcaaagtagatgttctcctcttttgtactttttttataattagggtacagagttaccaagtcagcaaggaaggggcactttgtatgctacttgcatggctacgaattaactgaaatagcagttaaaatgttcattttaaaaattatgtaagtgtattgggttcctaaggctactataacaaatgcacactggatagcttaaaccaatggtccccagcctttttgacaccagggatacgattggtggaagacaatttttccatgggggctgggtagatggtttcagtgtgattcaagtgcattacatttattgtgcactttatttccattattattacatactcaccataatgtagaatcactgggagcccagagcttgttttcctgaaaccagacagtcccagatgggctgtgatgggagacagtgacagatcacccggcattagattctcagattctcataatgaaggcgcaacctagatccttctcatgcacagtttgcaataaggtcggtgctcctgtgataacctaatgctgctgctgatctgatgggaagtggagcccaggcgataatactggccactcacctcctgctgtggggccctgttcctaacaggccacagactaataccagtccatgaccctggggacccctggcttaaacaatagaaatttatttctcgctgttttagtggctggaagtccaagatcaagatgtcagcactttgggattcttctgaggcctttctttttggcttgcaggtagcctccttgtcactgtgtcctcacatcatcttttttcttcgtgtgcacatccctagcatctcttttttatacatttcctcttcttagaagaacaccaatcagattgttttggggcctaccctaacagctgtcatccatttaaacttaatcacctctttaaaggggttacaaatacaaatacaaaacagatacagcataaagtcacattctaaagtactggaggttagggcttccacatgtgcattttaggggttcacaatcctgcccataacagtaagtatcgttttctcaaggaaaattatttttgatagactaggtcaagttattctctactcagcataattataattaaacaattttaagcttagctttttaatgcctagggatgcttaaacaatcatattcactctgttcctatttcctttcatatgcttgctcatagtaaggactcagtaaatatttgttgaatgagtaaattacaattcctataattaatataattctcatttgcactacgtcagttctttttcatatgctatattatttgctcttcaaacaagactctgattaggtaatctcattacccctttttatatattaataaagaaaaataatcagcaatttatttaacgtgagtcagttaaggatatcagtggaatactatattttttctaaaacaggacttcacccttctgaagttagactaactgggaagatggcatagcaaaggaaatgtcagtaacaaagacaacaacaaaaatcacataaaacagattaacaaaagagaaaggaaggaaggaaagaaaaaaaagaaataaactcagcaaagcaactcgaagaggtagccttgggataagaaataaaaatattgaactaagaattagttaagaaggaatcaaggttgtagattgacacaacatgctaacataatagagtaagcaaataggaaataaaatagcacatatatcaatatggaaggcatatcaattgaaggagaggtaaccacagtcacatatacatggttcagaataacaaaataatgtgtttacattactgctgtttacagccagttggaactggcatcatattcacttttgatacttgtgggcattcagaaacaaagtgtaaagcataataggacgatcttcaacttcagtatggtacaggggagaaaaaaaattctagagagtcatgaagcccgatcatctgattctggtattttaggctgtcaggactcaagacattatgcctaggccactcttggacagatttagacccaaaaatgttttccatataataagatgacagttgaaagtcccaggctaaaatcttaaaacacagaacagtgatttcaatctgaatactggtcccactttttattaacccctgtcttgctcagttacttaagctctcttaagcctccgttttttcatccggaaacataatgataaacacggtgattacattaaaggattgttgagttagttgaaatatgcaatgcatatataatgtgtcacatagcacctggctcattgagtattgttgcaatgcaatgataaaaacattaagcacttttcttagaatacattattacatgaaatgtgtctttaagaaattcttttagttctctgagaagagcccctgagaaaggcagacaacacactacgggctcttccagctgttagaagttcctcccaaggaatcatctctttgccaatcatttatcttgtggataacttctgtgtagtgtgtcttgtcttaaaagtttaacatatgttcacaatattatgctaagtttatggcatattaatcatatggatgaaattttgttattttttatgcaagtaatttatttctacaaaaacctctgagcaaaaaccctttacgcttctctcttcaattcttaaaattccacccccattaaggtaaacattgtaaacactgcagagtgtaccttttcttgctttaatagttgcatataagtattcaaaacctgtattatagcatatagatttctttgttttatttaataatacatattattctgttcttcaaattgattacttcacttaagctacataacttggtcatctttacatgcgaatacttatttataaaatatttttgtaatataagcatatatataagcaaaagtaatataagcatatggtaaatttagtgtaataatacatataggctaacacaaacagtgcaatgcttaaatagatgccaagtacttttctggtgccttacatttattaactcataatactcataacaaacccaaaagttggactttttcttatccttattttatagataaagaaactgaggagaaaggaagttaaatcgctattcctctgtcacacaggtagtatgtagcatagccaagattcatacctgggcaatccatctctggtggccatgaccacacaggtatacaatgaaataccacattgttttttttaaaaaaaacttcataatatactatcggatgatttttaaattttattaattcttatgctgttaattatgccaatgttttcattataattttggttttacttgtctatcctaagttgtactttttaaaatacatatacaatattttttagagaagttttaggctcatagcaacattgactagaaggcacagagattttccataaagcccccgtccctacatacactcacagccttctccattatcaacatcatacacaagaatggtgcatttgttaaaattgatgtacttacattgacacattattatcacacaattccatagtttacattagggttcactcatggttttatacattctagtggctttcacaaaggtatataatgacatatatccaccattatagtgttatacgaaattgtttcactgccctaaaaattctctgtgctttgtgtatttatcactgcctccacccagccctttgctagttgtactttttgcattaaaatctactctatctagtatatatcataatcattgttgctgcaagagaatccaatgatgttgttttcacacagccattgaaccaattccagttattatacaagtaattctgtttctactgcgttacaaagctaaagtttgcttttcatacaataaggtgccagtatatatttggatctatttgtgggctccctattgtgtttcccagctctctattattttattcttctgagcatgtcatactgtttggttatagcagctttatagtaagttttcaaatcaagtaggaagatgcctccacgatatgttgctgattgtgttattaccaggcctcttcattccaatgggaggaggttagggatagagccttagaataagtctgaaccactaggaatggtatcactgctgcatttttctattttattaatatgtagaaccatatgtgaatcccaaagaaagttcatatgagaaaacccaagattgccctcacagatctaagagataggatagaactatttattgctggcttcctgttttgaagacaatatttgttgtctaggtaatatcaggatattttttggagactttgtttttctctctcgagggatgttcacaatcttttggtgctaatttcctcttaatatagtgctatttttttccatacaaaatttgaagtagaagaaaaaaaataaagaattggtagccattaaccaaagctggcattctatttccattttcacagtgagactaccattttaaggaattcaatatccctttgtgatcacaaaagtaaggtgtaattcaggagttttcctggagtccccattagatattatacaatgcatattttgtttcaatatcatggagttttaacacaaatgtaaatagaagtttaattatttatatagattcaatgttaaatataacaaagacgggaaagaaaatatattattttgatgtcatttttgttttaacttttcctaactgtggatactcttcctaataataggtagcccatatgtcattataaaaaaatgtatttctagaaattcaggtaccccatcaaccaatctttgtatctcctcatataataactttttctgtgtgtttatagaattttaagttcagtgaaaagattttcagagcattttatttttgcttctatctggagcccactcacatgtgtttatcttcttgtttttaagggggaccccaggcatgaaagtaattgcttttattgcattgaatgctaaaaggtatacagccatacattctttttgtatttgtttcttagagctgctgtaacagagttccacaaactgggtggcttcaaatgacaatgagactttattctctctcagttctggaggcaagaagtctgaaatcaggatgtcagtagagtcatgctctctccaaaggctctagggatggattcttctgtgccatctaccttctggtagcccctagcatttcttggcttgtggcagcatcacttcagtctgggcttcacagaggcagagattggagtgatgctgccacaagccagacttccttctgtgtctgtgtcattacatcgtattctttttgtgtgtatctgcatccaaatttcattcttcatataaggacaccagtaacaacagattaaggcccaccctaacgactttaccttaacttgatgtcttccaagatcttctttgcaaataaggtcatatcattttttagtagacaaataatcttactatgttattaaagtaattaaatcatatggaaaaatattctatttaattattgtattttacaaaacatttcaaaggatggatataattcagagataaccattaatattttttgcataggcacaaaatagttctagttttaaggattacaattataatagatatgaatactggcaatttatgagctgaatgtcatttatatcatatgtcaggagaaaaattctgtagaagatattgtctagtttggttataagtaaaaaaaatggttaaattattaggtgagtttatgtacagatatatactcagtctaacaataacagcaaaacttagtatgtgcattttaataaactatttttcttttgagtaagaaattgttttcttgattagtattctcctgtaagactgctttaattctgtattctctagatataaatgagaattgggaaacagaactaaaaagtagcaagtatcgtataacttaattaattcaccaagattgctttgtgagtttgcaaatgcaactgcaagtgggaagtaaagtatttctagtttattcataagtgtcctagttgaagtctttttgtaaataggctggagcctaaatttaataacctaatttaataacaattttgtctttattgttactaggtcagcagttagcatttaagatgaaaaattgatgggaatgataacttacattatccaactttatgtggttatttgttattgcctaaactccattgctaatacttatactggctaatatttcttctgatttttattatgggccaaagctatcctaagctttgcaagtattaactaatttatgctcaaaacaagtctagcagataggtaactattattatctcattttctacatgatgaaactaagaaacagattaaatttgcttatgtttatccttctaataactactgcagtgcagctttttacaacgatatcgttatttctcttttaccaaatttctgtgtgatttttttgatacttttctctctctctctctgtgcttcaactacctcatttatacagttattttaataacataaataaaataaatggattaaattgggatttcttattgttcccaacaccaaaattctctttttggtgttaatagaaattactataaaaagagaattgtggtcaaatacatttgggaaatacaacatccttcttttgaggacacatcagcattgggtctgagaatttatgtagcaaaagcatttctttcatttgaggtactttttacaaatgtatatgatcagcgatttttatgaaagaaatgccaactaataaaatgtattttggagacatcgtttgggaaattctgaatttagatcctctaaagttctcttgatctctaaaaatcctattatacggtgtttaaaggaagatgatttgcttggtgcagtggctcacgcttgtaatcccagcactttgggaggcccaggcagcagaatcactttagccaagaagttgaaggcagtgagctatgacattgacattgcactctccagcctgagtgataaagtgaaactctctcttaaaagaaagaaaaaaaagtaatttcctctttttgacacttctcatagtttctctatatgttattttttttgagctctttttccaagagttcagattatctctttgatttccctttcaactctgcaaatcgtatttactgttttttctccctactatcaccttcctggcactacacaatcatattttgtattgatcttttctctcatcattatgttcaaatatatacaaattcccaaaattctaaattatctgaaacaatatttctctcaaacatcatttattcttggcccttttatatgtactgtgatttaagggttatattgcatctttgctataaactatgtcaaatctattagaaaataggctatcgacacacacacacacacacacacacacacacacacacacacacacacggatatctaaataaatcacattttcgttaccttaagagattccattcactccttaggataccgaaagaaggacttagaaaactatctcttacacaaagaatttttaaaaatacactggagacttgtggttatattgttcttgttatctatattaaaagattgtataaatgcaataggcttattttcatctgttgttccaaaactgacataggtgttcttcctccattataccttctgctgacccctttcctagtatgtatttttttaagaaaataagccttctttttatatttctgtctccactattacaatatatattttcttttataccaagtaatgtatcttatttgaaatttatgttctgtgctaagtatgataattaggacctaagatatataagagcctgacatatattgtacataccaaatataatctaagatattaataattattatttggacaacatttcatagtttgaaaaaataattttacttcagtagtatttctaatagtattttgatggaactttcaaaacttctgcaaataagttttagtattatttgtaatttgcagataagaaaacaaaagctttaaatgattaactcaaagaaagttatcattacaattgaaattgaaggttatataatatttagataggcagagggcagaggtgaagtcatttcagagaccaaaaaaaagcaaaagtccggggatgaaagcagctatgacatatgttgtgggacataaaaacatgcattttggatagaatagggaatttaaaagaaatatgtcaattgttcacctattatctggaaaatcaatcatcttttattctcttgcaattgtaaaggctcagttttctacatattcatccaatattgttccaaatttcaggttatatgatcatgcctcaatatatgtatttgccttaaatgtttaagaacagattgctttcttgtcatttgatcatttcaacaatgtgagttcgacttaaattgagtatttaaattttggcctactgcaccattttttaaatataacctttttctggaatatctatatattgtgcatacagataaagtgtaccctttgcttattttcagaggactcataaaaaataaaactacctaggcaacatatatgttgattaaagtttgtaccttttttatatttttaatatattttctttctgtgtgcatattttaaatgtgatgtgcaaaaaaaatgtcaaagtaagtatcagtgactcagcaagaaaaggcaaaaaataagcagtgaatacaaggagttgtaattggaatatttctcaaatgaagaatatgtgaatattttatacacataataaaatctataatattaaaaaatacaaaagcactaccaaaagagatgaccatgacatgagacattggccaattaatttaccatatatgcagaaaagtcccctcaaattgtaagtgaaaggagacgttgataagatatgctgaagaaataataagacggaagagaatcagcaggggtaggatatcattataacaacttcacgttctcttttagacatagtttttctaacttctacatttacccacatgtttatgtgtgtgtgcatgtgtgcgtatgtgtctgtctatgtattattttgtggaaatcagcttaaatgaacattattaagtattgtggtaggcagaataatgtctccccaatatgcccatgttctaatccccaaaacctgtgaacatattacctacttgcaaaaaggactttacggatataattaaattgaggattttgaaatggggagattttcccagattatctgggtgattatattgtaatcataagggttcttgtaagagggagataaaagtgtcagagcaggagagagattttttggtgctgcaactgctggctttgaagatggaagaaaagggtgtaagctgaggtatgcgggtatcactagagactggaagaaaccctccttgaagcctccagaaggaacacacagcagagttgaaacatttatttaactccataagatccattttggttttctggcctctataattataagataatgtattcgtgttgaggtaagccactaagcttctggtaatttgttacagaatcaataggaaagtagtaaaaaagtcaaacattttatggtaccaataaggtgtaaatttaaatcagaatttgttactcagtcataagatcagcatatatgattaacactgcttacaaatatttcaccagaattattttagattagaaataaacatgtttaggggatgtaaaatttaagcaaaggaagtgatttaattagaaaaggtaacttccatttcggaagaaactttcaagtcaaagtgaactcattgtttctgctttatttttgtagagcttaagtttataaacaggaccagagaactgaacaactgaataaacatcagtgtactggaaataactgaagtattgggttcaatatcattatacacactattgttttgaggtcacagaacatgaaatctctgggtactttcacccagcaaaatgcacacgttaataaggcaaaagatcgtgaattttttttttttttactattttattcccatgttggctaacactgagaaacttatattctcagttggataaaacaaaatattttgggccaatatttatgctaggataagtgaagaaataagacagtcactcaaaggatatcctagatgagagcattttggtcaaacaaatttacaaatcaaatagggtataaaaatgaatttccttaattttagccatattttacaaatattttcacatagtataattgcggaaataggtccatgatttgagcaagaaaagatactctgccaaaatattaatataatatcttgctaaattgtctcttcaaaagcatcacattttattaatattttcttatccatgccctttagaacaaacattttaagagatagcatgtagtagtatttaaaactaaaaaatcttagttttcatggctaaaactttgagccactttgcaaataaaaataaattttaattgagccttaggagtatgaaaataatcagcagtaaattgaacctgcataaaaaattctgagggaactattgtcaaggaactatactaaaaatttactatcatggaatgtggaataaatatttattagaatcttctttgacccaaatgtcattttagtgcctactcatacagttagtgattgcagttatttgtgagatacagtagtgaatatacgtttaatattttggggaagttgattagctttcctgaatatttcaaatcctagattcttagatttgaaggagacctccaaaatggtcttctgttctaaattgcaacattccatttcgcaatactcctgataggtgaccatccagccccagtttgaaaaatagcatgaataatctccttcttgatctgacattggcaaaccaaacagaaataggataaaacaagatattattttaaaattacattatgctgttatttgtccactgtatcactatagttgcattagtctgcagttgaaggtattacctaccaaactcatgcatttttccactattttattctttattgcatctaaaaatgtatagtttatgttgtaaatatatcataatatttatatcaccaggtgtagtgaagtataaacttaataattcctgttaatgtctgacctgacaccttgtagatgttcaacaaacgttggtcctgttcacttttcatttttgaaaatatagtatttcatctgatagatactgagggttctattgataattcttcaactttaaacataatttcaattagatataagcataattttcatcagatttaatatgacttcaatgttgtgactacttagtataatttatatcatctaatatttgattgaacaatataaatttgaatgtcacttatgtctctgaaagaacttaaaattttttgaaaattcattcagttacagtttctaatttgatgaaattagagatttttaggatgcactttttttttttgcaaatttcacggaacctatccttaatttatgagttattttaaatttttttaaccacagttagatattttcatttttgggaattatagcacactttaagaatttttaaaaattggcatagtgtgtgctactcatgtgacagttgcactaaaatcctagactccaccattacacagttcgtctatttaactaaaaactacttgtacccctgaagctactgaaataatacaatttttaaaaaagaataaaaagaagtgtcaatgactttttatcatttttcacattggcactgttactggtagcccataaattataaaatttgtgaggcatttgtagatatacaaggttgtgtgtaaatctgattcatagacaatcttatgaattcttaccacagtaagaaaaatgaatggaagtgtaatagtaactttgaggatgaaagcttatataactacttttgtaaaatacatttctctttagcaggaatcaaggttttaattttttgcttgctgttttcttaaatttttatttcgtacttatttatttattttgtttttgagacagagtctcactctattgcccagactggagtgtggtggcacaatcttggctcactgcaacctccgcctcccgggttcaagtgattctcatgcctcagcctccagattatctgggactacaggtgcacaccacgcaatttttgtacttttagtagagatgaagtttcaccatgttggccaggttggtctcaaactcctggcctcaagcagtccacctgcctcggccttccaaagtgctggaactacaggcatgaactgctgtgcctggcctagaatcaagatttttagttcacctggtaccatatctaagataaatcttagagcatttaggtacttaatccaaaaatatctttttgcagtatgcaactgtccctgaaatccttgaaataaaaagtataattttctaactaaaaatgtagttttatactataatttttcttttaaataatagtaaaacatatccataccttttttactctgactccagtgtatatgcattggaaaaggaaaattccgtgttttagtatatttcatacccaaattttcttttacttaatattttcagtattatctgtaaaattgctttctttactgtttcttttgtattttgtctgttttgcatgcattaaaacaaaatgtgagggaggacattatttttgtaattgtctattcactgagataaactgaaatgtatatcaaatcagtcattaacccccaaatttacctaaatgattccaaatatcctagtatttctcaaaaacaaattgactcagttttgtgtttttcactagaggtccaggattgtattgatggctgaataatgagtcaggaaaattgacctatatgatttttttcttcaggaacttatgccagttaaagtaattgcattttataatataattttattgtgagtaaaatataaacagtcgacaattaaagtaaaatcatatgaaaatgggagacatatttaacaatgtgaatatcattgaacaaatgtctgttaacaatttaaaagtagcaaagaggtaatcaaataattcaaaatcgtgacgtacttctttatgcttagattcaattttaaagatgtacttatctgtaattagagactgtcacattcagtcatctgaaaggcagtaccagtaaggatcatctaccaaatttttaaatcttgagaataggcattttgcataagtaaactccatttgtttgctccctacaatattctatatattaaaaataacatgtgccaaaaaggcttcgccttagaaaatctgtacaacctttatgtgaacgtgaatgaacattgtttttagcaatagcttattaggaactctgattttcaaataaatatgtgaagatctttaatatatgaatatcagcattttcccaagaaaggtaagtggatgtttattatctgtgagtgagatatatgtcagtttagacatttaaaaataaatcactctgatttaatattgtaatatagattataaaaacattcttaagtggtgaaaatgatctgccaaatcggataaataaaaaagagtgaaacagatttaatcaaaacattctttccatgggaggagggtgtttttggtgataggaactctcttccctgagaaaatggaaatgtatttggatttaaaaattacaatcaacacatggatgaaaccatacatcatataaatgcaaattttacatgtatattttcattacactattaccactgtgattttaaatgtagtatttaaataccaataattaatttagcataatacccctgttttaataaagcaactttatatggtgatttttgttttcttatccaagctgaattatatatagtgatgataagatcactagcatcagatgaatgaaaaactgatttatgctgtacaggtatacaactctttataaataatcttgcaacttgatacagaaagtgtctataattctggcatgtttgacattcccattcagtccaataactcgttgacagatacttaatttgctacttcttgaaggtgttgcttgaagtttccttctacttgacaggtgtctgacagttcagtctcactcagagcttaacaaaatgggaaaagaatgcattatctaaacccctaggtaatatccattttatgtcattttatgactttgatagtatccaggactcaattctgttcctctggatagtgaataatgtgcacttttacttgtggctttttaagatatgtgtatatacctttagatttccttcagactctatcttgaaatgtcaaatctttatgccctgcagttcttaaactataactgatgtttacaatatggactgtgaaggaaattatgataaaaatatatttcctggtcacccactgttttggtcaatttaggctgctatagcaaattaccatagactgggatgcttaaacaacagacatttatgtctaacaattctgaaggctagacatctgagatcagaacgtcagcatggccaggttctggttcaagccctcttccttgttgcaaacaaccaacttatatcctcacacagcagaaagagagcaagctatacaggcgcttaatttcattaataggttctacttaattatctcccaaagaccctaactccgtatgctgtggggatttgatttcacatataaaattttttggatatacaaacattcaattcataacacctaccaaaatcaaaatattcataatacaaataatgctcttagtatctggcatctctgacaaattatttcagctgttttgcttttgaatacatatttatatccattcagatttatcagaattcttcatttaacttcagtacagacacacgcacgcacacacacacacatatactcacacacactttttaagatgtaagcatatgatttcattttagaatcaggcagaaccatattataagtcagtgtccacagataaagtatctaatataaaactgagtttctaaaggaaacgtattttgaggtgaaaatctgtttagcttaccagtgtctatataatatgtgcaaaatccttaacatcgcattgaaagattctttggatctgatcttaccatatatttctagcctaattaatcttctacatttaccctgccagttctctgttcctactcattgattccctaacaatgtaagcagagttcctttgttaagtcattcacagaaagttttccctattcttctctatctgaaaaaaaatgtcctctatccttggagatctaacccaaagtccatgaagcattttactgatactttcattttctgttgcagcacttgctatttcttttatgccatggagtgggcacattttgtatttgtgtcttgtattattgtgacttgatccttggattggatcttattttacttttgatgtatgtggtagtcagaggcctaccaacagatagaacccacacagtaatttggagaaagttttacataaagaataagtagatataatacagtatttatgtaatggaagattagctagtaataactaaagaggagtctaaagaatatagtaataataattataaggagaaaccattgcctctgaagctgagaggtacccaaaaagaacctcttcatcccctgcaaggctgatatccaaactttatttgtgaggacatgcccgtggctcactggctggtggacaaattgctgaggtgctggaacagcaggacttgttggaaatgttttcctctgggattccaaataagtcacccatagggaggatcctaaccagcagcactcctcttcaaagccatctaaggggtgccatcttcgtagaggtgcctcattggcaacacttcactgctatgctatctgagagggtaatggaaaatgctatccacaaggagactgcacattgaaagttaatgcaaagcaacttaagggggtgtggaagatgccatccacaggaagtgctgggcttcggaactcactgaaaagccatcagacacagtgtctgggtgcttctagccaccatgttctataggagccaggtattaaagaagctgcatgctgagaggagcacactaggaccagaaagagaaacctttctccctctagtgtccccccaatgtcatgtactgacagagctcaaaatgtgcaagttcacaagggagaaatatttatcaaacccatctccattattgtagagcaggcagtggggggtggatttggatgtgataatcaatgtattcataattggcacaatatacttgtttattgactctttgaacaaatcagaatttcttacaagatagaaatacattcttaactttccttttgtgcccaggatttttaaaaaatctcaaataaatattactatatttctccatcatattcttattaatatgatataaactttgacattttatgtgcacaagatatatcctaagcattaaagataactgtgttacataagtgcacattattgtgcttagtaagtgtatgagcatgtgtgggcatatatgggtgtatataaagtcaatatttgatttatgattgaccaatttgaaaattaataaaatgggcttgctgaaagctagaaggtagctactttaaacatcagaaagacaaatgacaagtcttggtatcagctagttaaaaacataagtttctacctttgaaaggattatgccacacattgattttcctattaatttaaataaaggtaggtataggaaatttactttagtttccatctttgaatgttataaaatattgtactaacacatgttgatttctgaaatgttataatcttattatacttaaaggataacattggggctgggtgtagtggctcatacctgtaatctcaatactttgggaggctgaggcagggggattgcttgagcaaaggagttcaataccagcctgggcaacatgatgatacttcatctctacaaaataaataaataaataaaaactaactgggcattgtggtgtgtacctgtagtcccagctacttgggaggctgaggtggaaagatcacctgagtccaggaggctgcagtgagccgtgaccgtatcactgtactccagccaaggtgacagtgcatgaccctgtctcaaaaaaaaaaaaaaaaaaaaaaaaggaaagaaaaaaacaaaaagccaaaaaaaaaccaaccaaaaaaaaaacccctcacaaacaaaagagcaatattgtttttaaaagtacattttactggccaagcatggtggctcatgcctgtaatcccagcactttgggaggccaaggcaggtggatcacctgaggtccggagttcgagatcagcctaggcaacatggtgaaaccccatctctaccaaaaatacaaaattagccgggtgtggtggcacatgcgtgcaatcccagctactcgggaggctgaggcaggagaatcacttgaacctgggaggcggagtatgtggtgagctgaaatcgcaccattgcactccagtctgggcaacaagagtaaatctctgtctcaccaaaaaaaaaaaaaaaaaaaaaaagtacattttactaaagatgtaccttaacccatttatgccgaatgtactttaacccatttgtcttcaaatttattcacattaaaaccttattattgctcatacattaatgcatgtttccttgttttcaggtttatgtatactgattgtctgttatatagccaggcaaaataaatgtcagagtttggtaaaggtttccacaaggagaagggaggagtgtttgcaaatgaaggttaaatatgctaaaattacaaaaattacaaatatcttaagtattttctaagaaatgatgcgtaaatatttgctactaaaagagttctggcatttgattcatgtggtctagattcaaattctaccttttcattcactgtttaaagtttacataactcttctggaaaatggggattctaatagtactagtttatgaaagagtttttgtggatttagtaaaagattaaactcattaacaacttacaaagctctgctgtattgaaaattgaggagaaataactttacaataaataaaaactgttaaatttaaaaacagggatatagtgtgcatgtatctgcaattcttctctctcttctaaggtttactttgtacataactacctagctgcccttcatgtaacttagaacttcatctactatctttaaaatctagtcccatgttttaaccatcttggatggttaaaaccttcaatgaccttcacctagttacacaattcagggacccaggagtcaccattaaccctacactactcacattcacatccagctggccactaagtcatgttcaatctgtcttttaaaattcaatttagtatgtttccttcctcatattcacccttaaaattttctttaactgtaaataccagcaattctatatatttttttcttatttggcttaattcatttagtttttcactgcattttatccccgcttttatcagctacattgctgtgggtttaaaaaattataattggatcatattattcctctctacaaaacttttaataccattctctccatacaccttactcctattttcttcaggataaagtttgtacttatcctagatgacattactttatccataggatgaccttaccaaaacctttaagttctagtcttaacctacctgtctagccatatctctcataaggccatatctcctcataaatatctaatgcttaattttatgagaattgctgacaattccttgagattgtttttatgcttccttattttttcaaatcttatattttatctggaatgccattataataatgtttaattgatttgtatcaaaactactgggatttgttgatggcttcttgccttatgttgttagatatttggctttttttttttggagagatggtgtctcactatattgcccatgctagtctcaaactccttggcccaagtgatcctctcccttggcctctcaaagtgttgagattataggtgtgagcccttgcgtccagccttgccaatttttttacacatattatttaatgtaagttctatggcaatttagtgaggaaacagatacagaggagttttatttcatgtccaagtttacagaattataagtggtagagtcaggccaatgctatgtttgccgctaaaaactatgttatccaaaagatgctgcaaaactgacctcaatcatattcatgtgtgtgaaaccttttgtgacacatctacatatgagatattgatgatcatgttgtcttttatgttatcactatatccacaactgtttctgttatctcaggtgtcacattatctcaggtgtcacactaaacttcaactgtgaactttatgtctgttattcccacttaattataaactgataagcagaataacagtattttaaaaatcataacctcttgcccagtgtatatttctcaataaattacatttgaatgaatgaatgaataatacagattccttcttttttttgtattcaacttcacccatacaagagagactaaaagtgtcattagctattatctttgtattcaggaaacattaaaaaagaaaaatggcatttgagatgggtgttgaaagataatgatggagaattttgacaggtggaggtagaatgagaaaaggcattaccaacgaaggcccaacttaataagagctattttgcctatactaatggacagttaacagtctgatttggtgtattgcttggaaatgatcttgctcgcaaacttattagctgttcaatttagttttaagtaaatgggcaagtggcaaatatatgaggaagtcagaagaacctttcttatattaacttgatgagtcgctataccattgaaatctcttacctcacccagagcagcccctctggaagtgctctttcatacttcatgtctcttctgggtgtgtgaggcaaacatgaagtttatatcagacacatatgaatatactcaatgaatttctgcctatggacaactacccttttgcaatacttacttgaagcatgttttctacatgaataatatcttgaagcccaaattatataattgtatctgtaatttatctgcttgatatacccttcacaataattctatagcatataatttttctcatttttaaatatttatgaagaagcttatgttgcaagagcttcattctcactgtatatacctgaatgctgtgataggttagtaatgggcactgaatcagaactatttatttctgtcctacaccaaagcccttgttttataaactaggcaactttactcccagcatgagcatgagcatgagcaaatgttacggcaataggaaagcatagtatcattcaaagaattatctagaaagtggataattttggccaaatctgagattctcagtgctgtttatacatcacaatcacccatgggaggttttaaaacttaggctcagacatcatcacaaatctccaccacagacaaattcaaccccaattgctgagagaggggtcctggcatcagaagtttttaagctcctgagtgattccaatgtgcagccagtactgagaaccactggactaaaatgaagggcacatgtatgggggcggcatgaagagtgaatagggtttaaaaaggaatattagaatcacatgggcaggataaaacccaaacagcctcactcagtaactatgtgatcttgggctagttactaaacttcttgaaatctctattttcctgtaagatggggataaactaaagcatgtaaaatacttagtatttggagtcagtttaattaatggtcattcttactatttaaaaaaaataaatttgaaaaatgataataggactatgttgtggaaatatttgactaccaactgcaggaaaggatattactacgacagcataggtgacaaaaacaaattagagatatattttttgctcagatgcttaaaatattttttttcttttcatatcttgtttgcagttaagtaatctttggtattaagcagttttaattgcaataagcttataaattattagtactccataatgaagagaaatgataaaagtctgtcttgttttgataatatatgaataatagtgagaattataatgtgctttcttttactaagcatcagatatttttcagatgaatagaatttcgatgagttaactaccaattgcgtagtaccatttacaatctcatttttgaaagacactgtcttgaaacaatctagaactgacaaatgacaacataagatactctgctttgcatattaaagactttcacattcacttctcatttggttctgcccacagccctgagacatgggaattaatgagttttataaagtttattggtttttaggggagagggctatgacaagaatccttcccttctaactttgaatgtaatgcttcttttatgacacacatacttatttggaatatgttgaaagtctagaaactaagaattaatatgtaggcaaaaggaccagtgcaatgctgtgaactcgatgtgagtagatcttagggattctaaagggcactctaatgcctttagatttaagctgaaagtcagagaaacagttaagatagcagaaacctaaaaattctcaaaatatcaaacaggcagagttaactctaccaaagtcagaatgactcaaaacactgttagcagcaaatgaaaacaaagaaagaaaacagcactatgcaacctctggtttgcttatggtacttactagaagtgagtagtcttggctgcaatgaactttatagaaagtgtttagcttagagaatgtcagaatcctataaataccctggaaatagcgggtggcataatgtcttctgcagtctcgtttcagcagataaacttcttcagttctatttagaatgcattttttgtactacggttgatatttcaggcaacagtgatgtatatacaagtatcttcaacattctattaatttcaggttcaatttttactgaaatcaatatctattaaaattatcatgttataattaataatcttaaattgtacaaaattcctattctcttgtatctgtataatatcaaattagatgtctaaaaatctaatctgattttcaaattaacaaaataacctagaagcaatactataatcatcttctctaatatatatacttaagataaaacagctaattataaacaacttatacatggaagtatgcataaatattgtgatttttacttaacacagtgataaagaaattgatacatttaaataaccatatatatagccaatttgaaatttaggtatactccaaaagtagatattttgaattgatatgtttaactggcttaattcaacataatttaggccagatatttcataaaattgtgtttatttctaaagtaatgagtgcttcttgtaaataattccaatacaaaaatatgtggagcaaaatgcgacattaagaagcacaccaaaattaggatggtcagcgcctctggcaatgagggaatgggattagaagagagaacaaaatggttgacaaccttatctgtcatgcttaatttatttcatagataaagttaaaatgatgaaatgtttctattgataatcatggattctatgtaagaatttgttacagtatttttgtagctgtttgttttttttaagtttctcaaaagtgtttaagatttaaatttgaccatattactaggtaattgatcttgatttcagttaataccctggagttacataaacagaaatttaaaataatatttttgattctacaagcattccacattcattaatgtaatacaagaaaaccagatcattctactgtgatcaacttacaaattgtgttggaatctgcctgcatatagcccaccccctcaataaggcaccataaaagctattttaagtaatattctctcaatcataataaaacacacatagcaagaccaaaaggcagtgattcctttttccatttccaacttgtcctcaagctaagcagtccggcaactcaagcaaaaactgtgtttcataatatgaacagccacttaaatactttctccccatctctttatgtttcactgctggggaagttaataatgattaaagtaggaagattttttgttttaaatcagaaagtcagttgaaagaaacctaaagttctgccataaatatctagcaggtgctgatggccacctgccacacttgcaccagattgtctatgtagccagcagtctggccatcagcagaccagagaggtgcaatggggagtctctgccttgctgcagattccgataacttcttgcttaatttctatggtggtcttgccttctaagtcccagatcttgatgctgaggcctgtggtagcgcagaaccagtagcagttgaggctaaagcacagggcattgatgatattcccaccacatagcatatcaaggtgcttgcctttgttgagatcgcatggcatggcatggcatggccagcattgcctccagaagcacagagggatccatctggagagacagtcacagtgttcagatggactgtgtggccaaagtggttcatcttcagcttgcagttagccagattccgtaccttgaccagcttgtcccagctacagaggtgatagtgttgctgccgttaggtgagaagtggacataagacacctactctgagtggctctccacctggacagtgtatttgtatatactcagggttataaccataactagacggttttatctcaggatctagagacaatctacaggttgtcaatggagaaggccacactcaacacgtccttggtatggcctacagatcatctcatagtggtgccctttgtcagatcccagaagcacaggtttccatctcaggaggctgagaggaaaaagtggccacctgaagagatgattttgtcatagacaaagtggaaatgaccctccagggcatgctgtgggatgccatagttggtttcgtccctgttcaatgtccacatgatgatgattttgtctcaagaggtggactgtatcatgtccagggcagtagcgatctggttactcaggtattgtggccttcaagagtgtcacaaagggtcttctgctctgtcatggtggtggtgaggtcaggtgtcactgcagcaacgaggatgccactcagagagaccagagggacaaacaccacagccagtcctgccacagccctgccacaaaaaagtaagccaagcagggaaattttaatacatgaaaaatacaaaatataggcataggatggaatagtttcactaatttagagtctatgtgaagggcaatattggagaaggtaattatgtacaaaagtatcttggagctggttgaattgtttgccctttgccctttatgagtcacatatatatggagaaaagaagttgtctattgccaattggtacaaggattaaaattaggaactatgaacatttcatggcagaatttttgacaatatataagtaatgaaaaaagcagccttttatatttaaaatatacagagcttatctcttatttgctgccaatccctagcaccctgtacaagattgatctattgatatttgctaaatttgttaaaggacattaataacttattgaatccgtaataggtgacatgagagaaatcagctcagggaagcaaattatgctgtctatagtcacacagatagaaaggttggaacctggatggcaacacgggtctgtttgactagaaaactccaatccatcttcttgtcaactgaatagtatttatatttattagaaacaatcactgaaaagttctagattaaaaatgtatctagatcattgcacaataaaaaaaatcttacatcttccttaagttatgattaattttagtgtgtcagtaataagataaattagttgtttggtaaagaggtgctaatctgataaactctgaaattccttctaagcccttttgtttatttatcttaccatggatacaaaaatggccacaaaataaaagaaggatgtgactattttcctaggagtgtgcattgtccaccccagtgcctgacaggtcgaactgtttgtgatgactccagaatactctgaatcccatcagtaattccttccagtgttgacaatgaaatttagaatagggactggtggtagtaggaacagggatggtgtctatggggttgcctaataactaatattatggataatatctaatacaaagggaccttcaatctggctggtagttcaggggagataggatgaagtgaaacatctctgaaatgtctgagctagataatgaaggttaggccaggtgaacaggaatgttaggagtttgacctgtaggctaagaaagacgtagataaaggcatttttgcctgcttaggctgaggttctcttcctttataaatagaatccataaaatatcattaggttcttatatttgttggaggttattaaaatttatcattacttgtgtatttgaaaaatatatgatctttttattatctccaaatgtttaagtctctgctgtgtagtagctatgatttttttccccatttcttttgtttgtttgtttctagcagtttttgccagctattccctgctacctgtgacacccttttttgctaagaaaatacttctgtcttgggtgctagtttcatggctagggttttatattctcaaaagaataaattaattattaacatatgtttctgaaaataaacttttattatttatttcaaaatttaataacagttgaaagccattaattgctcttttaaaaaactaaagaaaattataattatcagacccacctcaaagctctgcctttgtctcttatcagtccattccccttgcatttatgtgtaacaagtttactcttttagtttatgttaattgctgatatgtctactcataaactactgtataaataatattaagaatttggattgactaagaaattaactttaaattgcctctataaacattaaactttacctttagatattgttttttaggaaaacccatgaagtgctcctttgtaattaataaaataatcaaaataggttgttagaaaaactattaaacacattgatgctatagcaataatgacatgataaccagataaatatatgaaagtttataatccacaatttatttttcatatccacaaatttcttaaaaaaaaggtattaacatgtatcccagaacttaaagtataattaaaaatacataaaattttttttaaaagtactaacatatatctgcccatttaagaaatatttccatgacagacacttagatactttgcaaacaatcgtccacctcttcttctgatttagttcatgtattatgcccagggatgaaaaaccagtagtaaaccagggtacaactagcctaaagagaacctttgcgcaaattacaataaaaaatcatcctatgaactcaaggatgatgaacagaaaaaaattcaccttccattggggctcgcagtctgttgagaagaatccagactgaacttcagcccctactaaaactcttggccaggtaccaagttacatgaacataagcagcagctctgcttatcagttgtgctatggcaccgaggagggttacaaacatgctgagacattgattcttcagctgtcatgacagcgaagtgagtcttaacatggccaaatgccataaacagaacacctccaggcttctgcagtcttgtctgtttgctctaacatctcatacctctatcattatttgctatgtgacatgacacatagcaaggctaaaaccagtcttggtcatactgttcccattcacatatgggtatttaaaggtggatattttagtaagctaggttgcatattattcccatataaatgagagccacctccgcccccaacagaaaccatgttgtcaaaatagcatgtaatgcaaggagccaaggcagcccatatgcaggcctgaaggaatgttcaatagacacctggacattgtgccatcagcaaaaaaggaaacagccttcatgttcttagcaacactggggaactacttaattcattttctggagcccatgttaggagaaatattaaatgtcctaactgcttaagccacttttggtttgatatattgctacttgtagctgaaagtatcctgagtgttccaacttggcactccttcagtgagtactcagtacagcagccagagtgatcctgttaaaacacaagtggcatcttgtcacccttctgctcaaaattctcagtagttttctctttcattcagagtaaatgccaaagtcctttttcagagctagaaatcctatgtaatctgcccttgctctgtctcctcctttcctcctaccttctctgaactcattcctacttatttctctttgtccattttatttaaacagacaaggtatgcatccaacttagggtctttgcacttgctatcctctgccttgaaaactcttccctgatagcttcatggattgattcctaagactcttttgctctttacattaatcttcctctctcattgaggcttttcctggatgcaccatctaatgacgttccaaccagcaatccctaacacaccatattttctatcttccttcctgctctatatttgtccatagtacttctgtataacatgtttcagtttttaattaattatctcatttgtggtctgttattcccactggagtgtaagttccaaaaagaagtgatttttgccagttttgttccatactgcatgtccagtatccataatagtacctaggactcagaaggctcttgatagatatttgtcaaatgcatgaatcatagcagttaagcttactagactacttgcattacattattctagctttgaatgtgacaatttataattatctgtataagataaccaacatatttaaattaatttagtacttttgtacaaaaccttatattgatttgcaaatcagctgatttaaaatgtcaagtattacaacatgagtttttcatataacaattagaaagacttaggcaatctgattttatagactggtaattggtttgattgatctaatgttatttcctttatatccaagtgttctcatggtgtggccttgggatactatcagttcattgagaagagttcattgatatgtttcaggttccatattctaactgagataggagtttttatgtttcatcaaaaatatccaaaattttatgggaaggctattgaaatacacttctcccctccagttacattcctgtataaagctgggccttcctcatatttcaattcatgtttcttaacaaattgagtagaaaatcagataaaagaatccacttatcctctattaagtcaaataccaagggatttgcaagtgttaggcaattaaactattctattttatttaaaaccatttatatttatccaaaaaatatttgttagttatattaacgtttaatgaatgaaaaagcatatatattggaaattatcaggttaattttgggtgcaataaacatcaacaggtataatccacataaacaaaaactctttggaaaactcaatactttttagcaatgtaaagggatcctgagatttaaaaaaaaaaaaaaaaaggagggagtcaatttttgttactatgtcccttctgtctttatttgttaaaacatttatgtgtttaacacctcccagccccgtcaagacccgatattctaccatcctggtagtatcttcacactactgggttttgtttaaatgctaagtagcttttaatcatattatcttaaatatgatttttttctccagccaagacaccaatatttcagagaagccatttcatggcagtgactcacacttaattgttgcatctgatgcccttaagagggtacaaagcagtgtaaatgctcaacgaataaaaaaatgaattaatgaatgaatgatatatgaagagatggatataagcactttccttttagctaaaataaatctagtttgctattttatgtttcaaattatttaacatagagcttgttatattgctgacagttttctttcttttttaaacttgcaggaatatgctgtcaagtcatttgtttggtatgaatctatagctaagtaaccaattttgatagttaacttgatagttaatgttgagaatgtcaaaatatatctccacaaatgatcagattaatagatatgtaagaattcctattgcagattcagtttcaggaacttcctgctaggctttcttgacttcaatctccaactaaaaagtctgagaaactgtattcccctacaactcctcaagtaattggtaatattggtcaaggattgtttcctaaataaaaccaaagccgattacatttgagttgctaaaatcaaaataggactatactgattttagttcccaggtccactttgactcttctaccagtcactggcaaccaaagtttattaagttaaatttattcagaattcataatgactttattgtagaaatctgcgaatagatttgcacttgatagatagacaaaaattacctttgatagaattagtaaattaatagttttaattggattaggtagggacttaagatgaaactgcttaacttatttaagaaaacaacttggtctaagcagtctactagagcacttgtatagaatagtgtgctaattatgtgtttcttatctcttcattaaggtagatttgtcagaatcattctttggcaacattgtttaataattggtttatattgctttatagccctgaagaaaataaattcatatttggttataaatgccctacatttctgacttttaactaattacagatgataacttcctcaccccaattaactcaattaatgaagttttacatttttttctttttctcttgtgtgattttggtaatgttaatcaacactgaaaaacattgtttttcaaaaatttgctagctttttttatgctctgttttagtacatgttgaaacaggtataagtaactaaaagaaggcaaacaagtgtctgtacatattcttcacccactttttgatggagttgtttgtttttttcttgtaaatttgtttaagttccttgtagcttctggatattagacctttgtcagatggatagattgcaaaaattttctcccatcctgtaggttgcctgttcactctgatgatagtttctttggctgtgcagaagctctttagtttaattagatcccatttgtcaattttggcttttgttgcaattgcttttggtgttttagtcatgaagtctttgcccatacctatgtcctgaatggtgttgtctaggttttcttctagggtttttatagttttaggttttacatttaagcctttaatcgatcttgagttaatttttgtataaggtgtaaggaagggatccagttttctgttttctgcatatggctagccagttttcccagcaccatttattaaatagggaatcctttcgtcattgcttgtttttgtcagaagacatttattgggccaacacacatatgcaaaaaaggtcatcatcactggtcattggagaaatgcaaatcaaaaccacaacaggataccatctcatgccagttagaatggcaatcatttaaaagtcaggaaacaacagatgctggggaggttattgagaaataggaacacctttacactgttggtgggagtgtaaattagttgaaccattgtggaaggcagtatggcaatttctcaaggatctagaaccaaataccatttgacccagcaatcccattattgggtatatacccaaaggattataaatcattctataaagacatatgcacacatatgtttattgcagcactatttacaattgcaaagacttggaaccaacccaaatgcccatcaatgatagactggacaaagaaaatgtggcacatatacaccatggaatactatgcaggcataagaaagaatgagttcatgtcctttgcagggacatggatgaagctggaaaccatcattctcagcaaactaacacagcaatggaaaaccaaacgccacatgttctcactgataagttggagttgaacaataagaacatatggacacaaggaggggaacatcacacacgagggcctgtcaggggtggggacaaggggagtgagagcattagtagagatacctaatacatgtggggctgaaaagctggaagatgggttaataggtacagcaaactaccgtgacacatatatacctatgcaacaaatctgaacattctacatatgtattccagcgcttaaaataaaattgaaaaaaaaaaaagcaaaactagcactgaggaaacacctaaagcaatcctgggactcataaacactcccatattttctaatataattctcaaaacagtgtccagttattttaagaacagaaaatgaactgaggctaagaacaataaattatttctccaagatcatgcagtaagtaggacaactgggatttacattgttttttttttttttattctgaaagactccttatgtcttacttcaaaatatttctatgttctctaaaaagtgaactgagctaagcctacgttttgtggtgcataaaccataccaacataccaacatcattatggcattaatcattcattatggtaccactttgctttatgttccaaggcattcactgtcttctagatattttttattttatcatgaataattttccttatttaagcatactattattattattttagtactaataattcaactttatcaaaacacattttttatttctcatttaaaaatatctttaaagagtcataagttaaataactgttctcagcacagactgctatgggcagatgccaagaaataagttctgttgagtttactaagagattcttcatagttttattttttaagttgttttctttctaattttatggttttattacactcttatttaaactaaagcaaaaatacttattctacctaggtctacagtcttcatcactttaagaggaaaacaaagctattccatttaagtatctgggtattgcaataattcattgtgtagttacagaacatatcatagagcagtcatctaacccttctctcagacagccattcaaggctgcctatgtctttctcaggaggagatagaatggttaagctgtcattatcttctagtgccactgaaaggacaatagtttcaatgccatattgcctgacatttaaactgatataccttgggatattgagaaacagaagggactaggggaaggagagagccagtttttaaattgttactatataagaagattctaggattttttcccactctgaattttaacttgcattccatgtaacaaaaaatagaccatgtaaaatgaatatcatcattttatgtctattcttttatatcactgtgaaagaaagcaacagaaatttaccaaagaaccaaaggattgtgaatgacttttcagaatatgagtgagtatgcttcacagaaaaccaaagagctgctcccctaattacaaatggctggtctgagagatgtcaaatgacaatgagattaaaaaggtaatgtacaactcaacaaaaacgtgagctaaatgattggagatccagctgtagtataaagttaaacacttttactctgtagtcagagaaacctggattcaaatgccaatttcgttttttttttttttcaaacctgcatggctttgagcaagttaactggcagaaagcttattttccttatctataaaatgattccaggcatggtggctcatgcctgtaatcccagtactttgggaagctggggcaggaggatcatttgagcactggaatttgtgaacagcctggacaacgtaaggagatgctgtctctacaaaaaattaaagtaaagttagctgggggtggtggtacatgccttagttagtcctagctacttgagaggctgagagaggaggatcacttaagccatggaggttgaggctgcagtgagctgagatcacgccactatactctagactgggagacagagcaagaccccatcttgctatataaataaataaattatacatctatataaataaaccccccaaaataagaaagtaaatagaacataactgctacctacatcttaacatggctctgacgattaatgatacagtgcataaaagactgtttcagcaatgattagtgtataaaaaggatgtaataactagtaatattggccacaaattctattaatatgctttatatgtaaagatatataaaataagtaaggtattaagagaatacaaatatcaacttatgaaaataaaaaaaaggaaagattagtaaataaaaatgagaccgggcatggtggctcactcctgtaatcccagcactttatgaggccaaggcgggctgatcacttgaggccaggagttggagaccagcctggccaccaagatgaaacacgatctttactaaaaattaaaaaaataaaaaataaaattagccaaatgtggtgatacctgcctgtaatcccagctacttgggaggctgaggcaggagaatatctttttttgttgtttttgtttgttttgttttgttttgttttttgagacagagtttcattctgtcacccaggctgcagtgcagtgacgcaatcttggctcaccgcaacctccgcctcccgggttcaagctattcttctgcctcagcctccagagtacctgggattacaggcacccgccaccacgcctgactaatttgtgtaattttagtagagacggggtttcaccatgttggccaggctggtctcaaaatcccgacctcaggtgatccacccaccttgacctcccaaagtgctgggatcacaagggtgaagcaccacacctggccagagaatctcttgaacccaggaggtggaggttgcagtgagccgagatcatgccactgcactccagcctggacaacagagactctgtcacaataataataataatataaaataaaaatgaaatctatttagtcctgttatttgcctgcactttttctctatgcatccaagtggatatagtaatgaactcacttttatcaattacagtattcatagtgttcataagaaataagacgttaattaggtcatagggaaaagtcagtataaactgactttaaaaggtatattgaaagatatggtagatgttatgtttacaaaatccctagaataaatttaataaggcatgtccaacagttgtttcttaaagtatatgctagtgcaagccagaagcatagaggtaattcaacacagcatgaacaatactaacaggagccacagcaatgcaggataactttccatagctcttaatgattgagttgaagtcaagggcacgatgtagactgtcaacatacttccagagaagcgggggaagtctgtaataaaatcatctgacatggactttaagtagttttccataaatattggttaatacaagtcaggttgtgataaagaacagtagagtctaaagttatacaagactctgggatgtactgacacatgtacttcatccataaaccccatcaagggctgtcaagaatgagtatctgttctttcatccagtcataacagtggcaataatgttaataaacaattcagcaaattacttcatgttgccctatagctcaggaatgacacttgatgatctttctttctctgtagcaaatgacttaaaatattcttattcagacagaagaagtaatcatatatgccctacctaacatgagcaagtttttaccatcacataaacagctacagatgaagaataaaaggataaccaattctaaaggactgccattatctaccataccctaaaatattggataaattgagaatgaaattgtattatgaatttttattaatagcatagtgaaaggatgaactattttcaaaatcttggatgttaaaaagaatagttttaggcagcagcttccgctgttagcttattggtggctgtggtaacaggctcctgcatagcactgagcctcctagaatcttcctccagttaatttcctgtgggtgacgatcactcctgagccaacaccagcacattttaacttcttcaggagcagccatcatgacatggaaaactaactgcttttttaaaggatgttttcacagatacctgttgaaatcagatagattcatgtcaaataagttaggtcccaaattcgtttttttagcagcattgatttgaaactgtcagttatgatagagtaatatctacttaaagttgattaagagaatatttattccttgtcggtgtcaacttaaaggatttcccctgaacctttatatttatattgcaatgtaagaaacaaatgctagtactgtgtcaaaagctattgccattccaatgaatatcatcaatatttccttcaacaatatgggaggttctcttttgatttttatttcatatattttcttttgttttgtctaaggaatttcatttcatatctcaggcaaagataataaaaccatttttcaccataaagagtttaaatgtttctattttcattttgctttttattcatttaagccttatgtgttgttgtcatttggcattataacagtggaatattgtctataggtgatctccacattctagcataaagattagtccttttatgagatggagaaatgagggattctgaatttttgtcgtttaatcaggcagtatgcaaacgtcttttatgagccaagcactgcattactggggtatggtaatgaataagacagacacagtttataccctcaagcagcttatactgcatcagagaagaggtacattaagcaaatggttttcaataactaaacacattatttcaaatgtagaaaaggctttagataactacttggttataggtaggttgggaagtactaatatttctttgtgtgatttctggacactgcatttttatcctaatgaggcctgtaatacttacttaggtctgtgtggtgtttgtgatggggatggagaataagggatgagaaagtgtgaaaagacacgtgcagaatgttctgggaatgagatttaataaaacacagctcttgataatgtatcaagtgaaactgccctgttacttcgccttggaaatgtatgatgagaccctgtttcctcaattcagttagcatgggttgaatacctacatagtatcagaaactctgtaatacaacaaagattgaaacagctttacttttctgagaacttattttaaataagtcaaagaatcacaaaattttaatatgatatggcagtgctcaatggaaagtaaaatttactgtaaggagacaaaacaagggttgagaataataaaaaatacaacaagcagctgaaagaggtaaaaaaaaaaaaggtaacaaatgaagatgaggttgagggtagggaaagtatctcaaagtgtcaaaacaaaggtaggaaggaggaagataatctaagcattctatgcatacattaattatttttggaggctgcataagagaatgaagacattgaataataaagtcagataagctaaaagtagctagcagtaggtagagaggcatgtaagaatattataaaaatgtttataattgtttatattatctgtctatctagtacagaggaagttctggttcaggaaattctacagataatgcttatgctgtttctcatacgtatgaggctgtacattagttttacctactgccttctacatcagaattgcatgaggtcctgttgacaaggcagatttcataggctgtagcctaatgccagacataagaagaatttttaaaatgggaccaccccccatgccagttcttacccccaggtgattctgaagccactaacatttgagaataattagataaaagcctgtgacaatttccttccctacatttcctaaaatttacatacacaaatgtatgcatacatataaaccttaaaaaattgttttaatggtaatgagtgtatacactcccctccacacttcgtattgtctttcactttgtccatataacaggaatcccaatatattgtgtccaaatttccctctagacaactccttgacagcagatcacaggcttaatttgattgtggaatacttctacggtagtttctgtatttcttggtgtcagagaccctttatattcttaaaaaatattgagaaccaaaagagctttcatttatatcagaggtcagcaaactgtagcctgcaagtcaaatacaaccagtatcttctttttgtaaatagctttttttggaacagagctactgccatttatttttgtatcatctatagctgttttctcactgtaacgacagagttgagtagtgacagagatcatacggttggccaagcctaaactatttacaatcttgtcctttacagaaaatgtttgctggcttctggtgtatgtggattatagctattgatttttagcacagtggaaactaaagctgaaaaattaaaatcaagaaatatactagcacacattccattagccatcagagctaatgttcaaaactccactgtataatcatgaatgagaatgaaaaaggcaaatagcatcttagtattattaagaaaatagttttgacctcatatgacaagctgaatggatttgatgaacacagtttgggaaccacttggatggtacatggcaaatagcagccgcttaatacatatttgaatgaataagtactaaccaaaaaaaaacagaaaatatttgcattgttatatattacagtttacaaataattttcatgtccatttctactttaggaaaatgtaaggaggcagaaatatcaaggaaaaggattttggtgtaggagatattagagcatgtaggctgagtagaaagacggccctagcctagtaaacagaattaaagacacacacacacacataaatgttaatttaaaatagaccatataaatgcacttaattgacttagtttagtatttggtaaaccacatagactacaaaatagtcccatagtaaaggaaatataatgtaataatctaataggtgggggaatagaagaggaatctttgaaacagcaaagcacagatctgcttcaaaagaaaatcgaaaatcttcaagcgaagattgcttgaggaaattttaaaatggaagacacagggtcatcaaaacaccaagggttcagtctaggtcctgctgctggctgcacagaaggccaatgactgagactgtgagagtattgccaaggaagtgcttcagtcgaggagatgggagttcagtctcaaatccatctccctgaatgactaaaattaggagtttctatagcagggaagaaatgtagaaagcaggaactctgaatggtaacgacacaatcctgatgaacgaggggcctggtgtttcattgtctggatgaaatgatctgctgagtttcagttctttgatactttttaagaggcctggggatcctttcctgagaaaggaactcaaacaaatacaagtttcaagctttaagaccagaagggtccatttctatgtttacccaagaacaagtctccgtgaaactattgggtccgtttcaacactaccttcaaaaaaattggggaaaactgtattcagtgtgtaattccactctagacatagcctgtatttgtacccttcaggttaaaaaaaaaaaaaaaggccatgtacatttttactcatcaaatgtaaccttgaaaaaatattcagtggttaaaattttatgttctgaatttctgtctaaataagatgaaaaatatgaaattccaagaaaaaatgtttttggtgttcagaaatggccaaaggtatttcaacacttcttttataatcagaagttaatttgagaaggggtgtggcatactaatatactattatactgtacctttccatgttttacttggtaaaaagtaattggatttggactaggatctatttattctcatcacatatttaattgcacgcaaatacatgctctatcataaattaacaacaacctaattgtggttaaacaatgtatgatttatgtttgagccgcgaattcaagtccttgttcaaagtctttatggcaaatgtctccttttacatatgtcacttgactataagctttattcctaggagagatatctaagtgctacacagtaaccaagcattcaattaaaataatgttttaaaaaaatgagatcagcaattatgaacctaaactcatctagaaacaatttgttctattacattatcgaaaacaaatgcaaacaaacttcagaaagccatggtgttttacctccttcaatattatattgacattatttgcacagcaggattagaaagtaatccctgtggagatattaagaaaatcatttatttttctgttagatacacaaatgggtgactgtgtattatacaatacataatggcttttaactgggagacataaaaattgaatatcactaccatgtgtgacatgtgaattttgatataatatttataaatattttagtagttaccatttaccagatgggagtgatgtgtgtctttgtgagcatgaaacatcttttttatgataatagtctacacttgagataattgattctgattttgcaatatggatgcaagttctctgtactatatacagtattcctagcttttagcaaatcaaataatcccaaacataaatacacatcaagatgaatgttagtaatccatttgactaatgaatattaaattgaaatgttttacctctgtgtctgctataatttgaaaccaaaaggctgaacaagcttgcatgtacatttctattatcaaatgtaaccttgaaaaaataactttaatattttaacatggagaaaatgacatggaagcccatgttctattagacataaagcattagactgttactgtctatatgaaggtggtaaactaacattcctccatattttgtaatctggaagaaatacctgctcaatctctgttaggaggtgagcagggaactttagccccaattttctttatccttttaggatcatttcctctcctctcagatctctattacctctatcatcacctttctgaaatgctatggatttatttaaagttacttagactagtctttatgtgagttctatagttgccacgagcaacaatacaaataaaacattacagggtcactctttccttttctactgattaacacaatggattatctggccagcgtcctgcttatgaattggtgtgtctgagaatgctatggcagtgattttataagtctttcaagcgagcatgtgtaattttagcatttcttgatgcatccttgaagaactgctctttggtgctttcaatcattttaatgaggtatcttagtttgatttacaaatttggtaaacatgacttggtgttgttatgtttagactttggttcttatttcatactgtgtgttgtaagagttctttttttttttaatactttatgttttagggtacatgtgcacaatgtgccagttagttacttatgtatacatgtgccatgttggtgtgctgcacccattaactcgtcatttggcattaggtatatctcctaatgctatccctcccccctccccccaccacacaacagtccccagagtgtgatgttccccttcctgtgtccgcgtgttctcattgtttttaaaattaatgtttttaaaattaaaaagttttctttaaaaactttttaaagaaaagtttttaaaattttcttttaaatttcttcttcaatccagtggtcattcaagagcatattgtttaatttccatgtgtttgtatagtttccaaaattcctcttgatatttacttctatttttattccattgtagtcagagaagatgcttgatattattttaatatttttgaccgtcttgagacttgtgacctaaaatctagtctattctttgagaatgatctgtgtgctgaggaaaagaatgtgtattctgtatctcttggataaagtggcctgtaaatatctattagatccatttggtctatcgtacagattaagtctgaggtttctttgttatttttgtgtctgaaagatctgttcaatgctgaaagtggggtgttgaattctccagctgttactgtattgggacctatctctctctttagctctaataatatttctgttatatatctgggcactccactgttgagtgtacatatatttaaaacttgttatatcctcctgctgaattgacccctttatcattatatagttaccttctttgtctcttcttataggttttgtcttgaaatgtatttttacaatataagtatagtgactcctgcttatatttccattgctatgaaatatatattttttcatacttttatttccagtctatgtgtgtctttacaggtaaagtgtgtctcttgtattcaacagatgcagatcgatcttgttttttcatccattcaaccagtctcagtttttttaatagggaaatttagttcatttacattcaatattattattgacaagtaagagcttaactcctgccatttttttaaatttgttttctgtttgtcttgtagtcttctcttccttctttcttttctccccttcttcctctactgaaagtgattttctatggtgatatgatttagtgtctttttttttaaacatagggagtttattcagtcctcaattattcccaaactccagatgaactgtctttttgaaactcagttacttacattaattcttcataattagtaccaaaagcaaaaatgttgcttcaagaaattctacgtgaaaatgtataatcttgtttcttggggcattttgtatcctaaaagctttcattgagcagcttcttcattgagcatatatgtccttccttcttctatgctacaaagccaaatagtttatactgaaaacatacttagccttgccctcaccagtagtatctttccaagttcaaaatcaaaggaatagttcaaagaaatatttgaagctctcttgcttcaactgcaatattcacatattgaaaatagcaataaatgtagtatttttgtttctcttggtactctgtttctctgtttcagtaactaaatgggttaattctgcttgctaaaaggcctcagattcttttcttcttaataactattccaaatggagaatgaacactgaaacaactgctttcccaacttatcttgattccaagatctgctctggtctcatcaagaagatttaggatatggatggtttatgtgagttgactcagagacagattatgatcttcctagtaactcctctcctcatttaatctaggctgtactagtaattgctttcaccacataatagaacaagttaattgcaaaattttgcttccacaggaactgtcaggtaaaattcactgatttaaagccagctgaaatctttttgtcagaaatgtactcacttttttctcaaaacatttaaattgtttaaatttaccaaatatatattttttcaacaagtaccatacattttccagaaataacaagatagtttatgacctgtatcatctttccacagttataattttacatatgcagaagtcggggttacaagcttatttgaggagctatttatgtctttcaatgtgcttctaatattattagattgttttatttccagaccacaagactcattactatttattccatatttagatgatgattagtttataagaatctaaatatcagttaatattagtttcgctagaaaaagtttaacattccagatgcagtcctttttcctacaaacaggtgcagcattacaagtaagctgcatttagatgcatgctctccagttctctgtggcaatgtaggccaagtgaagccagaaaaattattgcccaaggggaaacatttgtacttctcacttcattttgctaccttatcactaacaatatggtattcaaacaaacacatatatttatatttatagcttaattttttttttcctttagcaattctgacagctttgagttctcctcttgagggaatacataggaatatcatctctaattttattttctttttaacttattgcatttataccagctaaggactgtgaagacaaggtgaaagtgtaaataggcagggctgcagtaaaatgaataaggctccttaactggccttaatgcaatgcttctggagaagttactaccaaattgcagtgtttgcaactttacaaaaccccttaggaaaaatctaggtgtcatctctctaaatacgatggttagatttttaagaatgctgcatgatgctatgcttgtaaattcattatagtgatgtagcccagactctctctagggatcattaaacagcatgcattagggttttggtgctactgtacacaatttctaaacctgctattccataagttatttgttttacttgaaaggacttatggtatctgtgaccacaaaatatttgaagcatagtgattacaaagcagagacggcatgcctgcaatgctcaccatctactataggagagaacaaaaaccaagaaagcagtttttcctacaatgtggtagttatttacatcattaataaataacatttactggatgttgaactcatctatcttagttgtatatgaggaaatttcatatgcttactgaaaagggaaagtttatattttgtgttattctattatttagaaatgtttctaaaatttgggaagataaagtaatataattcgttcacaacaaccactcagtaatgtaggtcaaagtgtacatctccttttagatagtaggcagcttggcaggtgctgagaaatagtattttttctccttgcctagaagagccatctagaagcaaatgtgatctacatggaaaggcaagataaagataagacttagaagaaaaagatgaaaaacaaaaaaagtgggattacaggcatgagccaccatgccaggcctaatctttacttggaagaatgactgacagaaaaacagatcatttagatatgagtatctaaagatctgagagagcagatatcaaacatcaggtgtggtaagaaatgtggtagaggcaggcatttaggggatgtgtattagaaaagatgaggctgtagataagaagtcaaaaccaaaaagaattaaagccaggcatggtgttttacaccggtaatgtaagcactttggcaggccaaggctggaggatcatttgagcccaggagtttgagacaagcctaggcaatataataagaccccatatatacaaaaaataaaaataaaaaatacccaggaggggtaacacatacctgtagtcccagctacttggaagctgaggtgggagaatcgcttgaaccagggaggtagagggtgaaataagctgtgattgcaccactgcactccagcctgggcgacagagtaagactctgtctccgaaaaaaaataaaataataaaataaaaacaagtcaagaagctgaatataaaatcaggtaaagcagaagttcataaattcagccatcaacaacacaaggtctaattcttaaacctcattttgaattcaagaactcctttcacttagaaaattagtgtgggccctgtagaactttggtttttatgagctatacttattgatgtctgctgtatctgaaatttaatcttagaaaatgtgaaaatatgttattacttaaaatggtaatattaaattataaacctgttgcatggtaacataacattttcatgaggaataactatatttttcaaaataaatacaatatcatgagaagatactgctttacccttatacaaatctattttatgttatcttattagaagattctgcatccaatgtatttcagtacttggtttctgttgaacgacttgaggaaaatttagtgtcacaaagatgtgtagttggaaagggaggattttttacaataaccttcaaatatttataaatatcttctttgatactataccaaattcaacaagtagtttaagttttagttgcaatgtagaatctgaaatcatatcaacaaacttttcactttactaaattaaaatccgtaggtctactgtgctctttgaatgcatatttactcatgaatgattttgtaacaatgcattcgtcatttggaaaatgctggttcactgaatattgcagatcttgaaaatgctgacgtagtttattatataatatcaaatcccattgattaatatcaccactgatttaataaaaaaactttattgataatctattaagttgactgtggtagataaatttttcaaattctatttttgcttgaaattttgaaatttattaaattcaacaaggagtataattccgttttccttgaattaacaagcttaactcatttttgagaaaaatctgtcagatactcaaatctagattactagtttttctgtcagtcattcttccaagtaaagattaggccaggtgcggtggctcacacctgtaatcccagcattttggaggccaagacgggtggattattggaggtcaggagtttgagaccagcctgaaccacatggtgaaaccccgtctctgctaaaaatacaaaaaattagccaagcgtggtggcaggcgacgtaatcccagttactcaggaggctgaggcaggagaataacttgaacctgggaagaggaggttgcagtgagccaagatcatgccactgcactccaacctgggcgacagagtgagactctgtctctaatcatcatcatcatcatccacctttaaatacctatatgtgaatgggaacagtatgatcaggattgattgtagcctttcttgtgtcatgtcctacatagcaaatgatgaaaatttcagattgtgccactgcactccagcctgtgcaacagagcaagactctgtctcaaaaaaaaaaaaaaagaaagaaaaaaaaaagattgaatttgatgaagaaatctggctagaccagctcacattcccaaacaatcacacaagatgtctatgcctccttctcattttgtcacatagcgtagtattaaaaagctattctcaagggttaatgcttttttaaaaagtatcttttttactgctttaataaggacattcttaatgaaactggatttatgcatttgtctatttacttgtataataataaatttgtggctgttgagcactaactagtacagtccagtgccatggccttgattaggattaaagcaccaatagttttactgatcattgctctaatgacatcagtacaaatgtgcggacaaggaggataataatatctcagataatattgtgaaaatagtcctgacttgatggtcccctgaaaggtcttgaagactcccagggaccacataccacaccctgaaaaccactggaatagaggcactttgattgatttttctaaatgccatgtcttgaaactctttttattctcttggtttattttttggtttgtttttgatgctcatattcatacagagcagaagcagtagccctgtaacaatttcctgtctttactttttgagttccttaagatatagcattaaattgagttttaagttgctctttcattcatgaaatatctgtagagggcttaccatgtcctgtgcattgttttagaaacttgacaacacctctttgtaaacattattgttgacattggagtgggagttatctccctactttttattccttttggacatgtagatggggtacctgaccaaaaataaaaattttaaaaaaacatagtaaatataccatcctgctctctgccctcctccacccttctcaatctcctttacctccttttacactccctacgagtccaatggatatcaggtgcacacctggcagcaaccacacaattgagaagcaattttgttgttgttgcatgcatttttctttagagataatccctttgactatcatcctagacctctttatattcttccaagaaactcgcttcatcatttggttttcagcatgtatttgtttcacatatacaagctttgctctagtgtgtagtaatttaaggaatgcatttttattctgttaatctgttccataattatgatattcgacaatgtctcttccattttatggtcatagcccttctttctgaaccctgtttgatctatttttccacctggctcttcatttctagccccaacctcaaagctatttaggttttttacctccatttttgtcactagagaaatctatctcttcttaaactgttaaattcatgacttcttaatatctagttaaaattacagatttcatagccacctccttctccaagttggcctttattccctgggatgatgtgtctagctttcgtcttcatttctgtttataatttcaccttttattttaggttcaggggctacatatgcaggtttgttacatggtatatcgtgtgatgctgaactttggagtacagatgatcccaccatcctggtactgagtatatagtacctaataggtattttttgagtctttggcccccttcatctctcctccctctggcagtccccagtatgtattgtactcatctttatgtctatgtgtacccagtgtttagctcccttttgtaagtgagaacatgaagtatttggttttctgttcctgcattaatttgctaggataatggtctcccactgcattcatgttgctacaaagacataattttttatagctatgtaatatccctttgcttacagcttgatctcttcagaccttgcttttagttgcttatcaggtcttcccctttggtttagattcctacattcttggactcctgtgctcctctctctacctttgttttgtctaatccacctgcattcccactgtccacctcacgtattcataattcccctttctgggaagatgaagtgacgtgaattctttactcacccttccagcttagattgcactccagtttaaatatttcagtcagctctccacacaaaaaatacttgaaacaaagagagctcatttttattgtgtgccttacatgtatttagtcattacagtaacccaagatgtaggcgctatgctatttacaaaggaggaaactcagtcatagaaagattcccatgttcccattgatgagccctgaatcctaaggagacaatctgtcttcaaagccagcactttttgttaacacaatagagcctcccaccagtggtatccttttaaacatttaaaatgtaaagataccacttttccattttctctcactatgatcctgactttttatgtcacaagtcaatccatggccattttaagaaatggaatatgttgctaaacatatggaaactctttctgcttggctgacagctgagactttagccattgtcagtgttgcaaatagacaacctcttccttttctaattatgctgctgcttcctttggagccttgcctaaatttttgctgaagcattaggtagacacaaccaggtcaaactgcagaatctcaacccccagcacttctgctcctggcattttcccatggctcagtctttcacaaatactctaagaatggcagatctctgtgacagttttttcttgggcttctttgccataagcactcaatagctgctacatgatttaagttatatctcgctggcctctctatcactgtctttctcttcctttcctgctctttaatattttaaaatccccttctcctaggctgcatttgtgccttcaaataataaatatgaatttctttaaaataacaaaatgtctattttgataacataaagagatgtcttctacttcagatctctgtaattttaatatagctttattcttacatacacagctatactgatgaatttgttcccattaattttataatgacatatattccattccatacttagtctagtgtcataaataattatttcccaaggaatgtttattttatggaatggaatcaaataaaataatctgtttcatgacacaggacagttaagtggcaaacgaacaaatcgtgttccatttactttcttttttaaaaataaagtatactaaaatacttatataataatgatatatatgtttttattcagtagacagtattagcttcctgtgcatttgtgcattcagtgtatatgtatataatagatatatgcctttagaaaggattttcttatctccatgtcaacagtcaaaggacaaggtaataagtaatcaaatcccatcactttacacttatcttactagattttgctattgaagtaatttacatctatattgtgtctgaatggtgaaaataatggtatgttactgtgcatctcttccatttccacagtcattgatgtaacacaaacagctcgaaatcagtctttttggaagtgttcacaccacagaaatcaacaaacacaatcacacattcagggatttttttttttttttcacagagatctagttgctaattatttaccagcactcaactagttttaggcttgacttaatgtagagacacaagttaggctttcaattctctcctttctctactgccttcccttcctgccttgcttcctctacacatctctttctctcttcactcctcttctctatctcaattcattattgtttctactccatatgtatgtgtaccttattccctcctgctaaagaaaggctttctctatggggtgagagaaatggaagcaacaaacgatcatcatgaaatagagttccatgacctgaaaacttcttcaactccattttgcaaagtgcaaatcggaggccttggagtggcctttgattgttctaatacccacacctggaacaatgcctattgtcaagttaatgggtaactagattgatgagtctacatcattaccacctgagaatttaatgaagcgggctacggggatctggagtcacaccagaatgactctattttggagatagggtctttaaagaggagattaagtttaaatgacacagttaaggtaggcctaatctaatctgactggtggtctttataagaagagaaaatgtagacacatatagagacaccaggggtgtagctgggtataaggaagtccatgtgaggacactgtgagggagtggacatctgcaagccaaagagagaggtcttagaagtaactaaactcctgacaccttgatttgtatttttagcctccaaactgtgggaattaaatttctgttatctaagccactcagtgtgtatactctgttataagaggcttaataaactaatacacttgcattagctttccagggtatagagggctataagtatcctgtatatgccgcctaccatcaccatgccatttaccccagcactgaattgaaactggatgatgtcaattgatgatgatgaaaaagaggtgtttctgagtttgtattaggatgagatatcaagcttgaaagcatcttgagtactataatttacctatcagataggatacatcagcagatgcatttttccttagtacttgcctttatctgcagggcctggtttctcttctgggagatggtggaatgtattctttgacttggggatttataacagttggtacagaattctgcctggaatgcactctatttctaaggaaggaagtttgagaccatgcaatgagttagggagtgggaagaagcagttgtcaaaggcaggtaaaaggcatgacttggctaaaatatggagaaaaacatatcctataacaaaatagtaattttaataatttaaacagttgtgcttttctttgatagttacctcacattgtcagcttctagaaacattctcatctgcttaccccttcaactccatttttcaacttataacatcttttcttttagcttattaagcaatctttattatagtctaaaaatcacttatatttactttgatattaccaagacattataatctctaccttaatttattatttattatgtaagattggcttctaatatgaggctagatgattatttcaatggcataaagaaccaagactttttacaataatttgtacttattttccttgtttcattgctatgatttttaatgattgaaatttccagaaatctactttatcatgggttattacagtaaatttaattgcaagaagtaataaagcaattaaagattataatatattttatagctttctacttgagaagacagaattaatcacatgatatgccacaaatttaaatatctttaaaacaattatatttatggttctcagaacattgtgtgtttttcaaaaatgcatgttttatatttcatacaaatattcaaagttcactaatactattgaactattaaaagatctacaaagtttatcagcactaagaaatcattgtttttctagtaatatatattgatatgtttatagataaatacaatatataattataagtgaatctacactacatactggttctatttagatatacattgaaataaaatattttcataattcatattgtatgttataattattctctgttacacacctgaacaaatattcttataaaaatatgcattgtttcaggtattttattcattgtaaaactttttgtaaacaaatgttacatatttacctcttggtgatagttgaacatttttcatggatgttaataaacaatttattttggtagtgaacacaaacaggattgattgacatagatatggttttatttgcagtgttcatacataaacttagaagatcacagacattcattgtgagtattttacaaacccagattgtgtactatggtatcatgtttatttcttacccatatattttagtatttttcctcctaaggagctagccacttttaagaaatttcaagaaaggtgaatctgaattcccaaatgatagaaacagttcagttattttattacaatatagcaagctgctgcagatgtcagtgaccagttaaaaaggttgaaatgtagagctgttgaatcgagacccacaatgacccaagagcaatttacttccttcagatgattgggatgtgttcaaaaataccatttgagcaataaatttctggatatccagagactttaagtgagtcagttgtcttttgaaaattcttcatataatggctttattttaggcaccaataggaaggcattaaaatcatttcattgccacaggtgtgtgcatatgcacatgaaagtcaaacggtgagagaggagaggcagcaaacatgatcatttaattatagtcaagtttacttttaattagtattactgaaatatttttaatttgcagcttattaatctattgtttcaatagcaaatatccttaattatttcaaatcaggcttcatgatcatttaatgccatgtgatggtaatatgtacttgtgaattactgctagacctaaaatattaacaaatcagccaaatactttaaataaaaatttagcaattcaaaagtgcttgcttataagaaagtatgatttttttactcttgatggtaataagaataaataaatatgacatggtaatttgaccatttctatctcaccagaaaaacatttctattaaagcaatgaggcaaaggcaaatacagctcattcaaaatgcatagtaaatcattgagagggttcagtttatatttcattgtagttatttcttatcaggattacagaatttttagagtaatctagtcttcaatttaataaaacatataatagctttgaatagtttttccttcttctacataatcagatattaagaatctcaaaaatgtaattaagagataattatgtaggtaatgtttaacatgcaaaagaggcatatcaaacattagtatatctaaatttcagttaaagaaaagttgtgatgcatagcacttaaaacacttgttcaactttgtaatgaatcagtagtacaggtaaaacaaggaccaaactctaaatgccatgctttccattattataggtcataggagtacataatattgcctagtgaggccaaagtaacacctaagttcctgcctacagagaaagtatgtgaaaaagtgggtgaactttgtaacggtcattcacaaaacaggaatgaatcaaaaaatatgtactttctttgcaaaagaatgcagaaagactcctgagaccacctaaaaaattgcaagaaatcaattcgtaaatatttagagtccttttgttaagaaatttgtaaagagtggtaattatataattaggtctgtgcagaaggggaagaagcaggcctttggtcacaaatttaagttgcattaaaaacattattaaagtattcattacaggcacaatgataggcaaattaaagacaatctcgggtaagagatgaacacttgtgttttctctgtatgtggaggggggtgtatttgtggcatttaaggcaggatagagatgtgtaagggaggtatttgtctataaaaaatcatgttctattttactaggaattcctcatctttacctttttttctcagctgaatacatgctccagccagttccagtcttttcatctgtactgtctcctcttttccctttctgcctcttccagaagactgaatcattaataaactttctgcatcttcttccctactagctcctttccctcagataggctgaactgtcttccaccttaaaataaacaactccacgctgaagggaaactctttcttcaaatttaaattgcatgcttcactccattcacttcaattgtcttaaaatatgtgtccactttcacccatttctgcttcagtgaccccactctgaagctctttgatataatttcctcatcatcaaatgcaatgatttttttccacagtccttgttattagtaaactctcccaggccacagattccattaaccatgccctccttcttgaaagtccccatgtcctgggtttctacaccatttttcctgtagctcctcgtggcgcactctttgctgtaaccacactggaatattatgaagagccacactatttcacacctctttacctcagcacatactctttcttctgctaggaactttcattctcccatgttatgcctgaatttttacccttccttaaattttcagcttcattgttaattattttgtgattctcccttatgccttcctaccatgaacccaggaataatcaatcattctttctgttctgctgtaaattctttgtattttaatatgccagtgtttgcattttcttataatgtgcttggtctgctctgcaaggatatgaacttcttagaagcagaggcaaatccttgacatatagcacagactttggaatcacatagaccatgactcaagccttgttgatccacatttagctgagtgactatggacaagttgtttcagctcactaaccttcaggtcccttatctgtaacacgaccatcacaaagtatcagaaggattaaatgatataatatatgactcaggaagtgccaaagtggattattaaaggaatgtcaaataaataattgattaagacaatgaaactctaacatggatataaacacaataaatgtttgataaatttatattgaataaatagatgaattaattaatgagaggtatttcctttgtatgaagattttttgttttatcttttacactgactttctccaatctcatagaaaatttaaatcctcactgtcactccattaaaatagtattcatatttttatttctgtcatgcttatttgaaatgacattttatctcaccagaattttgactccataaaataaagacacatgacttcctttttttatttgccagagcctaccctgactcatagtagctatttaatataatttatatatttcaatggtagcattttattaaattagttaaaattatttttgagtgaatttaactcttacctgtcaatagtggcttaaagagcatataagtctgatgaattaacagtgaatttggaaaagaaaaccaaataccaaatggtcttacttgtaactgggagctaaacattgagtacacatgtacacaaacatgacaacaacagacaatgtggacttctagaggttggagggagggttgagggaaagggttgaaaaactacacatcgggtaccatgcctgcttcctgggtgatgatatctgtgcaccaaaccttagcatcatgcaacattcccatgtaacaaacctgcacatgtacccccatatctaaaatcaatttgaaattaaaaaaaaaaaaaagatgagaactgtgaacagatctgtggtgcaatgactccagagtgccagaggaccaaaattctttttttctttctttcttcatcatgtggcttcaccttatcatccctaaatacaaggggtggtctgggctacagactttattttgagtagccatatgcaaaaactcaaatttgagagtagagaactagtagtatgtgctataattaaaatcacacaaaatgtttgaattaatgtgctgtatttccctcatgctgaacaagacatttaatccaatagaagacttattactactttcttacatttaggagaaaacatataactgtcttctttttcccttctctgaattctgggctgaaaagatcactccaggggcagagacatttactgagaaagccatcaaaatatttgcttatctgtgcttgaggaacatagagtgatattcttataccacaatgagaacagctaatttaattatacatgtttcgaacactgcaatttctggagagaagttgtgatgtgtgtttgtgtgagtgaggatgtgtgtgtgtgtgtgtgtgtgtctgtgttttgaggatacttagccttaaattagaatctacgtaaacaagatgatatgaaagtcaggaaaagtaaactttaaatatatgttttaaaaaattacacaatagtaaagttttacgaacaagtgcaggataatatatttccaaataaaggtacacaagttttcaaaatttatctcaataaaaatgtattattaatgtaaataataaaaaaatttagaaaggggaaaattttttaaatgaagattgaaagtttatagtttatagaacaatgtcttatttttgccaatctctttgccataatgaaattgagtattctgcttagctcttacttcaaaatatccatttggaaaggaaataatattttgtgttttctacatctggtttaaaggataaaaattcaaatataaattatagtcaccaaactagttttattcaataaaagttctggcatatctgctattcccacttggaagctattctttataaaaagccattttgaaactataaccatacagaattaattgtaagccttttggatgtcccaaatctagcattgtgagactacttcttacagctacctagtgacagaatgacaaatgaatgtcctattcactgtagtgtaaagatgactgacttaatgagctgtgtcctacttgtcaattaagtttctacctctgtatgtcactttagagataaagcaattccctgaaaccacagtataaaggagagaaagatgtatatggtacctgtctttaccttaaaggcgaatagtcctgcacatcagataaaaaattatttgttattattactatatttattatttatatatgccatatgcatgtatattgtctactaatagattcaatcactttagatgaccatggtttcccatgttctttttgttatttgattctgcatatgacattgcttacttaattctagtcattcaaaatctatcactaatattgtaattccattttccagaaataaaacaaaattcatattccaatattgcaaatatacatactatacactagtgtaatggccttgggaatataggtcaaaggaaagtgataagttaatataaatagaaaaataaccattgttgtttataggatttttattaaacttaacacacacctttttagtcttaagaactgattacttcataagtataatatgaattatttttatctggaggtgaatttcctgactagaaataaatactatcttagagatcaatggagtacaagaaggtatataacattaatatttttctttctaattttaaatataggaaaggtgaaatgattgttttcactcattgtacaatgttaacagtctacttgaaggttgcatcatgtcacgcgatgtttcaggctttttccacttgaaatatatttacaattactaggaaaagcctcacgcaaaaaagatactttaaaaccattactgtaaaaagtggatgagtctttcctccaagctggaatttttttccaattatccttaattggttatctgtatctctactcctgtgttactggtttatttttaagacagctgggtctacagagagatccagtttcaagaactaaacaatagatttgattcttccttgttccttgcttttttcaccaacaatttacacgacatatttttctattatcatattttcattcctgtccttcttgtcctctgaatttctatacccactatctaatatcaggccattatttaccaaaactccacctcccattccagtcccttcgctccttaccattatgtttggtctttccattcttaacaagcaatatgcctaaatttaaacagtatactgaaagcctggagtttatccctctaatggcaactgcacctttggaaagcataatagggtcaaaaatacaagtaaatttgtgtgtgtttctgttgcatttttcaacactttttttccagaagatagtatgaaaatcattattgataatcagttgcaatcaaactatgaatttacttaaataaggctgtaccattagatttcacttaaggtttttccactggagtttaagttaaaggatatcactgttatgaagcaaaaacttctctcctgtgaatatcttacctgatgcattagagaagttatccaaaatgtcagcatttttcttcaacatcttgtacgtagttggttttatgtacggacattgttaacttctcaccattgcagggatacctttaagcattttgctttatggcacttcacagataccgaactttttttaaaaaattggaatcttgtggcaaccctgcagtgagcaagtctgtcagtacgttttaacaatgaacacgtgcttacttcatgtctctgtgttatattttggtagttctcagaatatttcaaacattttcattagtattatatatgttaaagggatctgtgatcagtgatatttgatactgttataattgttttgcagtgccattaaccacgcccatatgatagcaaactaaatcaatcagtgttgtctgtgttctaactgctccagcaatggattgttccattcccctcccgctcctcaagccttcctatttcttgagacaaaacaaggttgaaattgggccaattaacaatcctacaatgatctttaagtgttgaagtgagaggaagagtcatacatctctcacttttaatcaaaggctagaaataattaagcttagtgaggaaagagtgttgaaagccaaaataggctgaaatccagggctcttgcaccagttagcaaagttgtgaatgtacagggtgtgttggtgtgttcttaaaggaaatgaaaagtgttactccagtgaacccatggatgataaaaaagcaaaagtgccttgttgctgatatagagaaagttttagtggtctggatagaagaccaaagcagccacagcatttctttaagtcaaagccctaatgcagagcaagtccttaactcttcaattttatgaatgtgaaagaggtaaggaagctgcagaagaaaagttggaagctagcagaggttggctcctgaggttcacagaaagaagtcatcttcataacataaaactttaaggtgaagcaggaagttttcatgtagaagctgcagaatgttattgagaagatatagctaagatcattgatgaaggtggatatacccaacaacagatttccaatgtagataggacagcctgatattggataaacatgctatctaggactttcataaatcaaagcctggcttcaaaccttcaaagaacaggctgactctcttgttatgggctaatgaagctgttgactttaagttgaagccattgctcatttgccattctgaaaatcctagatcccttatgaattatgctaaatctattatgcctgtgttctataaatggaacaataaagcctggatgacagcacaactgtttatagcatggtttactgagtatcttaagcccacttttggagacatagtgttcagaaaacaaaattcctttcaaattatgtctgctaattgccaatgcaacctggtcaacctagacctctgatggagttgtatgaggagacttatgttgtcttcatacctactaacacaacattcattctgaagaactgagtagtaattttaactttcaatctaattatttaagaaatacttttcctaaggctaaagttgccatagacagtgattcctctgatggactgggacaaaatcgtgtggaaaggattcaccattctggatgccattcagaacattcatgattcatgggggaggtcaaaatatcaacatgaacagaaatttggaagttgatttcaaccatcatacatgacttttaagggttcaagtcttcagtagagaaagtaactacagatgtggatttgcaagagaattagaattttaagtggagcctgaagaagtgactgaattgctgcaatcttatgataaaattttaatgaatgaggagtttgtttgttttttttctttcttttgagacggagtctcacactttcgcccaggctggagtgcagtggtgcgatctcacctccctgcaagctccgactcccaggttcacgctattcttctacctcagcctcctgcgtagctgggactacaggcacccaccaccacacctggctaattttttgtatttttagtagagacggggtttcaccatgttagccaggatggtctcgatctcctgatcttgtaatccgcctgcctcagcctcccaaagtgctgggattacaggcgtgagcactgtgtctggccaggagctggtttttatgaaggaataaataagaggttttaagtttccatctcaggaaactattcttggtgaatatactttgaacattgttgaaatgacaacaaaggatttcaaatattgcataaactgatttgataaagcagtgaaagatttccagaggattgactccaattttgaaaatcctactacgggtaaaatgatatcaaacagcatcacattctacagagaaatcttttgtgaaagaaagaaagaatcaatgtggcaaacttcattttattcttattttaaaaaattgcctcagccccccaaccttcagcaaccagaactctgatcagttagcagccatcaacatcaagataaaatcctacaccagcaaaaatattatgactggctgaatgcacaatcattcacaatttatagcaataaagaattttttaaattaagatatgtgcattttgtagacataatgctattgttgatttgatagactatagtatagtataaacacaatgtttatattcactgggaaaccaaaaaattcatgtaattcactttattgtaatatttgctttatagctatattttggaattcaatccagaatatctttgaggtctgaccctattcttttattttaaataattaacaaaaagatccaaaatgaatttccccttcttccttgttatcttatagaaagttgctagactatgatttgtgaaaattatatcctcagattttttccttggattatatttccagattcaccttgtaaaaattcaaacaattctaggagacaatcatacacaaataagtttgaatgacaccttgattgaggagtagataccttaacaaagagaataaagggtttctttattctctttattagtgagaatagtgagaaagaaatgatctgctgatccacaactgaaatttcttcagatagcagcaacttgcctacctagagtagagtttctcagtcttgacacttgacagaaatttcttcattgtgggcatttgttctgtgcattgtagaatctttagcagcatttctggcttctgtccagtagatgccattagcacccctctagtcatcaccatcaaaaatatttttctattttggcaaatataggagggcaaagctgcctctagctgagaaccactgacaagaagaagaatggagtaataatcatatttagtacttcacaaatatcattttatgcaatacttacaacaaaccaaagaattgtctttttttttctggactaaggcccagagaagttaatttttaaattgaagattacagacttaacaagtggcaaacctcagaactcaacattataatttatactggaaaattctacagagttgaatagaacgtaagaggtgacaaataaacattgtgtccacctaacaattttgctgagggccagcaccggtcagctttctttttgttaacatcaattttacaaggctttgcttactcgagatgttggtctatgtatagaattttaaaagcgatttaattttattttctactttgtactcagagcttggattgtagttgttagactatgatttgtgaaagtgcttggaagccaggaaaaaggcagagttttgctattacaatgatagatttgatggcatttcaaagtaaatattgcctataaagagagtaagagtatacaaaacctgggagatcagctataaactgtcagcatttttcaccttttctcttgaaacttatctatgaaatgttaacttctgaaaattgcagttgaagactaaggtagaagttgaaaatgagaggaaaagtgattagtttatttatcctattcatttattcattcggtcaacaagtatgtaatttccatgagggtaaggacttgatttcattcctgttatgactgccatttcgcctgaaccctatacagtacctgaaaggcagttatcaatattaaatatttatcaaatgaaaaccagtgtgaaagcataagaacatgtttcttatcctttacgtatgtgagaaaatgtgctaagtacactaactttaaagagctaatagtttaggaaggtgtgtggggcagggagtagatgtgcataaagacacttaatgagataatataatatgttaagtttaaataaagttataaatatatgacagtaccaagcattttaagtctaagtaaatcaatccttccttacttattaatcctacccattttaagccaaagtctagattattaaattatggctctaccaactttaattgagcaggatttatcattactgtctacatctatattagttttctattgctggtaacaaattatcacaaacttaacaacttaaaagaataaccatttatcagctcacagttctgtgggtcataactcagaaaaagaagggacttttaaaggatggtaatattatgtcaggctcatccttaatctccctatcgaaaagtcacctgcaccatattatataacctaatcataggagtaaaatctatcaaacacccagttctgtgaattacgcaggggacacgcacactagtgcgaaggaaatcttggggctatctgagaattctatctaccaaagcaatcatctttttctcatgctgttttttctcatatggtcctcattgaccacgagactaggttaaccatagctgtcacagtacctactatgatcttgatcttaataatcaccatctttattgtcattgcttttttaaattttgtcttcctttttaagcgataggcatggtaatgtcagggactggtctggcttggttactactacatttctgacacctaacccttccctggactacacaaaatagatgttcaataaatatgtgatgaaggaagaaatgaaagcaaattcttattaaataagaagtaactaatcagactactctttaagttaatccttgttcctattgttcacattttagctccaattttaccttcccacctcattgaaatattgcaaatgtccaccctggctactccatggatcatcattctttttatttacttcctatctcttatcactttatataattatctctgttgcttatgtgagtacttccttattgtctgacgcccactatattataagaccccagaatttttctgtctcatttacccaagtatctccacggttttacctaacaccttgtctataatgggtgctcaataaatgctgaaaatatgaaggcctggcagaattgtcttacagggcatggataaaatttcatgtcccaaagggtactctggatatttaaaacctctcgacaagcatttcaggacctttctaacattttgggacaattgtttcaatcttaacaaagctatctgtaattttcactctaatttcatagtacatttacctcatattttgctacccccaaatcaaggatgttttatgcaaattaattgacaaacttaaggcaattatgaatgaaattcattaagggtttactataacgtgaaaattctaatttcatgatataaatttatttctctaacattcacttgggtgtaatcttttttttattttctacaaagtgaaaattgttttttgtatttggctttaataattgcttgtgttctgatttttaaacttctattagtcggcatgtttctgtgctgctccctgtgtttccctttggaaactcaaagtaaaaacaatatgaaatgtatcactatttgtaaagcactttaatcttcctagagcttcctgtgccatcaccaactataactccaagcatgtcatcctattcactttgtcaaatggaaagtaaaagttttctggtactttgcagcttgataaaatgtctcttagaaaataccttaatcagcataaatttcagttgttgtgcatacattttttataactaaatgttctaatgcagttttaggtatcctaaaatgtaattatttagatagtaactgcaagtaaataagtccttcattcattttcttttaaatcctgaaagctcagtgctctaaatactgctttggtagaaaatcattgacagctgcagactcctggcacttgagacggattgataaatgcacaacaacttttagaaaactccattcattatttaccagtaattatctcccactagctcttctctcggcacttacccatttagtctatcaactgattaatgctaaataactttctaagtctttgagcttaaaatagtaaatcttagaaactgtcttggagttatgcgttgtgcagaactttagagtttttctgtctgatgaaaaaagactgaattttcatttatcttttgatttaggcttttattttttacacttaactttgccaacatgtacatttctacatttttcctacacacatatcgtttgtccatagtgagttaattgccttttaaactccatcctcttaaatataattttgcactgtcctctttgtgctcctctctgtactgtacctaccacctttcattacagtccctatgaagttttgaaataatcacttattcacaccaccgactcctccagcagcctgtgaaaatacttaacctgttcccctagtttataaattcaggcaactagaatgacaaaagtggatatcaataaatgacaacggaaaatgtcccaatcaagattaaattacagcagcctgctcatctactcttcaaatactctgcagccctcattccaaattccacatcagcttttaaccagtagggtaagtacatatttgtgaagctttctctatgtagtattagtgtgtatcttcactttcatcatttttactgtactatgaaaaatatgtcttcattttatggttttgagaacatgtcgggaagtatagctgaaaattccgtgccacaggattttagagtggaggtttctaatagttttgctattgttaggtcaccatggaaggaacatcattgaagtcagtcagtgtagttatggtgccctgagatcatcgcactctcgatgttatttaactaagatctatgacctcaattagagtgaaaaggattcatctctcagctccacaggcttagcaaaagtctcagccattcagttcaaaggattaaataacccatgttagatggttacaattaagactagtaaatactgttttatttccatttagtaacagaatagacacgcctcaaggtgcttcccattaataagatgaataaaattaaacagttacataacgtgtctatccataaatcatttaaattcaactaaagtacctgactagcagtgttttacaataacaggcatagctgccatttgacataaacctgggttcactctgagccaagaacaagatcaacacattgaagactgtccttttcaaaagtctggcaaaagaaatttggattgttgaccaaaacttcttagtcacttcccatgggaaaagaagttcttttggaggacagtactgaatagcttggcatatgctgacacttcgttacagtcttttcaatagcagaatcatttccaggccaccagacacagtgaatgattcctgaatgtgctacatgtggtgtggccaagatgacagtactgccatctggaataataacaaaatttcttcaaaacagacatcctttatggaaggataactcatgcaggtcatgcatcaaggccttgatttcttttgacatttccccactggactttgcagtcacaagcaaaagcacatttatagcaacaaaatactactgcagatatgaactacataaaccacaccctattgccttttgtagccttccagatattaggaagggtatagcatccattgatacatagatactactactaggcctttccatctgatgtgaagaggttacattattgtttgtcatgggaaaagatacaagttcaccagtgacagggacaccatagactactgtgaagataatggtagtacctggataaacaaagacatcttatctcaacctgtatcacggaacataaattcagcagtttatggaaatattctgattgaaaatagcattgctttattgcctaactaacccgtctacctcccctcctggatccccaaaatttatttgatacagccaatagatttttttgttcttgctgtctttattaatgacttcattatccagtgattttcaaacattctactaaacctacaaaacttgtctttgtattaaatcaatatagaagctaaaggtataaaatctgtaggagattgttgtcttaactcgagtgaggtttgaggttccctgacaggatagattggtcccctttgtatataatccctggaattatttctacagaaccctagagcaccaattgtttattttcaaaaactcctgcctttactgtcataatatttacacagtcacttctctttctctagtttgaaagaaaccctgttataaacgtgaattcatcagatgatgttcagagatgatgtctaacaaatggatgttttggaataggttattgaagtaataaaatacaaggtcttttttactatttgtgatctattaaaatggcacaaatagttggacaaaaggaaatattcagaaggatgaaggaaacattcctgaaggaaaaatgtgaaaattaattgtattcttctgccagttgtcaacaagcacctttgtctataacttgcctaatctataaatatatgtgtaaaattttgtcattagacatacatatctgatccttgctatcatattcccttcaggctaaagtggtgtgtaaaattttctctagatgaagtatgttgtgactcaattcactcacagtttcactctttggccaatttgatatagagtacaaaaataagatcccgtgtgtttttcaaataagttgaatgactgaatgaatatttgtgccactgaataaatgggacgactgactgaataatatttcggccataaagcatatgtgttttacagtttgattatcaagaaacggcaaagcaaaaatactcttgtttgaaaatatgcaatacaaacaatgacactaacatgacagcttgcaaaaatacaaacatcgttatcatatactagtgatgaattatttttgtaaaagtgagtaaattaaaatgaaaaattaatttcagctatcactaatagtaaattgataaaaaatggagaagacatgtaagcagttattattcatttacagaaccaaaggcaagatagatttctttggttttcaaatcatggcctacctgaaaaactctcttggtccggcaccctgtgaatgatactgcacacatgttgaggatatttgggatagtgagaggaatattgtgaggaagtgttgtcagaacttcagtaggattttacagtccatcatcactcaaattgttgatacagacatagatggccttacttgttgcctctctgatacactcttacccacttatcagttgcttccttctctgtcatccgtatcacttcatacaaatctttagaagcttccatactgcttttggtattctgcttacctaacagcctctccctctccatcagattctattcagaggtaagtattcacttttgtgccttctttgccttgtcccatgcctaggaaataagtgtccaattggtgtcagcagactgagtaaacaatttttaataaagataattttaagaaccaaatggtgttgttagaaatcattgatgttatccttttttttttttcttctgagatggaggctcactctgtcacccaggctggagtgcagtggcacgatctcagctcactgcaaggtccgcctcccgggttcacgccattctcctgcctcagcctcccgagtagctgggactacaggcacccgccaccatgcccggctaattttttttttttttgtactttttaatagagacggttttcaccgtgttagccaggatggtctcgatctcctgacctcgtgatcctcccacctcggcctccccaagtgcggggattgtaggcgtgagccaccgctcccggccgatgttatcctctttttgatagctaactcacatattctctggcatatttaacattaccatagaatgctaacccctggcattctgttttttgaaacaaattaaacctgtagttaatggctcattcaatgaagcttttatgtccatcatattatcatgtcttccttcagtcttcctgtggatctttttgatggcttagtagtttaaatgatttttattacattttaagaaatttaagaataccgatactgtatttcttcttttacatagtaaatacatcatgtaaatgattccatttatcattaaaaatggttgttaaattttttattaataacatattggttattgcgctgcaataatttatcccattgtcttttataattattcaaagtaacagctatcctaagtggtagttgagcagtttattagcacaaagtcactgaaaaaaagtgctattgattctccttactgcaattaaggaaaccctttattcactagaatcaaggaagaaagctagagtgaaatatgtcaaacaccaccaagagcagtgtgctctgctgccacatctaatggcgataccacaattctaatcagagaagacagtgcagttccacacatacaaaactaagaatgctaatgctaatttagcttgagtactccagtcagtcaaaaatggtaattgagcaagtgattatggaacccctgaatgcagagagaagtttagctgtactattatttttttttttttttgcatgtcaagctttagagaacagtagttaatgtgttggtaaaaggctatcagtaaaatggatttttaacacttggttgctcaatggaaccttaaaaattcctatgatctgcattccagggtatctgtcgtactagatttgctattgtcctgtttgttgaagcttcgtctatatgaaaccagttagatatattgttgggtatgtacagctattcaaatgtgtttggaataccatcatgcaaaaatatacataaaatgttagtcattagaatcatttaacagatcagcaaactgcaactcacagggtagtgattcccaaatccaggttacataagcttcctgggtcccattttcacagttggttgtactttggctcagaagagattttggtgtaggtgataggcaaatgatactgaaaggttttctttctttctttctttctttctttctttctttctttctttctttctttctgtctgtctgtctgtctgtctttctttctttctctttctttctttttttaatgtgcagttgacaagttaactatttcatagtctaatgtattgctattactccataaactttgaatatattaagacaatccacaatgtgctagttctactacttctttgaatagatatattctacaacagggttggttttgaatcatggggcttagctacacagaattttcatgggcagaattatttgaaaaacaaaatacccgtacccaccctttcacaccaacctcataacaaacctgaagcatattaagccttaggagatttggttccctaccagacgcagctaccagagattttggttattttgctcccatacatacgaatttatctattacaaaatatttgttctctaaagatttcattcttctgccaattcaaagttttattaaaacagattagtggaagattaaaatagaaacaagtaggctattctttctcctttaaaacaacaaaggcaatcagtatgttgacattatttgtgactagtttctaaattgtgccatctttatagtagtttgtattatgtcttttgataaattgtgtttgacatgtagatgaaagagcagaggaaaactacattttatgtagtgtgtgtgtgtgtgtgtgtgtgtaggataatgttttacaatgaaatctgtagaaacaccctattaatttcatgaactaacttctaaagaatatgtcaaaaataagttggcaggtacatcttagcatttatcaagagtaatattgccagaatatgtttctatttatattgcttaaaagatgcatgaaaaaaatctacttttttcaaacatggaaatgtaaataagggatttcaaattgtttgattttcttctaggtccctgtctatgacatctaaattacatattaggatgataagtatatacaattttctgtggcctctaaaggaaattacttttaattttgtataaatgtgagaacaatatgtgtttccttctgtgtgtccatctctgcctctttctctctttctttttgtatttataggggtaaatttttcatctgacagattaaaaacattagattacatcccgcttacagtaattacagcttactggtgatactgtcattagctgagcaattttaatgtctaatttatagcaatataacgagtgattaattcaagatgaaatttatcataaagtgtaatcacgatgaaatggataggtactcaatacagaagcttttagcagtcatatgtgaggcagtacccaaaaaacatttaaatagtttaaatttcaaaaatccagcagatgaggtccacatggatataatgagctgatcgaagttttctgtcaaaaataaccaaagcaactggtagttcggatggctcatgtataccttctatttgaaacaggcagagatcttagcccatctttgtgtccttggtgtccaaaacatggtagatctaacattcttttttaaaattaattaatgggggaatgaataaataacaactgagttaccctggcttataaagcccgacattatcccagctgaaaactattgactttcttttgcattattcaccacctcaaccacattcagccagagtgttcagctttcctttccttgatcatgccaatctctttcccacctatcacagcaatttctctccctataatcctcttcccctaaaagtagtcagagcatggttgtgtctttctcatcattcaagtctctcctattcaaagaagccttccagaccaccttaacttcaactatcattttctgaaatgtttgtgcattatatacttgaatattaactataagttgggtgcagtggcccatgcccatgatctcagcattttgggagaccaaggcagaactacatgaggccaggaattcaagaccagcctgagcaaccaatatagtgagaccccgtctccacaaaaaaattaaaaaaaaaaaatagccaggcttggtggttcatgcctgtattcctagctacttggaagactgaggcaggaggattgcttgagcccaggagctcaagtttgtggtgagctgtgatcgtgccactctactccagcatgggtgacagagtgagactctgtctctaaaaaagaacaaaaaaaccataatgtctataaactatatatataatatattaagtacattatacggacacacacacacacacacacacacactttctctctctctctcatttagaatgttcatcttcctcttccacaggagtttaagctccataaggacagcacttttgttattttattcacgttgaatgcagaacagggcttggcttacagtatttaggtgtttcataagaacgtagtgaataaatgaatactttggaagtgtttccaaaatttgttctcaagtgtatcacattgatcactcctattgaaaagaattaaacattataatgtgaataggtgagatatatgtttcagatatatatttattttagtttattttaaataaaaaagaaatacatagtgaacaacaggaattattttaaaaagcattaacagatggcattcaattattaaattatagttcatctttcatagtagagaaatatgaagttgttcaatgcttggaaattgttgtatgcattacatgtgataaaagaaaaaaatagcactaccaaggggcaggggaaaataatctttactagattttacagtttaaaattaggttgctgaaatgtatatggcaaaggtgtgtgtgtgtaattgtgcttatatattgtgtttataactttagtgacaggaaacaatataaaatcatatgaataacttgtgataacatcagcacataatgatccctttcttatctggtgttttattgtactattcaaaagtgctaaataaaaaattcttctaaacatttttttcattaagatggatggatatgtattttctccttctctccccctacaccccatttctctccctttttcattttttaaaacatgtattaggtaaacagaatgttggtagatagaaatatacagatagatagaaacaaaaagtcttctctcctggagttgcgatgcctggtttaacattctgacttggtcactaacttgttttgcttttttatttttttgttttataattgttaactatgttttatttactttttttttttaaaagaactaaataacttcaatggtcatttagccactgggattctctgattctttttttttctgttaatgtaacaagttaaaaggttaagtaaatctttaggcctcagattttttattttgttttggtttgttttgcatatgaaaattataacttaacctagaaggtccctaacatgatgcaattattattctattaaatacagttgagttaattgattacaatttgttttaagttagttaccagaagtttaaaaaccatgtcctggtatttatgccagctgtacattcagggttctctttggctatgacatcagggcagagtactgacactcatgagtcaaggagcagggaagagggtataggaagccaataatttagaaacttaatgacttacactccactttcgaaaccggcaaatattagaattttttttaactcaactttccaaggtaataattttaagttttcagagttcagtgacttagagacacattgcaacaaaatgtacaaaagtcttcttggctccatactgtgaaagacaggggaaagaatattgtctaatgttttctatggataaaatggttgcttaatttaaatgaaaatgttttttactaccttgaggggctctttttcctgtgagtttctttggtgtttcagagagagtaagtcctattcaattaaatgtatagtgaaatttgcgtataaaaagaaataaactctccaataaatctgtggtcaggtgtatgtgtgagtgtgtgtctgtgtgtgtgtttgtgcttatttgtgtacatataggttaaactttgcatttgagaagaaagtttctgaaattgatttagaataatttttatgtttattaacttatttttagtagagaaattacagcttgtttcatatcataattatgttaacaatttattaggataaaatgaaaatgtatgccaaacatcaacattactctttattaatatcaatttatgaacacatttatgaagaaagaatatatgaagaaagctgttcaaatgtaataaccaagaagacatataaatggcaattagttaaactgaaaactttccaatttcatcttagaaaaaggaaactagcaatatgaaaataacaaaaatcaagcttaatttatggaattctccatgaagaaaaatccttaattatatactgcatatttttggtaaggagaaatgtttttattctacctaaaatttttctagaattgtagaattaaatgatggaaattgaaaattaattatttggatgattaaaaataagaaaatcattattttaatttgaaaaaaaaatgttaatactcttctgcagggggcaaatccatgcaagtatatcttcaaagtcagaggaagccaagaggcttaaggaagaggtgaacatattgttctcagaaagaaacattttataggaaatttgaacagaagccatgcctgtgcctccagcaatgagacatgctggcacagctcagtgaccttaccccttggacccagggcttatataccatagggaaagaatgtgtaggacaattgcagggaaaggcaaaggtgctctgtgaatatgcctaagggcaggatttatggtcaaagctgttttgaaataatgcggtaatttttggtaagtacatgctcttactcaagaaacaaaagataaactggagatcttagaggcctttctagaactggagttaactagaagtcaacatggtggattagtacccaagatggaattgctttagcttccacagataccaacagaaaatatagtattataatagtattgagtataagaataaagaaattggactatgatagagctcaaatttcataaaatgaaaatttttttgtttggtttgattgtgcttctttggatcatatatcatgaaatatatttattattgtacttataatatcagtctgtaatcatttagatgtttagtttattaagctcttcaattctattatgtagtatagttttcacagactcatttactgaggtagaatagatcttattacttttattttaggaatgaggaaacagagatttagctaaatcaagtgtcttaaggaagcagcaaattgaaatgccaggatccagtcccagcattttcattctaacttcaactttttttttaatataaccacgattatatgtattttcaaaaaaatcatttaaatgttatattattaaaattggacttgaactcaccttgctccagtataaattctacattcaaatcttgatttttatgtctaggtttacattagataaataaaagataaaaatttagatacgcttctattgtcaaaagccttgtatatctaaagctaaaattacttctgatttcctatccataaaagagaggtagagggagggaaatcttgctgaatttgatactagtttaaacatcctctaattgaggtttttttgtttgtttgttttgttttgttttgagatggaatttcgcttttgttgcccaggctggagtgcaatggcatgatctcggctcaccgcaacttccacctcctgggttcaagcaattctcctgcctcagctacccgagtagctgagattacaggcatgtgccaccacacccggctaattttgtatttgtagtagagacggggtttcaccatgctggtcaggctggtctcgaacacctgacctcaggtgatccacctgcctcggcctcccaaagtgctgggattacaggtgtcagccactgcgcccggcctcctctaattcttattaaagagccctgtcctgaaacttctacttccccctattcttcttacactcaggaagagaaaggagcaggaactgataaagggacccttctcacttggaaaccctcaacctttgaatatccagattttctgctgcacatataattgatattgtcacaacatttgggctcttttgtagcagtctgtgactgatttcgtcttgttttactttatttactgtaacttcaaatgttgtagcgtcttccaattagtagcctcttcatgaagataggactgagtattttgcataagacattcattcaaaataaaatgaaagattaaattaactttattaaaatgaaatgattcggatagcatcctactcattagcctttagttcattttaaaacaaatataatattatcgtctatgctttcaaataaatgtcatacctccatctaattaatagtgataagcagttaagaaaaaataaaaattgggttcaatatgacttttacaacactattttaaacatccaaagagtactcaattattttcctactttccattacttttgaaagcgaagtattagatagcttttaaaaaattacaacatttgtatgtatgagtaaaggttagaatttaaagacagaagctacaaataatatttttcatcttttctatatgaaaagacaccagacccatttaatgcacgccatgagcgtttggggactttgacaagctgacttgtagatgtaaaaaatctaattaaaattgttgtcaattaagttacagtggtactcagataattgcatcactcttcaaagatttgtcttccaaacattaattttaagtatttcaaaccattttattttcttttttcaaaaactttctgatgcagacctggtgttttgttgttggtaattagtgtttacaatcattcacataattttttaaacatttgttttaggcagaattcaagtgtgtatccataaaatcagtaacattttgttttgtaattagaaaacaactggactttattagatgtaaatattgtttaaatttacggtgaaatttcgtgtgccaaggaactagaggtagcaactgaaggataattcatgaaactaaatattaactcaaaaggtttttttttttttttttttttttttttcccgagacggagtctcacactgttgcccgggtttggagcgcaatggcgcaatctcagcctactgcaacctctgcctcccgggtacacgcgattctccttgcctcagcctcctgagtagttggtattacaggcacacaccaccacacccggctaatttttttctatttttagtagagacggggtttcattatgttggccagactggtctcgaaatcctgacttcgtaatccacctgcctcagccttccaaagtggtgggattacaggcgtgagccacgtcgcccggccaaaagtattttttcataagcaaggttgtaaagttaaggttcaatacaacacatttggttgtgtaggagtgaacatctggaaatgtttaataaatataattttactgcatgttagaaaaatatagctaattcttttagaatattattttgaagaaaataataatatacatggtgtgcagatatggcacaatacatgggggtgggctgaattttgggaaacactgatttaatatcacatttattgtatagatgagggaactgagatccagagaaataaaatgaattattctaaatcatgcagttttaggatagttaattaaatttgaaagcaaataccatatctacctagaataaataaaaatgacttttttttgtcaataatcattaagcatttactgaagacttacaacatgtgtaaggtgttatgatggattaaaaaatgcttcccaactctattagttcaattgaggaaagttcttgctttaaggatatttgaactagcagagagcgcctttactggggcctggaaacatgtgggacactaaaatagcattcacggtcatacagtgttctcttcttaatacgctctcaattcaatctcctatataccaaatactataatattaaaattctaatatttttggctttttgctctgaagtcatttaatcctcaatttccagagtgatccctttgtaatgtttagaaatgtcaccttatatatttaaaattatgtattttgacagtgtggattctctgtttcgaacagcaaatttataaattatgaaattaaaaaaacccaattatcttttttttttattattttatttatttatttatttatttatttatttttgagatggagtctcgctctgtcgcccaggctggagtgcagtggcaccatctcggctcactgcaagctccgccccagcctccagagttcacaccattctcctgcctcagcctccagagtagctgggactacaggtgcctgccaccacacctggctaattttttgtatttttagtaaagacggggtttcaccgtgttaaccaggatgatctagatctcctaaccttgtggagacgcccacctcggcctcccaaagtgctaggattacaggcgtgagccaccgcacccggccaaaaacccaattttcttgattattactacagttcagctatatcagtgcacatcttatctaccaggaaaatgggtaaaatgcatcatctgagatctttatcaccagagattctgattcattagtttttatttttacaaaacccacagggagcagcagaacacacagggaggacagggtagagactaagaatttatagttttagcaagtagcaagctaattccaatgttggtggactgtaagccatgctttgagaaaaatttaatcataagttataaaatatagaagtgagaagtaaacatggttgaattgaattaatccctgaaaacatattgaactttattcagtgctattttaattgtattttttaaagtaaaggagaacatgttacttcaacatctatcaagagtgaattatggtttttatttgtgttttaaaatatcttggctgtgtacatttataagaaacaaaacaaatttttttaaaaaactctccattaaaagaacttcatgctaactctgggacctcaatctatgtatagagtctcaacaggaaacttaaatgacaaggaaatgagaaaaattttgccttcttattccttgttgaatcaaggcagagtccaaggttagtacactgcatctaaggtaggaaattgcttaagcagttttcaaaggttcattctgccttcaggcaaggattttctatttaaaagggataagtttagccaggagcaaaatattcctcattgttttttctctaaagacagaaaactctcagtaattttaacctccttgattgtatgtgtggagcaatatgaagctctgaagtaactttgtaactgtgctgagtccgtgaaggaggtacactagttgagtaatgaggatgagcgaggcatcatttatcaaaataatcttcaaaatcttgccttacttcacacacattcttatgtacaagataaagagaattaagttatccaggtcagcatcagcccaaatatacagtttgttcttttgttcttctacagtcagcataaccaggctacaatcaggatacctcccatccttatcagaatttcacaaagaagttcattagtgtgtcctgtcactctgaaaaccatatagtcctgcaaagtggtttgtaagtccatgttgatggatttatgccacacctttagggacaaagatcaagcatccttagctactttataatttggagaatgacttaagatttcaagattggggaggctttttatattttactctccttaagcttttaaatcctctgctcagtatatttacttcttctcagataagttttatagagttggagaccagaaaagaaaaaccgtctggtgtttcttgctccccaggtatttctaaacatttcaatagctttgctacaaatactcaatttgtaccattcaaaattaggacataaattcagaaatcggaggataaaaataaaggcaacatggcagttgtgattgatataactgggttaaattcttctacagagaagagtttttcaagaagcagttagatatctactttcacaggttgatttaaccaggatgtcacttgaacaaagaaaaattccttccctacattgtctgcattacattaattctccattaaaaatgtttattattcagtgtaggaggcggttttactcagtcatctttcaaatatctgcttcactcatctgttccaactgatggtgatagtagtttagaaaaagtatttttaaaaaacaaatatttgaaatcatttttatgtagcccagcagtacatttcatcgacttcaataaatttgatcttattgtttgtttagagtaatattggtgtctgttatttgttgataagtctggctagaggatggggagaaaagagagagtacctggatggtagtttgaactttaaaagtctctattattaagaagttcaagatgattttacttctgtaggatataccgcttgtttaagatttcgtggctcttttcaaaagcaaaacagtgacatctgttttatgatgcatatttgtaaatttcttatactgaatcacacttttttctttttatattcatgtattcttttagcaaatatttattgaattctttatttgcatgatatatagtgatagaaataatattccctgagctcaaagtttatcatttagagagatgacatccatacaaggaattagagaagatagcctttattgaatgtcataaatgaataggaaaatctctagcaagagttcaaatgaggatgaaatcatgtaagacaaaatcccatttatacaaacccgtgaggctatctaaattctgttggtatacaaaatgttatttcacgttttgctgctcaccaagctttgagggaaatggcatcattttaaattaattactcttgattagcataattatctggctttctagagctttatcttattttgacatcaaactgttaaaagcatatagaattgtatgtatattctattttcaatttcgtttaatgcaaatgtatatagacaaagactagaaaaaagatataaaatatggtgattttattttcaaaactgttaatgatactatctttctaagtatatatatttttaaaagtaggaggtatgagggtattgatactttgcctctcccaatcagggaagacagagtaaatactgatgtgactgacccttgtgaaggttgactgacaccaataaaatgacacccaaaatagtacttcttcataggcatcagactgagaaaggaaaaaatgaaataaagtaaatagtactacatctggcacatctaagcccacaataaacattagccctaataagtgctaagcagtcttctcaatgtatagccaggtggactagtagcagtgtatacccatacagctgacttcagagaatttcaaagcacctttgttctggaagtgttatcttctgccagagatcccatatacacttgcctgtaaggcaagggaaccattgtcatttttattcatagctttattcccagggcctaacttactatttaaaacaaagagactttcaattatatttaaaccaactaatcaatcatttattaatttaaaaatctcagtcacaaaaggaaaaataagctttaatcacattcaaatgtttcaacacaatgtgcaggagaagttaagtaaacatcatgcaatgtttctatgttaatttgttctacctggattagtggtgaaactcctcattacggaaagtcaagtatgcaactgttctttggccaagagcttttgaatctcatagtgctccgaattaatgaatccaattggaatccagtaggtaacttagcttaaatataagaataaaagaaaattgtgtatttataattttttttaccaaacagaaagttcaacacagttttgtatgtataaaaatccaaggaattttttgtccagttttggattcagaattttttacagaactcatgattctaggatgcaaacaggaaatcaggatctcaagtcaggctaactctgcaaactgtgtttattcccgttctgtgataatgtgaccttcccaaagcaactcaagattaagtagacaggtagggatgaaaatgaaatatttttggtggagcatttggaggagtattaagaactgcttgcacttgattacctattaacaactggtctttgaggggctttattttcctgtaaagatgatgcaaaagtttttcctctttatcttagatgtcttcaagagacagaatttaaatcataaacattctagtccataatattttttttctcagtgaacaaatttttttccaccttctgactagatatcaaatactaaagcttagtttcgacttttcttgtcacaaaggaaaaataatgaatgattataattatctgattttagctactgctgcagctgaaggcaactgaattttgaaattttgtcatataactgtatatcatagaaagtgtttgtttcgtttcaacatatttctaattcatatttaaggataccaattagtatctatatattctagagggataataaatatggccttttcaaaaaaacaaaaacaaataagaaaaaaacacaacaatttggccacagagatctttcttccttttttattttggacataattttgctcttttctgcccaggctggagtgcaatgacgctatcttggctggctacaacctctgcctcccgggttcaagtgattctactgcctcagcctcccaagtagcgtggattacaggcgcctgccaccactcccgggtagttttttgttttgttttgttttgttttagcttgagactgagtctcactctgtcgccccaggctggagtgcagtggcactatctcggctcactgaaacctctgcctcccgagttcaagcgattctcctgcctcagcctcccgagtagctgagattatagacatgagccaccatgccccgctaatttttgtatttttagtagaggaagggtttcgccaagttggccaggctggaatccaaagcctgacctcaggtgatccgcccacatcggcctcccacagtgcggggattacaggcgtgagccacccagctcggcctctttttttctttaacaataaaaatacactcactcattcaccaattcaatgttatagttctcagagctcgccacctgagttactcaaccctaaccaaattgtcattttcctggcttcttttctttcatgatgccatcttcacctcttgattttacatatataacatttacctgtcactttccaatacagaagctaagtacttggccaatcaaatccttcactgaatactagagggttctcaaggtggccatgtgagaattagtgcaatataaagacaaaagaaaaaatatttcgtctgcttccttttttttcctgacccaataattgatttgcattacaacacaagtcaaggtaaaaattctatatttatgattttatagttgtcaatagatcatatgacagtattgtgattagagaaatggaaggttgcagtgcttaataaaacaaccataatggctgctaaaaacttttgttatagttattaggtagaaaacattactttttaggtattgtttttattaaataggaaatgaatgttgagaaaaatattgtctttcaaataatgaggggaatgacagaattaatgtgatgttgaaatgttttatgaaatatatgttttgatgtgatatcctaataggtgtaggatcataagcaatacactttttaaaaagtattatacttttaaacatattgttttaaaaataaaattagataagtgatttaaatactgttactaaatagtatgttaggaattaattttctatacctttcaattttcattatgtgctggtaatattcttaggacacatatcatttagtaaggattagagccagctggggcagattatggctcaggaataatccttaaggaatgcccagattcaattattcctacttaaatgatttagtttggatgcatttggtggagtagagttttattttagaagaaaggtgatattttttgtctttagttctactcttgaaatagtctgccagattgatggagcctcatttagggctcatcagaagctgtgaacgctgcaatatggtttgattatagtgctaaatatcaagcaacagagacaagaataccatttagccaggtgtggtttacacatatttgaataaaaaatattttcctcagaacttaagataatttgttttgtacagaaagcatattttacagatcttaggaagcaagacttttaaataatgtaagactgtaaataattttagtaaaatatttttgattaaagaaacattactgaggcaatactggatagtcagtggctctctcattttttttttaatttcaaatgcctagaactatattaggggttttcagttagaaaaacactctgttaattaaaaatgagacattttatttactgtgaaatattttagacccttcatcacattaatatacatgcatacctcagagatactgtggcttcagttccagacctccacaataagtgaatattgcaataaaacaagtcacaaagatgtttggtgtcccagtgcatgtgcatataaaagttgtgtttaaagtatactgcaatctgttaattattcaatagcatatgtctaaaaaatgtacatattttaatttaaagtaaaacctttggtggttaaaaaatgctaacaaataatttgagccttcaacaagtacaaatctttttactggtggagagtcttgcctccatgttgaaggctgctgagtggtcacagtagtggttgctgaaggtcggggtggctgtggcaatttcttataataagacaacagtgaagtttgccacattgattgactcttcctttcacaaaagatttctctttagcatgtcatactgtttgatagcatttaaccacagttgaacttccgtaattacagtcagtcctctcaaactccatcactgccttatcaactcaatttatgtaatatttgaaatcctctattgtcatttcaacaagatttatagcatcttcactaggagtagattccacctcaagaaatcattttctttgctcatccataacaagtaactccttatctgttcaagttttaccatagtattaccacaacttagtcacatcttcaggctctgcttctaatgctcttgctgtttttatcacatccacagttattttctccactgaagtcttgaacttctcaaagtcatccatgagggttggaataaacttctcccaaactccttttaatgttgatattttgacctcctttcatgaaccatgaatgttctgagtgtcatctagaatggtgaatcctttccacaaggttttcaatttattttcccagattcatcagaggaatcactgtctatggtagctagagccttaagaaatacatttcttaaataatgagactgaaagttgaaattactccttgattcatagctcgtagaatggacgttgtgttagcaggcatgaaaacaatgtgagtcttcttgaatatctttagcggatgtcttgggtgaccaggcgcattgtcaatgagcagtcataatttgtaagttatactgttttctgaacacttggttttgaacagtgggtttaaaatattcagtaaaccatgctataaatggatgtgctgccatccaggctttgttgttccatttatagaacacatgaagaataggttagtataaatttactggatccaggattttcagaatggtaaataagcattgacttcagcttagggttgtcagtttcattagtccctaataagagagtcaacctcttctttgcaagtttgaagccaggcattgacttctcctctttagctatgaaagtcctagatggcgtgcttgtccagtataaggctgttatatctacactaaaaatcggtttagccacttcatctatgatcctagctagacctctggataatttactgcagcttctacatcagcacctgctgcttcactttatacttttgtgtcatggagatggcttctttccttaaaacccatgaaaccatttttgttatcttctgacttttcttttgcagctttcttacctctctcagccttcatagagttgaagagagttggggtcttgctctgcattaggttttgatttaagggaatgttgtggctcgtttgatcttctatccagatcactcaagccttctctatatcatcaacaagaatgtttggttttcttattatctgtggtgttcactggagtaacacatttaataaccttcaagaacctttcctctacaacacaacttggctaactattcggtgcaagaggcctagcttttgccctgtcttggcattcagcatgccttcctcttgaggcttaattgtgtctagttttgattttaaaataagggatgtgcagttcttcctttcacttgaattcttagaggccacggcaggacttttcactggcctaatttcaatattgttttgcctcagggaatagggaggcctattgaacattgaaactctgcctctttccagagtacaacaagttaactctagctacctgaagcctcctttaatgttcacttgaaggactaatggaattgagtggaagctcttctcaattaataataatgctatttaaaaatttcatgttgaatcagaatgtaatgctttatgtgaaaagaattactaagtatgtccatacagtgtcagttgagaaatgttctgagaatggtactatcaatgtagatgataagctggtgacatttggtctccccaaaaaaaaaaaatcgcatctaaaaggcaaagtgttttaaataaaggtgtataggattaattactgctgcacagtgttacagaaacaagctgaaaaacaggaacagattcttctttcctcttaaacaattcaaccatcaaaataaatttattgaaataaaaaaactgttaaaatttaagtaagttaaacttgatggttttgcctcttgtgtaatcactaatacgacatcttcagtccttgtcaggatagaactaatggagtacaacgtgttgtaaggctgtacttttatgaattaatgatctgaggtttgatggtaatgtttctactgtctttgtaggtttgatcttcctttgccactgctgacagagctaagcctgggggtgttctggttgcaacagcctttccttattgttgtttgattttgagaactcccatgttattgatacgtggagggaattgtaaaacttgttgtgaattaaagctaagcctcagattttttgtgtctggatttgaaattaactcagctctcacttgttcacattgctataaatatgcttagcattttttgtgaggaatatctaaagtgccaagaatgaaaagtgggctgccctgatggtacttttcatttcaaaatcaaacatattccttgcttttgtctgtgatgattctgttgtttaaagaacatgttcttacccccgtttttattgtttggggattctttgttgtaagatgactctcagaaattactttttgattgatagtcagttaaaacttctgatcagaatgaagttgtcttcttcaccactttcagttgtaattctggccaaaagcaaaggaactttgatttacttaatttgtgcacttggctaacatgccgtttatattagactgtttggaaatagcccaagtggtggctgtattgctctttgtgaacctgttatgggtatagtaactctcaagtaggaaccaactgtgttaaaatgttaacttccacatggtaatatactatttctttgttttttaagaaaattcaactgaattttaagctaaatgttcttaatgcaagatcaatatcttgattctcatggttttcttttataaattttggtttatttttaataaatgtggacttgcaattgcaattacaactttcagccctttctagtacaaaataatataataataataagcctcaagaggcctatttcctgaggcaaaacaatattggggaacagccagtgggtggagcagccagaaccagcacaacatttattagtcaattttgccatcttatataagcatggtttatataagcatggtttgatattacaatagtaatatcaaagatcacttagtatagatcaccacaatagatataatcatgaaaatatttgaaatattgcgagaatcaccaaatgtgacacaaaaacagcaagagaggagatgctggaaaaatgggcacaatagatttttagatgcagggttgccaaaaactttcagttagtaaaaaacacaatagccttgaagtgccataaaatgaaatataatgaaatgaggtatgcctctccctgtctccaagaaaaatatccaagaaagacctttatatttgaccagagaatctttaaatttgaaatatcttaccttgctattattattattttaaatttaattttatttaatttaattttatttatttgtatttattttttgagacggagtctcgctctttcgcccaggctggagcgcagcggagcgatttaggctcactgcaagctctgcctcccaggttcatgccattctcctgcctcagcctcccgagtagctgggactacaggtgcccgccaccacgtccggctaattttttgtatttttagtagagacggggtttcaccgtgttagccaggatggccttgaaaacctgacctcgtgatccacccgcctcggcctcccaaagtgctgggattataggcgtgagccaccacgactggcccttaccttgctattattttttgggggaaaaaaaaaactgttgaaatcactaatctaaatattattgcttcccttttacaattatctcctgtcttcaatttccttgctgtgtttaacataaataactctacatatgatttctgtaaaaggccacataaacccacagtactgttaatatggtgttttgtttttttgttcatattgttatcattattgctggttccttgtgctatttcccatcctggaggtctacactctcctgagagatggtaaagagagaaagcccagcaacataatgtctggatggctcagtatccttacataggacacccagagggtgccccaactcagcgtacctgattactgggtttatttttgcagagcttggtgcctggtgactagaaaagcagacattagaaatttgcatatctttgtttttgttttgttttgttttttatcagctctggattgaagaaagttggtagaagtagcagcaggtcagagaagttccttttaaggttctggccccagtacttatgtgcagaaatcatttgtgtcatgttcattgtgtcactcattgtgcacccctctcaagtgctttaaaatgtcttctccctagttagaatcaatggatcttgattctgatctctgcctctaattgcatgatggttttcatatcatggtgtcatcattagataatggtgctaggaccaggtctactgcaaagtagagtagaggaagcacagttttgacaaagatcttttcttaatcagatttcgcctgtgtattttggatgctttcactattgatgaaaagagaatattggcaaaatatgttcaaagtgcctcctgttttctttacctttttctctcttgctttcttaaaatctgattctgtccttaagttctggctgaactgtgcattttcaaattttctaactcattgtctttatttctttctgtcctcttttataccatgttctctcgctaataatagcttctcatttcatgcacacactgtttctatacatctgtttcctagtgcttaacacaaagaataatgcagagtaaaccatttatatatgttaactgaattaataaataaatgagtgtgatagtatctatgaaacctagagttcgaaggattatgatgcagcctatatggtgtatgatgaaccatctagcttaacttgttcaaagagagaagtttatgaaaagaattgttatttcatctttctcaactttctggtactcaaacgattatattgtatctattgtttaaaactgtcatttattctaattattaactccagaacacataataaatgtacttattagaaatacaacatcttagggtagaataaagggctcagaagaggtttttggggggtagtatttaatgatttaaatatttagtaagaaagtaattatttatataattatttggctattctagaagcctgtaatctttcgaatttgcccagtcaaccaagcctggggtttaaatgaattttcaacacctttctgctgacagtcacacatgttaaaccttgatttgcttaaaagtattattaaggatgagaatgtaatactgccagtggtatgtggtgatattattgtggcgctggggggatgaaactaacgtctttcagtaagtaaatgtttaattttacacaccatataatcagttgtattattgcaagtgcacagcaggtatgtagaaaaatagaatgcatatatttaacatattagaaataactttattaatattcctatttcatgttctcatgaaattttaatcatttgcattttttagcttcaaacatttttataatatgtttctcttgcaccctttatctagtagctgacaaccatatagtgatccacttatcagttctttttaatgcaaataaagcggacattttttacctattagatcacttggaaagaaaaaaaaactaaaatcaatgtttcatgctacatattatctgtatatgagcagatatacacattttacaggtcaattttattgtattttggtaattgtctttcctttatcttctcttatttagtctttagatttaaaattgaaactgttgttgttgtactgaatgctaatgcagtgcaaaccaagacagtatgttttacatggcctgaatagattctttgtcactcccttaggaaaaatacgttgttcatctcatggaaataaacctttatatatagaaaagtatttaagagaaagtaatttttaccgtttaagtattaaattttacctaaacttctattacgtgaatctcagtagatacgttcaccattataaagaagcagaagttctggccagggcaatcaggcaagagaaagaaataaagggtattcaaataggaagagaggaagtcaaattgtctctgtttgcagatgacatgattgtatatttagaaaaccccatccatcgtctcagcccagaaactccttaagctgataagcaacttcagcaaagtctcaggatccaaaatcaatgtgcaaaaatcacaggcattcctgtacaccaataatagacaaacagaaagtcaaatcatgagtcaactcccattcataattgctacaaagagaataaaatatctaggaatacaacttacacaggatgtgacagtccttttcaagaactacaaaccactgctcaaggaaatgagaggacgcaaacaaatggaaatatatcgcatgctcatggataagaagaattaatatcctgaaaatggccatactgcccaaagtaatttatagattcaatactattcccatcaagctaccactgactttcttcacagaattagaaaaaactactttaaatttcatatggaaccaaaaaagagcccatatagccaagacaatcctaagcaaaaagagcaaagctggaggcattgcactatctaacttcaaactatactacaaggctacagtaaccaaacagcatggtactggtaccaaaacagacatatagaccaatggaacagaacagaggcctcagaaataaagccacacatttacaaccgtctgatctttgacaaacctgacaaaaataggcaatggagaaaggattccctatttaataaatggtgttggtaaaactggctagccatatgcagaaagctgaaactggaccccatccttacaccttatacaaaaattaactcaagatgaattaaagacttaaacgaaaggcctaaacccataaaaaccctagaagaaaacctgggcaatatcattcaggacgtaggtgtgggcaaagatttcatgacaaaaacatctgaagcagttgcaacaaaagccaaaattgacaaataggatctaattaaactaaagagcatctgcacagcaaaatagactatcatcagagtgaacaggcaacctacagactgggacaaaatttttgcaatctatccatctgacaaaagtctagtatccagaatctacaaggaacttaaacaaatttacaagaaaaaacaaccccattgaaaagtgggtgaaggatatgaacagacacttttcaaaagaagatatttatgtggccaaaaaacatatgaaaaaaaaagctcatcatcattggtcattagagaaatgcaaatcaaaccacaatgagatgccatcacacgccagttagaatggcaatcattcaaaagtcaggaaacaacagatgctggagaggatgaggagaaataggaatgcttttacactgttggtgggagtgtaaattagttcaaccgttgtggaagatagtgcagtgattcctcaaggatatagaaccagaaataccttttgacccagcaatcccattactgggtatatacccaaaggcttttaagtcattctactataaagacacatgcacacgtatgtttactgcagcactattcacaatagcaaaaacttggaaccaaccaaaatgcccatcaatgatagactggataaagaaaatgtggcacatatacaccatggaatactatgcagccataaaataggatgagttcatgtcctttgcagggacatggatgaagctggaaaccatcattctcagcaaactaacacaggaacagaaaactaaattcctcatgttctcactcataagtggaagttgaacgataagaacacatggacacagggaggggaacatcacacaccaggggcctgttggggagtcgcgggggctaggggagggatagcattaggagaaatacctaatgtagatgatgggttgatgggtgcagcaaaccataatggcacgtgtatacctatgtaacaaacttgcacgttctgcacatatatcccagaactcaaactataagaaaaaaaagcagaagcaattaatagtgttgcaattaattttcagttttaaaaatgtataagtacctgttatgtgccaggcattgtattacacactaaagatacaaaagaaataagaatttagacatgatctccagatacaaatagcagactaagcaaagtagaaagagaagtcctggatgaaccacaaggttgtttatctgttctctaaataagaagtgtgaagtgttttggaaaagaaagggagaggttgccttccttttcactagtcatcaggttgtcacctagagctgagcagcatttttttttaagaaaattagcacatgtactgggtgaaaacagcctattttctattttaatgagctaggtacatagaaaggaagacgtaaaattttcctaaagtagaatcagtataggctgtaatgttttgcagccagaatctgggacagacttgcctatctgagaataaattgttacatcggcatcataagagtcataagtactgggggtgcagagtacagagcccacttattgagtcacacttgcacatataatgattttcagtctctgatatatgtaatgcataaatggccattaaagtcagatttttcaagggcagttctgtgtcaaatattctttcctgttttcttaaatattgcattaacatattgagagattcccattattttacctttgaaagtatgcctcttataatgtattttgcacccaaaagtatctctaaacagacacatatttaattatatttgattatgaaaatgtaatagctggtttttttttttgtttttgtttttgttttgagatggagttttgctcttgttgcccaggcttgtgtgcagtggcacgatcttggctcactgcaacctccgcctccagggttcaagcaattctcttgcctaagcctccctagtagctgggattacaggcacctgccaccacacccagctaatttttgtatttttagtagagatggagtttcaccatgttggcctggctggtcttggtttaaactattctgttaaaaaaaaattgagggaacttattctggggtaaatgatgttttcaaatacattgttttttgaaaaatttgttctgagagatatattttcttcattgttaaaaaaaattgagggaactttttctagggtaaatgatttcaaatacattgttttttgaaaaatttgttctgagagatatattttcttcattgttgtggaaatatattatgtaagctatattattatgtgtgagaataaagaatgtattttctctgaaaatgtggcagctcattctttgttcacagtgctggttaaagagattaggccacaaatattagccatcacattgttaatgcactcaaactgccagttcatgaccctgagattggagaaattaataagaaaaatataaacataattttaaaaataactgatagaaaatccacttgggaacacataatttttaaaatctaaaatcatttaatgataaaatagtatgtggtcttgccaaatgatctactcttctactgtgaaaaccatagattattacagatttgtaaagttgttgacactttaaaattaattttatttgttaaaggaaacaatttactaacattaaactgtttagcataaaataaaacagcatgcagcatttcattacagcaaacatgaaatatgaattctaaagaaataaaatatgaaagaaatgcattctttttatagcctgaaaagacaatattaatcaaaataaccaaaatactttgaaaatcaatgttgaatgtgaatgtttctggttttctttttcttggacttgtatttacttttgtcaaggtaacataaagctacagtatatatcctctgtaacagtaaaactcagaatgtagattttttttctgagtatagtgcctaccctagtgcttaccctacttatctttataccccatagagtttaaacccgtgactagcagaagtgagtgctcactgatggaaattaaaatgaatatatgcctgaatggatgaataaataaagttaaccatctgctccttcttgttcgttccttcagaactctttattccatattggttagattatcacttttcaacccaggggcatggtggggaaataggaaggtatctggattgacataaatcctgagcccttgtcctggctctgaccctttctagttatcagacattaggcaaatcactgaacttctctgagcctgtgttctcacctgcaagatgaaagggttagaatagcatgatcccaaaagtatgcttctatattataacatagtagcccatgtgtaactttttttttcctcttaatctttacagtttgtcaaatctctgctccatgcttttcttgggtgtaaagagataattaattatttctgtttaaaagatttcctactgtgccacagctggcacaggtgaaagaaattaagtaagaatgcagtagcacaagacatcatcacccactctgcttaattatagaagtcagaacttgaaaatgagatttatgaggataagttgaaatgcagataatatgtttcgggataatgtagagttgatgatgtgttattttggaatcttaaatttccaagttctgcataagtaaaggatgatggtatcataaatccaagtggaaaatggatccttcagtgtctaggccagtgagtttgatgtggacccagtaaacttttaaatttgataattaattacctagagtgtgggtactaagaaaataaataactacaagctagcaagtcttttggttacagctaggtcagctcaaggagctgtgtgaaaataatggtctttaatttttactaggcatttaacaaaaacatacattatatttttgtccacatggtagagaaatatggaccaaagtacattcataaggttgatcaaacctacccaaatagtgttcatataaatctagagagaaggtctcctttaccgtgttatggtggtcttcttttattagcttttccatgattggatgtttatttgcttattatttttcagtgactgaatatgatatttttaaggttctagatgatgatttagtgcttgcatttgtatgaatgtttagtgttatcttgaatggccaggaggatagactataaaccaagtaggtctacattttataagacaggggttttacatttgaagtttaatgttaaaaaataaataaataaactacaagtacagaatcctgagggtcccagcttgacaatatttcaaatggagaatattggtgattgcagtaatctggagcttaattaatagaaggatagattttaggcaaaaacaggtaatattcctactatgtactatattgctcagacttcatgatgagtacttaattatggggaacacgtttaaaagaacaattgtctaactgaaataaattcagcaaaataataagattgttgaaagttctcaaaatcttgttcagtgaaccgtgcttgatttactatccagattattcaaccagtctttattttatggtggccataagcctgtttccctcctgagaatcaagacttcttccactattaatccttgtatttagggtaaagttgactctacagtctgcttcttgggcaggtcaaggggagttcttgaaatagaattaagatcagtaaagatgcactgtacggccataattgctatttatggccagtgtccattctaactggcctgaacccagttagtttatatatgttatgttaaacctgtctcccatatttaagttaatcaatatattatatttgtcatgccacagggattaatactgtggttaatgagaattggctggggacattttctgtcttttccactaaactcagagttatgaagtcacaaagctgggactatcttaacattaaaatggataaatctgtgaggccaacatggggtagaatgtaagacaagttttgaagatggcaaaacaaggttctaaagatgtaatctgagcctctggtcataccaaacctgtagctggtagatctactccagtacatgggttaaagaaagaatgttttgcttaagccaaaacccaaagagcttgaattgacacatcatgtagaaaacatatatatatatatatatataaactgaaagatgtttagcttacaagaggtgagggaaaacaagttatataagcttatcagacttctcctcattatttagagagaatcaaaggctctatctgatgtaggaaggtagaattttcaggtagaccgaattgggatcaatgaaaaaggatgtacatcttcacaatttgagttaccagtaataaaacaagctgtcttctgtgcttaaaaaatattaaaatagagtgtagtttataaagactctcatattgagttgaaagttctactatctgttactcaaatccttagaatgtgttaactaactactgtgccagacattataccaggcactttatataaatttcctgtaaagtcagtaccattatgaactgaagaaaccagggagtaacaatgttgaataacttgcccaaggtaaagaaatctagtaagtatcaatcaatgaacaacaaaccctatgtgtctgacttttctttccactaacattctagcaatacctggattttttatgaattcaaagtaattatacaactcccctgttgtcagtattttagccatgatttacataacagaaaaatgaaacagtttagttcaaaatgaattatttttgatttagggacagtaaggaatttctaaaaatgcactaaaagcactttagtacgtaaattccatcatgactaaaaggtgccatgcctatgtaagtataattgtgctgaggtttatacaattccataagtactaaaaagagaagttttttaaaaagtcataaaaatgcaaaacaaatatgttctgatttctgagaaagcctagaagagcccccaggcaatatgtattcaagggctatgtagccaggtgttcccctctggggttgtattcaacgtgatttcttgagaattaagacagtagtgaggaaacacagaagaaaaaatttctgctgtaaataaaatcctgatagaaaaagcataccagggaattttggttgataattgtttcgctaatttattgcctctcactttatctcgaaaaataaaacattgtttggcccttattcaaataattttcactagtgcaggaattctggtaacctgatcatatatatctatctttattatgagatcttcagttgtttaaagttaccatattttataatattatatatatatatatatagtcaattgaaaaactgatgtagtcgagaacacaccttgcctaatataactgctacattgaattcatttacatcataacaatttctcagttctttaaaacagaagtttaaaagcagattcattatgtggttcattagattgaattctgtggtcagacaaacccaggttttgtttcttttgtgtgtgtgagacggagtctcgctctgtcgcccaggctggagtgcagtggcgcgatctttgctcactgacacctctgcctcccaggttcaagcaattcttctgcctcagcctcctgagtagctgggattacaggtatgtgcgacgacgcccggctaattttgtatttttagtagagacggggtttcatcatgtttgccaggctgatctcgaactcctgacctcaagtgatccaccttcctcggtctcccaaagtgctgggattataggtgtgaaccaccgcgcccagcccaaacccaggttttaattatgaccctcctgtttgctgggtgaactccttaagactctgcatgtctctgttttctaatctggtaatgaggatcctaatgcttaccttcttcagagattattactggtattaaattatattattttaaatgtctctgtctgcctgcaatggtgctgaatcaacagtagctgccttctctgttttccccaaacaaattctccccatgtctctctaagttctctgcactaatttcaaagttaatgaaaaacaactatccatctctttaatactattcagattttaagcctgtgattttgtgtataaactattctcaatcatacaaaacagtgtacttttagagaaagggcaaagttcctattttgtttgttttaaaaaaaaagtaagttagaatgaatgggagttcatttttaagtcaacatctatttcccttttttgtcactctactttctttcagaatctttccatgccacttccagcaggacttacacgtgggtgccctggcttccttagttgcattgcagaatagttattgtaaacagaaaatctttcactgccaaatttgaacttggagtagggggtcttccctaatttgagaaagtcattcaagtgtgtaactatataggaaatgtattactttataagtttggagaggcttggaaatattgctggaacacaacgaaaaaaggaaatgaaatgaaacctcattaactctgtccctaattcttttgtaagcagatagcagttcccttgaaatggaaaactgggaaaaaggccacaaagaaattatatgattattctcctaagatcacataggaatgaagtacaacagttatgagcataagctaagatgatttaggatgctaaattttggctaagcaaacatatacacttttccagcttaggaagagattcacgtatccaacactacatcttctttacattttaatttttacttcatctgaaaaattgtaagttaaaaaaaagttgtagataatatataagaaaatacaaaacaagttcaaacccacacaattatttttcatatattctagttatttctcactgatcattttgttgaaaatacatgggatatatcaatgtcctgactgcatgaaaaagaatttcagtgaacatccctaaaagaaaagacgcatatccatcctttcttccccgtacccagcaaaatgagaacataaacatttagtccctaaaagttttcagttgccagaaaaacaaagaaatatagttacacatccatttttaaccatatatagaacctagctctgatagacttgaaacaaataacactatttttcccaatgatttctaaaagcagcaaaccatgaaatacaatttcattttcctctaatggtaatagaagatatttcatgttgctaccaaacatatactgtatattcttgtctcttcaaagtctattttttattagcttaaaaccctgagctgttaaatgtagcataaaacttctgtgaaattacactgctttgcatcaggggaaaagggtcttttaattggatgattgcagaagaggagagaaaaaggagagagccttcaaaagtttgggtagttcagattttaaaaatctggatgcttcagcaaaattgccaatcctctgagctttgattattattactaatgtagcgcttacagatactgtaaattagatcttgagcacattatgggccaaataccatccttttatactcatgtgtaacctttaacaggtttcaatgggaaatgtgcatggttactcgaaagcagttttcccattatttttctactctaaatctgatacaaaataaggcaattagaagaaacatgttaaaaaattaatagtaacaataactttaattttgtatagacttttccaattacaaagagttttacacaacataacattatagctgtatagtgaaataagtttgtgtatataaaatcatattaaagcatcttcaatatcaaaatttaacatcagtatatctgataaaagatgattgtttagatttatgtttgacagagtagcattttgaaaagaataaaattttgaattcaattctgttaaatggtcaaacacgttaattttaataataggagtaatttatactttatataatctataaacattattcttttataattgtttttagtttatatttttcttgtatgtttgtaaatctgtcttttgttttccctttatttgcttgtttgcatatttctttttcagttttccgaaaaaatttagctatattatgtttttatttttctggttcattgtcttggaaagtattcaccaggatacaggcttccaacaaggcatattctgaggaagcatcctaagtcattttcacaagtggttgaatttctgagaagtaatatcagtcttgagctacttccattatataacctaggataaaccctgtgcattctagttattcaacaggacttggtatttcctaagcctgtatcaagatgcattaactgatttaatagtcagagttctttaattgtttgttattttgttttattcatttacattttttacaaacaagaagaacactatgatcttcagatcttcagaccaaaaaataagcaaaaacaatgttgaatgctattgtgcaaaatgaaagccatcaataaacaatatttgctgtgggtttttgcttgtacctaagttgatgaaacaaaggatatctctacttttgtggaagagagagaacaataatagcaataaacataatgaataaacacattttatagcctgatggaagatgaagatggtaattcctatagataaagaacagggtcacaaagatcaggtttatggaggagagttgcttgtaattagtcctagccctcgtcaaggaggtgagggaatggtcaagaaattagatgggagaggagtgttctagagatggaggggaaaggatgtaaatttgaaaatgtgcctgatgactttcaggaccagctgaagggtaaatagtgaaaatagcagggaaaggtgaggttagagaaagatgggtaggaatacaatatgaaaggtcattgtcaactttaattcttatttaggtgtgaaaactctaacagactctgagtgacacaaagtggcttttaacaagatcattctggtttctcagtttacagcacattgcaggaagctaggggcagagacaatcatttaacgttttatctacttttttgtataaatttagggggtacgagtgcagttttgttacatgggcatattgtgtcacagcggaatctaggcttttaatttaccttcatcagaactgtatacattgtatccataagtaatttctcatctcctaccctcctctcaccttcccacccagtgtttgctatttcatactatatgtccatgtgtgcaatgatttagcttcctcttataagtgattacatgaagtatttcaatttctgtttctgagttatttcacttaagataatggcttccaggccaggcacggcggctcacgcctgtaatcccagcactttgggaggccgaggcgggtgaatcatgaggtcaggagatcgagaccatcctggctaacacggtgaaaccctatctctactaaaaatacaaaaaacaaattatccaggcgtggtggcatgtgcctgtagtcccagctacgccggaggctgaggcaggagaatggcatgaacctgggaggcggagcttgcagtgagacaagatcacggcactacactccagcctgggcgacagagtgagacttcgtctcaaaaaaaaaaaaaaaaaaaaaaaaagataatgccttacagtttcatccatattgctgctgcaaaagacatgatttcatgttttatgactgagtagtattcgtctgtgtgtgtgtgtatttcccattttctttatccagtcatctgttttagacacttaggttgatgccatatctttgctattgtgaagagtcctgctgcaaacgtgaatgcaggtatattttatacaataattttttttagcggggggattagataccccatagtgggatgctggattgaatggtagttctatctctagttatttgataaatctccatactgttttccatagatgttgtattaatttacattcacaccaaatgtgtataagcattcacttttctccacatccttgccaaaatctgttattttctaactttttagtaatagccattctgacttatgtaagatggctatcttgtggttttaattttcatttctcagatggtaagtggtgctgagcaatttttcatatgcttgttgttgcactgagttgcttgtagattctggatgttagtatttttcagttgcatagtttaaagatatgttcacccaatctgtaggttgtctatttactctatgattataacttttgctgtgcagaggctttttagtttaattcagtcatatttgtctagttttgttttggtttcatatgcttttgaggtcctagtcataaattatttacctaggccaatgtccaaaagagtttttcctaggttttcttctagaatatttatagtttcatttgatttttgtttttaattacgtttatgcagtgaatcacatttattgatttgtatatgttgaaccatccttgcattcctggagtaaaacccacttgatcatggtgtattttattttattttatgatgtgctgttggatacagtgttttgttgaggatatttgcatgtatgtttactagaaatactgatctatattatctttttgtgtgtgtgtgtgtgtgtgtccttgtcttgctttgtatcagggtgatattggcttggtataatgtgctggagaggattctttactgctcaattttcaagaacggttttaataggcctggtatcagttctttgtatgtttggtaggactcaagtatgaatccatctgttcctgggctttgtttgtttgtttatatatttgttagtacagatttaacctcactacttactattttggtgcaaaagtaattgtggttttgccattgaaagaaacagcagaaaccacaattacatttgcactaacctaatattctatttgggatttctatttcttccttctacatgcttgaaaagttacatatttctggaaattcattaatttcctctaagttttttagtttatgagtgtagagatattcatagtagtctctgaggatttttagcatttctctagtatcagttgtaatgtcttctttttcatttctgattgtgtctatttgaatcttctctcattgtttctcgcttaatgtagctagtggtctatcagttttgttcatcctttcaaataatttcttgtgttgttgattctttgtaatttttttggtttctttttcatttagtcctgctctgatctttgctatttgtcttctactagctatgaagacactttttagtttaagttccatttgtcttgttttgtttgtgttacatttgctttccaggtctcagtcataaattctttgcctaggccaatgaccagaacagtttttcctagattcttttctagtatttttatagttacaggtcttacatttaagtctttaatccatcttgagttatctttgtatatgtgagatgtaggggtccagttttatccttctagacatggcagtccaatattcccagtaccgtttattgaatagggtgtaattctcccaacatatgtttttgtcgactttgtcaaagagcagttgactgtaggtctatggcttcatttctggattctctgttctagtgatctatattttgatttttatctagtgacaaaaatctatgtgttgattttatttagtggttaacacatggatctatgtgttgatttttataccagtaccatgctattttggttactatacctcatagcatcatttgaagtcaggtaatgtgatgcctctagattttttctttttgcttaggatcgcttcggttattcaggctcctttctggttccatattaattttaggattttttttcctaattctgtgaaacattacattgtaattttaatgggaattgcattgaatcagaagactgctttagtcagtgtggtcattttaacgatactgattcttctgattcatgagcatgggatatttttcccatttgttcatgtcatctaatctgccatcttgaagggaaaaaaaaaacccacaacattttaaatgaataaaatgaaggctgaaataacaatgtgaactcaggcagatactatgtgggttcttaggtttttataaaattgcaaagtaagtaaattaatatccaatgctcctagattttccataaccttttttcttacttctcctgtgcacatttctctttgtcagacttaatcttagcaaaggattcaatacccacacattaagaatatttctttgactttttaatgagttacctgcattttaacctggaggaacccacaggaataaatttcaaatggttaaatgtcaagccttaaaaaccatgaataattatttttggctaggaataaaatttagatccgtggtgaaccccagtaatttctggctcttgggatttttaatgggaataatttattataaatgtttctctccatcagaaaattaaaaaattttaaaaggcacagtatttttgtttgaggcgagttgataagtctactaatttctctaaaaatgtcatcgaattattacacagaaacaagtagttgccaggcaagaatcaaggcattagagataaaatctgatttacataccgcacttctctctcctcaatgtgctcatagtataaattggaggcaataggtaagtaaacaatgggagggtgttggagagagatctatcatagagggaagtatctatgcttatgaccgtttatctaaacatcattctcatctttgattctgtttaatcatcactacgattcaactcaatgcagtttcttttcttatttctaagaatagtactatattctgtctgtcacacaggctctttcacctggaattgtcactaacctctctcttttcctcactttcaactttaaatttggttctagaataattccttggaatttaataaaagcatattcaattaaattgaatataatattaatgtatggccttttttcaaaattttttcttcatatcattttaatgactcctgtatactcataaaagtttaagtttcaaagcattagcttgtaattttttacacatacatacccaaatatgaagataattttaataccttatataaataaataataaaataaataaaatatatttattttcaataaatgtaaatattatcttgatatttattttgcactcacagttattactgatttaataacttgatatgaaacatccttgttttcagaagtgtactgtgagtttggatattgctgctttttattgccacaaaagagtacataagcatttagcagccagagcatgaagcccatagggtgactgtggcaacagagtttctaatataaagtcgatgtaaaagtatgcaggagagaaatagaagaaaaataagaaaaataattaggccagacctcaaaaataatgcttatataaattagatgtgataaagtgataggtaataaaacttcaagggccaaacaaattaagaaatgaatgatgtgaaatggaatcagctcaggggagcaatgacaatggatggaaccaaagaaagaatacatttatgaattacagagaaagaactttagattaatgaagaggagattttatcatatcaacagagcaattgagatgagtggtccataaagctttatgactttagcatgaattctggtggaaagaaatattatagtagatcatgttaatctaattttactatccttaaatgtaatggcttttaaaattgttagctgaacaattcaaggtggcaatttgctacatcaatataagcagtctcttgtgaccttttaggaatactgagctactgattagttaagtgacagtgatcctttttcaaaacaaatgctatatagagattttactaatttccctacttaattaagaaatgatatttatttcccctaaggacaaaaattttcaatggtactgacgatcatatattagatggtaaagtggattactgaaagttagtgccactctaattaaaaatttgattcatcccacccaagacagaaatggggactgaattttatatcccattgaataaattaattccacacacaagttttaagttcctaaagtctttaacttcagctgtggctctaaaaaaatcaacatgactctaatttataaaatataataacgttaaaattttcatatgattgtgaggatagagttaggtaataaactaaataactacattgtttaaaaatttacaaatgcataggagatctgtaaacattaaaatatgattgaatttttcaatagataattgttctgatgtttgaaatgttctggaagtgttcatatagaggagtatgctgtccaatatggtatttaccagctattgatggctactgagcacttcaaatgtagctcatttgatgaggaaattaattttttaattgtatttactttcaattaatttaaatttaaatactcatatggggctagaagctccaatattgggcaatgaaagtctagaactcacatcttaaatttgatttgattgttgaatacatcaagtttgtaattaatgtagctgctgggaggtattgctacaatcagacaatcagaggactcaaagtttgcaatagagatttaaggtaaactgtgagcaagacacttttagtgatgaatttctaattaatttattaatttcagtactgagttcgctctataattaagtcttaatatgcatattacttaaagttaattataaatactaattcttggttttatcaatcacaaatgggtgtagggggtagaaaatgtgaataaaaatattggagagttaatttatatactagtcttacactgagaggtgaatagtttatgtttggtacagattagctacatttagtcaaagcaaatattgtagaaaaataaacatagtgcctcttttgaatatgtaagtatttttagtgacaatttgattattcaaattgattatttgaaaatttgattatttgacaatttggattttagaaatctgtagacctgaagcttcccttgaaccaggattaattaaagacaatattgccaattaacaccagacagtataactggtgttcttgctgtgcttttatgtatgtgctctaggcagagcttttactagcttacacatctctacgcagatttttaagcctttcaagaattttgccacttctgagctgagctcagagccaaaggagagctgaattttagcactttggtggaagcagctttcatgcccctcaggcttatacttaaatctgtctttactctaggaaacttcatagagctctcttggcctctgtgcccctttagtttctaaactacaagggaacccagccctttcatccttaaaaaagacacttttaggactttacttatcatttatttatttatttttttagaggcagagtctcactctgtcacccaggctggagtgcagtggtgtgatcttggctcactgcaacctccacctcctgggttcaagcgattctcctgcctcagccacacgagtagctgggactacaggcacctccattaataactactaggactttaagccttttcccctagaacaaaatcctctggtgttttatttttccttgacttagattaatctcaattttacagtttactactcaaagtgttggccttggactagcagcatagcttcactctggagcttgttaggagtgcagaatatgaggccccacaccagacgtactcaacgagaatcaacatcttatgatccccaggtgtttcataggtacataaaagtttaagtactgtatgtagcacacttcttcttgtttgctccataagaatacaaaggtattttattaatggaatttgtttttatagtacttccttaaatgagccaaacttcatgatcatcaaccagtatatgccccgtttttccattccagatcattctttacattttatttattaacttttttaaaaaaattaagacaagtacaagaaagagccagacattcattcttcccttgtcttaatgtaaagtataagtgtgcatattcattgtctcatctgtcctgcactcctctcactttagcagcaactctgtagaggacaaggatcatttgtttctataggtaggtatttggtacctcttagaatattatctacctgtcctagaaaccatatagtccattccagttttaaatttttttttgagacagatattcgctcttgtttcccaggctgtagtgcaatggcgcgatcttggctcacttcaacctccaccttccaggttcaagcaattctcctgcctcagtcccccgagtagctgggattacaggcatgtgccaccacacctggctaattttgtatttttagtagagatgggtttctccatgcttgtcaggctggtcttgaactcctgacctcagttgatccgcctgcttcagcctcccaaagtgttgggaatacaggcatgagcccccacacctggccttaaaatgttttctttaaaaacttaaattttcagctgggcacggtggctcatacctgtaatccaagcactttgggaggccgacatgggcagatcacctgaggttaggagttcgagaccagcctgaccaacatggtgaatccctgtctctacaaaaacacaaaaattagctggatgtgttagggtgcgcttacaatcccagctactcaggaggctgaggcaggagaatcgcttgaatccgggaggcagaggttgcagtgagccgagactatggcactgtactccagcctgggcaacaagagggaaactccatctcaaacaaaacaaaacaaaaacttgattttccttattatctaaaaacacagtaagtttttcatgaaaatctcagtgctaagcattgtgagattcactagctattctcatgcagatcttaatgtagggactaatgtctatcagatgcattcctaatctgattttgttaatagtttttttattgacagtaattcatcagagataagtactagtttccttttacatgtaaaatattcagtataattgtattgattgaattatagcatcaactattttaacaataaattattcctactctacacatccactgagtacacattatgagtaacattatggtaactgctgaaatatagaagtaaaaattagagttcttattttgtagtagcacaaagacactgaaaagcaagatagagctttcttagaaaaatattagcgttaaaaatgtgaccattacttgtcgtgaacctgggaggcggagcttgcagtgagtcgacatcgtgccactgcactccagtccggacgacagagcaagactccatctcaaaaaaaaaaaaaaaaaaagcagccattactaaacaaaaaatatgaaaaaaaagtactaacaggtagcacactttgctagattcaaaataaattttatagtatctgattctaaacagcatgttatagatgaattcttaaagagaatagttatataaaaaattctaatttattttggaaaattaaatttctgtcaaaacctgtaatatttatgaacagacatacttttcttttagcacgtcaacagagttgttaggttgtcttaatccttcactggctacctgcactttcccttcaattcgtcaggcacctttgaggctgtccttatatcttcatcaattgtcttcaacaaaatggatgagactatgaatagaagctcattgtcatgaaagtgatatgagaaataaatttgctgagtaaaagattataaattcacattaattgattgttcaattttcttgaaaactgatgattattctgattttaatatgtttggcagattttaaattatatacttgtttttcaaaatagagcttggtaagagtgatataccttatcatatctttaaaagaattattttttattttaagtaattagtgtcctaatctagccatatatacaagaattcagataaaaagtttactggttgaattaatctacactatcatagaactgtgaaaacatgcaataaagttagtttttttctttttttttttcaagaaatgctttagcaaaccaaaacttgttttgcgatagccatctctcctatatatctctaataaaagagcactttttcacatatttttaagtagctattccattataaacaccttccctcaatttgaaatcaattaatattttaaatactggagaaaaggcaaatctaatatatatcttctaaaatattttttacatagtagcaaaacctctgattatggctttaattttaaaccactcccatttgcctaacgctgtcctgattccaggattgaaatttccacattctaggaaactcctcagttgcagggatacttggatgattggtcaccatcatgtaccattttattgccttaatattttaatattcaaagtgtaaaaatgtgtcttatacaggaattcagagctccttgggatgtctatagtgataactttaacattatttgctaatgccttctgttattttaaaacccattaattaagcacctatttttaaagcattttttatgttaaaaatttcaatagatcatgctctatgtccttaaggaactcatagcttaaccaaagagcaaggcatacaaaataataaattataaatatgaggttggaattgttaaaagaaagcaaatttcttctaaacacagaagacttagacacttactttacctaggagaaattaaggaagtcctccattagtcctaattaaagaagttgtggtattttaggagaaacaggagttaaccaaaagagaggaaaggaggaaaggatttccaggcttggtggtatgaaaatgaaggctgtactcagtgtttggtgagaaatttaaagccattataatataggatggatgatgtggacataatcatttggaagagcattgatgaccagaattgagcaataggatttaccctataggagtggtttgaaaaaaataaaaataaaaaaaaaaagtaaatgctcaggacttaatcagaatcacctgggaagattttacaattacagactgctgcaccacttccagcccaatcccccagagaacctgctgagcagatctgaggtgccaattacttcagttcatatatttgtaatgatcttcataggattacgatgtctgtggagatttagaacctccagatttcccatagagagccaatagtggtaattaagcatttgatttacatgattttatttgatttaaaaaataattctagaacatttttgtagagacagtaggccactaagatttctttgaatgatgcagttgagagataaggaactgtactgaggctttgtcaagggaggagaaggtagtgctaaatacaatgagaattttcaaaagttgagtacaatctattttttcagagtgtggctgccatttggtatccttgggggactggttttaggacctcttttcatacaccaaaatttacagatgcttgagtccctgatataaaatggtgtggcacttgcatataacctatgcatatactcctgtatactttaaatcatctctagctcacttataatacttaatacaatgttggtgtcatgtgaatagttgtcataatgtattatttagggaataatgacaagaaaaagtctgtacatgttcagtacaaacacaattaaaaaaatattttccatctatgaattcatggatatggaggaccaactccatatgttttacgaatatttgttatactagtttctgatacagttgatatagtttgaatagagtacaaatactgcacgttgaatatcagtatataataggacaaataatgagactatttttctcatgttttccactgtatctgtttatttcttttttcattattggattgattcatccacatagtaagtaatttttaactgcccaccatgtgccgaacagtgctaactagatgaagtattcatttattgttttttggaaaggattgaaagcaactttaattaaaatacaaattattgtatttagtattcatttataataaaaatggtatattttcaaaaggaccatacatttcatacaggtattgacattaaagtgttctacttaccttttctttgcgaagaatttagaggggcatttataatataaattgttaccacttttctgaaggacaacttacctgtgtaacaaaaacacttaaagtgtgcaacacatagtggatatttatttctgcaggtagttaggtataacagttgctgaagtagtattcttaccacgtgtatgctgtattgttggactgccatgataaaacaaatactatgtcatttgtgcatatcttttttttttaacaaaacaaatttatacagggattttaggaccacaaaacaattgctggtgtgtcatgaagaaaatatattgtggaaataatatgttccatctgtggttttcttttttaaatgtaccaccttaatacagaactgcatctctaaatcaaataaccttaagcaataaatagagacttgctttcaagtattggcaaataaatgccttttttttttttacaagaacaattttttcctagttgttcatgtgaatttaggataaaaacatgcagcaacaataaatcccttgtggtattaattcttaaggtttatcacaaatagtattagagataacaaaatatagtcaacacaagcttccagtttttcctgtttatggcttaataataatttggacataaagatgcctactttatcagcatgttattggcccatattttatatttggggaatgataagaattttttcataaataatagaagataatatttttatgttatcatgtctgtcatgtactttactatattattgctgaagacaaaacactttcttgaagaagttttatttaatctatacaggatattatatttcagtcttcttaggttttccaaagtaaaatgaaacaatttttacatttctacaaggatatatgagcttttaacttcgtaaaagagaagggtatactacacatgatgttcatctgttcagcagcaaaaaggtcaagaagctaaacaaatatgccctcaagtctgaaagtgaaaaatagatcttgtaagcaagagagacactaaggtattacattagagataggtagcattttggaaccttagctgcaacacactatttgtaaaatgtatttcccatacgtcctgatggtaattgttatgcattttagttacacagatagtgttttgatatgtacagaaaaaaaatgtttatcatttaaaagataccttattccataatatatataaagaaagttgttattatagtcattaccaggtacaaatcagcaaaaaacacttatgtcaatagagtttcaagaagtactttaatatgaaatgttttaacattattctgatttttaaaaattgatacatttgttgagtggtatttaaattttgtgatattatttaattgtagaggcaatgagttatagagatgtcgaaaacaaactctttaagaattgtgaatatacaactatgatttcttaaagtttgagactttataaaagcagtggttccaaaaaaagtgcataaatacacatttacacgtatgtttacacataacttggtgggaatcacagatgagttgtaatttacccatgacatcaataaatacattgtatcttatccatgacaccaatttggaacctagaatagaaacttctataaaagtatagaagatttgttttacttccttatatacaagtagagtattgatcctaattttgatttattaaagaggataactttgtggtttaagattatattttgatggtgaataatcatcaatattaataaaataaatgaaaatatgaatcttgactttaaaatttctgtacttctcataaaacttctgagtatgtatgaaaaaatgtttggtttttcatgataaaagttttgtgaatatcaagtttgaaatatattacagacatttgctactttgtctcctcaccttggttctgtgaaagaatcatctggaaaataacttggaaagtttaccttcctagtataaggaggggaatagtgaaatacgacaattagaaaacttgtgttttattgctattctgggcactaactattattattattgttacgtttttgtctgataacaacctacattttttccagatctccatctatgcattcacaaggcacacatgtctttcaagattatcctaaatataacttttatctgaactccctctgttttatatttcactttcattcttcaagagaccaatttcctgcatgaacttgtcctagatgaagctcattttcataaatgttattttcttttgtaattagactgtatacgggcatctaatcactagcaaaactgcagcacttgaaaaccaagattatactgtagcatttgactagctttagaaaatatagtagatttttattggataatgaataacttactggttgagagagaaaattgtctgtatgttaacaaaaaagaagtataaaacgaagaaacgtttcactaagtcactcagtataccagagacaataaataaagtgaaacgactcaaattctataaaaggaaattcctcttccctcacaaaaaatgactactattttttcaaacattcattagaagtggatagtacgttctacttgtaagtacagaattattttaaaaattataattagcaagtctgctagtcattcatagcatactgcatttgaacagtgtttgaaaagcagaaatggtttggtccaaaatatattgtagttaatatacatgtgaattacattagttttattaaaacaacaatgaattaacatttgcaaatcgatctttggtttattttagcatccaaatatgtgttgtattttctatccactttgcattaaacaattgtacatatttaataatgtataaagagataaaatgtaaacatattttccccaatgttaaacagtcatgcattagattgtgcatggacatttttactcaatagtctattgggtaaaatgcttggtaattatttccttagctatatgcagactttataaaagtgtaaatttccctcttatactatgtttttaacactttaaaagaaacatatatctatgttcttcaaatattatttctctaatctttggaaatataatttttttacttttatttctggtttggagtgtaagtgcaggtttgttacataggtaaacttgtgtcatgggggactgttgtacagattatttcatcaccccggtattaagcctagtaatcattagttacttttcctgatcctctcccttctcccacccaccgcattctgataggccctagtgtatgttgttcccctgtatgtgtttgtgtgttcttatcatttagttcccacttgtaagtgtgaacatgcagtatttgattttctgttcctatattagtttgctaaggataattgcctccagcttatccatgttcttgcaaaagacacggtctcattctttttttatggctgcatagtattctatggtatatctgaactacatttttttaaatccagtctatcattgatgggtgtttgtgttgattctatgtctttgctattataagtagtgctgctatgaatatgtgtacatgagtctttaaaatagaatgatttatattcctttgcatatgtattagtctatcttcatgttgctataaagaacttccccagactgggtaatataaaggaaacagattcaattgactcacagtccagcatggctgaagagtccccatgaaacttacaatcatggccgaagttgaaggggaagcaaggcacctcttcgcaaggtggcaggaaggagtagtgctgagcgaagggggaagagtcccttattaaaccatcagatctcatgagaacttactcagaataatgagaacagcaagggggaaaccgcccccattattcagttatcttcacttggtctctcccttgacacatggggattatgtcctattagccttattctaatgcctaacagcatagattagttctaccatttttgttgtttcaaaacatctagatgtctatgctgttagacattagaatagggcttacttggggcaagtataatgactggaaggcacaaagagcctcaaggatggtcaaatgttctggtttttcatctgggtgctggctatgctagtgtacttattttgtgaaaatactattagctttacaatatgaattttaaaattgtactttggggattatgggaattgcaattcaagatgaggttttgggtgagaacacaaagcctaaccatatcagggtagtacccagaaatgggattgctgggccaaatgttatttctgcttttagatttttgagggatcaacccactactcttttccataacagtggaactaatttacactcccacctacaatgtataagtgttcctttactgcatagcgtggccagcatctgttatttctgactttttaatagtagccattctgtctggtgtgagatggtatctcattctggttttgatttgcatttctctaatgatcagtgatgttcagcgttttttcatatgattgttggccacatgtatgtcttcttatgaaacgtatctgtttatgtcctttgcccaatttttaatggggttatttgtttttatttttggtaactttgtttaagtttcttatagatgctggatattagacctttatcagatgcatactttgcaaatattttctcccattctataacttatttgctcactctcttaatagttttctttgcgatgcgtaaactctttagtgtaattagatcccatttgtcaattttagcttttgttgcaactgcttttggtgtctttgtcgtgaaatttttcctgtgcctatgtcctaaatggtattgcctaagctgtctttaagagtgtttatagtgttgtgttttacatttaagactttaatacataatgagttaatttttatacatggtataaggaagggttccagtttcaatattctgcatatggctagccagttatcccaatttattattttgaagctagaaaacgatcattgtctctgtaattttagagaaaccgacactgtttttaaattatactttaagatttagggtatatgtgcacaacttaaaggttagttacatatgtatacacgtgccatgttggtgtgctgaacccattaactcgtcatttaacattaggtatatctcctaatgctatgcctccccccagcccccaccccacaacaggccctcgtgtgtgatgttccccttcctgtgtccatgtgttctcattattcaattcccacctatgagtgagaacatgtggtgtttggttttttgtccttgtgatagtttgctgagaatgctggtttccagcttcatccatgtccctacaaaggatatgaactcgtcattttttatagctgcatagtattccatggtgtatatgtgccacattttcttaatccagtctatcattgttggacatttgggttggttccaagttttgctgttgtgaatagtgccgcaataaacatagctgtgtgtgtgtgtctttatagcagcatgatttataatcctttgggtatatacccagtaatgggatggctgggtcaaatggtaattctagttcttagatccctgaagaatcgccacactgacttccacaatggttgaactagttaacagtcccaccaacagtgtaaaagtgttcctatttctccacatcctctccagcacctgttgtttcctgacattttaatgatcaccattctaactggtgtgagatggtatctcattgtggttttgatttgcatttctctgaccagtgatgatgagcattttttcatgtgtcttttggcggaataaatgtcttcttttgagaagtgtctgttcatatccttcgcccacgtggtgatggggttgtttgtttttttcttgtaaatttttttgagttcattgtagattctggatattagccctttgtcagatgagtagattgcaaaaattttctcccattctgtaggttgcctgttcactctgatggtagtttcttttgctgtgcagaagccctttagtttaattagatcccatttgtcaattttggcttttgttgccattgcttttggtgttctagacatgaagtccttgcccatgtctgtgtcctgaatggtattgcataggttttcgtctagggtttttatggttttaggtctaacgtttaagtctttaatcgatcttgaattaatttttgtataagatgtaaggaagggatccattttgagctttctacatatggctagccagttttcccagcatcatttataaatagggaatcctttcctctttcttgtttttgtcaaagatcagatagttgtagatatgtggcattatttctgaggactctcttctgtaccattggtgtttatctctgttttggtaccagtaccatgctgttttggttactgtacccttgtagtatagtttgaagtcaggtagcgtgatgcctccagctttgttcttttggcttaggattgacatggcaattcaggctcttttttggttccatgtgagctttaaagtagtttttttccagttctgtgaagaaagtcattggtagcttaatggggatggcattgaaactataaattaccttgggcagtatggccattttcacaatattgattcttcctacccatgagcatggaatgttcttccatttgtttgtatcctcttttatttcattgagcactggtttgtagttctccttgaagaggtccttcacatcccttgtaagttggtttcctaggtattttattctctttgaagcaattgtgagtgggagttcactcatgatttggctctctgtttgtctgttattggtgtataagaatgattgttatttttgcacattgattttgtatcctgagactttgatgaggttgcctatcagcttaaggatatattgggctgagacgatgggattttctagatatacaatcatgtcatctgcaaacagggacaatttgacttcctcttttcctaattgaatgccctttatttccttctcctacctgattgccctggccagaacttccaacactatgttgaataggagtggtgagagagggcatccctgtcttgtaccagttttcaaagggaatgcttccagtttttgcccactcagtatgatattggctgtgggtttgtcatagatagctcttattattttgagatatgtcccatcaataccgaatttatggagagtttttagcatgaagggttgttgaattttgtcaaaggcctttctgcatctattgagataatcatgtggtttttgtcgttggttctgcttatatgctggattacatttactgatttgtgtatattgaaccagccttgcatcccagggatgaagcccactggatcatggtggataagctttttgatgtgctgctggatttggtttgccagtattttattgaggatttttgcattgatgttcatgagggatattggtctaaaattctcttttattgttgtgtctgtgccagactttggtatcaggatgatgctggcctcataaaatgagttagggaagattccctctttttctattgattgtaatactttcagaaggaatggtaccagttcctccttgtacctctggtagaattcagctgtgaatccctctggtcctggactttttttggttagtaagctattaattattgcctcaatttcagatcctgttattggcccattcagagattcaacttcttcctggtttagtcttggaagagtgtatgtgttgaggaatttatccattttttctagattttctagtttatttgtgtagaggtgtttatactattctctgatggtggtttgtatttctttgggatcagtggtgatatcccctttatcattttttattgcatctatttgattcttctctcatttcttctttattagtcttggtagctgtctatcaattttgtttatcatttcaaaaaaccagctcctggattcattgatttttttaaagggttttttgtgtctctatttccttcagttctgctctgatcttagttatttcttgccttctgctaacttttgaatgtgtttgccttgcttctctagttcttttaattgtgatgttagggtgtcaattttagatctttcctgctttctctagtgggcatttagtgctataagtttccctctacacactgctttgaatgtgtcccagagattctggtatgttgtgtctttgttctcattggtttcaaagaacatctttatttctgccttcattttgttatgtacccagtagtcattcaggagcaggttgttcaatttccatgtagttgagcggttttgagtgagtttcttaatcctgagttctagtttgattgcactgtggtctgagagacagtttgttataatttctgttctgttacatttgctgaggagtgctttacttccaagtatgtggtcaattttggaataggtgtggtgtggtgctgagaagaatgtatattctgttgatttggggtggagagttctgtagatgtgtattaggtccgcttggtgcagagctgagttcaattcgatgtccttgttaactttctgtctcattgatctgtctaatgttgacagtggggtgttaaagtcttccgttattattgtgtgggagtgtaagtctctttgtaggtccaaggacttgctttatgaatctgggtgctcctgtattgggtgcatatgtatttaggatagttagctcttcttgttgaattgatctctttaccattatataatggccttctttgtctcttttgatctttgttggtttaaagtctgttttatcagagactaggactgcaacccttgcctttttttgttttccatttgcttggtagatcttcctccatccctttattttgagcctgtgtgtatctctgcacgtgagataggtttcctgaatacagcacactgatgggtcttgactctttatccaatttgccagactgtgtgttttaattggagcatttatcccatttacatttaaaattcatattgttatgtgtgaatttgatcctgtcattatgatgttagctggttattttgctcattagttgatgcagtttcttcctagcctcaatggtctttacaatttggcatgtttttgcagtggctggtaccagttgtccctttctatgtttagtgcttccttcaggagctcttttagggcaggcctggtgttgacaaaatctctcagcatttgcttgtctgtaaaggattttatttcttcttcacttatgaggcttagtttggctggatatgaaattctgggttgaaaattcttttctttaagaatgttgaatattggcccccactctcttctggcttgtagagtttctgcggagagatcagctgttattctgatggacttccctttgtgggtaactcgacctttctctctggctacccttaacattttttccttcattttaattttggtgaatctgacaattatgtgtcttggagttgctcttctcaaggattatctttgtggtgttctctgtatttcctaaatttgaatgttggtctgccttgctagattggggaagttctcctggataatatcctgcagagtgttttccaacttggttccattctcccagtcactttcaggtacaccaatcagacgtagatttggtcttttcacatagtcccatatttcttggaggctttgttcatttctttttattctttttttctctaaacttctcttttagcttcatttcattcatttcatctttcatcactgataccctttcttccagttgatcgcgtcggctactgaggcttgtacattcatcatgtagttctcatgccatggttttcagcttcatcaggtcctttaaggacttctctgcattggttattctagttagccatttgtttaagttttttttaaggtttttaacttctttaccgtgggttcgaacttcctcctttagtgcagagtagtttgatcgtctgaagctttcttctctcaactcgtcaaagtcattctccatccagctttgttccattgctgttgaggagctgtgttcctttgaaggaggagaggcgctctgatttttagagtttccagtttttctgctgttttttcctcatctttgtggttttatctacctttggtctttgatcatggtgacatacagatgggattttggtgtggaagtcctttctgtttgttagtgttccttctaacagtcaggaccctcagctgcaggtctgttggagtttgctggaggtccactccagaccctgtttacctgagtatcagcaatggaggctgcagaacagcggctattggtgaacagcaaatgttgctgcctgattgttcctctggaagttttgtctcagaggagtacctggccgtgtgaggtgtcagtctgcccctactggggaatgccacccagttaggctactcaggggtcagggacccacttgaggaggcagtctgtctgttctcagatctccaactgcatgctgggagaaccgctactctcttcaaagctgtcatacgggtacatttaagtctgcagagttttctgctgccttttgtatggctatgccctgcccccagaggtggagtctacagaggcaggccggcctccttgagctttggtgggctccacccagttcaagcttcctggccactttgtttacctactcaagcctgggcaattgtgggagcccctccctcagccttgctgctgccttgcagtttgatctcagactgctgtgctagcaatgagtgaggctccgtgggtgtaggaccctctgagccaggtgcgggatataatctcgtggtgtgccgcttgctaagacagttggaaaagcacagtattacgatgggagtgacccaattttccaggtgccatcgtcacccctttctttgactaggaaagggaattccctgaccccttgcgcttccctggtgaggcaatgactcaccctgcttcggctcatgtttggtgcactgcaccctctgtcctgcacccactgtccgacaatccccagtgagatgaacccagtacctcagttggaaatgcagaaatcacccatcctctgtgtcgctcatgctgggagctgtagactggtgctgttcctattcagccatctctccacccccccagaaactgacacttaacttttaggctcatttaatgtaaaaatgaactgctctgaactggttgtcaattcaaatatggttttaatatgaaattacaaaaacataagaatatttctaagaagaaactcactatgtaatagtccaaaatctaaaaacaactcaagtatacatcagcaggaggataaatatataaattatataataaccacttagtgaaatactgcaaatcaatgaaaatgaatcaccactatacaaaagatggatgaatctcacaaacgtcatgctgaatgaaagaagccagaaacaaagcgatgcttattttttgatttcattcaaaacatcagaaatggcagaactaatctatgctgttagacgttagaatagggcttacttgggggaagaataatggactggaaggagacacaacggaggctctaggacgctgaaatattctgctgtttgttctgtgcacttgctatgctgttgtaattattttgtgaaaataccattaaactttacatatgaattttgttcttttttgcatgtgcattatacctcaataaaaaagttgttttaaaactggaatatatcaccattttctaccatgcatcatttaaacataattttcatgaaatgcaatagtgttatataatcactatgtagtaatcttaatgcatattggtttaaatttgcatattttaagttttgaaaggataactgtcaggaaattgaagtatatactatcagtgatgtttgtaagttttttatcatttttgttagtgaagaactaacatgtttatgctgataattgaatatactgttttatattacaatgtgaaatctactttcagaaaacttgatatggaatgaatgtttcctttaaagcttttcagaattaaaatattgctttattgttgtaatcttttaaaaagatgcaaaacaattaacatcagatttttcataaagatacaaattcaagtgaatagtactaataccatatttaattagaaatcaataaaaaaatcactttattctttataaatactttagaatacttatttctattctgccattttctttgttttattttctgttataaaagccaaccaaaaatgacaaaaatataccaggaaagataaactgcgacgtaactggggagtagatacattatacacatactactttggcaatataaaaggaggaaataatctgttattacagatagctccatgaatattcaccagtgaagcacataatgatcatttccacagtagcaatacagagactgcgacattgaaattattcagtcctcctgtaaactagttcaaccattgtggaagtcagtgaggcaattcctcagggatctagaactagaaataccatttgacccagcaatctgattactgggtatatacccaaaggattataaatcatgctgctataaagacacatgcacacgtatgtttattgcggcactattcacaatagcaaagacttggaaccaacccatatgtccaacaatgatagactggattaagaaaatgtggcacatatacaccatggaatactatgcagccataaaaaaggataagttcgtgtcctttgtagggacatggatgaagctggaaaccatcattctcagcaaactatcacaaggacaaaaaaccaaacaccacatgttctcactcacaggtgggaattgaacaatgacaacacatggacacaggaaggggaacatcacactctggggactgttgtgtgttgggaggagtggggagggatagcattaggagaaatagctaatgttaaatgacgagttaatgggttcagcacaccagcatggcacatgtatacatatgtaactaacctgcacattgtgcacatgtaccctaaaacttaaagtataattaaaaaaaaaaaagaaattattcggtcctctaaagtgagggtctgctgatttttccatggatgtgtaagaaatcgtcaccatttctgaaattaagttttgtttgttaagaagaaacagcctaactttttagatagttttaaaaattatcttccaaaacactgctgcatggacaaaccatagagcactaaatcttgtagatagatcggtccatgccatgctgttgcatgaggttatatttttctagttacattcactgcatcatagcctggagaacaaaaacacagcatgacaacatatgccatgtctctaaaccatgcatctttaagagtctgatattcagcctttcattcatttaccttccttgttagcctttcatttaacactgattaaaatacttcaaatgattaattattgcacatttttgcctgatttatcacagctcagcaataagatcctttgttgtagcttcatcatattaatgtggaagctgttaatgtgagataatattacaaactcttctgtttctgacctgcttttcttagttcctatcttctttacctgagatccatcacttaaaacagcctttccccaaaggtaagcagccctctttaagagtcttgccacattttaacatatgaattaatctaagcaagggtccagaataaaataacacgtggtgtctttgctcaactaggttagttttccacaccttcctgtaacattatcagcagaagtcattcacacataaagcaacgacctcaaaattaaaaagttactttggataaaattcattttattgtgtaatctgggtattccttctctgtctctcctttcacccccaccatgggactttaaaaaagtaagttgtaatgctgagatttctgtgtcaaggttaaagagtgaagagaatcatttcagagattagaggtgtcactcatgtcaagaaacattataagagatctctggaggcatgtaccaacatattaaattactacatggaaaaataaattgaaaaagaaaagccctgaagtaatgaaagctgactacattttcaaagcaactactattttaagaagagtatatttcctttatccacaaacaaatacaaggcaaaaactgggtgtgtaacaatatatgatcttctttatgatatttacatgttggttgtgtcacccaaactagatcaaatgatttttaaaataacatttatattggtaaactctttcaaaataaatgtagaaattttctgtggctggcttctaggtgtggaattagggaagcaacatgtattaacttgaaattcctacccaggcattcacttgaaaggtacccaaagttatatttgatagtaacatagttttaaaagcttctgctttctgttttaactgatttgcttctacaccactccatggacatcattaagcctttttatttagaattatgacattgcttttatttcattaatttcactagcacaggttcaaagggacaagagttagttttagatgtaatatataatgtaattaaaaagttcccatcatttgtgtgtttttgtagtcactacttactaatgtaagtagtctgcacattccaattctgtttactacagaattaaagttgcaacatcaacagttgtctgagactgtatgttttatcttgaacaaggaaaataaggttttaatagttctgattgttattaaaagcctttatgaagtaacatttataaaacacttctaatggtggagattaattttgcccctcaggtattttggtccaagtaaataagaagcgactgatggtcccactaaacaaaataactacaaggaaaatgcaggaatttcttttcttcttgttaatgaatattttgaagatggttaatttacggttatgtagacattctgcaatcagctaagatgttaagtcacatgttttatatctatgaaagctactattttgtagtggtgacaatttgttgtgtgaatcagtatgtacaatgaagagtgacccattacatacaatagaaagtggtggtagttcaccatagaaattatctgttgctataataaatttcacatattctttgatttttaatgatttctaaacaaggcatataaatatgctatatacatcatattaccaaagacatcctttcaagtataactgctgaaaaagagtctattgaatgagttagtaaataaatgattatttatttgcaagccttttggtaaaatagcgttatttacacaatgaatttcattgttttggcattgtaactgtgtcttattctgttttgtgctgctaaaagagaacatctgagactgggtaatttatagagaacagttctggaagctgggaagtccgagattgagagaccacacctggtgagggtgttcttgcagcatcatatcatggcagaaggcataacatgagttaaggagcaataactaactcattcccatgataatggcattaatccattcataagggcagagtcctcataacctaatcacttcttaaaagttccactctcaactgttgcactggggactaagttcaacacatgaactttaggagacacatttaaaacatggaagattatatcccaaccagctctcctttaaaacccccaaatctgatacttacctgattgataagagtatttaaaataataaaatgagacaacatctttaaaacatctttctagtattatgaacttggagataaaccaatatagtccaagttgattatagctcatattccagtatcaacatgttcccagcactaaagcaattattttctacagttaaagagaagttttatttcataagagaaatccaaagagtaatacccctatcttagttgttgagggatcctgtaaagaactgtgaatctgatgttttatcttacttgctataatagcttacaggttagcctgccagttctatggatgctggcagaacttcttgggacaaagagaaaatattttatttttcacaggaatcatagccagtgtgtcagcattttcttgtgtttgtgcccaagttccaattcccacagggtagcacaaagagagctagatgctacctgtacacagttgggttgcaataacaaaaaaagagaaacctgatcctaggtacaaaaaatcatttataatgggtagtaagcatgtctggacttagtttactggacagtaaccatgcctgacctttgctctagtgagaatcactatctatatcttcagtgttttttgctatacagatttgagatcctttatccaaaagacagagccatcaagagttgtctgagagtgtgcatttaattttgaacacggaaaataaggttttaatgttgcagattcttatggagatatttacaagcctttttgtgaagtaatatttatacaacacttctcaatgatgaggattaattgaaaaatctgaacgatttcagatttttgcatttttttggatgttagaatgtttgcattatacttaccagttgaggatctcaaatctgaaaatccaaaatccaaaatgcttcagtgctaatattctttggatgccatgttggtgctcaaaatgtttcaaattttacagcatttcagatttgggtttttggattcaggttgctcaacctgtataagcatctttgaaaacttaatccagaccaaaagggctaccagtgctttgtttccaagactaaggaaacttgagaaaccaacagagaattgtctctcaacagaaccagatacaggtgcaatagaaaaaccaccagtctattttattatccttataaattcccactaactacagctgtttagaccaattgcttcagcaacaggaactgaaaatggaaacttatttacagagtaaaaagtagagggctggaattgtgtgcatccagtaatataattttcatataatttttatttagaaagatttaagtcatttcatgatatttagaagtagatatgtagagaatgtagtcaactcagcaataatctcatagaaatacaaaatacactaatagagtttcccatgcatatttaggttctcatacacggagaattaaatacaaagtaataaaaaatgactataaagtatacagtgaatatgctgtgccaatgtagttctgcagcataatatatccataaattttcttgcctttattgaacttacataatttctcctaacatttacttgagatgcattcttgtgatttatttaaagaaatgatatttgtggccaaaaattggaaagtgatatttcgctttagtacataggtaattaaccactgaactaaaggtctgatcatttatccactttcacattaaagtgcaaacactgaacaaaacataggtaagagatgtttcccatttcaagtggcaaaatttctagtgattttgtggtttacagaattcagttgaggtttgtatagtcattcacagagcaaaatattcaaagtagttattttttgagaaccatctttggcaacatatagcagtttttgatttccccatctagtaaaagcaatgagctaaagaagtccaccttccaccccacccccaaatgaagcccaaattaaactgttctaagtaggcattgaattcaacatattcattttgcttaggattaatttagaatattaaattaatgtgatcagtatatcttctttttatgtttatttcattttctttttgcctattagaaatactttaaaaaggcaaactctgtaaatcctcaatctttaaaggagccacatcagcatcagctttaaaagaacatctttttttttattgttaaatgaagcacctgttaatattattgttgcatgaataaaactgtctcttcatagctctttatctaaaaaagactgatttgaatgaaggtaaacatatgtggatacagatttccttgattttttaatacattcataattttgtttctttttttctcattttatataacacctatattttgattaaaaaaattatttcttctttaaaagatacattaaaaaacctaacttataacaagtgtaagtaatttttctagttgttaggttataatgttttaactttagtttttgtatagtaagtatggatgcatttttcgcaccacagagttgatcaaaataacagactgacataagagttggctgtctgataatattgtaacttgtgaactaaatgagcatgtaaaagtcatgctaacattcatttatttgataaagtcttcttaaagattttgagggcattgatagtacaaatcaaatgcacaatttaaaactgagatggttttcttatttactgaagatctgaacttggatattaaaatctctcctttgccatattctgcatgaaattatttcagtctcttaaccttactttttccatgtgtaaaatgatattattaatgtctaatttgtagattttagtttttaaaaaaggttaatatgtaaaagtgcttgatacatactgtttgcttaataaatatattaaacatacattcttttttacttgggttgtacaaaatcataatatcttaggtatgtaaaacactttttgagttctggcctaattcaatatttctggtgaaaatatgggaaactccttctccctccctccatcttggccttgcccaccacagaagaagaaaatatgtattgaagaacagtagcatttaattttcataactttttcgtaaatgaggataccggaagtcacacaaagtaaatgacttactcaagatcacatagacaggaaggacaaaggtaggattcacacccggatctgtctgaatccaaaggtgaattatgtttcatcatattatgctttttatcatagcttagagatttttctagcatggaacattatttagcaatatctgtgtgattaggcatctgcttcctaattcaacgttttcatcttcaactaaggtttattattaaatataaaacatttaataaaagtcaaaacatttgcttgttcaatttattttaatttatatttttgccttgccataaaaaatattaaagaaggcttaaatttgaatatacttgctatactaccttttaattggtgatatttcaaatttaataagcaaactgcactatgaagacaggatataagaagatttaggcaattggaaagattctttatcttgttacactttcggcatttttttttttttttttttttgccaattctcaatgtgaataaatttacaacatgtgaagcatcaaaagacttataaaatcttgagtcttgtctgaaattagcaaattaaaataaatatatgtgttgaaagaaaagtcctgtcttgcagatgttttggattagaatgaaaatggacacacacatacacatgcataattgttaactttcatttgaaataaaatttaacttagcaaaactaacaagaaaaaataaaataattgaatatctatattctattaaggaatgtaaatttaaacaaaaacattccacaaagaaaactccaggcacggaaagattggcaggttaattctatcaagcatttggggaaaaaacgaaaaagtaaaagcaacattacacactcagaaattaaggaaggaaacactttccaatgtgtttcatgaggcagcatatctctgatacataaacctgataaagacataacaaagaagaaattgcaggttttttaccactacaaacatagttaaaatccttaaaaaaattccaaagttgtattcagaaatacataataataaatcataatggagcagagtttgctataggattgaaaagttggtttaacatttgaaaatcaactcactaattcaccatattaatagaataaaggagaaataacttaataggcattaaaaaaaagcctgacatgacactcatttatgttttaaaaaggtaagactggaagagaacttccacacttttctgaagggcatttatgaaaaccttacagctagctaatttattgttacagatgaatcactgaatacttattcccagcagttgggaacaggcaagatctcttcctactcctgtactcaacattgcattagaattcttatggtagtgtaatttagcagaaaaaaaataaatatgatacataaatattgggatacatgaagtagaatgataatcatttgcagattacgtaagtgtgtttttaaaatcactaagaaattacaaaacaactacccaaggctacaagatagaagatacacacacacacacacacacagcattcggaatagatctagagtaaccaaaataacctggataaaaaaaaaaaagtttgaatacttaatatgatttgattattttttataatgctactgcttctagtaataaagtcatgtgttattgccgtaagaatatttcagcaaaacataatgagtagagatatttatccacacacgtgcagtcaattgttttttgacaaaaacactcaggcaactcaatggaaaaaagaaggcctttttaatagaaaattctcaaattactagatatttgcataaaatatgtaaaccatatgctttcattttatttcacacataaaattaatttgggataaatcaccaacctaacctaaaaactggaactgtaaatcttctcaatttggaagtaggcaacgatttcattggcaaaaaataagaagcatcaagcatgaaaaaattgatgacatttcttctcaataaaattgcaattaagcatatgaatagataagaaaaagagtcgggaaaagtaatcgatatttaataactgtcaaagaatttttatccaaaatatttaaacaacttttatgagtaaatatgaaaaaaacaacacattaaaaaatggtcaaaagacttgggtcgtcaccttaatgtgagtatgaaaaatatgctcaatgctaatatcattagacaaatgcaaattaaaaccacaagataaggttttgcacaactacaatggcttttagacacacacacatacatgcacacatgcacacacattaacaataccaaaatttggcaaggatgtgaaacaattgtaaactatagctcccatacaccacgttttgtggtaggaaaaatgtatgtgaaatagtacaacaattttagagaagtgtatttaatatctgtcaatcctaaaatcaagcaaccccattcccagatatttgcccaagagaaatgaaatcatatgtccaccaaaatacttacacaaaactattcatatagcacatttaattcatattagccagtacctgcaacagctcaagtggcccaaaatagaatggataaatacattatcttatattcatacaatgaaatactacactgaaaggcaaagcaacaaaaacgaatgcaggcaaaatgtggatgaatctaaaaaagtctttattgagctaaaaaagtcagatataaaaagtatatatcatatatatggtatattctgtatgtatgtgatctgatttatacggaatttgtaaagtaggcaaactattgtgataattgaaattagactgttgttgcttttgggtagaagtgggaatgattgaaaaggagtgtatgggaaatttgggaaataatgggaaaagtcagtatcttgatttgagtagtggttacataggcttataatacaattagcaaaacctatcaaatactatacttaaaaacctctccattttattttatatacattataattcaaatacaactgataagaattatagaaaatgtggacaatatgtacaattttatacattatatatatatacacatatatatatgtaatgtttcccttaaattttacctcttaatcggattactgtggaaatatattcttaaaagtattatttgtatgtatcagttgcaaatctgacttacattattttaagtggtgtaagatattaggagaagtttgttatctaatgtaccttgatcactaatttatattacaaaaagtaatatgttccaatccatatttcttattggttaaatcagttctactgaaaaaattttaaattctatgcttcacaaacaaaacagagagaaatgtatttgaatactgaaggctacactgtgtctatttccaaggggctaataagatttaagacttcaaagattcagtcttgtggtcaagaataagtgatgtggatgcctaagaaatgataagccatgccaggagactggaacataaatttgaggctgaatgactgcaattttccaaacatattttctgtttatcacaaagtttcatagtagttccataacttttccctccactcggtctctttaaaattctactgaacttctgagtaaaattgagaataatttggtccactgaatactatggcaaccctcccaccaaaataaataaaatgaaaaatttttctttcttttccttgctgttttctaattattttatctttgattatgcttcaaaagccccctattttctcggaaatggaatgttgtatatcttcttagattcactttgtttgtaaaagggaggaatatctgaaagtagaaggtaattatttacattagaagcagtgttttttactctctatgaaacttcctgcaaatataatacttaaacactctataaaagattgcaagtatacacagcaagtttgtaaatttttattttaatatctctaaagaatgagtagattgtaattttgtatttgataaaaattattgaggcctgaaatgcttttttcctactttagaaatttaaatgccattttcataatattgattcttcctacccatgagcgtggaatgttcttccatttctttgtatcctcttttatttcattgagcagtggtttctagttctccttgaagagatccttcacgtcccttgtaagttggattcctaggtattttattctctttgaagcaattgggaatgggagttcactcatggtttggctctctgtctgttattggtgtataagaatgcttgtggtttttgtacattgattttgtatcctgagactttgctgaagctgcttatcagcttaaggagattttgggctgagacaatggggttttctagatatacaatcccaaggtaatttatagattcaatgccatccccatcaagctaccaatgactttcttcacagaattggaaaaaactactttaaagttcatatggaaccaaaaaagagcctgcatcgccaagtcaatcctaagccaaaagaacaaagctggaggcatcatgctacctgacttcaaactatactacaaggctacagtaaccaaaacagcatggtactggtaccaaaacagagatatagatcaacagaacagaacagagccctcagaaataacactgcatgtctacaactatctgatctttgacaaacctgagaaaaacaagcagtggggaaaggattccctatttaataaatggtgctgggaaaactgactagccatatgtagaaagctgaaactggatcccttccttacaccttataccaaaattaattcaagatggattaaagacttaaacgttcgacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcagaagaaactagcatcagagtgaacaggcaacctacaaaatgggagaaaattttcacaacctactcatctgacaaagggctaatatccagaatctacaatgaactcaaacaaatttacaagaaaaaaacaaccccatcaaaaagtgggcaaaggacatgaacagacacttctcaaaagaagacatttatgcagccaaaaaacacatgaaaaaaggctcactatcactggccatcagagaaatgcaaatcaaaaccacaatgagataccatctcacaccagttagaatggcaatcattaaaatgtcaggaaacaacaggtgctggagaggatgtggagaaataggaacacttttacactgttggtgggactgtaaactagttcaaccattgtggaagtcagtgtggcgcttcctcagggatctagaactagaaataccatttgacccagccatcccattactgggtatatacccaaaggactataaatcatgctgctataaaaacacacacacacgtatgtttattgcggcactattcacaacagcaaagacttggaacccacccaaatgtccaacaatgatagactggattaagaaaatgtggcacatatacaccatggaatactatgcagccataaaaaatgatgagttcatgtcctttgtagggacatggatgaaattggaaattatcattctgagtaaactatcgcaaggacaaaaaaccaaacactgcatgttctcactcataggtgggaattgaataatgagaacacatggacacaggaaggggaacatcacactctggggactgttgtggggtgggggctggggggagggatagcattaagagatatacctaatgctaaatgaggagttaatgggtgcagcacaccagcatggcacgtgtatacatatgtaactaacctgcacattgtgcacatgtaccctaaaacttaaagtataataataataaaataaaaaaaagaaatttaaatgctgtctacttgaagaaaatgtttatattgaaatgttaaacaaaagaaatgcacttttaaaattataaagtatattttgttatctctttaattttctttcaattgttacatttatattgtgatcttcacaaacgaatcattatgaaacacttttgacaccaatttgatctgttgactaatagttcaattaattaatagctaaataggctttgtttcctttcaaattgattaaatgtttgcatagtttaaaaatagaaaaaaattacactaaggcattatctgagattcgtttgtaaatataaatcacgccattaattatactgcctaattcatgataatagagttaaggggtctgttttatttaaataattttctgtggttttcaacatgatttaataaaaatattcctgaaaaagatcaacacatttcccattgtgaaaattttttcatgaaattattatctagtatttaatcatgtaatattagtagattgtggtttccagttgctttgagataattacttccttttaccagaaaacttcaacatcaaatttgtaggcctgttgtcatttataaggtctgttcaatcaaggtcacaattctgtcttaatttcatagtattgctgtaacttcaattaagagatttttggaagtttgcctcatcaatttttctgcctctggccatgataatacataaaattgtgaggatataatatttttaattacttacttctgagaatcctcagtcctcaaagaaacttagccaaatatatgtatgttttgtttgtttgaattttgttttttattatagcccccatagttggtatgaagtgatatgttcttttaatttgcatttccctaatgactaattatgttgagcatcttttcatgtgcttgtaaataatttgtatttcttttttggagaaatgtctcttcaagtccttggtccactttttaaaataactgtttttctctgttgttgacttgtgaaagttctttatactttctgcatactaggcggttatcagatataagatttgcaaatatctcccattatgtggcttgtctttctctttccctttctctcgctgtcttgatagtgtccttagatacacaaaatattttaactttgctagagtccaatttatttttctttcattgctcatactttcggtgtcagatctgagatattattaccaaatccaaggtcatagagattttccgcattctttcttctaagaattttatagttttagcacttatatttaagtctttgatccattataagttaattatttatatgatgtgaggtaggagtccaacttcattcttctgtgtgtggatttccagttgttccagcaacatttgttgaagagactgctcttgccttcaaaaaatggtcttggcacccatgtcaacaaccagttgaccataggcccctgggtttacttctgaacttccaattgatcagtatgtttatccttatgccaatgatccatatatttatatttatgtcagtatcaaattatctggattactggtgctttgcaataagatttgaagggcaaattaccctgttatattatttttcataattgttttagctttggggctccttgccttccactggattttaggatcagctttctttaacatttacattttagcaaaaaaagaaaaaaatcattgggatttctatacggattgcattgagcctgtagattgcttttggtagtattttcatcttaatagtattaattcttccagtgtagtttattttggctgattactctgactagaactttcagtaccaatgttaaagcacaagggcaaatgtggaaatgcttgtcttcttccttatctaagtagataggtttcaatctttcacctttaaatatgatggtagctgtgggttttccacaaatgccctttattatgttgaggaagcttcttttaattttcagacttcccattgtttttaagatgaaataatgttagatttttttaaatgctctttatgcatgaactgagaagaatttctgtttatttctctttgttttatcaatatggtatagtacattgattgagttttgtatgttgaaccaccctggtattgctgaaataaatcacacaaaatcatgatataggatccttttaatatgctgctggatttggtctgttagtaatttgtgataaattatcagttcttatttttagttgggattcttttcttatcaatagcataaatcttctttatggcccatctttctggttttgtttcacaagaatttcaaaaaaactattataaaccatctttcttttccatgcagtcaattgaaattccctgataattatttttcataagagaaataactattttccaagtatggcctactacttctatttctaaatctctttaaattgagatggttaaagtacagtatagtaacaaccctagctatgtaatattaagattagtgggaggattaatgtcaatatttctttttttttattatactttaagttttagggtacatgtgcacaatgtgcaggtttgttacatatgtatacatgtaccatgttggcgtgctgaatccattaactcctcatttagccttaggtatatctcttaatgctatccctccccccagcccccaccccacaacagtccccagagtgtgatgttccccttcctgtgtccatgtgttctcattattcaattcccacctatgagtgagaccatgcagtgtttggttttttgtccttgcgatagtttgctaagaatgatggtttccagcttcaaccatgtccctacaaaggacatgaactcatcattttttatggctgcatagtattccatggtgtatatgtgccacattgtcttaatccagtctatcattgttggacatttgggtgggttccaagtctttgctattgtgaatagtgccgcaataaacatacatgtgtgggtgtctttatagcagcatgatttataatcttttggggatatacccagtaatgggatggctgggtcaaatggtatttctagttctagatccatgaggaactgctacactgacttccacaatggttgaactagtttacagtcccaccaacagtgtaaaagtgttcctatttctccacatcctctccagcacctgttgtttcctgacattttaatgattgccattctaactggtgggagatgatatctcattgtggttttgatttgcatttctctgatggccagcgatgatgaacattttttcatgtgtctgttggctgcataaatgtcttcctttgagaattgtctgtttatgtccttcacccactttttgatggggttgtttgtttttttcttgtaaatttgtttgagttcattgtagattctggatattagccctttgtcagatgagtagattgcaaaaattttctcccattctgtaggttccctgttcactctgatagtagtttctgttgctgtgcagaagctctttagtttaatgagatcccatttgtcaattttggcttttgttgccattgcttttggtgttttagacatgaagtccttgcccatgcctatgtcctgaatggtattgcctaggtttttgtctagggtttttatggttttaggtctaacatttaagtctttaatccatcatgaattaattttggtataaggtgtaaggaagggatccagtttcagctttctacatatggctagccagttttcccagcaccattaattaaatagggaatcctttcctcatttcttgtttttgtcaggtttgtcaaagatcagatagttgtagatatgcagcattatttctgagggctctcttctgttccattggtgtatatctctgttttggtaccagtaccatgctgttttggttactgtagccttgtagtatagtttgaagtcaggtagcgtgatgcctctagctttgttcttttggcttagaattgacttggcgatgcaggctcttttttggttccatatgaaatttaaagtagttttttccaattctgtgaagaaagtcattggtagcttaatggggatggcattgaaactataaattaccttgagcagtttggccattttcacaatattgattcttcctacccatgagcatggaatgttcttccatttgtttgtatcctcttttatttcattgagcagtgatttgtagtttttcttgaagaggtccttcacatcccttgtaaattggattcctaggtattttattctctttgaagcaattgtgaatgggagttcactcataatttggctctctgtttgtctgttattggtgtgtaagaatgcttgtgattttttgtacattgagtttgtatcctgagactttgctgaagttgcttatcagcttaaggagattttgggctgagacgatggggttttctagatatacaatcctgtcatctgcaaacagggacaatctgacttcctcatttcctaattgaatgccctttatttccttcccctgcctaattgccctggccagaacttccaacactattttgaataggagtggtgagagagggcatccctgtcttgtgccagttttcaaagggaatgcttccaggttttgcccattcagtatgatattggctgtgggtttgtcatagatagctcttattattttgagatacatcccatcaatacctaatttattgagagtttttagcatgaagggttgttgaattttgtcaaaggccttttgtgcatctattgagataatcatgtggtttttgtctttggttctgtttatatgctggattacatttattgatttgcatatgttgaaccagccttgcatcccacggatgaagccctcttgatcatggtggataagatttttgatgtgctgctggattcggtttgccagtattttattgaggatttttgcattgatgttcatgagggatattggtttaaaattctcttttattgttgtgtctgtgccagactttggtatcaggatgatgctggcctcataaaatgagttagggaggattccatctttttctaatgattggaatagtttcagaaggaatggtaccagctcctccttgtacctctggtagaattcggctgtgaatccctctggtcctggactttttttggttggtaagctattaattattgcctcaatttcagatcctgtaactggtctattcagagattcaacttcttcctggtttagtcttgggagggtgtatgtgtcaaggaatttatccatttcttgtagattttctagtttatttgcatagaggtgtttatagtattctctgatggtagtctgtatttctttgggattggtggtgatatcccctttatcattttttattgtgtctatttgattcttctgtcttctcttctttattagtcttgctagtgttctatcaattttgttgatcttttcaaaaaaccagctcctggattcattgattttttgaagggttatttgtgtctctatttccttcagttctgctctgatcttaattatttcttgtcttctgctagcttttgaatgtgtttgctcttgcttctccagttcttttaattgtgatgttggggtgtcaattttagatctttcctgctttctcttgtgggcattgagtgctgcaaatttccctctacacactgctttgaatgtgtcccagagattctcgtatgttgtgtctttgttctcattggtttcaaagaacatctttatttctgcgttcatttttttgtgtacccagtagtcattcaggagcaggttgctcaatttccatgtagttgagtggttttgagtgactttcttcatcctgagttctagtttgattgcactgtggtctgagagacagtttgttataatttctgttcttttacatttgctgaggaatgctttacttccaagtatgtggtcaattttggaataggtgtggtgtggtcctgagaagaatgtctattctgttaatttggggtggagcgttctgtagatgtatattaggtctacttggtgcagagctgagttcaattcctggatatccttgttaactttctgtcttgttgatctgtctaatgttgacagtggggtgttaaagtctcccattattattgtgttggagtctaagtctctttgtaggtcactaaggacttgctttatgaatctgggtgctcctgtattgggtgcatatatatttaggatagttagctcttcttgttgaattgatccctttaccattatgtaatggccttctttgtctcttctgatatttgttggtttaaagtctgttttatcagagactaggattgcaactcctgcctttttttgttttccatttgcttggcagatcttcctccatccctttattttgagcctgtgtgtgtctctgcatgtgaggtgggtttcctgaatacagcacactgatgggtcttgactctttatccaatttgccagactgtgtcttttaattggagcatttatcccatttacatttaaggttcctattgttatgtgtgaatttgatcctgtcattatgatgttagctggttattttgctcattagttgatgcagttgcttcctagccttgacggtctttacaattgtgtatgtttttgcagtggctggtaccggttgttcctttccacgtttagtgcttccttcaggagctcttttagggcaggcctggtgttgacaaaatctctcagcatttgcttgtctgtaaaggattttatttctccttcgcttatgaagcttagtttggctggatatgaaattctgggttgaaaattcttttctttaagaatgttgaatattggcccccactctcttctggcttgtagagtttctgccgagagatctgctgttattctgatgggcttcccgttgtgggtaacccgacctttctctctggctgcccttaactttatttccttcatttcagctttggtgaatctgacaattatgtgtcttggagttgctcttctcgaggagtatctttgtggtgttctctgtacttcctgaatttgaatgttggcctgccttgctagattgaggaagttctcctggataatatcctgcagggtgttttccagctgggttccattctccctgtcactttcaggtacaccaatcagacatagatttggtcttttcacataggcccatatttcttgggggctttgttcttttctttttattcttttttctctgaacttctcttctcacttcatttcattcatttcattcatttcatcttccatcactgataccctttcttccagttgatcgcgtcggctactgaggcttgtgcattcatcacatagttctcatgccatggttttcagctccatcaggtcgtttaaagacttctctgcattggttattttatttagccattcatctaattttttttcaaggtttttaacttctttgccatgggttcgaacttcctcctttagctcggagtagtttgatcgtctgaagccttcttctctcaactcgtcaaagtcattctccatccagctttgttccattgctggtgaggagctgcattcctttggaggaggagaggtgctctgactttcagagtttccagtttttctgctctgttttttccccatctttgtggttttgtctacttttggtctttgatgatggtgacgtacagatggggttttggtgtggatgtcatttttgtttgttagtgttccttctaacagtcaggaccctcagctgcaggtctgttggagtttgctggaggtccactccaggccctgtttgcctgagtatcagcagcggaggctgcagagcagaacagcggctactggtgaacagcaaatgttgctgcctgattgttcctctggaagttttgtctcagaggggtaccaggccatgtgaggtatcagtctgcccctactggggggtgcctcccagttaggctactcaggggtcagggacccacttgaggaggcaatctgtccattctcagatctccaactgcatgctgggaaccactactctcttcaaagctgtcagacaggtacatttaagtctgcagagttttctgctgccttttgtatggctatgccctgcccccagatgtggagtctacagaggcaggcaggcctccttgagctgtggtgggctccacccaattttggccgctttgtttacctactcaagcctgggcaattgtgggtgcccctcccccagccttgctgccaccttgcagtttgatctcagactgctgtgctagcaatgagtgaggctccgtgggcataggaccctctgagccaggtgctggatataatctcctggtgtcctgtttgctaagacagttggaaaagcacagtattagggtgggagtgacccgattttccaggtgccgtctgtcacccctttctttgactaggaaagggaattccctgaccccttacacttcccggttgaggcgatgcctcgccttgcttcagctcatgctcagtgcgctgcacccactgtctgacactccccagggagatgaacctggtatctcagttggaaaagtagaaatcacctctcttgtgcattgctcactgggagctgtagactggagctgttcctatttggccatcttcaatatttctaacatattagaatctatttgattttttaaatctacataaactcgtgtactaacagttattttatttgtaaaacacttttttttcctatagtatgttggacttatcaatattttgaatatgtaagtcttaccctttggagtttactgtccaaagggcaaaccttatatattttaaatgtatagcttctaatgttctgattatagaacagttatgcatgggatataagcaacaatttgtcttccaaatatgtcatatttgccactgttttcatggattatatgaaacctgtgaataattgcttttgtgtatattgattcttcagttacattcagtggtggtaactacttgaaaatatttctgataactaagtttgaaattagattttaactgttcctgtaagtccctcattcagtgacttattgtgtaatgctattttattgcttctatacatcctatttcttatgtaatcatgcatgtaagatttaatcttgaatctttgaatatgtgaacctcactttattctactctcttgattgatagtttactgtagaataaatttgattggttgaaagtaattttctctcagagttttaaagtcattgttctattattttatggaatccaacattacttatgagaataataccaaccatttcaatgtgtctttgtaaataagctgtttttttttcccaatgggagaaacttaggatcaactcaatgtttttgctgctctagaaagtctagaaaaatgtggctaggttttttacaacatactattcattgagataccaagacaattaatactgtaagtcttcatctctaggaaattatgtttgattcttacaattgtgataattgttatccttcgttttctctattccagtgaacgaagtaccagtgatggtcactggggagggagttttaatcaacagcactaaggttcatggtagctgcttcagtttttcccaaatgattacttgaaaaataacttttgttttgttttgaaagtgggaagtttaaattggatgttagtgattttattgaggatgatggaagagtgcagttgatgagaatattttcatttgatcatcttattttcagcctttttactgtctgtaatttttgatttttcaggtctgcctcccaaccctctaagtgtattttaggaaagatctatgcccccttaacttcagtcctcttcataaatatttctggctgcaactacttgcactgtgttttattagcgcatgcctttttacatgccttccagaaatatgttggaatctctagtctgctaatgactaccaattgttcttttaattttaatagcttatagctcttaaaactgcctttaatctcaccgtttaggtctcatatgaggagaaaatttaaaaaattatattttctagtccatattcttcaaccgctgtttccttaaaatgattcattgacacaaaaaatggcatttggatatgcgaatggattccatcaaagccttcaaaatgggaggtctggcaaacaatttattttttcttacaatatatacctattcccaaaagttatttgactactttgtttatatattttgtgcttatttgactattctattccttagcctactttttctttacccactcttctcttgcctatctcatagcctatttcagaaatatgtttatgcagatttttcatctaaatcttttttcctgtcttttccagagtatttcttcagaatttcactttcttctgaagtagcttattcacatatttcctaaataccttttcttcccccccaaaattatattaataacttttatttaagttgtttgttttaaacctgttccattaaaaattccaaggctttgtttgtactactatgcaaactctactgcatattactcagcaatattggctttagctgattatatccagcaatgaatgcttcttcacctctaagacataaactgttttctgcagaaaggccttacatcagatggacagaaagtctcacaactttctgtaccttacagttatggttctccaaatgcagcatcgttcaaagtcacctgaagaacttggtaaagcactggtttttaggtccaatcttgtaatttctgattcaataggcctgcatgaaagccaagaatttccattcctattaagttcctaggtaattctgatactgctgatctgagagctgtagtattagaaccattgcctggagaaccactattccattggtaaaagggtaactcacatgtccttactctgaaagatggaaagatttatagaaagtccaaacaagtcaatagtttctgaaagcactaccttgtataattatgacatgctaataattttgtaggtagtcaacataaaagaaagatgtttgaggaggatataacagaaaactgggtttatttatatgtctgttggctttaccaatatctcacagtcttgggtaaactgatcaaagcacacataagttctaactctaatttttgcaaatactatagattctaaagagaaaaacaatgaaatgattatgaatctcatcctctttgtcagcatgcgtgtgtattgtctacctgtatgcccaatatttatgagttattatgtgctaatatgaaagaaatatttattaaatgtgctatgtttaacaaaataatgcagttcttccctaagcaatcacaaagtatgtatcattggctgaaatacaatcagatttgtcaattttccattttgtatagtagtgacatatgtgctacttatggaagaataaagataaattataaagggatttttattagtaaagaataaacttgcaaagtttcagatttatatttttttttcaaaaactgactatatcttatgctttaacttttaagaaatgttagatagcattgacaaatgtctacttcctgaaagtttgaattaatgaaaactgtttcttgaccatatatagccttcaaatagtcttcagaggtgtatatgggttgtgtgtgtgcgtgtatatgtgtgtgtttgtaatgatgtagtgaatacagaacactttttaaagtattagaaacaataaaagggtgcattagaatggatggcatctgcatcatatatatcacaagcttttaatatctgataatcagtatttttattatgtccagtgtgataataaaatgaatcctatgttgtttgttaattaccttttgtaaaatatcattttacattatactatcagcatttttatgccatcaaatatgcttctgaaaaattatttttattgtgtcatatgaaggtggcacaaatttagcttgtccctcaattaatgggaatttaaaaaaatttgttttctaagagggaaattgccaagttaaagtgtataaatatatttatggctcctaataatttttttataaagccattatactcctacctgaggtttcattttacattttaaagtatgcttgttacataaatagtctatggttatttatatttttaccaatttggtaggtaaaattataatatgttatatagttttaatcggcatttttgtaactttgtttggaatagaagtttttaacatccttttttgctacttgtatttgaaagtgaagaataaagcatttatggctttagtgggtataatctatcctgtcaaagcagaaaaataattactaaaattttgtaaaggttatttttatactattttcctattttaaatctaaagatatggggtaaatacatgcattattgttatagttacttttagtattttagatttacagacatttctctttctctttccttttttctcttctactttgtatgcccttaagaatgacttatttaaactcatttgtcaaaatcagaattagtgcataaatagttctatggataagaaaaactctgttttatatgtgatccaaaatgcaatatatgaatgttatattgcctagaataaacgttcttaattttttagggaatggaactcattatgaaacatacaaacatgtttacctgtttgacagtttaccataccagaatcgtttcttttgcaaattgaagtataatgaattagtacaatctctgagaacacagagatatcacatgagaatgaaatctacagcatttaactttcagatttattctttcacttattctaggtgtatatatatcatttgtaaagtgagtgactcttcactttttaaatctaggaataatatcagtttttttttcaggaagaaacttcctccagtcaactcattactaaatatttgtgtgagtgtgtgtgggctcgtgtgggtttgtgtgggcttgatgtgcttttctcttagttgaataacagtatcagtcctataagcatgtaatgatacaagaagacaaccaaaaaagatctggaggcatccttgttatacaattagacaaagaaaatgtgtgtgtgtgtgtgtgtctgtgtgtgtgtgtgagagagagagagaaggagggagtatttaacgagtagcttctaaaattttgagatgggatagattaaatggagctaaatgttgaatttataattactaaatatctatgtaattattaaagataaaatttaaaataaaaatagggcatagtctttttttattatacttcaagttttagggtacatgtgcacaacgtgcaggttagttacatatgtatacatgtgccatgttggtgtgctgcacccagtaactcatcgtttaacattaggcatatctccaaaatggaaagctaaaataacctttacattttaagaagtgactgaattttagtttatgattgactgtcttctagcggtagaattgacatagttcagaaagggagctaaatgtgcctccactgtgataagaaatgggaagaaaatagaaaaagtaattgctttagcaatgatctagtatgaaagtgatggattctttcaggtagaatttggtaggctttcagtggctggcacattcttcggagcactcaatgaggtcaaatatctcagtgtaggaaggtgtaaactgtttagaaacctgctaccatccaacaaattgaaactgaactgatgttagtgtagctgtgcactaaggcatgtttttctgtgtccatgagtatgagatgaagagggactatctcttaaagatttttctatctgatactcttcaggatctaatgagatcagccagctacagataaacaaactgatgctgaacctgcaattggccatctcctctcagctaacccatttgtctttagctgttctcacagagggaatgacagtgcatttatttagggcaaaagaaatacctatttttatataactatttgagaaaagaatcaagatgagtcaataaagatgtagcaaagtttggcttttggatccgtcctgttttgcttctctggccagctacacacgtttggggaactaatcatttactttgacagagtttcctgcatcacaccttctactgaattttctaaaaaagcaaaaagtattttgtcctccagcattcaaacaccaggtggtctaatttttgcctgttggctcaaaatatgtgtttggagattttctccctgacctgaatcgatcctctaactgacagagcaatgtaaatcttggacataaacaacaaagagtgtgtttctactggcaaagacagtgtaaattatggaggatttatgtactatggtaataaattaagttcctacaagtgcttttgtttgaatagaaatatcaaaatcccaaggcctgttgctttagacatatacgtgatttttttagtccaactttgattattagcttatatccctttactcccctgatgcttcattcatttcagaattagtacttggggaatctcctacttcagtcccagaagaaactgggttagtcacagatagttcttcatagcatgcttcttctcacagtggtaccaacgaagcatggcaatgcaatacattttgtcctccaaatcatcagccatgaaaattggtccttaattttgtctttactttccattatttatataaacctataagaaaagtacttgttttataagcttgatgtcatttcgtgtagtgtgtactagaaaagtattgccttccaggtaaaagagaagaagagtttgtttcttttttatagtagtacctaattgtatttcagttctggagtgcccacatattctgtagctttgaaaattacttggcaaatccattttcagattatgtatactgattatgatttttacaaggtttggttcttatttactttcagtaatttcctttcctgttagaaaaatctaaatattgctttgttcttctaaaggaaactctttaaccaattttctctggaggattcttagttttctgacatctttttgaaattaaggactagaaccacactatctattagaagtacatatattctatgtatgtagagataatgttttctgatgttttcactactgtttattatttccatggttgtcatcactacaacagaatcatccattttaaatgagccttaagttttctacttattaaatatcttgttttttgaataaaaggaacttaacaatagattttatgttgttctatataaaattgttctccaaaaattcgcaaaattttttatttatttatttatttatttatttatttattttgagacaggatctcactttttcacccaggctgtgcagtggcgcagtcacacctcgctgcagcctggaccttaagcaattctctcatctcagcctcctgaggagcttggactacaggtacactccaccacaactggctaatttttttgtattttttgctgagacagggtttcaacatgttgcccaggctggtctcaagcgatgcaccctgcttagcctcccaaagtgtgtgactaaagttatgggccactgtgcccatccaaatttttacttttacataggtaataccaccataagttcaaatattaaaaagcataaattcatgccaagccattagttttgcaccaaactgtgtgacccaaacacccaattcctcttccaaaattggtatagattcatatgcaaatactaattttctatcctttctaaattgaaattatatatgcattgtattgcacctttcttcaagtgtttaatatgttttggataacaatcttttattaatcttttattcctaaagagttccatattctttttatggctgtgtattatttcattacatggatatgctatctcacctaagtcttattgattgatagataaggctttcctaatatttttatattaaaaacaatgattcagtgaaacactgtgtacatgtcccttcacatatgtgcaagtataagaaaaaaataaaatctcaaaagttaaattgtttgatcaaagggtaaatgcattcatattttgccaaattgccctccaaaggatttgtaccaatgtggacttagcccggtgatatttgagagcacctgatttctacatactcattaagtgccctaacaaatttgtaaatctttattattctgataggtaaacatgttttctctcttaaataatttgtagcatccatacatgttattttctttgaactgtttacatatttttatcataatatttcattgtgttctttttatcaatcgtagacgacctttattcattgaggataatagatctctatgagattgctttattctgctttcttaaacacattcagaaattatgatcaaaacatgaatggtttgaaattattacaataactcagattgtttttgcagaaatatttcatattttgtgcttctcctcatgttttttaaatctcatttctgtttctacacaaaaggttcatagtctagtacaattatattaagaggtggtatttggtagctatatgaagaaagttgtgggtgatgaaatcagtgatagcatagtgactaaacataactgaattgcctaactcaaagtttaatccaatttttgaataagtcaagtagtagtatctttctcacctgcacatttggaattcccatgtttcaggcttcttttgtcattgtattttatttcctaattcagtaaaacctgtaattgaatgtattcgtttcctacgactgccataacacaatatcacaaatggagtggcttaaaacaacaaaaatgtactgtctcacagctcttagagcgagaagtgaaaaatcacggagtcagcagaggtatgctgccactgaaacatgtaagagagaaatctttgccacttcctagcttctggtgatggtcatcaactggcatttttttttactttcagctacattactccaatctctgccactgtcctcataaggcattctccctgtgtgtgtgtccacatttccctcttcttagtacaccaacagtcgtattggatttgggcccactctaatgatctcacctttatttgatcacgtatacagagaacttctttacaaataaggtcacattcagagggactgggagttaggcttcaatatattttgagtttggggaagccaattcaacctataacattgagtaatagcaggtaaccacaatgctttagtgatcttataaaaatgatgtcgaaaagtaagctctgtgttctagagtttgttttcattataaagattacattcactgaaagctctatgcatataatgtatctttagatgatagtctactataaatgttgatgctcttagctttagaaaaattcagtaaattctaaaaactttcttcaaattgagctgaactcatctgtgatctcactatttctgtgtcacaatcaatttgggaaataaacatattttaatattatattttctctttgttcatgacgggcatagtcaagtgatgattagtttatgtgattcattttattgcatttaatagaaattactaaccagaattacagctcaagtctctcgacagggaacaaatcacagcaaatgaatccaacaggaatcaatatgatgattcattagcaatgagctctcactgagagtcccaacaagctgaagacttcataccatatttttttatgaaccaaatgtcaatagcgaaattaactactaaaaagtatcacagaaatgtgctttattttaatatcatatttcacaattttttaaacaactgaaacaagtttatgtatttcacttttgcttctacaaattattttaaaatagtttccacatctcaaatatcatattggaataattattagaattttataaagtctgtttcccaaaatatttactaaatattttgtcctcataatctcactagaagattacattccattatatgatattttaacagttttctcattggtttaactgtggcatgtatgcacaaatacacatgcacatgaatccatgtgcagacacacacatatatgcacagcacaaggtcgaaagcacattaaaagatttctcaaatatagatatatcaatatataaatatgaaaaaagcatactatgtgtgtgtgtgtatatatgtatacacacaaacatatacacacacatatatatatacaaacacatacacacatatatatacaaacacaaatatgcacacatcaactttttggatatgacatctaattcaactccaaatttccccagttatactgtcatgaccttagaaatgaagtaggtagactgggggatcttgggataaggagtataacactgtttctgcagttttattttattttattttattttattttttgagacggagtctcactctgtcgcccagactggagtgcagtggagcgatctcgactcactgcaagctccacctcccaggttcgcgccattctcctgcctcagcctcccaagtagctgggactacaggtgccagccaccatgcccggctaatttttttttttaattttcttttttttttattattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaagagtccccagagtgtgatgttcccctttctgtgtccatgtgatctcattgttcaattcccacctatgagtgagaatatgcggtgtttggttttttgttcttgcgatagtttactgagaatgatgatttccaatttcatccatgtccctacaaaggagatgaactcatcattttttatggctgcatagtattccatggtgtatatgtgccacattttcttaatccagtctatcattgttggacatttgggttggttccaagtctttgctattgtgaataatgccacaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgggagatggtatctcattgtggatttgatttgcatttctctgatggccagtgatgatgagcattttttcatgtgtctgttggctgcataaatgtcttcttttgagaagtgtctgttcatgtcctttgcccactttttgatggcgttgtttgtttttttcttgtaaatttgtttgagttcattgtagattctggatattagccctttgtcagatgagtaggttgtgaaaattttctcccattttgtaggttgcctgttctctctgatggtagtttcttttgctgtgcagaagctctttagtttaattagaccccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccattttgaattgatttttgtataaggtgtaaggaagggatccagtttcagctttctacatatggctagccagttttcccagcaccatttattaaatagggaatcctttccccattgcttgtttttctcagtagagataggatttcaccgtgttagccaggatgttctctatctcctgacctcgtgatctgcccacttcggcctcacaaagtgctgggatcacaggcatgagccactgcgcctggactttctggagctcttaaaaaataaactttatttagaaagaaaacaaaaaacaaaaacaatttttggaacagttgtaggttcacagcaaaactgagcagaagttacagagatttcctatatacttcctgttcccatattaatataccatctgtcattaacaacatcttcctagagaacagtgcacttgctacaattgatgaagataacttgacacatcattaccaacccgggttcacagttaaagttagaactcacttttggtcttattgagtctatgggcttggacacatttttaatgacatatatgcacaattatggtattatgcagaatagtttcaccactcaaaatcctctggattctccttatgtatccctccctatccctaacccttgaaacgactagccttactgtatccacagtttcacctcttccagaatgtgatatactcatttatgtttcttccatgtcttttcatggcttgatagctcatttttttagtgctaaataatattccactctctagatgtgccataatttatcaattctccaacatctgtttcttccaagttttggcaattataaataaagctactataagcatcaattttcaggtttttgtctgaacataagttttcatctcctttggataaatagcaatgagcagtatggctggatcctacggtacgagtatgtttcattttctaagaagctgcctgtttttcatagcagctgtaacaatttgcattcccagtggtaatgaatgaaagttcttgttggttcacatcctccccagcatttggtattatcagcgttctggatttggctattctaataggtttgtagaaatatctaattgttgttttaattttaatttgcatttccctaatgacatatgatgtggagcatattttatgtgcttgtttgccatctgtatatcttctttggtgaggtatcttttaatgtatttggctcattttttgtttgttttctttttgttgaattttaagcattccttgtaaattttgtataatagccctctatcagatatgtcttttgcacgtattttctctcagtctgttgcttgttttatcattctcttgacagtatctttcacagagcagaaattcttaattttaattaagtccaagttatcaaatttttctttcatgaatcatgcctttgttgtagtatctgaaacgttaccatcaaacccaaggtcatatgatttttttttctatgttatgttgtaggagtttaatatttttgcattttgcatttaggcctgtgattcacttcaagttaatttttgtaaaaggtgtaaggtttatgtttagattcatttttctccaggtggttgtctagttgttccagcactgttttttgaaaaaatttccttttctccactgtattgtcttttcgcctttgtcaaagattggtatactgtacttatgtaggtctctttctggactcttttctgttccattgatctatttgtctgttctcttaccaataccacactctcttgaccactgtagctttataacaaacttttgagtcaggtagtatcagtcttccattttttttttcttcaactttaacattgtgctagctatactgaatattttgccacttcataaaaacttccgaatcatttagtagatatctacaaaataacttcctgtaattttgattggggttgtatattatttatagatcaaattgggaagaattgacatattgaaaatattgaatctttttgtccataaacataaaatatttatccatttattcagtcctttttatatctttcattagagatttgtagttttcctcatatagattctgtgcatattttgttacatttatatttaaatatttccttttggggatgctaatgtaaatagtgtgtgttcttggtttcagattcctcttgttcattcatggcatataggaaagtgattaacttgtgtatattaactttgcattctgccacactgctataatcacttgttagtttcaggaacttttgttgttgttgtcgattgttttggatttcctacataatgatatcacctgtgtacaaagacacttttaattcttctacaccagtaagtatacctttatttctctttgtataattgtgctaggactttcagtaaaatcttgaaaaaagagtggtgagagttaaccttgcctacttcctgatcttagttagaaagcttccagttttccacaatcaagcatgatgttggccatcagttcctttgtagatgtctttatcagtttgagcaagttctattcttagttgactgagagattttatgatgaatgactgagagattttatgatgattttatgatgaatttttggattttgtcagatgctttttctacatctattgatacagttttgtgatctttcttatttagcttgttgatatgatggaccatattaattgattctggaatattgaaccagccttgtatatccgggataaatcccacttggtcatggcatacaattctttttatacattgttggatttgatttgctaatattttgttgaagatatttgcatctatgtccacaacatatattggtgtgtagtttccttttcttataatgtctttatctgattttagtattcaggtaatgctgacttcatagaatgagttagaaagtattcactctgtttccaccctcagaaagacattatagaaaattggtataatttcttccttgaatgtgtggtagaattcatgagtgaacccatctgggccttgtactttctgtttggaaagttattcatttttgattcaatttgtttggtaaatattcacctattcagattgccatttcttcttgggtgagatttagcagattgtgtctttcaaggagtaggtctgtttcaactaggttatcaaatttgtggtcatggagttgtttacaatattcctttattatcatttgcatgtccattagatctgtagtgatgtgtcttctttcatttctgatgttagtaatttgagtccactcttcttttttttttttttttttccttagcctggctaaaggcatacagattttattgattttttttttttttcccaaaagactgacttttgatttcactgaatttctctattggcttcctgttttctactccattgatttctactctggtttttagtactactattattacttccagttactttttatttaatttcctctccttttcctagtttcctaagatgaaaacttagattattaatgttagatctttcttcgtctctatacaatcaatgttataaatatccctgtaagcactgctttcattacatcttacaaattgttatgttgtgttttcatttttatgtagttcaattttttttttaattttctgttaagatgtcttctttgacctgtatgctatttaaaagtgtgtttgtaatgccccgtaaccttcagcaatcccactgttgggtataaacccaaaggattataaaccattctactataaagacacattcacatttatgtttattgcagcactattcacaatagcaaagacttggaaccaacccaaatgcccatcaattatagactggataaataaaatctggcatatatacaccatggaatacaatgcagccataaaaaaggattagtccatgtcctttgcagggacatggatgaagctggaagccatcattctcagcaaactatgcaggaacagaaaatcaaacaccacatgttctcattcataagtgggagatgaacaatgagaacacatggacacagggaggggaacatctcacactggggcctattgggggatagggtagctagggtagagatagcattaggagaaatacctaatgtagatgatgggttgatgagtgcatcaaaccaccatggcacatgtgtacctatgtaacaaacctgcatgttctgcacatgtatcccagaacttaaagtataatttaaaaaaaaaggagagaagagaaaaaaaggggtgtatttgtttaatttctatctattttgaaaattttcagctatctttctgttatggatttctggtttaattttattgtggtctgagaacaaacattgtttgattcctattctttcaaatttgttaaaatatgttttatggcccagaatgtggtttaccttggtgaattttccatgttagcttgagaggcatgcttttctgatgttgaatgaagtacccaatagaggtcaattatattcagttcattgatggtgctgtagagttcaaatatatccttacttatttcctgcctgttggacctgtccatttctgatagaggggtgctgaagtttccaaatataatagcaggtttatctatttcttctttcagttatattagttgttccctgatgtattccgatgcaatgctgttaagtatgtacatattaaggactgtcatgtcttcttaaaggattcatccctttatcatgtaatgctcctccttatctctgatactatccttgctctgacgtcggctctgtctgaaatttgttttgatgattgttagcataatatatatttccccattcatttactgttaacttatatgtatttatatttagggtaagtttcttgcagacaaaatatagtcttgcttattgatccactctgtcaatcttatcttttaattgatatatttataccatgatgtttaaaataagtattgatatagttgggttaatatttatcttatttatgactatcttctatttgttgcctgtgatcctggttcctttttttgtcttctactctttccgcattttatgaatttaattgatcactttatattattccatttcatcttctttttatcttagcatatcagttatatatttttccttggtttcttataagttatttttagtggttgctctgaagtttgcaatataaatttacaactaatccaagtccaccttcaagtaacactatgctgcttcataggtagtgcaggtaccttacaataactccctaaaaataatacttaatatttctaacttcttaaaaaataataattaccccctccattctttgtatcattgctgttattcatttcacatatacgtaagcatacacatatatatgcatttttaataaaaacattgtttctgttattaatttgaacaaattattgtccatttgataaattaagaaaaaggtatttattttactttcacttactcattttctgatgctctttctttatgttgatacaagtttctgatctatttcagttttcttttctctgaagttcttcttttggggtttcttgcagggagggtctgctgacaacacatcccctcaaatttttttttttttttggtctaagaaaattcttatttctctttcacattttaaggataatttcacaggttacagaattttaggttgatgatattttcctcttaatattaaatatttcatttaattcttttcttgctttcatagtttctgataagtcagatataattttatcttagtgagtgctttttttctttctctctagtttctctcaggatttttgtttctttattttgattttcttcaatttaaatatgatttgtctaggtgtaggttttcttagcatttatcttgcttgctgttctctgaggttcctgaatctttggtttggtgtcagacataacttgaagaaattcttggtcgtgggtgattcaaatatttcttctctttttttttaattcttcttctgatagtctcattacatatatgttacactatttgcagttttctcacaattcttggatattctgtgttgttgatggtttttttaatctttttttatttttcttttttggcaataacaattgaaatatccttaagctcaggtagtcttctctcaaccatgaccgatctactaatatgcccaagaaaggcattctttattacttttacagtgtttttgagctctagaatttctttttgtttctgtctgagaatttccgtctctctgcctacattgcccatctgttcttacatgctgtctcctttatacattaaagttcttagcatataaactgtagctttaaaaattcccagtctgataattctaacatccctgccttatctgagtatggttctgacacttactgtgtctcttcaaactgtgtgtgtgtgtttctttttttagtatgccttgtttttttaatatatatctgaacatgatgtagtgggtaagtagaactgttgtaaatagacctttagtaatgtggtggtaaggtgtggtccttaatcataggtctggtcctatgattgagactcggtcttttagtgagcctgtgcctctggactgcaaccttcacaagtgcttctctgttccccctcccaccctcttttacctttaataggatagctagaatgggctgacgttgagtattttccttctcccagttggaaggctagagcctgctggagttgggcatttccctttcccaggtcatgtagactcgaattaacccccagtaggttaggttcaagttaaacagtttccccagggacagacattgtgaagaagaaaagaatagtgtatttcaaaatggttactttctcccttcccctgctggaagcatgaagggatttttttttcctctaatattcactgtgggaatctagttcctcaaggcaaaactcacataagtatgggcacccgcctatgactagatccccctagagtttttgactctcagaattttccacactgagtctccagcaagtcatcaaatacagttcaggttttcctatagcccagcaatagttcccacagaggtttctggtccagtaagttgcaattctccttacaggcgtatcttgccttagagacattgaaggttcagttccagatcacagccacaaagtgaatactgcaataaagcaagccacacatttttttgtttcccagtacatatcaaagttatgtttccactgtgctatagtctcttaagtatgcaatagcactatgtctaaaaaaacaacatgaataccttaatttaaaatacttcatttctaaaaatgctaacaatcttctgggccttcagcgtgtcataatccttttgctggtggagagtcttgcctgggtattgatggttggtgcctgattagggtggtggttgctaactgaggcaatttcttaaagtaaaacaacaatgcagtttgccttatcaattgcctctttgtttcacaaaagatttctctatagcatgccatgctgtttaatagaattttacccatggtagaacttctttcaaaattggagtaaatcctcttatccctgctgctgatatatcaactaggtttatgtaatattcgaaatcctttgttgtcatttcaacaaggtccatagcatcttcaaaaggagattccatctcaagaaaccactgtctttgttcctccataagaagcaactcctcattattttcattctcattttattgtcagattgtagcaatttggtcacatcttcaggctctacttctaatactatttctcttgttatttttaccacaactgcagttacttcttccactgaagtattgaactcctcacggtcattcatgaaagttggcattaaattctttcagacttctgctcatgttgattatgttgatcacctcccatgaatcacaaatgttctaaatttcatctagattggtgaatcctttccagaatattttcaatttactttacccagacccattggaaaaattgctatctatgacagctgtagccttacaacatgcatttcttagataatatgacttgagagttgaaactactctttgacccataggctgcagaatggatgttgtgttcacaggcataaaatcaatattaatttccttgtgaatctcgatcagagctcttgggtaaccaggtgcattgtcaataagcagtcataatttcaaagtaatattgttttctgagcaccagttcgcagcagtggccttaaaatattcaggaaaccatgctgtaaacagatgtgctgtcatccaagctttgttgttccattaataggacacagggaggatagatttaacagaattcttaagagctctaggatttttggaaaagtaaatgagcattggcttcaacttaaagtcagcagctgcattagcccctaacaagagagtcagtctgtcctttgaagctttaaagctaggccttgttttgtcctctctagctatgaaagtcccagggggcatcttcttccaatataaggctgctttatcttcactaaaaatatgttgtttaaatgagaacacatggacaagggaggggaacatcacacaccgggccctgtcaggcataggggacaagaggagggagagcattagaacaaatgtacatgggggttaaagcctagatgacaggttgatgggtgccacaaaccaccatggcacatgtatacctatgtaacaaaacagcaccttctacacatatatcccagaacttaaagtaaattaaaaaataaaaatctgttgtttagggcagccccctttgtcaatgctttcagctagatcttctgaataacttgttgtagcttctacatcagcacttgctgcttcctcttgtacttttacattatggagaagacttttctccttaagcctcatgaacaaacctctgctggcttctattttttcatctgaagctttctgacctctctcagacttcagagaattgaaaagacttagggcctttccttagattttgctttggcttaaagaaagatagtggctggtttgatctattcagaccactgaaactttctccatatcagcaaaaaagacttctttgttttctcaccatccgtgtgttcactataatagtacatttaatttctttcatgaacttttcttttacatttacaacttgctcaactcctcgatgcaagaggcctagctttcagcttatctttgctttcaacctgtgttcctcatcaagcctaatattttctaaattttgatttaaagtgagagaggtgggacgcttcctttcacttgagcatgtagagaccatttgcagagttattaattggcttaatttcaatattgttgcatctcagggaatactgggaggggggaattggggatgaagcaatcagaacacatgtggtgtttattgattaagatcgattcattttgccatcttttatgggcatgatttgtgtcccctccaaacagtaacatcaaaaatcactgactatagatcaccataagagatataacaacaatgaaaaagtttgaaatatattgagaattaccaaagtgtgacacagagacataaaaagtaagcacttgctgttggaaaaattgtgcaaatagacttgtttgatacagggttgccataaacattcaatttgtaaaaaaaaaaaaaaaaaaaaaaaaaaaaaaaaaaaaaaacacacaacatctgggaaatgcaacaaagatgaagtgtaataaaatgaggtatggctatatctgctcctgtctccaaaattttgagagtagatgtttaccttgcaatctcacttctattatgggtctaagaagagttgctggccttctgtgtgttcagctttttacttattgttgcaatggagtgatgatttccaagttcttacatttggggcaggaaattggaagtccaaatatagtattttcaaatgacagaagagcatattttcttcaaaaatatagccagtatcaatttaaaactcaaatgtttaaattcccagatgacgaaattttgtatattttctcttattctgatttgctgacttattcttttacaatatttatactgacaaccaagccctcctccaagtatagccaggagaatttagtcttctgaccaaattcttgttcattgattgaaatttataaagttcataccttttgccaaaaaccaggctcattcttagaaacagaaagacttacaggacaataaacttgccagattatgtggcagattcaggaggaaactctcacaatgtcttttgtgatatgaatctgtatctgaagaagtattcatggacttccacgctatgcaagacattctgacaggtactatggaagttaacagaaaacaaagggcaaggcctctgccctcaaaagtccattatttagttggggagaaaagcctgaaactgaaacatcaagtcatgacataagaaaaatgcaggatgttaaggagtagttgccttataaggtataaaagtggtatgataatacttgccaggagttcatgtgaggggtcgacccttcggccaaaaaggataaggtggaccacaaaaaggacaaagcccttgacctactttttggaagaaatataatttggatacaatgttatgctcatgattcacattatgctatctcacatccagatttcagtgggctctgatatagcttggctgtgtccccacccaaatctcaccttgaattgtaataatccccacgtgtcaagggcagggccaggtggaaataattgaaccatgggtgcagtttcccctatactgttctcatggtggtgaataagtctcacaagatctgatgttttcataaataggagttcccctgcacaaactctcttgcctgccactgtgtaagacatgtctttttctttcttcaccttttgccatgattgtgaggcctccccagacatgtggaactgagtcattaaacctctttttctgcataaattactcagtctcgggtatgtccttattagcagtgtgaaaatgaaccaataaaggctctgtgtgtctttctcttttgaaagtatagaaaataattagagctaactttaattagtaacttactatattaggtattatcctaaacaatacaatgattatgaggttgatctgatataggcaccgttgtcatgatcattttcggatgagaaattgagatactgagagattatgcaattctccttgattcacacaggtcagaagggatgagcataatcaaacctaggcagcctaattacaagtgtacccactttatatgtactctccacttaaggcaacaaactgataagggaggtcagtatgttccaattagcatttaaaatcagcatctccctctaataaatgtctaaattatattaaatctgggagccttgtgaattgtagtggattcattgagcaaactaattaagcatggttcaccatttgctggattgattttatatcacagaaatcaacctttcaaataattatgaaacaccaaattgaatataaactaaaccaggtaataaaaacacactccgatgcttcacagtaaaattcaattattattgctttttgaaactaaaataaattgggcaaagtgtttttgtatttagtctataggaaaatttcttgtttattattcatttgtttatcttagctctgtagcttttatttatttatatgtgtcatttttttaaaaaaatattttttaccagtaaaggaagaatcattaattctaggaaattgctggaaagcaagctctttattgtattctgtactacctgattttatgacttcagatctctcctgaagcatttcgtgagttctaatataaattcaaattcaactgtgatgtattttagttctataatgaaaataaagatgagctgtctttcaatttctggagttaattatctttgttgagttcaggattatgaaaatatattgtagaatgtggagggacaagactgtgcacaagcgagggtatagctattggatagctccaacaaaacatctttcagtgagcagcaataattctccttgaaatcttcactggccctccactccgaagtaatctctcctttctctgaatgtggaaagcggtgcaggatgtatctctattagcattctatcactacttaggttatttgcttacctcttattcataatgaatgtaagcatgagtgcaggaaccttgtgcgtctattttctagaacaccattaggcctgatgtctagagcatcaggctacaaaaacattttggagtataatttatcagtgcccaccttgcatagaaaagttttgatttatcaacatagaagcagagctaagtaataaaactatcacctatgttcatgaggctcagctagtgtgatgaactctggtgatagtcattattcccctaattttcacaacctctaaggtagatacaatctccattttacagattaacaaacataagttattaattttattaattaaatttgttggttaaaactcaggctttatttaaaaaaatagtatcactatttgttgagagacacagttcccaagtcatcaattttactattctggattgcatgtctggcctttgaatttgttcagtaataattagtgttgaacctcaaagccaagctattaggctacctaaatctagcaaaaaccacctctttttaaaatataaatatatgcagaacacatttatttactttaagaggatcacaaagtctagtttcattgatacatctcatgtttctcagtattttttatttattccttaatttatggaggtaatttagaaaacttaaaaaatacatcattcaatggctttaatagattcacatagttgtacaaacattgccacattgtaattttagaacagtttttctttttttactgcaaaggaacttcatgcccattaatagtcactcttcatttactccacccacgtcccctagccctaggcaaccactaatctactttctgtctctattatgtatttgtggtctttttgactggctgttttcacttactataatcaaaaacttgtgaagtttatttaaaaacatgtatttctatacagacacacacattcattctaatgatattacccaaagaaaaccattgttgtttattgtttggccatttcatattgtggtccatttccatgtgttcaaaaataaggctgtatttgatataacagagtttttacttaattacactgaacttgagattattcaagctaatataaggcaatagtagcataggttatgatcaagtcacttacatttacctttgggatatactatgtgtagttttgacagcgtgtttgcttaaataattatgttcagctagagtaaagtcaaattatttttgaattcccctagcacatgtcaactaggactagatagagatggatgtaaagtgtcatgtcaagcagaagtcaccataagattaaagtcttattataaataatccacaatgtgaacaatccaactatagataaagaattttgactgcatgttgtataactgccttattagatgctgaaaaatgtggacattaatacttggatggaaattgttatcatgattaataacaatgagttgtggcaattttacaattaagagaatgttttggggatccatgttatataatgagggtctttgtggaactttgataaaattcattcttctagatggaattacaactgataatcataatatagctaacatgtattgagtaattacattcccaggcactgctgtaatggttttacatgcactcagtaatttaatcttcctcataacgctatgagactcagattaaagaaagtaaatttcctatagaccaccagcaagcattggtggatgtgcaaaatttcttaattccatactttcgttttcaatgtgtttttgacataggataattagattattaaaaattgttttctctagtgaagaaatgctactattcctagtaccaatagaaacccttgtttccctttgaaagaaatatggagcgcctgaggactagataaccaaggttgcctgaggaaaggatcacaataacagtaggcaattctgtcccaagaatgagtgcttcttaaaacataaaatagttttaaaaatttcttaagatagaaaatgtattctcagtcagattttttaattttgactttggttaatcctaaaatttccgggctaacaatggaaaaatgtttcttaaaattctagccaaatgttttcatttattcaacagagttagttagtttgaaattcttcttgaatgtctcagtattgctcaatcaaatggaatctaggttagactaacaaatattgttgacattgagtaagaatgccatagagtgcagagatgtggtaggagctcagattccactaatccacaatattatgagtcatttaacacaaattatcgtcatttcagcagaaagtgtttgtacttaattgaagtaagtggtcccattcaaaatctttctttattcagtctcttcaatcaccaaagcaaaacaggatatatgcatctttgaataaatatctgatttattgtgtatctgttaatttatatagaatatattaatgttaaatggcaaaaactgcaattacttttgcgtcaacctaataatagattgtttaataaataatagtgcacatatttgtgataactataaagacaaaatagctaaaactaaatcgatgatatttgacctatgtagctaaattaagcctgtgtctttcatgtttcatacataaattctgagagcacatatctagaatatgatatcataaacatcaaaaatttgaaaatcactttcgtgttagtctttagaaatagtgagaaactgtgttttagaaataattttgttaaattccattagtgcactgatataaagctaactgatagaattatttccaaatatttatgtttagtcaggatctgagctacaattcagtaatggaaaaggaatcgttggtaatatgaaaatatttatcagtgtgtatttcataatattacagtgcttttgacattgataaagtaccccttgctttactacatgttgcttatcactggtaagtagtgtgttaattagcattgcatatatatatatatacacacacattgcatatatatgtatatatacatcgtgcgtgtatgtgtgtctgtgtgtgtattgttaaagctttttttaaaaaaaaaaatttgtacagaagaagactcagacttggctcatactcctgggctcaaatgatattctcgctttggcccctcaaaatgttgggattacaggcatgagccactgtgcccagatcatcttaaagctttaaactaaataagtagcaatgataggataagctttagaaataaatctctgtagggagcattctcataatgtgttctgtcttgattaaccactaaagaattttcttaatgcatattttaagcaggaagagcagggacataggcactttatacaaaaataaattacatatatttagtacagatttttatgttgcaatcaaatcctagatagttacacagaagtaataagggtgcagttgtcagttaaaattgctagtttttttccttttatttttagttgacatgtaataattgtacatacacagttatattttaatatatgtgtatatgtgtaatgatcaaatcagagtaattacatagccatcaactcaaacatttatcatttctctgtgtgtgaacatttaaaatcctcttttctagcttttcaaaaatatacactaaattattgttaatcgtattcatgctgcagtgctacagaacacttgaatttattccttccatttagctgtaagtttgtattcattaattcacctctccctacccccactcctcccattcttcccagtctataataaccacaattctgctccctgcttccatgagctcaattttctttagctcccacataggagtgagaatttgtggtattatctttctgtgcctgacttatttcacttatataatgtcctccagcctcatccacattgctacaaataatgggatttcattttttcaggcagaatagtattctattgtgtatatgtaccacattctctttattcattcatctgctgattaacacttaggttgactccacatcttggctattgagaataatgctgcaattaaaaggggggtactgtttctcttttatatgctgatttccattcctttggataaatacccaatagtagtggagttactggactgtaggatagtcctacttttagtttttttttctcagaaacttccatactgttctccatagcagctgtactaatttacattcttgtcaacagtgtataagatttctcttttcgcttcacctttgctagcatttttttttttttgtctttctgataacagctatcctaactggggtgagatgatatctcattatggttttgatttgcattttcctgatgattagtgatgaacagcatttttccctatacttgttggccatttctttaaatagattaagaagacaaaattttaagaagatatttagagaaaatgtagaaatatagagtaaaatatttgactgtgggggacatgaataaacgtaaaatataaaaacatggtttatgaataacagataatgtaacacaatttggtgctcttttcagtaaaatatatgtctgtatccaatataatttaagtgtactatgatcctagtaaaaatatttaaagatcttatttatctcagttttctagctctctcaggaaaataatttttttttttatttttaattttaagttcaggggtgcaagttcaggtttgttacataggtaatcgtgtcatgggggtttgttgtacagattatctcatcacccaggtattaagcctagtacccactggttacttttcctgatcctctccctcctcccaccttccaccctctgaaaggccctagtgtgtgttgttttcctctatgtgtttatgtgttctcatcatttagcccccacttataagtgataacatgcaatatttggttttgctgttcctgtgttagttggctaagataatgacctccagctctatctatgtccctgcaaaggaaatgatctcagtcttttttatggctgcatagtattccatggtgtaagtgtaacacaatttttttaatccagtctatcgttgatgggaatttgggttgattccatgtctttgttactgtgaatagtgttgcaatgaacatatgcgtggatgtgtctttataatagaatgatttatattcctttgcacatgtgccaagtaatgggattgctgggtcaaatggtatttctgtttttaagggtgtaaattaattcagccattgtggaagacagtgtggtgattcctcaaagacctaaggagaaataatattcaatttcttggaaagagggagacactctgctcttcccatctatattttcccaccttgatgtttaaatagaagagggataatgaaattatataaggaagcaggtgagtttggatcccatactctcataagaacagagaaatagttacaataggtggcatttatggaatggtatctatataaacatagtatgctctttgttttacatgccttaactcataagtcagtattgctaaagagaattcagtttcatagctgttgtgtaaatgagaaaatactattctacctctattatttattaattcataaaggggaagcaattagtttatatgccagtgaattaggtttcgactggaacaagtgtaggaagattaagagcaccagaacctgaaaactaaaatggaagtagccataccaatgtgagatgtgaaagtggagataatttattttataaggtaaactgtgataattagttacttctttatatttagcaaatattaaatgatacttattagtaattatttagaatactaaatcttatttttaaatgactgggaattgtaatacaccttctagacactttgcttttatcatgtgttgattaatgggatcttattaaactaaagagcttctgcacagcaaaagaaactatcatcagagtgaacaggcaacctacagaatgggagaaaatttttgcaatctatctatctgacaaaaggcaaaatccaaaatctacaaaacttaaacaaatttaccagaaagatacaaacaaccccatcaaaaaataggcaaaggctatgaacgacacttttcaaaagaagacatttatgcaaccaacagacataggaaaaaatgctcatcatcactggtcattggagaaatgcaaatcaaaaccacaataagataccatctcacgccagttagaatggcgatcattaagaagtcaggaaacaacagatgctggagaggttgtggaaaaataggaacgcttttacactgttggtgggagtgtaaattagttcaaccattgtggaagacagtgtggcaattcctcaaggatctagaactagaaataccatttgacccagcaatcccattactaggcatatacccaaaggattataaatcattctacgataaagacacatgtacatgtatctttattgtggcactgttcacaatagcaaagacttggaatcaacccaaatgtccatcaatgatagactggattaagaaaagatggcacatatacaccatggaatactttgcagccataaaaaaggatgagttaatgtccattgcagggacatggatgaagctggaaaccatcattctcagcaaactatcacaagatcagaaaaccatctgcatgttctcactcataggtgggaggtgaacaatgagaacacatggacacaggaagggaaacatcacacaccagaacgtgtcgcgggggtaggggggtaggggaggaataacattaggagaaatacctaatgcaggtgatgggttgatgggttcagcaaaccaccagggcacgtgtacatctatgtaacaaaactgcacgttctgcacatgtaacccagaactgaaagtataattaaacaaacaaaacaaacaacaaaaaaagtgttgattaacaggccgggagcggcggctcacgcctgtaatcccagcactttgggaggccgaggcgggcggatcacaaggtcaggagatctacaccatcctggctaacacggtgaaaccccgtctctactaaaaatacaaaaaattagccgggcatggtggcaggtgcctgcagtcccagctcctagggaggctgaggcaggagaatggcgtgaacccggggtgtggagcttgcagtgagcagagatcgcaccactgcactccagcctgggcgacagagtgagattccgcctcaaaaaaaaaaaaaaaaaaaaaggtgttgattaacatctagcttattatttatatatgtgcatatatataatatgttgagcaagtagaataaaacatttctgtaagacgtgaaactgattttatattaatacttttttttctttaaaactgtttttcaaaactctgttataatgggatacttctagtaggcaatcttcaattccttaagatacttggttagaccattgtcatcatggatggaacaggcttgaagagagagttgcaatttgccttcctaacctataatggccacaacattagtatcattacttatatgtatcagtacttatcaatgaaaaatacatctatgtcatttattgtatcatatgatgtataccacatcagaatcattacttgaattaaactagtggtgattcaaccttctctgtcacctcactttttctttttatcgtgagaaatttccatgaacttattttgcaaattaagtgctttttacaatcaatgattagactattattagtaacaacttgcttgtcataagttttacaacttatcatagcacagcagcatatcaagaaatttgagcactgcaactctaggttacaaattattatcaacaaatgtagataatgtcaagagaatacgaatttaatatttaacaatgaaacatggagtgttttgatagcaaagaaactaacattctcttctgctcctaaggtgtaggcagtctacttacaagcagagaagaagcaaatttacatgactatatgtgtatatacacagacacatatacatatatgatatttgtgtctttgttgtactcattgaactgcatacaagtgctttttcttaagccaagttttcattaattaatatactagattaaattagtgaacattaccatatataagcagagaatatccagttttcaattacttgtttttattcttctactcaatcatagactgttgattatttagaagacactataaatatttcaccttggtcataataaataatgatctggtcaagtaaaaataaaaattaactgatagctaatcttgttatagtaataaacaatggacatagataaaatacatatgtgaaaaaatgaataaacaaatgatgcagtgtgtagaaatacccactacaaatttaaatcattttcgtagtgaatatatgatatatatctcatgcatgtctgttgtacctatcaattcatgaatagtgagatacagagacagatacacatgtacatttatgcagttgtagcaattgaacctgtgctgtgtgtgttctataacaatattatattaagtgaatatagtcaactcttgattttatatatatatacccttttatgatcaattttaattttaattctgggatattttgccctaagtatataatacatttctggcacactattcccacttcccaacttgcctattgtcagtcagagactacaaggcaatttagtatcaccaaagcaaaacaagattacaaaaatgaaaaatctgccatttggtattatctctatacttctccctatattagcagagaaaattgacttgatgtctattgctgactcttccagaattgtggcttcagcatagctgagtgatttcatggatatattagccagttggcttgaatattttacagcaaataagcaaaaactctcagtattagctttttcattattcattatctttatgaaatcatacactcttacattaaagtaggaacccatgttacgacacttactttactcatgaagaaactgagactcacagattagcatccatgactgactaaagtacaatttataatagcagatctgagagtagaactcatttttttcatctctatgcaattcattcaacaatcaatcagtaaatatttatagaaagtaatatgtattgggctctgggaaactcatctattattacaagaatcagaaagctaaaatgtaagcaaatatatttggaagataattacgtattaaaatatgtactatgcaggaagctaacaaggtaatttgtaaaaagtgcgattaacaggagaagttgtggtgatgcagacctactgaataatgggagacattttccctaaggagatgacatttgatgggagaaccgaaaagcaaaaagtagtcaaccacaaaaatttctgggagaggtacattctacatcaaaggaacaggaaatacaagggttcaaggttaagaaagaacatggggacttcaagaaacagaagagaaattaatataactggcatattgtgatgggggcatagtagaagatgaaaatggagaagcaggcatgagccagatctttgaagcccttcatgccctggtaaaaaatatagattttattcagtgtgaaatgggaatcctctaaagatctttaagcatacattatctgatttgaattttatagagaatgttctgactacaatttgaagaatcaattgtaggaagcaggagtgaaaaccattgctgtaatgtggatgtgaaattaagacttggactatggggttgacaatagagttggagagaagtcaagatatatgtttggatttaaaatcaataggatttcctggtcaggtggatatggagagcaagataaaaggaaatcaagggtgatttccatatttctagtctgagcaattagatagctacaatgtcagttattgagaaggaaaagactaggagaaaaacagaaatgggagagttattgatacagaattattttcacagtatgtgaagatgctaggtcaagagaaaatgtcaagtagtcagctggaagctcagagacagggaaatcttgcacaagttatacatttggtagtattgctagacaaagtcctcattaagatcaccaagggatagtctatataagtaagagaaggtgattcacgaccaatccataggtattttgtaattaaagaattagagtgtgcctatggaaagggcacacatgaaaggaaaataagaaaggatagccaaaggtgttggaggaaaccaagacgcactgaatgtttctcttcattccttttccctttattgtcctagaacaattattaaataattactgaaacatttttccacagtttgatttcagtaattattaaataattactgaaacatttttccacagtttgatttctaactctcattcctttattcctgtttattctctttaagaacctctataagaggaagttcattattcttgtccattattgtagtctcaccttcagtgcagtatctggaacatagcagacactcaagaactatttggtcaagaaacttatttccatttttgctgctgttgtttttattcctactttgtttcttttctcaggttatcctgtttcaagacctctaatggtctgatctaggtctcaggggtcccctctggcttgttttctttccctagcaggtataaaacaaattatggatgttgttagttaagagctacacttaaacagattaaaaatgaaggagaaatttagaaaagagcacaattcatgatttcactagtaaaatattattttgtttctttctaaattatgtaaattatatctaaggctgtgtacagttgctcatgcctgtaatcctggcactttgggaggccgagataggagaatcacctggggcccgagaccagttgggctgcaacatagtgagaccctgtctctacaaataaaaaattagccagacatggtggtgcatacctatagtcccagctacttgggaggctgaggtgggaggatcacttgagctcaggagtttgaggctgaagacctatgattgcacccctgcactccagccctggtggctgagagagaccttgtctctaaaaaataaaaataaaaatgaaaataaaaataaattatactcgtgctgtccgacattataaccactaggcatatgtagctattggtcacttgatatgtggctagtacaaattgtgatgggtcattgtacaaaatattccagatttgaaggcattactaacaaaaaaacctaaaatatgtcattattaattgaatattatatgctgaaaaggtaatattctggatacatttaacaattactaaaattaattgcaacttctaaaatttgtttaatgtggatactagatatttaaaatcaaatatgtagctccctttataatttattataattataataaacagtatttggatagtactgttctatacttttgatacacagagcaaggaccttagatgatttaggtacgactcagtgtattggtaggcatgtaaaatctcaggtcgtttttcaggcctatgaataaaattctgtgttttaagaagatccccacataatttgaatgcatgctgaagtttgcaaaatgctgctgtatatattgttgctgtctccaaagagcaaggtgtgattttgccttcgaacaatgacatatccaacctcatttccgatgtaattcagactaaaatctaaaaactgcaaatcctacagtgatgcacagaaaggttaatatcaagtgtgaacccagcttacaagccatagttctgcattttcaactacaagggttcatgtgccatactttggaattagtgcaagcaaaagccagctcacattgcttgtgcattttgttacctagagagatttgcatttagcaaatttagctcagctggcacttataaaaaagccattgccagaatgcctgagaaatttagtctcttgtatggtacttagagtggtcagcaggaatgttagcagacaacatctcatttttgcaattaatctgctttatcactacagtgtaatttaaaagaattttgtctagcaggagtctttttatttgctgggttgtgattttttccaggttatatgttattcccatgctaatatttgccttaataataatgtgtggactttaatataaatatgattttgcagcagcatattaattacaaatatgttgcaataacttcaagaacccaatttttgactattttatctttacatttgatttattagttttgtagattcttgatttgtttagatagggttgggagagtagagttcctttttaaaaatattaagtctatgtaaacatagtcatgccatctacttatttgcacttgaggttcagaaaaaaaatgttatgagaatttaaaattttgacttaattaatttatttgtataatattttaccttaaaaataattgaagataattgtgatatatcatatagatcacatttcaccatttaatatgattcagtacttaggcaatggaagcagaatttagaaacctctctttattggaattgaattatattaaaagaaatgaaaaataagttattaacacatttcctagaatatgcatcccttatatatttgttgttatgtagtagaggctgtcatttatcaattaccctctgtagtagacagaactaggttttaggagtcataatttttatcatttgttttgtttttcacaatacaaatgtgcaaatgtcaaactcctagaaaaatacattattcttcatatatattatatcaatgatataaaaactgagaattattagacctatgtgcaatgtagaaaagcattgaaactcatttcaaacatagcataaatgtattcaaagcattattgaggaagaatgaataatatgggtttgaaaatgtggcaaattatcccaaaaatatgtagctacttacccagctggcatcatggccacacaaacaaaacactgttcccacattgtttcacttactttccatggcaagtctcaagggcagtcatatcttcattcttatattaaagctgaatttcagaaaagccaagcaaattacccaagggcaaataggtaactgaaataaaaaatataattcatttctgtctcatttcaatgttgataatttgctcattacccatgcctcaataccagtcaaaactcaatatttctgtatctttggtgtcattttaaaatacttccagtatgtatgtataatttagtaggaaagtttgctgaattatacctatatatatgtgtgtgtgtgcatacgtcttaagatattgacagtcccaatagaataataattatttagttcatttttcataaaacattaaaatcactgccaaagtcactgatgtaaacactttgtgacataataaccactctgttccttagatgtagcagttaatgcgtgcgtattattgatcattatctagttgtaacagtaaaagtaattgtacacttgagtaattcttgtaattattattagatgtattccatgtctacacttgtaaatgtggaaagcatcaatagttcaaaagttttaatcaagggcagagagattatatctgcggctaaccctcatttccaaggcctccatctctttatattgtatctttatggattaaaagttaatgcagtttctcagtgcctgcatcaccaacaaatcacatacagtgagttgaagctggatttgtgggaacaattactgttggttgtatttattatataaatacatttgatgattcccaacagttctggagagacatggtcttaataattcaggaaaatattgggaatgcattctctaaaaacacagctaatcaatacaatatagagactaataacaaaatgaataactttttaaaaattatttccattttaattctttgttaaactgggaaaacgcacatctatgcagatcaacaactgtaaatgattttaaattgtgcaatgtggaagtgaacgttgctgagtttgcccaggacaaactgtgctgacatatgggaaatttagtttatttcagtttttacagaaaagtatcttcacagtctaaagtactggtaaaaaaaaaaaaaaaaaaaaaaagaaaaagaaaaaagaaaaaggtgactcaggaatcaacacctatatgtgataagtaggagtctcatttttactcccctactcaactttctctctgttagatgtgataatgaactgtgaaatggtcaaaatgagaggaagaaaa

SEQ ID NO: 841 - DNA, 23692 bp, Homo sapiens
tctgagcatcgattaaataaaccaccagaaactaaaacaggattctagatctcatctgcactaacattgtaagtgctttatatgttttcacccaaaatgactgaatttggaaagaatggattaaatgggattgaaagagggcaaaagataaaggatttcaaatttcatctttgcatctaaatttcaggctatttaaggacaaggtccaaaccgtcatagtagctaagggaatatctgttgaacaatgaatgcgcctgattttgtctggcagagtgaatttatgaggttgacattttaagaagtcaaaattttagctcatttcaaacagtggagcatagctaaagccttgttccttctggtagcagtccctccagattgaagtctgactttgaggtagtattgaccttttataagtccctgtgaaatgcaaggtctgatgctttgggaaagcacacagtcaaatatttttttctctttaattgataccacttaaaaattcatgcaagggctggaacattaattgccaattattttcatagaaatttttaagaaaaacgtgaaaaccaaatagaagggatataaacagtcaaagcaagaaaggaaatttggaacacccggtacggtttaggaacgtgtggagcctcagggtgagtcaagatgcacaaattaataaaataaaaaaatgaaaacaccagttttcacgcaccaaatcggcacgtccacttttgtggtggcgcttagtgttggtgacggtgcagcggcacagcccgtccgtgggtggctggtggaggtgtcggtcagctctgcgtccgtggaaagcaatttggccacgcttatcatgaacactctcttccgttgctttgacccaataattccccgtctagaaaaagaaaagtatcacaaggaaaccagaaagtcacatttatgtaactgtcatcacagtataatttacaataagggaaaagctgggaacaacccacttttgtaagagcagaggtgctaaactaaatatagtgacccaggctataagtcggcagcgtttcagagacgtagacggagccgagcactgcggtgctaagtgagaaaggcaagatgaaaagctacaaaaacggaacacttgtgaatttacgaaaatcgtatattaatatatattatatacaaaatattttatgtgtattcaacatatatttaaatagacattatatgtgtctatcctggaaggaaaatcagatgagatggtagtagcaatcccttggtgaggaggtttaatgggtaattttaaaaggtgtattattttatatgttccaaatttctaaagatatcttcttctttcataatttcagaaaataataaaggtctttccccaagaagcaatttgcccacctactgtacttgtgtcctgacaatattatcacgagactgttttaaggctgcagttcattaagcattctagacaacgcacgccctcgtcttcacccagacaggcagctcccgggatcactctgcacccagagggctcccgagccatggtggcctttcccaggacgcgctcagagccaggatgtaaaggtccctgccagctgattgtgccaactgtgcctctttaagtgcaggagcccctgaaaatcagccgaatcaatcacagagttacagcctgaggttaacactttggcacggccagatttcaaaaggggatcatgaaaatcatggctgggggactggccgcagctgggttgcttgtgctgaaacgttggccaagaggtcaccttcagaggtaggaagacaggcaaatgttctcagctgattcaacggagcagcccagtttcaaagtatgtcagagttcatagatctgcttgctgggtgttctgctgcctatgtgtgtaaatataggcagtgcagtgagacttctaagccctgaaacagaaaataggcatccacggaaatacaattccacagacaaaggctcttgtgagatcactgttgcagtttaagtccttgttggatgctcaggatggcgggcatggagggttgtctctgctctaaccgcgcgaatgtctcaactccctcgacatttcttgagcttcttcacctgaaagctggggatcacactgtcccctagagctggcgcctgtccctagagctggctgtgagcactgaatgaggaaatgtgcacatgggaggagcccggcgcctggcttgggtcccgctgatgcagtatccttccctacccgtctatgcacccccacttggtagcataatatcttacagatagagcaggagcttcatccgtgtttgttgatggtcctgatggggagggactttctccatctcactcgctcttgaatttgtcgagtccaccgggtctggaaggatcccaggcacaggtgggttctccactctgtctgttgccagctccgtggacaggtgagggcatgggtacagtgttcagtcttctcctgtccacaatggctgggttttcctctgtgattatatacaaatttgattttttttttttttttttgagatggaaactcgctctgtcgcccaggctggagtgcagcggtgtgatctcagctctctgcaacctccaccttccaggttcaagggattcttctgcctcagcctcacaagtagctgggattacaggtgtgcaccaccatgcccggctaatttttgtatttttaatagagacggggttttaccatgttgcccaggttggtcttgaactcctgacctcaagtgatcttcccgcctcagcctcccaaagtgctgggattacaggtgtgagccaccacacccagcctaaaaatttgaaatatgggaaagctagaataggaaaaccaaacatggaggttgaaaaagaaattgagacgaagttagagaaagattgaaacccgtaggttaacatttaaccatgccaatagattgtgtcgaatagactgtgactcctaagacctccctgggtcagttatgggcccctccgtgagtcgatctgctgcttgtactggagggacaagctccggggatgctctgcaattccactgcttctgttcaaccctgcctcagctacctacaacatgtacaatatttaaggactttgagcctcaactgggaaatgtgatgttaatgtaggatccatatttttgtaatacagccaagaagcagaattataaaaccagtaataaatacctgaaatgtttcctttccattttaaacaaatacatggcaccaaccagccaatgttttgatgtggagaccaagtcttttctttgagcataagttattgactggagttgagcagatatatttttcttttctttttttttctttgtaaaccatatgcattgtatattgacctcaacttacaagttgggtttctttcaaacaggtcaagaacatacaatgcttacaacacaatctgagtgaagactccttctacatttctgagagattttcccaatcttttatggtgattttatccaatcttaatttcacagtaactgtggtgagtcacttttcttactagcagatgtttcccaagcacttgacttggtttccatgaaaaaataaccctgccttcacatttgtcagattgtataacatttaattaacatgcatatttacaatagaaatatgcctgccataagcacatttttgaaaaactaaatatgaccttcggaaagcacatgagtgagaggggactggtgatggatgtgggtgcgcagcggccgcctctgcactggggcagtcccgggggacattgtacagagaagctggagggcacggggtatccatcctgagacctggatgggaggaaatgagctaagaggacacccccccaagagggtatgttaaaatccttacctgcagcacctcgagagtggccttattgaggtcactaaggtgggccccagtccattgtaactggaggcctcacaaaagggggaaatgtggacacagagacagacatgcacacagagaaggtgatgtgaagagacacggggggaaggtggctgtgtaacgaagggattggagcatgtgtctgcaaggtaaggaatccccaaaactgctggcaaaccactagacactaagagagggatgtgcaacagattctccttcacggcctcaggagggacaaaccctgctgacaccttcagcgtggacgttggcattcgagcactgagacagtaaatgtctgttaactaacacctgcctcccgccacctcccagctctccagtttcacggatttctctttagtcctcaaatctcgggtcttggacttctcttctttgggtgtcctctctgtctgtcagatctcattcaggtttgtggcttaagtaacatccataagccaatgacccagacttttatgtctctagctcagacctctctccccaaatccagacctatatgttcaattgcctcttgctaccttgcttgatgttctaataggaattttctcccccaaacccatccttccagaaaattaagggaggtgtctgggggagaatgggagccagaactcacctgtgtggaggttggtccttcagtggaaccctgcggatgctgtcactgggggtttcccctggtaatgctgcttttcagcctgctcattcccgtgtgaagccactgtctaagaagcactgcccacgtgtacagtaatccacaaaatagagaaacctggctctgaaggaaacagacagtttggggaacaaaagaaaacattggaccatctctaatattctcagagaaaattcaaggagatattgtatcttttaaataagagcatcttttagataatcaagaaacagggggtttatcccaaaacacagtgattatgggcttcagactttcaaaagaaagtgacttcctgtctagaattctacgcactggaggcagatgcccatggtgtgctctgcaaagcctgtcctgagagggtgactgcatcctaccatgacccttgcagatcattgcggaagggctttctctggccaaaggaggcaacctgtgcagttgagacaattcaggcagtcaacacttctgggagtagccctcacacagggaatgggggtttcgccgattactctggtttcctcccagcttgaatgagatgacttggagaacatgcctaccacacagtctgccagaggtcctgctgctcatagtggtaaccttcactttgaggcacatcatattggtttgctttcttttcctcacttttgcactcacctacaagagattcttcagagtacctcccatgcaaactgctggcacttacttctttgtcccagggtatttgttgggagagcccagccttagatacaagtcaaactattattaactatgcaaatagcatcaataaactgtgaatatgcaaagattcatgccccaaccctttctaaagatattacatgaagatgtactgcaacaaaataatggagaaaatcaagaagatatggatctgagaaacaggggatacaactcaggacattgagaaattgaagtcccaggataataggggtacagagcaataagtccaggagaatagagttctccaaaagggaagtccctgggaagaaaaaaataataatggtgggtgatttcattgatagtgcttttaaaatatcaaatcttaagaacatggtaaaaagaacatggtagaaacaactaatgcagaaaaacaaggcaattagaaactccagaaaaaccaaaaagctctaaaaggaaggaaatataattatagcatatgattccactttgcagcaaataatataccaagaccataatataaatatggttcattgattttctaagctttagaaccaatatagacagaattcagagaattcttaattatgattatgggatagaatgcaaatgcaatcaaacttgacaatataaagtaaaatatagagagaatctggaagaagaattggaacaggtggaagggagagatgatgaattaatggaaatacagaggatgtaacgatttcatcttgtgaagcaggaaaccatccacactatagttaacaaaacaagaagtagaattgcaattatatgataaaagtaatcaacatgggaaccaaaaataatacagtaggtatattggtcaaatgtggagagggggaagtaatacaaatgagctgcaatctcccactgtagacagccaataggtttaataccaaaaattgataaatcaataaatagtgctataacatattattaagagatacggaggtaaaaataaccagaagaactaataatggaaataattaaaatgtggaatgtgtggttggggtgcagagtgagagctctgttgcttttttactgtttgatttaaaagtcaacaatcaaatgtgttgtttttgtaacaacttaagaatgcaatttaaaatgctttgtaatttagtaacctacaaagtatcttttcctgttttcctgtgctgttaattttacagctaaatgtgcatggttttaattgcctgtcaatcgagttcactcccgccactgaccctctcttgtgatggataattgagaactgactctgttaaggaacaaagagcttaaaatagctgctgtactagtgcatggcacatcatcatgtctagataatgaactcccaataccaaatgttttcatgatggcacatcccgtgacacctgcttttcaatgacaacgaggtatctaaaagagaggaggtggctgatggtgtggctgatggcatgccccacctccttgatgtccctgctagcccctgtgctgcagcccacatgaagtgtggacccagcctcttcaagcagcaactttgcctaattaaacctgaccagaattaccctcattatagcacaactcacgataacatcccagcgaccttgttccccagaaccctgtggtgagaagcaggttcagttctatttttggcttctaacaaatgaagcatttctcccaaactgcagaaatagacaaataaaagacactggcaggaatcaatccagaaacagaggctgggaatggtcattgagaaaagtcacgtgcttttaatattgcagtatgaaactcaacaacacgataacacccagatggttctgcaatttgtgttagtgcagtgtctgaggtcattaattgggcggaaataaccatcttttaaaatcaccagtgagaagtgtttgtgaagccacagaattagctctggaagtaactccagggtttatttagccccacttcctcatttctgaattgaggcttttgaggcccacagagatggaatcgacccctgttccacaccatccccaggactgcgggtcgagtggtttgcttgaagctcacaaagttggaatcggcccctcttccacaccatccccaggactgcaggttgagtggtttgcgctgtgtcactgctgctgctccaaacttcattacttgtttaaaaattgtatcattagagagtcagactaggcataggaaaacagtttatgtatttaaacgattctctttcaagtcgtttagtgactgtttaaaatgctatggacaaaggatttttcatcccgcaacatgatgttttggagaaaaagagtgaacagcaaattggaaccacgagaatgccaaacgatacaatttttggagaagttaatgcagccaagtcaggacacacaaggcctggatgtcagatccacccctgaccaatactggccttgagcaggtgtcgatgtctgtgagccttgcctcatggccttgctgtgaggacgacatcagatgatgctgcaaggtgttcctgtggagtcctgaacttaatgggaggccccaaagcagctactgaatattggagaattccgtgtgtgtttacccagagaggccaaagcactcagcgtcgggctgcctgtaggggagtgtcattcacacagaccatggtggcctagggaagctgagcatacgggcgggcaggctttggaggatgtgcagacccagatcctaggttctcactggccaggcgctctcctgaagacacacctaggatgaggtcattaagcaggtgagataccagtgtcagagatgggcgcgtgaagactcacacctggcaccaggcagtgtatctggagtgaatgactgggcagttgctgtagctggagccaatttctattccattcctgcacgagcagagacccagtggccccttagaatagactagaaggatgtgagcaagggaagggcagacccgctactttgcccaccacctcagactgggctctgtgtgaaactgggtttcccagctctgccttcctccggagcacaatgaaggcacttttggaggaatgacttaaagatacatcagcgtccagtcatgggccagcctcccgtgcatgcagagtaactataaacaaaccgggaaataaaagaacgcccttcctggtgctgtctgtggggtgcagggccatttccgtgactctccacccctgcatattccggaaaagcctctcccactaccattttgctgtctaaaacagtagttaaagaaaaaaaaaaaaacgcaaagaagaaatatacactgattttagaaaattcagaaaacacaagagttctagaaacccacgtttcaaagagataattaactccagcaacctttcacttgtctcggtgaggtttgatcatcgaggcaatggcggctttgtgaaattattcaggaagacttccttctgcccaatgccggccagcatggatcttccgtgttccttcagagctggaagtattccacaggaaagaaacccacaacaatctctttctttttgaagcacagagaacatcgatgtattcacgtttgttctgcatttcgcctttgccacattttgcccattttcatgagctgggttctcacttcacttttaaaattagtctttatttgaagtttttattttttctttgaatagctgttaaagattttgtgcttcaaattgcataattggtttttattttaagcatctgttatttgtttcaaattttcttttattgtctctaaactgtggtacaaacacatcattctgtaaattcattaagggtttctttgaaaactagcatgtgattattttctttcaatgtttgattgttattctaagaaacagtgaagtctctgccattaggaagcagtttgctatgtagcttttaagttacagtttacttattatgtttcacaaatcctagtgtttttctctacctaatgtgccaaaggctgagaaaagcattcatctctgataactcttgatggaactttaaatttctccttgtagcctaacaatttcttagtgttatagctagcgttcgtcattgtgtattacacattttgtcagtttaaaagaccctgtttagtgggtcaaatgcttttttgtcctgcatttgactttgactgtggttaatattgatacctaggtgtggtgatcagacaaattcccaggtctccacactctcccattgtggaatcattccttctctaccctgggcagcgtctcattccagtggctgccaggagggttggtagagcctcttccctgccctgttggcttgggcttggccatgtgatgttctctgggtgctggaagctggagctgtgagtgtgctcatcttggcctcctgggctcagtccttccccacgagaaggacacactcttgcagcccttgcttccccagcctggattctagggtaagagtgtcatggggcaaatatgatctggacccacagcctggagcagagccctcagcaggtccttagaccttgggcaagagacacatgcttattactttaacttatattaaactgctagaattttaaggttctttaagcagcaataccttagcaaaaacctgattaagataccatgtttccttattacttcatagccctttgcaacagattgtctaaatatttgggtaggtttttcttgttatagaaatcaatgctcagacagtcaaagcatatttaaaagaacaccagatatagtgaatttttagatacactgtttcagatgttaaggaaatttcattagattgtaaatgaaactggtgtttaagaaaattggttagtttaacttgagttacactcataaatggaaaactgaagggtgattcccctaactttaccagatttataactagagtaacaatagttgcaaattagactttaatccataaggaaatctaggattttaaattggtaatgtgtgtgtgtgcatgtgtgcatatatgtatattatatatatatatatttacacatatatattcatatgttaaatattactttaaaccaagtagctgtaaatagtctatcccgtgcacaaaggccacacttgggtatcaacaagttgatgtgctaccattggaaagcacacagtaggcatgcatgagtcgaagtgatgaacactccaatctttgcattctttaaaatgctcttacacctttcaggtgtaagacatggaatgaatcactagttcccagcaaaattcagtgacaaatacaagattgtaataacgtaatcaaattcagacattgataccaaaataataatcactaacagatttgttttctaaaaaaaccaataatataaaagttagaacatattaaaagagatatgtcatagtcaagcatgggacgtagaagaaggaagaataattatcatgttgtgactgtttttaggaggagtaggttttttaaaataagggctttctttttaataaaactgtcattatgcaaaaatattgacaaatcctggccttcagtttcaagtacataatacaaggaaattgtatgcatgtttgtaaaatttttgtataaatctcttattggggataagcattaattaatataggaaaatacagtattttgttcaaatgattaaatgattagtataaataataaatctaaaacaaagcccttgttaatttgctaaatatccttccttgctgcacacatttctctgtagagtttgattttaacacaatgtagcaaattgacttgttttcaagagagatgggaagtagaaattggaggaggcggaacctggaagtctgtatttctggagacttccatctgcaaaggcctcagtcagcacctcatattcctgggcaccagggttctcagtttccattctaagcagggtggacattcaactcccatgaaagggaactgaattctatctattatcccttaatgattccattaaacaactcaaaaaggaaggccacaggagggaaatagcttttgtcaaatattctaacgcacagtatgtggtaagtgctaaattgggaaaactctcttggaaaaacttatccaatggttgtcaaaatcacttgtgaatttcacagtcctatatgaagttcaagagattcaatagtaatgtgatcttaaatcatctgtttttctagcacatatgctccccttctgaagttaaaatgaaaacaacagcgctggctcggatgagtgaaactgtgaagggcatgagtaggattgcgaggaataggtttagtcactcaaacgcgtctcaagtgaattctttttttttttttttgattattttattgtttttgtttttaagttccagggacgtgtgcaggatgtgcaggtttgttacatgggtaaatgggtgctatgatagttgctgcacctgtcaacccatcatcacctaagtattgagcccagtatgcattaactcttttccctaatgctctctccctcccccgccctcccctgacaggctgcagtaagtgcttttcccctccctgtgtccacgtgttctcattgtccagctcccacttataagtgagaacatgcggtatttggttttctggtcctgcgttagtttgctgaggataatggcttccagcttcatccatgtccctgctaaggacatgatctcatttcttgttatggctgtatagtatttcatagtgtataaatcattctattattaagacacatgcacacatatgctcattacagcataattcacaatagcaaagacgtggaatcgacccaaatgcccatccatgatagactggaaaaagcaaatgtggtacatatacatcgagtgaattcttaacagtaagtaccccaggagagggcatagaatcccaatttaaaccttcagttctttcctctaaagtattatttgcagggcaatcaaatagataaggtttcttatgcagtagattttgctattttccttatacttttcatattttttccatcttctctattcagatgaggacagatattgccctgttctaggcacagatgtagctgagatgaaaggacatgagcatagctgtctttggcatccacggtcctgtagtgggtgcaggaagagctgtgctgccaggagtccgcctcctccggtcctctgggggcagcattctggggagccggtgcctcgggctgcccgccaccaggaagttgccccgttgctccccacgtctcctcccgccatcatcttttctgtcctggttctcccccagtagcctgttggcccatgcagctggttgaagcatcggtgctgcaagtgcttgctggtttaggtgacgcaggtcagttttagctgcgacgagaagccaccctggacttttaaaaacgagatgctctggtgacagttgcttccagtctgagatgagttagcttctcgtttctgagatccagccacacagattttgggcacgtgaggtggccggctctgccattggcgtcatcccagtgtcccgtcactccgggctagcctgggaccacacctggtgagggctctcctctctctcctctgtctgtcagccaagctagaattgagtgcaggggaacacagccccgtagaactcaggggccttctcagaatccaggtgtggatgcttagcttcagaatcttcaggctgtgtggaagttagaccagtgatttgactgtttatttcatgtgtacatgtaatacaatttctaccactgtgcctgttagcaatgattttacttcccaggtgctgagggtaggcctggtgatgggtgagctcaatattgagcaaaagaaagataatcgtgggatacacaggaaataaagtcacaggggagaagcttgttagatgcattcttctgcaggtaacaatttttaatcctgcacaaataatttttaaactctcaacaatttgaatgcagtggagagtgaatgaaggcaggaaaaatacatagtgtgctgaatccttgtgagaaggtaccacatgggatacgatcggcagatatttggctttttacctgaggggattcccttgctgcacaggggtgggcccctaatctcaagcagaaagccgcagtcttaaggtctcaggagttggaggacaatgtccagggaaactagagtcactaaaaggagaggagaatatgtcctgaaggagcaaacacaataaggaacggccaaatctgcacctaatatatgtaaaagtgtgtggttcaccctcgaactcacacctatggggagacaaccgaggttcccagcaaaacaagtcaacaatgtcaacaacagtgacaacaggagagcagctgtgaggctgaaggagctggatggagactctggcttttgtccaccaaaagggagacagagtttagggtgtaagcccagccacgtaaagcacctggtatgaaaatggcatcaaccaccagagaagcagcagagcccggcatctctgccacgcagaactcacagcatccagtattcaaaacagatactgagcacgtgaagacacaggaaatggagcccacactcaataaagaaatcaggttgctcccagcactttgggaggccgaggcgggcggatcacgaggtcaggagatcgagaccatcctggctaacacggtgaaaccccatctctcctaaagatgcaaaaaaattttagttgggcgtggtggcgggtgcctgtagtcccagctacttgggaggctgaggcaggagaatggtgtgaacctgggaggcggagcttgcagtgagccgagatcacgccactgcactccagcctgggcgacagctccatctcaaaaacaaacaaacaaacaaacaaaaaaaatcgggttacagaaacgagacatgagaagacccagacagcagaattaacaatggtttcaaaactaccactaaaaatgaactccaggacttagaagaagatgtggtcatgatgaatgaatagttatagaatctcatccagacaaaaaaggacatttaaagaaagaataaaacaaacaccaaatcagaaatacataactgcacctatgtatgttataagcaagctaggaatagagaggaacttcttccatcggaggcagggcatctgtgaaatagacattctgcttacatttgacagtgaagcaccgacgcttgcctccaagactggaaatgggccatgatgtctgctctccctgtcccttacactgcttgattccaagttgaataaagtgacagagatcaggaagtatggaaccataggagtaggatatcaataggatagaatagggagtccagaaatagacccacagtctacttatttttgacaaaagtgctgcagaaattgaatggcattggactaatgggatatccgtatggatacaaataaaacctgaattctattccatgtcatagttaaatattaatttgatattgattgtagacctaaatttaaaagctacataatttctaggggtgaacttaggagaatacattcataacttgggagtatgtggatatttcttagaacactaagtgcaaaaaatgtaaaataaaatcatgatggatcattgttcataaaaattagtaatgttaggtcatcaaaagatatcataaagaaaatcaacaggcaggcaggagactgagagaaaatattcacgtaacacatatctgaccatagactagtatctgtccacactacataaagaatgcatacaacattacaataatagacaaacaacacaataaaaagagctatccacttgaaatgatactttacaacaatcacctgcaaatagttgcatggaaaaatgctcaacatcacaatttatcagggatatacatatcggaaaataagaaaacaacacagagacattagaatagctcaaattaaaagatttaaaaagataacaacaaataaaggaaaagatctgtagcaatgaggattctcacacaacagcccaggagggttgaagtgcacaagtctttgggaaaagcttggcagttccttataaaactaaccacacagttacctatgatgcagcaattattctgctagatgtttacccacaagaaataaaagtttattttgaaaaaagaacttgtacaaaatgttcactgtgtgaaggaacatttcaaatattcaacatgtgtttcacagcagcttttggcagaagtactccaaatgctcataaagacaatagtgaattaggccgggtgaggtggctcacgcctgtaatcccagcactttgggaggccgaggcgggtggatcaacagaggctgggagttcaagaccagcctgaccaacatggagaaacccagtctctactaaaaatacaaaaattagccaggcgtggtggctcatgcctataatcccagctactcgggaggctgagacaggagaattgcttgaacctgggaggcagaggttgtggtgagccgagatcatgccactgcactccagcctgggcaacaagagcaaaactccatctcaaaaaaaaaaaaaaaaaagaaaagaaaatagtggattaaacgaattgtgtgtattcagataatggcataacagtaaaaatgtgacaaatggtgggtgcaagtgatgacctggatgaaacggacaggcatcatgctgagcaaaggaagtcagagatagagggggcagacttcatgaatccattactccaagttctagaacaggtaaaattaatctgtggtgacaaagagggcttgctttgtggtggtgggggctgcctccaaaggcagacaagggaatttttggaggttacgtgaaggttcaatatttttatgggttacacggatgcatgcatctgtcaaacctcatcaaattgtacacttaaggtttgtacattttactgtatgtaaattgtaactaaaaagtcccctgcaaatattgaaatcaagttgcaggcttgctgttaacactttcatgggtagcatatctgaaactattctttgcatattctgggcctcagcaaatgcgtgccagtgtttctcagggttgcataagggagtttcatatatggaaacaaagactgaactattccctgtgtttttgcataggaattagagatagcagtaaattcatgattttattttcacaatgtggacatttagacatatatttgtacccatctatgtcatgtccatatctacctttctcccaattctgtctgctgagagagcataaaagctgagtcacatcagcagcagtgaacacacctggtgcccagatcttggtttctaattaccttcttccactgaaaggaaacagagctcccaaagaataggctgattccagactgaggcagagaaagcccagggcatcctgttttgccagaaagcaaagaattgccccaggacttaggagaactgttccaatcacgtattactttgtaacaaatcatctcaaaacttagttacctgaagcaacaagttattattattgcttacaattctgtgggctgcctgctaggttagtaggttctcatttgaggtctttgttaagactgtaattagttaccagctggaaggtgatttggcagtgttttattgcaaagtaatacttgcattgccttataatcttactttttgaaaaccaggaaatggatttacagcggctgaaaacacagggctttctcttactcacataaggatggacaggagtgagcagtggccactggtgtaggctgagccacccaccaacgaccccagtgggttttgtgctcatgctggctgacccatgctcactagacaggagccaggtttgcagactgcacattggagctcaaggaatagggaggggtagagatgtgccggcaagtgtgtgcccatctcttgtctagaaaataatggggttcctattaggtatggggttcctggaaagccccaacagatttcctcttccataatttggctagaacttgtttcatggaaaatcgtagctacaagagatcctggaaaatagattactggtctttaagaatttctctttaatttgaggcatggaagagagaagggagaattgggaatggcggtgaggtaaacaaaccaagggtgcatactgcaactgatgataggaaaataatcaatcaccaaatgcagtgtgcatttgggaacaggtgcaaagggtgcatatgttaagggggccttctctccagtcgctggcttcttcaactggggcttcatcaccctcagccctgtctccagctcttgctaaactggctcatgctgaagctctccagacaggctaagagggtcccaaggcccacgcatgcgactgggaaactttagcaaatgttgccacccaaagtctaacagctagaatctaactgcgcgattgcaagatagtctcatagctagactctgagattccaaggtagtctaatacctagagtgtgactgcgagatttcaaggtagcctcatagctagaatcgaactattaggcttcttgctaattatggaaatttctgcagccatcttgaatttctccccagaaaatgggttttttctatctcatagtcaggctgcaaattttccaaactttgatgctctgcttcccttataaaactgaatgcctttaatagtaccctagtcacctcttgaatgctttgctacttagaaatttcttccaccagataccctaaatcacctttctcaagttcgaagttccacaaatctctagggcagtctctttggtaaaacaagagtcatgcttgcttcagttcccaacaagttcctcatctccatctgagaccacctcagcctggaccttcttgtccatatcgctatcagcatttgggggaaagccatgcaacaagtctctaggaagtttcaaacttccccacattttcctgtcttctcctgagccctccaaactgttccaacctctgcctgttaccccgttccaaagttgcttccacattttccagtatcttttcagcagcgccctattctactggcaccaatttactgtattcgtctgttttcatgctgctgataaagacatacctgagactgggaaggaaaagaggtttaattggacttacagttccacatggctggggaggcctcagaatcatggcgagaggtgaaaggcacttcttacgtggtggcagcaagagaaaatgaggaagaatcaaaagtggaaacccctaataaacccatgagagctggtgagacttattcactatcacgagaatagcatgggaaagacccaccccatgattcaattacctccacctggatccctcccacaacatgtgggaattctgagagatacaattcaagttgagatttgggtgggaacacagccaaaccataccagagtgggtttcagccggagggcctggacccagagtctctgcttttgaccaggatcttttcactgcctttgctgagattgggaagcagcatccctctgtctatttctggaggaaagtttatacctggagtgcaataggacatgctcagagagtccatgaaatagtccagccggctgtcccttcagcatcctctggtgtctggtgatggccaagcttattttcctcagaacagtaggagcgacccaagccagagaaaatcaaccaactgagcccacagctccctcctaggcccctctggacatgggtctcatggcctctgtgatctggaaagcccagggaaaagcagtattatcttagacagggaactgttatgagagctaggagggggccctgcacccctgcagcagaggacaagcccgaagcaggggatgggtatgagaatgaggaggggcttgtacccttgcagaggagaacaagctggaagcaggggactggtttaagaacgaggagggggccctgcacccctgcagcagaggacaagctggaagcaggggacaagccagaagcaggtcctgttgcccgcagagcagagccaggagttacaggctcacaaagccacggtaagaacagcctatgcgaggctttcagtgacatgaggttgtgcagcaggagatggggggatataccactctatctgaagaagtcaggacattcagtcaccataaaatactagtccaagcattattccaaatacaaatatccaattctaagcaataaatgcttattcagaagatactgtgaccaaagtggcaggttaaatatgttaagacctaagagacggcaaggggctgactgggaggagcccaggcagatggggcgaggggctcagtgcagcagggacacgcaagtaactctcccaccacagagaagacgtgaaggacgctcactttcaaccttccttacacacaacacacaaggggctacacagatattgctgatgacacagcaagtagatgacaggtccaggtcttgagagataaattgggggcagttgtctctggtgacccccgcgacagctcccatctggcaataaatgctctctgcaaggcacagcaactcagaaggtgatcgtcctaacaagaatgacctcagggcatccagactggaggccataaatcacaggaaggtaacagcacccagaaggagctggctgggctccccaaggtctgatctggaggtggagtcagagcagctcccaccaatgctgagtggagcggtcactctggcctgtgaatgcgagcttcctacttgggagctgatgttcctgaacaccagacagcggcgtggacaccttgactgaggggcctggttgttttgccatcacgctgctgatctgagaaggtaactgtcgcccctctccaagcgtcctcacggggccatccactgtttctcacgcaaggccagagccagcagagcctgcaaggaatggaggggtcccttgactgttttctgagggtctctcacagtttctgcttggatgcctttcaggaaaatagcacgagcaggagcagctggtgagcttacacctcagggggagtgataagaacatctgagaagaacttctgtaaaataaagatggtcattgattgaaacagagagtcgtgggaccccttttctgagaaagtttcttaatggaaatagttaaaacacagaacatttgataagatcttgagggagttttatcaaaagccttttctacatctattgagataatcatgtggtttttgtcattggttctgtttatgtgattgattacatttactgatttgcatatgttgagccagccttgcatcccagggatgaagctgacttgattgtggtggataagctttttaatgtgctgctggatttggtttgccagtattttattgaggatttttgcttcgatgttcatcagggatattggcatgaaattttctttttttgttgtgtctctgccaggttttggtatcaggatgatgctggcctcataaaatgagttagggaggagtccctctttttctattgtttggaatagtttcagaaggaatggtaccagcccctctttgtacctccggtagaattcagctgtgaattcgtctggacctgggctatttttggttggtaggctattaattactgcctgaatttcagaacttgttattggtctattcagggattcgacttcttcctggtttagtcttgggagggtataagtgctaagaaatttatccatttcttctagattttctagtttatttgcgtagaggtgtttatagtattctctaatggtagtttgtatttttgtgggatcagtggtgatatcccctttatcattttttattgtgtctatttgattcttctcttttttcttctttattagtctggctggcagtctatctattttgttgatcttttcaaaaaaccagctcctggattcattgattttttgaaggggtttttgtgtctctttcttcttcagttctgctctgatcttagttatttcttgtcttctgtcagcttttaaatttgtttgctcttacttctctagttcttttaattatgatgttagggtgttgattttagatctttcctgctttctcctgtgggcatttagtgctataaatttccctctaaacactactttagctctgttccagatattctggtaccttgtgtctttgttcccattggtttcaaacaacttatttatttctgccttcattttgttatatacccagtagtcattcaggagcatgttgttcagtttccacgtagttgtgtggttttgagtgagtttcttaatcctgagttctaatttgattgcactgtggtctgagagaatgtttgttacgatttccattcttttgcatttgctgaggagtgttttacttccaattatgtggtcaattttagaataaatgtgatgtggtgctgagaagaatgtatattctcttgatttggggtggagagttctgtagatgtctattaggtccacttggtccagagctgagttcaagtcctgaatatccttgttaattttctgtctcgttgacatgtctaatattgacaatggggtgttaagtcccccactattatttgtgggagtctaagtctctttgtaggtctctaaaaacttgctttatgaatttggtgctcctgtattgggtgcatatatatttagtatagttagctcttcttgttgcattgatccctttgccattatgtaatgcccttctttgtctcttttgatcttcgttggtttaaagtctgctttatcggaggctaggattgcaaccctgcttttttttttctttgtatttgcttggtaaatcttcctccatccctttattttgagcctatgtgtgtctttgcccgtgagatgggtctcctgaatacagcacaccaatgggtcttgaccctttatccaatatgccagtctgtgtctttcaactggggtaccaaaacagaaatatagaccaatgggacagaacacaggcctcagaaataacaccacacatctacaactgtctgatctttgacaagcctgccaaaaacaagcaatggggaaaggattccctatttaataaatggtgttgggaaaactagctagccataggcagaaaactgaaactggaccccttccttacaccttatataaaaattaactcaagatggattacagatttaaatgtaagacctaaaaccataaaaactctagaagaaaacctaggtaatgccattcaggacatagccatgggcaaagacttcatgactgaaacaccaaaagcaatggcaacaaaagacaaaattgacaaatgggatctaattaaactaaagagcttctgcacagcaaaataaactatcatcagagtgaacaggcaacctacagaatgggagaaaatttttgcaatctatccatctgacaaagggctaatatccagaatctacaaggaacttaaacaaattcacaagaaaaaaaaaacaaccccatcaaaaagtgggcaaaggatatgaatagacactttttaaaagaagacatttatgcagccaacaagcatataaaaaatgcttatcatcactggtcatttgagaaatgcaaatcaaaaccacaatgagataccatctcacgccagttagaatggtgacccttaaaaagtcaggaaacaacagatgctagagaggatgtggagaaacaggaacacttttacactggtggtgggagtgtaaactagttcaaccattgtagaagacagtgtggcaattcctcaaggatctagaactagaaataccatttgacccagcaatcccattactgggtatatacccaaaggattataaatcattctattgcaaagaaacatgcacacgtatgtttattgcagcactattcacaatagcaaagacttggaaccaacccaaatgcccatcaatgacagactggataaagaaaatctgtcatatatacaccgtggaatactatgcagccataaaaaagggtgagttcatgtcctttgctgggacatggatgaagctggaaaacatcactctgagcaaactaacacaggaacagaaaaccaaacaccacatgttctcactcataagtgggagctgaacattgagaacacatggacacagggagggaaacatcacacactggggcatgtcacagggtgtgggggaaggggagggatagcattaggagaaatacctaatgtagatgacgggtcgatgggtgcagaaaccaccatggcgtaggtatacctatgtaacaaacctgcacattctgcacatgtatcccagaacttaattataataaaaaagaaaataaacaaataaaaaataaaataaagatcttgagggagaatgaaataaataaataaaacccttgtctgaagtaaatgttcctggtgacctcctccaatcctgtcataaacgcccttcccctgtagttaatgttcccgtttctcctctgggactgggaagagagaagcccggaacctctccggaggtgctaagagcctctgggaggtgcagcagggcaggaaatgggattgtgtttgcctgtcaggttggcttaggggatgga

SEQ ID NO: 842 - DNA, 12539 bp, Homo sapiens
gttctttatctgagattccacaaacaaaggaatagttggagattaaccatctcactgcacgactaacagctcaggtctcaaggatgagtagcagatttctcctgagacttggagccacaaacggaagctctcatttgtttttactaaatatgattataatagaatgtaacccaactatggtgatatagtttgggtgtgtgttacaaatctcatgttgaggtgtaatcctcaatattggaagtggggccttgtgggagatgattgaattatgggagtggtttctcatcaatggtttagcatcaaccttggtgctgtccttgcaatagtaagtgacttcttgtgtgatgtggctgtttataagtgtgtggtacctcccccctctatctcttcctcctgctctggccatgtgaagtgctggctcctccttcgccttccgccatgattgtaaatttcctgaggccaccccagaagctaagcagatgcatcatgcttcttgtacagcctgcagagccatgattcaattaaacctcttttatttatttattttactttatttttgagatgtagtcttgctctgtcaccctggctggagtgcagtggcacaaccttggctcactgcaacctccaccacctgggtttaagcaattctcctgcctcagcctcccaagtagctgggattacaggtcacgcccagttaattttttgtatttttagtagggacagggtttcaccatgttggccaggctggtcgcaaactcctgaccttgtgatccacttgccttggcctcccaaagtgctgggattacaggcgtgagccactgtgcccggctcttttctttataaattacctagtctcaggtgtttctttatagcaatgtgagaatgaactaatacatgtggtgatttctacatataatctgtttttgtctttgccaggctttatgcctaccccctttgttcttattctcctgacacactacaaaaaaacccactcacaccaaaggcattagtgagcactattaaacttattgaaaatgttgacttcagaaggtgtctgttttttcctgagttcactctcactggccatccagaggctcttttcctcacccagtcctgaaaccaacttcacttctctcagctttctttttcattgcaaattgctgcctcctttgggggacaccctgctatgggctcttgaaattatcttctagacaaacctgatccctcattgagatggaattcatgcaccaacttctacaaagacaacacttcctctatgttatcacgatacaattacagtgatcaccacgtgtgaacaatcataatattaccatgattaaaaagatttttgagttccgtatgactgaccaacaagtgcagttttggaatatgatttgtacttacgttagagaccatcttttatctatgaaaattatctactaaaatttttctaagaaacaaaaaactgggtgtgagggcgatctggctgtgacatctgtcaccccatcgatcgctagagttgattctgctgatctggctggctaggcgggtgtccccttcctctgttaccactccacctgcgtccctcccgaagctgcgtgctcagtcaaagaggatgaccatccctgatagaggaggactggtctttggtcaagggcatatgagtagctgcgctcccctgctagaacctccaaacaagctctcaagaaacaaaaaacctatttctgattatgtcagagtgttttagcttttcagggaaaagtgaatactcaataaacagataaagtaggctatgtcgttattatttttattctaggaaggagactcacattctattaggttagatattaggttagaacatttttttttttttgagacagaatctcactctttttgcccaggctggagtgcaatggtgccatcttggctcaccacaacctccgcctcccagattcaagtgattctcctgcctcagcctcctgagtagctgggactataggcatatgccaccacgccaggctaattttgtatttttagtagagatggggtttctccatgttagtcaggctggtctcgaactcctgacctcaggtgattggcccgcctcggcctcccaaactgctgggattacaggcatgagccactatgcccggctgttagaaccattttaaagaaaaacatggccaggcacagtggcttatgcctgtaatcccagcattttgggaagctgaggcaggtggatcatttgaggtcaggaatttgtaaccagcctgggcaacatggtgaaaccctgtctctactaaaaatacaaaaattaccaggccgtgatggcaggggcctgtaatcccagctacttgggaggctgaggcaagagaatcgcttgaactcgggaagcagaggttgtagtgagctgagatcgcaccactgcactccagcctaggtgacagggcgagactctgtctcaaaaaaaaaaaaaagagaaaaacataaagtcgctgttttctaataaagaggcatgagaggaactactctgccattttttagctgttgttgttgttgagtggaaactaagtcttggggtctgggttttggtcttgaatgtttgtttgcaaagtatagaagactcctgtactctaacaagtgaaaataacgtaagaatattgaacatatgctcacaaaatgatgcaattaattcacacttggtgaattgatggttagaggctaagcagagaacgtgtcatttcacttgacaaatgctgttttgtttgtagcttgattataagaaccacaaaagcatgtcatagtgtagtttgagtgaaaggatgaaaatataaatagaacatttaaaatcatcagttgttgtgcaattgtcattctttctgactgcctgatacattttgaacactcttaaggtatctggagaattccacaactatgtttagtcttagtggcttaaaaagcacaaacttagtatcttagagttttggtgatcagaagtccgaacaggtctctctgggataaagtcaaggtgacagcaggctgcattctttctggaggctctagaattggtctctttgcttttttcagcttctagaaactgcctgtattccttaggtcatggccgtgtttatcttcaaagctagtagcatagagtcttccgatctctctgccctttgcttctctgtcacctctcctcctctcccccacctgccttcctcccataaggaacccctgtgattagacaaggcacacctggataatccaagctaattttcccacctcaagttcctcagtcacatctgcaaactcctctttgccatgtaaggtagtatattaccaatttccggggtcaggacatgcatctctttgggggctgttttctgtgtaccacatcccccattcaatttcatacccagaaactcactttcccagcctcctttgcatgggctatggtcagcatgagtgaggcactcacctcacgggacaaacttaagggggcgccaaaaaatgcagtaatcaagataagtaactttttttttttttttgagacagagtcttgctctgtcacccaaggtggagtgcagtggcaccatctcggctcactgcaacctctgcctcctggattcaagtgattctcatacctcagcctgctgaggagctgggattacaggcacatgccatcacacacagttaatttttgtatttttggtagagatgggattgcaccgtgttggccaggctggtctcaaactcctgacctcaggtgatctgcctgcctttgcctcccaaagtgctgggattacaggcctaagccactgtacccagcctaagataaataaaattttaatgcaatatttcaaaaaattcaaaaaatctatgttggttaacattttaaaacaaagacagcattacagattttcccttttgactttggcttcaatgtggccaagcatggcggtatcctttgcaactaaacaaagcatgtgacccagactgaatagatgaggtgcacttgtggtaggctttaacttagagcaagcaaaagaagcaggggcctggcacacagcattcatgccagcttgtttgggatgctcatggctgagagcagaagtggaaagcatgaggcctcagagacgtgagctgcttgccagggcccttgctctgggacaatgtcagtggcttgtgggcagtaggttggtgaaactcaggttttgttcctcgtcacactgcctataaacccattctctgatcaatcaggagattctgagagttacttgttaccctttatgaaacctcttttctgcttaaataaccaatctactgttttttgtaactaccagccctgaataatgtaacttatcagtaaggaccatctgagttggttggcacaggcaagacaaagccacaggtgcagatcaatgttaaagggcatcacgctgggtccttaatcaaggaaataaagcacacatgcctcatttaaaaactcacccttgttgggcatggtggctcacgtctgtaatcccaacactttgggaggccgaggtgggtgtatcattttaggtcaggagttcgagaccagcctggccaacacggtgaaaccccgtctctactaaaaatacaaaaaattagcaggggtggtggcacacacctgtaatcctagctacttgggaggctgaggcaggagaatcgcttgagcctgggaggcggaggttgcagtgagccaagatcatgccattgcactccagcctgagcgacagagcgagactttgtctcaaaaaaactcaaaacaagaacaacaataaaaacctcatcctgttctctggaatctagaaagaaaatctttacttctcagttcctcacctggatacttcaccagttctaaattagtagcttatttagggctttgttagtaataagaagataatgactttatctttgcacattgactaacaaatcaattcctgttggaatcataggtgctggaagatgtttctgatgatatgagccttggtgctctctctctctctctgagtattctgagaggggcaaaattgtttgtgattccatatttcaggatttccaggccttatattctggctcttaatttagctgatttttctgtggagggtcaaagatggcattgcgacagtttgctccaaaattctcacgaggtatctggcttgtataactcctttctttaagatatttcttgtacagatcctttcttggagagatttcttgtctttttatccaagcctatttaattaaattgactatgtattagaatcaattacgcatttgaaaaataattttcccccaatccctcaataactctgattattattattgaatcacaaatctgtgtctagcagaaaatagcagatacaaataagcaaatgttgagattaataatgaagggagcttaagtgaagtaggctgtcagcttagttaggacagcatcctgtgacattttggcaacctcgagatctgtgaaaattagctaaaaatggctgttgggctccaggtgttagcagactcatttttactgaactgaaatcatagatttttacatgtaaaaccaggggtcctatagaagttcttctgtgctaattttttcctaccctttatttctttctaactccttcaactgtgttaccaaagtttaaagtggtttatggaaggttgacaagtaggatgatataatcaatgacagtggccaaatcaacgcccttccacactgatgtgagaaatactcttttattcctttcaagtgaaactaacacgtttatatattgggtattgacaaaatgcccaatactgtcataggtattaccagagataaaagtaaaagctccgaggcttgccttctagatacgtaaaatataattggagagtgcaaatttgtatttaagaaaaaaatacagagtaagatatgacagtgtgaaattaggtgaaaattgtggggtgctgactaccatatgtaatttaggaattcagacaaaagacagatgaatgctggccagagggaaccatctaggacagttttctttcccttccttccttccttccttccttccttccttccttctttccttccttccctccttcctccctctctccctccctccctcctttctttctttctttctttctttctttctttctttctttctttctgtcttccctccctctttcctttctttctttccttccttccttccttcttttctttcttttctttctttctttcttttctttttctcctttctttctttctttctttctttttttttttgacaacgtctcattctgtcacccaggctggagtgcaatggcacaaacttggcttattgtgccttaacctcctgggctcaagagatcctcctgcctcagcctcttatgtagctgggaccacaggcatgcaccaccatgcctgactacttttttaatttttttgtaggatggggtctcactttgttgcccaggctggtcttgaactcctgggcttacatgatctggagagagctttcttgagggtggttgcctgtgtagccttcttccccaccaggtaaaccttagaatttagaatatgaattaaagaatataaattcaagtcatatttaattgagaatatgaattaaagaataaatacgctaagaagtagcaggttctcagcttagattaagtcaggaaaagaaaaagaaaaaacacttcagatatttccagcaaagaggtatttaatatggagaattagattacaatttacattagatttaggttagatttagatttacaatagaattaaattacaattgttagacgggttggaggagtggaaaggagagtgtggttttcagaggtcaggagctacagaaacctgcttccaactgcttagataccactaaggcttcaaaaggaaagatgtgtactctccttcttccttctaaccttccacaagagcctcctgttggcagatccttggctggaaccaagccggcatgggcgtctgtgaaatgtggtctccatacttctagcccctgtgaagaatcaataggcaatatctagctcaggactggtaggacgcacgtgatgttttagaaggatttttctgctagtgaccaaagtcctatttccctaagaatgctttttcttttctcttctaacccattctgtatcccattgccactgcttttgggtttgtttttgtcttgttgatttgtatcatattaacactttatgcttgctttacatatgttggttttatttccctaactggatttttttttttcctaactagatttttaaagattgggagcaggctggatgcagtagctcacccctgtaatgccagtactttgggagtccgaggagggaggattgcttgagcccaggagtttgagaccagcctgggcaacaaagtgggacctcgtctctatttttatttttttaattaaaaaatttagaagccgaacttcacatactagcaaataataatctgtgtgcacaaagaacaagacactgttcaggatgctgaaggcagagcaatgaccaaaacaatcttaatcttactacagcttccattccagcaaggaaaactgagaataaacagcaaatgcatatgtaatatcacatggagaaagatgctctggagaaaaaaagaaagtattataaagtgatagtcaaggacagtggtgggtgtggcagggggctacttcataaataatggtcaggaaagaatgctctgataagaggagggtaggatatgagagagagggaaccatgtgtgtttctggggagaggtttccaagcagacaaatgaggaaatatggagtgaggtgggaggtcgcacagcacatttgagaaacggccagaagtccaatgaggatggaaaggagagagcaaggggaagtggtaaaaaaataagatgacagaaggggaaagaccatatgctgcttatatcttatttcttctgtatccttcctagagttggccttctttcgggaaagtagccatgtttcactccaatcttcaaacccaacacccaccatctcaagcattatcattttcccttctgtattttattttgtgtcttctctccaatgtggctctgtagctacatttattttttcttttattaaattgcaaagaccgcttgctggaatgatgtatagattggttattcctgtaggcaggttgccctagcaacgggaaaatcttacccatttcagcaaattttatcaataaagcagtctaaccagagactaatgttcacataattaaatgtctgctgtacttttcctctgttccttaaccatggtaattttcagattgttaattagccgagtgccaattgattgaatggctccacaggagtggaaactaagaaagcataataatagaatgatcctaagcatcacaggtgacagccccaaatcaccctcttgctttggtttccaagttaaccacagcaaatctttatcctttccaggaagaggcatacagtttccacgctgaacacctggaatccatttagactggccagtgtccactacctaaaaagccttgagtgctaaggaagcagtgtttggaaggagaacagagtgtatccagtcatgccaactgcagtctaagaatgatcagtgaagtggctccctgaaggggcaaagtgaaataaatgcatgccagccgggcacggtggctcacacctgtaatcccagcactttgggaggccgaggtggaaggatcactttcgcccaggagtttgaggccggcctaggcaatatagtgagactccatctctaccaaaaaacaaaacaaaacaaaacaaaacaaaacaaacaaacaaaaacccccaaaattagctggttgtggtggtgcatgactgtagtccctgctactcaggaggctgaggcaggaggatggcatgagcctggaaggttgacgctgcagtgagccgagattgagccactgcactccagcctgggtgacagagtgagactctgtcacacgcaaacacaaaatacatgccattcctttcaggttaaaacttaaggtgacctcaggttcaaatgataatagtggttacactgaatatgtggtcacatatttgttagaaaacataaacttttaagtataaccccctctataagatcatatatccaattcattcataacagagttgctcaatatgtccactttcttgcattcataaaatgcaatatgtacatttttctgatcttgtctgcatttgtgattttaaaaaaatccttcagaaaagatgatatcatgatcttctatggctataaatggcatgaatatagaatcatcttcattttcttttgggggaagttttctttgaaacacaacccaagtctttctaggttctgtgtcatgcatagatatctaatttggcatgaaggattctgtgaaatgattgttttggcttgccactcaataataatgtaacctccttattccgagggatgtagttcactacaatgggaaggggtatatataggtattggagagagactcctatctcttcacttttttttttttttttttggtacccaatttctttatgtgaaggaatggtacaaatcaaagaacttaagtggatgttttggtacaacttatagaaaaggtaaaggaaaccccaacatgcatgcactgccttggtgaccagggaagtcaccccacggctatggggaaattagcctgaggcttagctttcattatcactgtctcccagggtgtgctggtcaaagagatattccgccaagctagattcgggtgctcccatcttgcacaagttggtcatgtggtcacccaattctttgatggctttgacctgctcattcaggtaatgtgtctcaatgaagtcacacaaatgggggtcatttttgtcagtggccagtttgtgcagttccagtagtgactgattcacatttttttccaaatgtaatgcacactccatcgcattcagcccgctctcccagtcatcacagtccggtttcttgatatcctgaaggaagattcggccacctccttggttctgcagcttcatcagtttctcagcatgttccctctcctcatgagattggtgaagaaagtatttggcaaagttcttcaaagccacatcatcgcggtcaaagtagtaagacatggacaggtaaacgcaggaggcgtagagctccaggttgatctggcggttgatggcggcctttagtcctggtggtagtcctggcgcacctgtgaggtggacgcggtcgtcatggcggcgactaaggagaggcggctgcgttcgcggtggtgactgcgcagtgctggagcggcggcgggggccttggggcagtccgagggcgcggtgaggaggtgacggagggctggctatgggcagccggccggtgtgggggacgagcgccaggttctgtccaagcactgttgaagcaggaaaccccgacgactctcgtggaagaacgtccatctctctacttttaagctaagttgaagcagtctgttatcctcactgatactcacttccatcaccactattttccccactgtgaaatgactaaaataccatccaccactcctgctctgagaattaaaagataacctacacagagcctggcacataggaagcattcagtgaactttttttccttttccttctcttgtccttaaaaatatacaacatgaaattaaataggatgtagtcacactattgaaataaattttcttgtagcaaatcttatatgtcttatttatttatttatttattatttattttgagatggagttttgctcttgttgcccaggctggagtgcaatggcacaatcttggctcactgcaacctccacctcttggattcaagcgattctcctgcctcagcctcccgaatggctgggattacaggcacgctccatgacgcccggctaatttttgtatttttagtagagatggggtttcaccatattggttaggctggtcaggaacttttgatctcaggtgatctacctgcctcggcctcccgaagtgctgggattacaggcgtgagccaccgcgcctggccatctgttttatttttataaaaagaaacataaaggtaagtgaaatgtaagtgtaataaataaatgtaagtgaaaagagtgactaaaaacacaaatgccaaaagcaattccatagaaagactttaattttctatcactttatccataaaggtaccaaatatatatttcaaaagattactctccttttgataaaataactgcaaaccattgtttcatgtaaaaatattaacacatttcttggtatcatccaataactattcagtgtcattatgttttacaatttatttttataatcagattccaaataaaagatacatatattttgaaaaaataaacttaagatgatctcataccattgaaataaattatttagttactggtaaaacaagctcatatggtttggctgtgtccccactcaaatctcaccttgaattgtaataatccccacatgtcaagggcgaggccaggtggagataattgaatcatgggggcaggtttttcctgtgccgttctggtgacagtgaataagtctcaagagaactgatggttttatgaaagggagttccccaacaagctctcttgcccacttccatgtaagacacatctttgcttcccctttgccttccatcatgattgtgaggcctctccagccatgtggaactgtgagtccattaaacctctttcctttataaattaccgagtctaggttatgtctttattagtagagtgagaacagactaacacacaggtatataaaagatttttttgttacaataagttgtatctcttgtctaaaatatttataagcaaaccaaaaaaaaaaaaaaaagcttgccttagtcaatgagtcaatgttcccagagaaacagtacacacactgtattagtccattttcatgctgctgtataagatctcatgagactgactcactatcatgagaacagcacaggaaagacctgcccccatgactcaatcacctcccaatggctccctcacacaacacatgggaattcaagatgagatttgagtggggacatagccaaaccatatcacacatgcatacatatgcacacacatatacatatatacatgtgtacatacatttatctattgattgattgactggaattggcttacatgattctggagagtgacaactccaaaattggtagggcagactggtaggaaatttagctaagagaaacttctgtctttgcttttaaggcctccaactgattggatgaggcccatcacatcatgaaaggtattgtgttttactaaaagtctactgatttccatgttaaccacatccataaataccttgacagcaacatctagactagtgtttaaccaaacaactgggcaccatagcctagccaagttgacaggaaaattaactatcacaaagctcaaaacaagagatttgatattttgatagttctggttttctaatggtagtttctttt
